United States Patent 9,932,637 (GENETIC POLYMORPHISMS ASSOCIATED WITH CARDIOVASCULAR DISORDERS AND DRUG RESPONSE, METHODS OF DETECTION AND USES THEREOF) - sequence listing, part 12

SEQ ID NO: 53042 - DNA, 201 bp, Homo sapiens
tcacacaatgctacttccccatagttaatcaatattgggcatataggtacctgaatcacacatcttgaatccaaatattaatcatagcaaaaacctgaaamttttcaagtgcttattacatgccaggaagtggtctaagtattttacatatagttcatttaattatttggacactgactattagtaccccatttatacagg

SEQ ID NO: 53043 - DNA, 201 bp, Homo sapiens
aatatctgctcctcgccctcctatagtattgaaaatctctgcattgtatgttgataagtttgtatgtttgtatgtcaagaaaataatgaaccatttagttmtaatttttcaatggtatgaaaaaatctaagtgacaataaacttgtatctgtcaaaattcaaactcgttggaatataatctgtgacgtgtcctcgtatata

SEQ ID NO: 53044 - DNA, 201 bp, Homo sapiens
atagatttgataaatgaggatgtttacagctaagtgtcttaggattgagtgaatactttaaaatagatcaatgctaaagatcataaagcatatcacatatycacattacatatctaataaagagaaatagaacatgacacattttcatgtaagaatctgtttattcatagtgcccatgatgtggtagagactgcatgccat

SEQ ID NO: 53045 - DNA, 201 bp, Homo sapiens
tgtaatcccagcactttgggaggccgaggtgggtggaccacgaggtcaggagttcgagaccagtctggccaacatagtgaaaccccatctctacaaaattaaaaaaaaaaaaattagtcaggtgtggtagtgtgcacctgtaatcccagctactcgggagaaccacttgaacccaggaggtggaggttgcagggagccgag

SEQ ID NO: 53046 - DNA, 201 bp, Homo sapiens
tctctgagcatgaagctttgccatggacttcaaagatatttttccactggagttacaaacataggtgagaaaaacatagctgaagactattgtcctaaaaytgtattaactttaaggcttagtctcatgagtaaaatagtattttcctcaaaacttttattcattcctgcttatatctctataaagtagggatttctggtc

SEQ ID NO: 53047 - DNA, 201 bp, Homo sapiens
ataaatgaggatgtttacagctaagtgtcttaggattgagtgaatactttaaaatagatcaatgctaaagatcataaagcatatcacatatccacattacwtatctaataaagagaaatagaacatgacacattttcatgtaagaatctgtttattcatagtgcccatgatgtggtagagactgcatgccatttatagcgt

SEQ ID NO: 53048 - DNA, 201 bp, Homo sapiens
aaaggtaagatgaacttctcaaatgcctagaagatattaccaagtgctaatatgctatgatttattgagtaatgactatatgccacgcattgtgttaaatrcctgcatagcgttaataataggtcacaatcacatcctttactattttacctaaaataattttcatattaggctgggcatggtggctcacacctgtaatcc

SEQ ID NO: 53049 - DNA, 201 bp, Homo sapiens
agtccttgcttgccttttttttttttttttttttttttaactttacagctccatttacgaaagttcgactggtcggtgggagcggccctcacgaggggagrgtggagatactccacagcggccagtggggtacaatttgtgacgatcgctgggaagtgcgcgttggacaggtcgtctgtaggagcttgggatacccaggtg

SEQ ID NO: 53050 - DNA, 201 bp, Homo sapiens
ccacgcattgtgttaaatacctgcatagcgttaataataggtcacaatcacatcctttactattttacctaaaataattttcatattaggctgggcatggkggctcacacctgtaatcccagcactttgggatgctgaaggtgggtggatcacttgaggtcaggagttcgagatcagcctggccaacatggtgaaacccca

SEQ ID NO: 53051 - DNA, 201 bp, Homo sapiens
gcaaaatacaaaaaaaaaaaggaagaagttaataagttaataataaccatttatttgctaagaaatatataaatgtgagatatgaggtattatcagcaacktttttttttaaaaatatatagaaaagatatatatttatttttcattgtttgaaagttaagacaaatggatgaaaaaaacagtgctatgataaatatgaaa

SEQ ID NO: 53052 - DNA, 201 bp, Homo sapiens
taaatgtgagatatgaggtattatcagcaacgtttttttttaaaaatatatagaaaagatatatatttatttttcattgtttgaaagttaagacaaatggmtgaaaaaaacagtgctatgataaatatgaaacaattaggagagcagaaaattaatgttgaggtattcccctgcattggggatctttctcccaatccaact

SEQ ID NO: 53053 - DNA, 201 bp, Homo sapiens
attccacaatacatttgtcacatccatgtgtcctcagaggaaaaataaccagaataagaatcagaggctctagatgccagtatttgctctggcatgattgyatatgtgatctcagttgcttcatctacctagaacataagccctcccaggaagtcagtccacaagagtatggagtttggtcttgttcactcgtgtaggcac

SEQ ID NO: 53054 - DNA, 201 bp, Homo sapiens
cccctgcattggggatctttctcccaatccaactatccatttttgtgtgtgagggagttgacattcttataaaaccccaactgtagaacgaagtgactggyctaacaatggatctttcaccgaacgtgacccatcagaactaattcctaaagcttttaaacttagaaccatctgtaaaatgtgctgctggtcagaagcagt

SEQ ID NO: 53055 - DNA, 201 bp, Homo sapiens
ttccacaatacatttgtcacatccatgtgtcctcagaggaaaaataaccagaataagaatcagaggctctagatgccagtatttgctctggcatgattgtrtatgtgatctcagttgcttcatctacctagaacataagccctcccaggaagtcagtccacaagagtatggagtttggtcttgttcactcgtgtaggcacc

SEQ ID NO: 53056 - DNA, 201 bp, Homo sapiens
aagggggttgggtggtctcagagatatggccttgagctgctagaagccttgttaaggtttggtgattgcttcttgaagagtagataatagaaaacaaaacragtttggtgaagtctctcagtgcaggtgtttaagtggagtgtccctatcaatcatttttacagttctcattaccacattagaatttgccaatgagtggtg

SEQ ID NO: 53057 - DNA, 201 bp, Homo sapiens
gccttgctggtgctgtagacattgggagaattcccactctcagtttccttttcctggattgtacaaattctgcactgctgaaatctaaattcactgagtakacctacaaaatacaattcgaaagcatcacagtagcccgggttcacaattcatggagccattctcgcactctccaaattatgacagagccatggctttcac

SEQ ID NO: 53058 - DNA, 201 bp, Homo sapiens
caacgcaggaatgtgtcatttcctttcttcatgtaccagatgctgaaatactatgagataaagattttaggtttcaattgtaaagagagagaagtggataratcagtgctgctttctttaggacgaaaggtaaagaaaaaaaaaggcttattttaatgttttttccagaattgtttctattgattgttatgtgtgtactct

SEQ ID NO: 53059 - DNA, 201 bp, Homo sapiens
aataaatgttaaggtgaaaaataaatgttgtctttatgaaaaattaaaactgctctcagttccatattgttcataccttcatgctttttaacatgatattwtccatcctggaatgaccttaccccagattctgctcattttcaaaaccctgattcattgtcatcttttctgtattcctaccttgattacccacttccccaa

SEQ ID NO: 53060 - DNA, 201 bp, Homo sapiens
tctgtgtgtgtatgatgagatgaatgctttattgtatcagcaataatttggtttggtttttttcgataatcaaaaaatagggatttctgctaaattttccrtgagtgaaaaacatatatgttcacaagtacatatgaaatacactaaatgctttgtagtttgaaccagcaatggggttttttcatataattaagcatattt

SEQ ID NO: 53061 - DNA, 201 bp, Homo sapiens
atatatataaaatatatataaaatatatataaaataagattttatatatataaaatatatataaaaatatataaaataagattttatatatatatgaaatrtaaataagattttatatatatatgaaatgtaaataagattttatatatttgaaatataaataaaataagattatatctaaatatatataaaataagattt

SEQ ID NO: 53062 - DNA, 201 bp, Homo sapiens
gaatggcgatcattaaaattcaagaaacaacagatgctggagaggatatggagaaataggaatgcttttacactgttggtggggtgtaaattagttcaacsattgtggaagacagtgtggcagttcctcaaggatttagaaccagaaatgccatttgacccagcaatcacattactgcgtatattcccaaaggattatgaa

SEQ ID NO: 53063 - DNA, 201 bp, Homo sapiens
acctaaagaataataaaaaaaatttcaagtttgaaaaattcgtttgaaatattaaaataatgaggtgattttaaggaaaacgcgtaataccaaatgatacktgcatgatgatatgaactatgttacaggtatacatacatccaaagactcgagtttcatttaaaaaattaagggtttttttcctttattagggtgatgaga

SEQ ID NO: 53064 - DNA, 201 bp, Homo sapiens
aaattatatattatataatgtatatataaatatgtattacatgttatagatgtaattatataatgaatatttatatctatatagttattcatctattcatrtatgaatattcagcatattctatttattcagtatattcaatatttatttaatatattcaatgttccaggttgctttaggctgtagtgacataatgtggac

SEQ ID NO: 53065 - DNA, 201 bp, Homo sapiens
tcgagaacagtgttcactcttcctggacacaagctacttccattagaaactgttctttatatctcttatagcacctagccataaaatatctattaattaarttataacttaagaaccatattttagaaattaatgagtgctttatcctttatcatgtgttgattgcagagttagtgtaattactttgtgttctcttttccc

SEQ ID NO: 53066 - DNA, 201 bp, Homo sapiens
tgcgtgcatgtgtgtgtgtgtgtgtgtgtgtgtgtgtgtactcctgtgtacactgaaaaacaacattgggacgctcatccccattgcttgaataattttawtgacctttgaatctttagctcaatgtaggaataaataaattaaatgaatgcctgaatttgtaaatggcgtttgaggaaataggttataagtgacaccagc

SEQ ID NO: 53067 - DNA, 201 bp, Homo sapiens
gactttggatttccttatataagtaccttgacagatgactaacccatttttcctatgctttacaactatgatcagtaactgtaatttttttaaaggtcctsctggacccccgggtgaaaaaggagatcgaggtcccactggagaaagtggtccacgaggatttccaggtccaataggtatggtaattttagctatttaatc

SEQ ID NO: 53068 - DNA, 201 bp, Homo sapiens; identical to SEQ ID NO: 9961

SEQ ID NO: 53069 - DNA, 201 bp, Homo sapiens
ttcacaattcatggagccattctcgcactctccaaattatgacagagccatggctttcaccaaaagtttaatttctgtttgtttatacaatttataaatgmcaataaatataatagatataatttataaatgtctcgtacttcggcttcctcctgtattaacatgggaatagtcttactatttgtgcaattgtttttattt

SEQ ID NO: 53070 - DNA, 201 bp, Homo sapiens
tccattttcacattagagagatatttttgttatgaaaattacatcttttttataatataacattcctcaaacttatatttgaaaagctatcttttgtttaygtagaattacatttattagtttttatgattattagaaaatattatttttatttaatattaactaaatttttaaaaataatttttcatctctgcctttcat

SEQ ID NO: 53071 - DNA, 201 bp, Homo sapiens; identical to SEQ ID NO: 9962

SEQ ID NO: 53072 - DNA, 201 bp, Homo sapiens
tttagtttctgtttctgttttttcaccaattaaaaaataataatacacgaaatcgtttaggcacatagtctatgcttatctgtgtttatttgatttgaatstagaaaatgtctacacaaataaagaggaaacagctatccagaacacacacacacacacacatatacatgtcttctgaaatctttatatacaagataaaaa

SEQ ID NO: 53073 - DNA, 201 bp, Homo sapiens; identical to SEQ ID NO: 9963

SEQ ID NO: 53074 - DNA, 201 bp, Homo sapiens
caaaaaaagaataataaagcaacctacagaaagaagcttgagtacaagttggagactcctaagcagattcgggtcttgggtcagctattgcagatacctawctataatcttatccttgggttctatgaaacatccagtgtccttaaaatacattattattttggttttggtttaaattactttagtttctgtttctgtttt

SEQ ID NO: 53075 - DNA, 201 bp, Homo sapiens
atagattacacaaactccaaggattttacaatcgtttatcagcacactgacatttaataggaagagtaactttatgtgaagctactttttgtcctaactgwggaactgatattaaaaggcacacttgaacagtgtgagttgttcactgcctgctaatgaaggctcatgcaagtatgtatgttcacgttactaaaaaattac

SEQ ID NO: 53076 - DNA, 201 bp, Homo sapiens
tgccactgcactccggtctgggggatagagtaagaccgcaactcgaacaaaacaaaaacagatagatagatagatagatagatagatagatagatagatasatacatacatacatacatacatacatacatacaaacatacatagatagacacacacatattctcaagtctaaactatatatatcatgtatataatatatg

SEQ ID NO: 53077 - DNA, 201 bp, Homo sapiens; identical to SEQ ID NO: 9964

SEQ ID NO: 53078 - DNA, 201 bp, Homo sapiens
cagttagaaatacagagatctcctgtcttctgtgtcgctcatgctgggagctgtagactggagctgttcctgtttggccatcttggacttatcaccatttsattcaagtgttttgagaagcttaaatgtatttttagaaggaaattattttattcaatccagtgatagatacaacaataacatttccacaattttgtttta

SEQ ID NO: 53079 - DNA, 201 bp, Homo sapiens
tttgtgctgtggccttgatacatgtgatttccaaaagttctccttgggattctgaagcacaaagtagttgagaaactgctatttaatatatgatacttttkttctcccatcacctattccccatcattaggccagaaatttgaatttttaagaaataatagtatcaataatacctataatgtgtagaatgaaccctctgta

SEQ ID NO: 53080 - DNA, 201 bp, Homo sapiens; identical to SEQ ID NO: 9965

SEQ ID NO: 53081 - DNA, 201 bp, Homo sapiens; identical to SEQ ID NO: 9967

SEQ ID NO: 53082 - DNA, 201 bp, Homo sapiens; identical to SEQ ID NO: 9968

SEQ ID NO: 53083 - DNA, 201 bp, Homo sapiens
catcttttctgtattcctaccttgattacccacttccccaaaagagttaatcactcacttttgtactatgcctgtgccatatatatatatataattatatwttatataataatataaatatatttaatattatatattgccaattctatgatatataaaatatataatatataatatatttgccaactaatataatatata

SEQ ID NO: 53084 - DNA, 201 bp, Homo sapiens; identical to SEQ ID NO: 9969

SEQ ID NO: 53085 - DNA, 201 bp, Homo sapiens; identical to SEQ ID NO: 9970

SEQ ID NO: 53086 - DNA, 201 bp, Homo sapiens
agaaagatacatgagagggttccacatacatctgtctttttacgtgaaagttaaaacttatgggtaagtttaatacattgctgtatatgagagatatacamatttaactaattatggtttttttgctaaaattaaatgttatttattacagattgtgtcatagaatatagattccgtttcatttttttttaaatgctcatc

SEQ ID NO: 53087 - DNA, 201 bp, Homo sapiens; identical to SEQ ID NO: 9972

SEQ ID NO: 53088 - DNA, 201 bp, Homo sapiens
tattaaaaaattgcatagttactttagaaaattttattgtcacccagaatattttcccatatgaacattgaataaaatttatgtttgtatatgtaagtgtygatattaaaatttaccagctgattccaaaagatcaaacaagcacaacttgtagagcacagtaactttcttgtagatgtttagtgagtggataagtcagtc

SEQ ID NO: 53089 - DNA, 201 bp, Homo sapiens
ttttttttttttttttttttgagacagagtcttgctctgtcagccaggctggagtgcagtgcagtggcacaatctcggcacactgcaacctccgcctcccsggctcaagcaattctcctgcctcagcctcccgagcagctgggactgcaggcacccaccaccacgcctggctaatttttgtattcttagtagagacggggt

SEQ ID NO: 53090 - DNA, 201 bp, Homo sapiens
ataggaaaacagaaaacctcagccatgactgaatagtgataagattgtgtttaacattttcctcattgtctataattattcatgttttgtttttttttttytgagatggaatctcactctgttgcccaggctggagtgcagtggcgtgatctcggctcactgcaacctctgcctcccaggttcaagtgattctcctgcctc

SEQ ID NO: 53091 - DNA, 201 bp, Homo sapiens
gaggctcacaaaaaatgcttgaaatcatgatgatgttattgaagacaccccctcttacatcctttcaagttagaatatcctcctacatatgacctggttcktacttttgaatggcttttagaaatataagttactttttattaaagagtaatacataggataggagatagttaactctaggtttggaccaagcccttgcat

SEQ ID NO: 53092 - DNA, 201 bp, Homo sapiens
tactcgatttagcctagcattcaaaatgttggaatggaatggaataaaatgaacggaatggaatgatatgggatgggatcctgtatgcattcaaggatcasgccatgactggtttatttttacttaaatatacagctcaactcctgaagtgggaaacgaagaattgctcagttagttcaactaatgcaaatgatataactc

SEQ ID NO: 53093 - DNA, 201 bp, Homo sapiens
accatctacaactatttgatctttgacaaagccgataaaaacaagcaataggaaaaggactcccttttcaataaatggtgctgggataactgattagccayatgcagaagactgaaactgaactctttccttacaccatatacaaaaatcaactcaagatggattaaagacttaaaagtaaagcctaaaactataaaaact

SEQ ID NO: 53094 - DNA, 201 bp, Homo sapiens
aaaaaatagacaaaattagctaggtatggtggcgggcgccggtattcccagctacttgggaggctgtggcagaagaatggcgtgaacctgggaggtggagmttgcagtgagctgagatcgcaccactgcactccagcctggatgacagagcaagactccatctcaaaaaaaaaaaaaaaaaaaaagactttcccagataaa

SEQ ID NO: 53095 - DNA, 201 bp, Homo sapiens
agaatgactcgtgaggcttttatcatataaagatgcctggacatgacacacagatattctgatttcagggagtttgtgctgtggccttgatacatgtgatytccaaaagttctccttgggattctgaagcacaaagtagttgagaaactgctatttaatatatgatactttttttctcccatcacctattccccatcatta

SEQ ID NO: 53096 - DNA, 201 bp, Homo sapiens
cagtacattacctgcacctagaaatactatttctgcaccaaaaggacatgtgctttatcaatcacagagtgtaagctaacaaacatattattattattaaygtattaaaacatctaataggtccttcgtaagtacttatgtcatttttgaataaaaatcagcttttaaagtaggtgttttagggacaaagtgattattttc

SEQ ID NO: 53097 - DNA, 201 bp, Homo sapiens
gtaaacctctttaactgcatacaaatattcagtttctgtgtacagtattttcactaaaacttcatatgatttacagcaaaacttatttcccctataaaatsattatgttttattataaaacatcttccacctcgaactcttccctgttgcattctcacttaatcctgttacccagtacattacctgcacctagaaatacta

SEQ ID NO: 53098 - DNA, 201 bp, Homo sapiens; identical to SEQ ID NO: 9942

SEQ ID NO: 53099 - DNA, 201 bp, Homo sapiens
gcaaaatacagagaagtctgaaatcctatcctctgcaaaataaattgtctgccattatctactagtgcttaagaatcaaggttgctcagcattttgaaatstacacacatgatgatattatttccatcagctctgccagtagcctaagcttaaattgcaaactttgaacagcaatcttagaaagagctaggcttactgtct

SEQ ID NO: 53100 - DNA, 201 bp, Homo sapiens
tagaccatagtagtttgtacttaagtaaagcattacattaatttgtaatgtgcctattacaaataatatacagttgacccttgaacaatgcagaggttggsagcactgatcccttcacagtgaaaaatccacatataacttttgactcccccaaaacttagccactgagagcctactggtgaccagaatccttaccaataa

SEQ ID NO: 53101 - DNA, 201 bp, Homo sapiens
ctactgaactctaggataaaatattttatttcactggaatataacattttcttttatatacagttgttatgatcaccatagtaatattgggtaaaaaaaayagccattttcagttttcatttaagcatatgaaaccctggatttgtgtaagtatatagtacatactcataagtaaatctgtgtatcgcatgtgtgtgtgtg

SEQ ID NO: 53102 - DNA, 201 bp, Homo sapiens
aggcaactttgaaacaacagtaaagtttgtgatatttttacctgccttccccctacctcctcctggatgcagcaatgttttttttttttttttttttttgycttgaggtagtggtaggcagtctacattcgtagcttgggcccttgggccctggttccatgggaagcagagatgaccttcctcacaaacagttgtgtttgt

SEQ ID NO: 53103 - DNA, 201 bp, Homo sapiens
agagcacagttgattggaaagacttacgaggctacagaaagcggtagaattcaggacagaagggaatatgttatttatctctgaacagcaggagttgtagrgataaagtcaccctctggcattagtggcaaggcttacgaaagcatatctagggaagtgtgtaatctttgagtccgtatctggaggaaggtcaagtttctt

SEQ ID NO: 53104 - DNA, 201 bp, Homo sapiens
tatagttgaaacatgaagtagagagcataaggcctggtagcaaaaactgaagacagtttctttgggaaattagggtgtttaaaaaaatgaatgcagggaartttagaaagccgcatgcatgctcagggcgaaacacatgccttgaaaagaacctaaactttcaccttgggctgatctctaggattagtgcaaatctggcta

SEQ ID NO: 53105 - DNA, 201 bp, Homo sapiens
tacagctcaactcctgaagtgggaaacgaagaattgctcagttagttcaactaatgcaaatgatataactcaaagtctcacgggaaaaggaaatgacagcraagaggaaatgagatttcaagaagtctttatggaacacatgagcaacatggagaagagaatccagcatattttagacatggaagccaacctcatggacac

SEQ ID NO: 53106 - DNA, 201 bp, Homo sapiens
ttgttggttgtgttggttgctgcagattttgtgttttgtcttttatttctgtttttagtgcttggcattcaaaaacactagcttaacacaaagtaaggaamagagactccagtgatcatcaacaataaggaacacagtcttggtaaaaatcattcaggatagtcacaaaacaaaaataagcaaaagaaattaaaagaatgg

SEQ ID NO: 53107 - DNA, 201 bp, Homo sapiens
agaaactcaggagtaccagtatccagaccagcttgctgagttttcagcctctgctatttgcattttggaaactcaggagcaccagtatccagattgtcttrttgagaaaagcctatgttgttcagcccatgaaccacttcagtctcctctgcatggccatttcccatatgctatggctagggcaaaagctgactgactttg

SEQ ID NO: 53108 - DNA, 201 bp, Homo sapiens
agtccttaataagtttgaataccacattgcttgatttgcagctcaacatagaaaatctgaatggcaaaatccaagagaataccttcaaacaacaagaggtragagtttgtggactgcaaggtcacttgctggaactgaatccatccaagtctcgtctccttaggcagtacaggaaagcaaaagttgcaaaccctgtttcat

SEQ ID NO: 53109 - DNA, 201 bp, Homo sapiens
cattttgtgaaaagtaaagcaaaacataaaccaaaaaatagatagtgaaattggctgagaaagaaagttcaatggtatgggagcagaaacagaagttaaargaggagaaatttttaatgagtgattttaggctcagtggtgactttagaacattttctctgatgatgagggtgaaggcacattgcagttgattgagaaatc

SEQ ID NO: 53110 - DNA, 201 bp, Homo sapiens
gataggctgggtgcggtggctcacgcctgtaatcccagcactttgggaggccgaggtgggtggatcatgaggttaggagatcaagaccatcctggctaacwtggtgaaaccctgtctctactaaaaaatagacaaaattagctaggtatggtggcgggcgccggtattcccagctacttgggaggctgtggcagaagaatg

SEQ ID NO: 53111 - DNA, 201 bp, Homo sapiens
ttggaacaggaaataaaaggagaagtgaaagtactgaataacatcactaatgatctcagactgaaagattgggaacattctcagaccttgagaaatatcaytttaattcaaggtaaaatgtcttgtcatttctccagaaaatgatatatatattaaaatatactgatacatgcagagatttgatatttgaaatcctatggt

SEQ ID NO: 53112 - DNA, 201 bp, Homo sapiens
ccttgaaaatgggacataccagaggaatagacagaagtagagtcaaggatgtcaaaataagcaacaacaaaatgtacaaaatatacttattcatgagatawtctttatttatttatgtggttccccctcttagatttcttcgggtattatgtctcccacctgattaaaatttgtaaacaagtgcattctaaccagggatgc

SEQ ID NO: 53113 - DNA, 201 bp, Homo sapiens
tcattttttaatttcctgcatgatttaaaagatctaagtgttaaaaataactatatgtttattgtattatacacatataaacatgtaatatgggccaacamcaaagtgtgagaaatatggagtacttagaagcagaggttttaaatgttattgaagtcaagttggcatcaatttaagacagatgttataaatttaggatgt

SEQ ID NO: 53114 - DNA, 201 bp, Homo sapiens
ttactccggagtctgaggcaggagaatcacatgaacccaggaggcggaggttgtggtgagccaagatcacgccattgcactccagcctgggcaacaagagygaaactccatctcaaaaacaaaaagaaagaaagaaaaaagaaagaatatgataaaaaaactaaatagggaaaaatcttaggaaaacgaatgcatgtcaag

SEQ ID NO: 53115 - DNA, 201 bp, Homo sapiens
tattcttcctcacgctttttctaggcttttatgtttcctataagtagagttgcttttataataaaaatacaattaaatgtgtgtccaatgttgcatatgargagaaagggacattctattgagaagagtaataatgatatcttgggcctctaaaacccaaattgtaccttgaaaatgggacataccagaggaatagacaga

SEQ ID NO: 53116 - DNA, 201 bp, Homo sapiens
aatgtcaaaagttagttcctgtcagaattacattaaattcaaatggattaggttctctaaggcagcaattggcagaatgaaatttttttaaatgataactrtatgttgtctgcatgagactcactttagattcaaagacacaaacacattcaaagtgaagtgatgaaaaaggtatttcatgccaatagtaaccagaagaga

SEQ ID NO: 53117 - DNA, 201 bp, Homo sapiens
ttttttgtttgtttgtttgtttgttttgagatggagtctcgctctgtcgccaggatggagtgcagtggcaccatctcggctcactgcaacctccacctccygggttgaaatgattcttctcccacctcagcctcctgagtagctgggattacaggcacatgccaccacacccagctaatttttgttatttagtagagacgg

SEQ ID NO: 53118 - DNA, 201 bp, Homo sapiens
agaactaagaacttcatgtgacttcatttcaaatacactagtttgagaaaattaagaagcctaataatcaagtgatgacaatgaaaaaaagaataaaaacragtcccagaaaactatatatagacaatttttacttctaatgctcatagttagtaaaattatgtaaatttacagacacataaatatgtaatataatcattg

SEQ ID NO: 53119 - DNA, 201 bp, Homo sapiens
ctcccgggttgaaatgattcttctcccacctcagcctcctgagtagctgggattacaggcacatgccaccacacccagctaatttttgttatttagtagakacggggtttcaccattttgaccaggctggtctcgatcccctgacctcatgatctgcccacctcagcctcccaaagtgctgggattacaggcatgagccac

SEQ ID NO: 53120 - DNA, 201 bp, Homo sapiens
tctctgaaaaaaaaaaaaaaaaaaaaattaaccaaaggaaaaaaactgaattgtgagtttgtctaaccactatgtaaaggaaaaattcagctgaggaatawtggaagaacagatgtggaaaatgaagtcaattaaatttagaacatggtagcataggatcaggaaagaaatgaaattcttctagttctgatttaacccaac

SEQ ID NO: 53121 - DNA, 201 bp, Homo sapiens
attagtaaatgttctagtagcctaatcacataatacactgaatgataagcattactcatgactgttgaagaaaataaatgctttaaccagagtaaccaaayggaattgttcgtaagtctagatagtgacatgtatataatagacagcaaacagtataaggcagacctaaccgtagatcatatgtgaaggggagtacaacaa

SEQ ID NO: 53122 - DNA, 201 bp, Homo sapiens
ttgaaaatgtacttgatttgtagttgaacatccttgatttttagttgaacagctgtgttctgagcatcactgtgaggtacttgagaagtcagcattggagkggcttctctgatgctcttatggccccaagatgctcctgtctaaagcaggcaacatggcattctctgccatgggatcaagtgagactgggtgaacgagttc

SEQ ID NO: 53123 - DNA, 201 bp, Homo sapiens; identical to SEQ ID NO: 10107

SEQ ID NO: 53124 - DNA, 201 bp, Homo sapiens
tgaaaatgtacttgatttgtagttgaacatccttgatttttagttgaacagctgtgttctgagcatcactgtgaggtacttgagaagtcagcattggaggsgcttctctgatgctcttatggccccaagatgctcctgtctaaagcaggcaacatggcattctctgccatgggatcaagtgagactgggtgaacgagttct

SEQ ID NO: 53125 - DNA, 201 bp, Homo sapiens; identical to SEQ ID NO: 10087

SEQ ID NO: 53126 - DNA, 201 bp, Homo sapiens; identical to SEQ ID NO: 10088

SEQ ID NO: 53127 - DNA, 201 bp, Homo sapiens
ttgtgaggatcaagtaagatattgtgtgtgtgaagatgctctgtgaaatcataaagtcctttaaagatgtaaggtatgcttcgcagtgatctctctgaacyggaatagcttttccccgctggtataatgcagacatttttaatctgtaatcagaataggagtgaaagcaaaatgaaaatgcaagaagctgaataaatgtca

SEQ ID NO: 53128 - DNA, 201 bp, Homo sapiens
tgaggactcagctcagtcttaaatgaatactagtctttttccaaagcattgttgatcaaagtaaagcctgtgaggcaagggctttttttttttttcctttrtctttttttaagagacagagtcttgctctgttgcacaggttggactacagtggcacgaccatagctccctgcagctttaagctcctgggcttaaatgatc

SEQ ID NO: 53129 - DNA, 201 bp, Homo sapiens
tgacagttacatggtgtttagagctttctgtgggttcacaaattagcggtggctcacacgtgtaatcccagcgctttgggaggccaaggtgggtggatcasaaggtcaagagattgagaccatcctggccaacatggtgaaaccctgtctctaccgaaaatacaaaatttagctgggtgtggttgtgcatgcctgtagtcc

SEQ ID NO: 53130 - DNA, 201 bp, Homo sapiens
tatctgcattaactttttaatgcagaaaacaatttggaatgagacggaaaatgtgtattaaataaatttttcccctgggctcaatagtcttgaatatattratataaaaataaaacaacaaatctttggaaattacttctataattctatctagacatctatgtaacccatgaatatcactaagctttaagtgtcatcatg

SEQ ID NO: 53131 - DNA, 201 bp, Homo sapiens
tttccaagctatcaattttaattattttatatctcccaagaccaccattagttctcaacattctgtattctctgttcctttgtcatttctttatatcctcrtgtaaattattcttatgactctttgccagagttgcaattgtttcctgcccagactgtaatcctttttgcacccttgtagaatacagccttcctaaaggaa

SEQ ID NO: 53132 - DNA, 201 bp, Homo sapiens
aatttgttttttatctcattggtttacacaaggataaaattttatgaattttatactatctgcattaactttttaatgcagaaaacaatttggaatgagayggaaaatgtgtattaaataaatttttcccctgggctcaatagtcttgaatatattaatataaaaataaaacaacaaatctttggaaattacttctataat

SEQ ID NO: 53133 - DNA, 201 bp, Homo sapiens
ttttttaaatcttaatttcttatagagacaggttcttgctaagttgctcaggctcatctaaaactcctagcctcaagcaatcctcctgcctcagcctcccraagtactggaatgacaagtgtgaaccactgcacctggtttgacttagctgttgtttccactccctgcgtagagttcagtaccaaacaactaaagaataat

SEQ ID NO: 53134 - DNA, 201 bp, Homo sapiens
gactcacaatgttgtattgctcactactgaaggagatcactgctagcagcaacacaaactgtgttatcacacatttatttgctattctctttgaaagagtsagatcgctattacattgtatattgacatcagtgatattccaaggctaattcaaagtagatatcccactaatatgacttagattttttattttatagacag

SEQ ID NO: 53135 - DNA, 201 bp, Homo sapiens
tgatagttatgcaatacagtaaatttattaaaaatcagataaatatttaaaacgggaattttctagtatgtaatttatatctaataagtctgggttttttwaaagtatatgataagagaaactagagtgtgactataaagactgcttttaaagaagtattatggttgtacgccgggcgcagtggctcacgcctgtaatccc

SEQ ID NO: 53136 - DNA, 201 bp, Homo sapiens
gataatcatgccactgtatttagaatcattgttaaacagttcttatcccatctggaaagattgtaaaatgtgtatgttataatgtcagtattatatatatyttttatttatggatgctacaattgtgttcttcccctatctatgactctgcttagattggtgtgcaggccaaatctggttacttctcacgctctgatttaa

SEQ ID NO: 53137 - DNA, 201 bp, Homo sapiens
tgcatgccatttatagcgttatagttggagtagtgtaaactgctacattgtgaactataacaactgaactgaaaaagaaaagaacaaagacagaaacagtyctggacaatggaaattaaagaagagtgatttgtattcttttgatcctccggtttctctatgtcggcttctctttggttacctcaagtatcattagtatta

SEQ ID NO: 53138 - DNA, 201 bp, Homo sapiens
tggtaaattatttaaccctgcaccactggctcagatagtcatcgctcacccacaacaaatatttatttaaatttgcgcatgaatttaccaattgttctccrttctaaaagcacctcgggcatttcttctgggattattttccttctgcctgaagtatatcttttggaagttcatttagtgaaagtaaattgatcaagaaac

SEQ ID NO: 53139 - DNA, 201 bp, Homo sapiens
gccttttattatcttcccttgattatatagcaaatattggctgggtatctactatatgcacttcattgaactagatgtggggaaaggatacaaaaaataaratatagttctttttgtgctccggaatcttatgatttaaaacatatccccaaataggcataatgtaatttgagcaccttaagtagtatgaaagtactatag

SEQ ID NO: 53140 - DNA, 201 bp, Homo sapiens
aatttgttggaattgcaaattcttgagcccccaccccaaatatcagaaactctggtggtgaggcccatcagtttctttttatcaaacctttccaatgtttytgatacatgttaaagagacacaggaacatttttaaaagctgcttagtatgcacataaaatagagattatgctggaaaaggtacaaggacatatttatatg

SEQ ID NO: 53141 - DNA, 201 bp, Homo sapiens
ttgttaataaatctgcctttctttatctacaaccatcttggtaaattatttaaccctgcaccactggctcagatagtcatcgctcacccacaacaaatatktatttaaatttgcgcatgaatttaccaattgttctccgttctaaaagcacctcgggcatttcttctgggattattttccttctgcctgaagtatatcttt

SEQ ID NO: 53142 - DNA, 201 bp, Homo sapiens
ttattaccagaatagatgagaacatttggttcatcaaaaataaaaagcccaatgctgaaagagaaaaccaagcaaatgatctaaaagaaaaattaataaayattaatcgtcagaaatttaatgactggatactttaacctcactataatttgaaaaacaagttaagtaataatgatttgctatgtacctactcttactatg

SEQ ID NO: 53143 - DNA, 201 bp, Homo sapiens
tgaaacttgtttggaagaatggtgaaatcaccgatactttatgaaaagtttataggcacaatgtcccaaaggaatcagcagttgacaaaaagagaactcarttttacaaagggataagaaaatattgaagatgaaccctgcagcagctgactatccacgtcaatttgtgaggaaaaaaatacatcttgtttgtgccttaat

SEQ ID NO: 53144 - DNA, 201 bp, Homo sapiens
tactttatgaaaagtttataggcacaatgtcccaaaggaatcagcagttgacaaaaagagaactcaattttacaaagggataagaaaatattgaagatgarccctgcagcagctgactatccacgtcaatttgtgaggaaaaaaatacatcttgtttgtgccttaattgaaaagaactgagacagcagaacaacagccaac

SEQ ID NO: 53145 - DNA, 201 bp, Homo sapiens
attttactaataatggaaaagtttgcaaatcaataaatgtgattcacctcataaaactaacaacaaaaactacatgatgatctcaatagatacagcaaacrcttctgataaaattcaacacctcttcatgttaaaaactctcaatgcagtaggtgttgaaggaacatatctcaaaataataagagccatctttgaaaaacc

SEQ ID NO: 53146 - DNA, 201 bp, Homo sapiens
tgcctgtagtcccagctacttggggggctgaggcaggagaatcacttgaacctgggaggcaggggttgcagtgagccaagatcatgccactgcactccagyctgggtgacagagtgagactctgtctcaaaaaaacaaaacaaaacaaaaaaagaaatacacagtatcaaaatagaaagagaaaaagtcaaactatctgtt

SEQ ID NO: 53147 - DNA, 201 bp, Homo sapiens
cacaagattatttattttgctcaaattcaagcactggacttgtatgggctcacagcctattatttgcccccttcagccgatcgtctctggaaatgtcctgcccttaagatgtaaatcttttttagggcgtgttgaggggatagtctctttctgtgacccaggctggagtgcagtggcatgatcttgggtcactgtaatctc

SEQ ID NO: 53148 - DNA, 201 bp, Homo sapiens
taaatggcgtttgaggaaataggttataagtgacaccagcataacacttatcaaggacacaccaaaaattaatttgaaagaaagaggaagaacattggcascaaatgaaagacaggggtggcatttatcatcatccatagaggtgaaaaggactgtacgactacaaaattaaatgcctgtttctaggagggtcactggtgg

SEQ ID NO: 53149 - DNA, 201 bp, Homo sapiens
ttaagatgtaaatcttttttagggcgtgttgaggggatagtctctttctgtgacccaggctggagtgcagtggcatgatcttgggtcactgtaatctctgyctcctgtcctcaagtgatcttcccacctcagcctcccaggtagctggaactacaggcacaggtcaccacactcagctgttttttaaaattttttgtaggg

SEQ ID NO: 53150 - DNA, 201 bp, Homo sapiens
ttaatatatgatactttttttctcccatcacctattccccatcattaggccagaaatttgaatttttaagaaataatagtatcaataatacctataatgtgtagaatgaaccctctgtaccagacactctgaaaagcactttatatacctcctttacttaatccccacaaggaatctatcactctggtgttctccccatga

SEQ ID NO: 53151 - DNA, 201 bp, Homo sapiens
atggccgggtgcagtggctcatgtctgtaatcccagtactttgggaggccaaagcaagcaaatcgcttgagctcaggagttggagaccagcctaggctacrtggtgaaatcccgtctcttcaaaaaatacaaaaatatctcctcttgactctgtcccaaatacttgtctccctggctttaggagtaacacaatatgttatg

SEQ ID NO: 53152 - DNA, 201 bp, Homo sapiens
tcatctctgcctttcattctgttctttagccaaataattttctaaacaaatacttagcagaataatacaggctgttgagagatttttcatacgccaagtgaattgctcttataatatttgttgcactattttatttaatctgtcactaggtcaaagtgcatatatattggtttttaaaaatagaaaagagccatttcatat

SEQ ID NO: 53153 - DNA, 201 bp, Homo sapiens
tgcagttaaactctttaccaataggtggtgctagaaagtttaatatttattccaatagttgaagttatttggaaaatgtgctaaacatttttttgtgtttaaaaaaaaagtgctgtaaagcagtatgtacataattagtccttgcttgccttttttttttttttttttttttttaactttacagctccatttacgaaagtt

SEQ ID NO: 53154 - DNA, 201 bp, Homo sapiens
ggattttgctcttaacagctgttaaagctgcaatatttgcagttaaactctttaccaataggtggtgctagaaagtttaatatttattccaatagttgaarttatttggaaaatgtgctaaacatttttttgtgtttaaaaaaaaagtgctgtaaagcagtatgtacataattagtccttgcttgcctttttttttttttt

SEQ ID NO: 53155 - DNA, 201 bp, Homo sapiens
ccaggaggtggaggttgcagggagccgagatcatgccattgcactccagcctgggtgacagtgcgagactccgtctcaaaaaaaaaaaaaaaaaaaaaagraagaaaaagtagcctcagcttttaggtatgatgaaaaacctggatgattcctcgtttctaggaagcaaaatcactgtctagtcacttaacactttatgct

SEQ ID NO: 53156 - DNA, 201 bp, Homo sapiens
tgtcaaaattcaaactcgttggaatataatctgtgacgtgtcctcgtatatataacttacatgtaagacagattggattttgctcttaacagctgttaaarctgcaatatttgcagttaaactctttaccaataggtggtgctagaaagtttaatatttattccaatagttgaagttatttggaaaatgtgctaaacattt

SEQ ID NO: 53157 - DNA, 201 bp, Homo sapiens
cacaaaaatctttgttacagaatccaggaacctcacaacaaggaaagtctttgctatttctaaatgaaggttgtcactatagttcccttgtttcccttggkaaaagatatgaagtttgatcacctatttttgtgtttatgatattctaaaatatctgctcctcgccctcctatagtattgaaaatctctgcattgtatgtt

SEQ ID NO: 53158 - DNA, 201 bp, Homo sapiens
ctaaagaggaaaaacacaaaaatctttgttacagaatccaggaacctcacaacaaggaaagtctttgctatttctaaatgaaggttgtcactatagttccyttgtttcccttgggaaaagatatgaagtttgatcacctatttttgtgtttatgatattctaaaatatctgctcctcgccctcctatagtattgaaaatct

SEQ ID NO: 53159 - DNA, 201 bp, Homo sapiens
agatccatacatatactacaatggagtttttaaaattatttttgtagaataatattaaataatataaaaaagtacttatgatagagcattacattaaaaakttgtttccagattgtttaaaaatgtcatattttaagataataatatgataagggttgagacacgtacaccaaaatcctagagtttaagctaggatggtga

SEQ ID NO: 53160 - DNA, 201 bp, Homo sapiens
acttgtataaaaataaacatttggatatcacactagttaataaaacatgtctctaatatgtaaaggcttctcacaatccattcttggatttttctttctcsttttctttaggcaattacaggaaatgattgggccactcaggaattttactagtaaatgaaagttgaaatactataataacaaattattttcatgttttaa

SEQ ID NO: 53161 - DNA, 201 bp, Homo sapiens
ttaccaataggtggtgctagaaagtttaatatttattccaatagttgaagttatttggaaaatgtgctaaacatttttttgtgtttaaaaaaaaagtgctrtaaagcagtatgtacataattagtccttgcttgccttttttttttttttttttttttttaactttacagctccatttacgaaagttcgactggtcggtgg

SEQ ID NO: 53162 - DNA, 201 bp, Homo sapiens
aatgtgctaaacatttttttgtgtttaaaaaaaaagtgctgtaaagcagtatgtacataattagtccttgcttgccttttttttttttttttttttttttaactttacagctccatttacgaaagttcgactggtcggtgggagcggccctcacgaggggagagtggagatactccacagcggccagtggggtacaatttg

SEQ ID NO: 53163 - DNA, 201 bp, Homo sapiens
gttgctatcactgtagaaaaccctgcttcactaagatagcatgttggaaatggaagcaggcttttcagtgcttttgtggcaatttcaggatattctgcttygaaagtttaatccagaatgtatggaaatttgaagttgtctcaaacatacctttaaaggcaccaaaagcagctgtacaactgaagtacatcaactcacttt

SEQ ID NO: 53164 - DNA, 201 bp, Homo sapiens
tttttttttaaatttttttttttaattatactttaagttttagggtacatgtgcacattgtgcaggttagttacatatgtatacatgtgccatgctggtgygctgcacccactaactcgtcatgtagcattaggtatatctcccaatgctatccctgttaaatattttttaaaagatggcattaagaaggggtcaggagag

SEQ ID NO: 53165 - DNA, 201 bp, Homo sapiens
aaaattcaggcataaattgagtgtctgtcctgcttgcccccctcccctgggattcattgctatgtagtgttgaatggatgcagctgcgttcatggttatgraagttaccataactccattttcttgggaagtactacattcttctgcagggaatagggggcacatagagattccctttgatacagaaatcttacatttctt

SEQ ID NO: 53166 - DNA, 201 bp, Homo sapiens
agcatgttggaaatggaagcaggcttttcagtgcttttgtggcaatttcaggatattctgcttcgaaagtttaatccagaatgtatggaaatttgaagttstctcaaacatacctttaaaggcaccaaaagcagctgtacaactgaagtacatcaactcactttcgactctaaagcctgccatcagatgcagcttgtcact

SEQ ID NO: 53167 - DNA, 201 bp, Homo sapiens
agattggatgtagtggatgagaaaaggcgaggaaaagaagacctctaggtttgcaccatattagaattctaagcaggggtgttgttaggcagtgcatataygggtttgtagttgagagacgagctatgggcaagagataaagacttaagagtcatcagccttctagattatatttaaagcaatgaggctagtgagatcacc

SEQ ID NO: 53168 - DNA, 201 bp, Homo sapiens
taaacataaatgccatttaaaagttattcttagctgtcttttctttgcttttttattaccacttttacataccataatcaattttctatgtgaaattttcaaaaaaaaaatgtaagggtaaacagaaggcaatcaaaaaatgcacctctatacctctgaactatcccttaatgaatgggagtaaatataatctcaaagata

SEQ ID NO: 53169 - DNA, 201 bp, Homo sapiens
agtttggcttcttacaatagttcattttcccagataattgtttatttattttgctttgcctctacctgagaaaggagaagatttgggttctatgcctaccycccttcattccctttctccacagtggtcagatccattaaagaacagagtccttggtcagatcaacatagcattcatgaaaaccaactctcagaaaggagg

SEQ ID NO: 53170 - DNA, 201 bp, Homo sapiens
agaaaaaagaaagaccaaagggatgtagaaaatgaagaataaccattaatatctaagggccaaacacattccacctaaattatctaaatagtttcaaatcaaaactttccattttttcaaaacgtatagaccatagtagtttgtacttaagtaaagcattacattaatttgtaatgtgcctattacaaataatatacagtt

SEQ ID NO: 53171 - DNA, 201 bp, Homo sapiens
aaaaagcattagtacatagttccaattgccttaaactatagggttttcgtttttcttttttttttttaaattatactttaagttctgggatacatgtgcaraatgtgcaggtttgttacataggtatacacatgccatggtggtttggtgcacccatcaacccatcatttacattaggtatttctcttaatgctatccctc

SEQ ID NO: 53172 - DNA, 201 bp, Homo sapiens
tcacaacattatagttgaaacatgaagtagagagcataaggcctggtagcaaaaactgaagacagtttctttgggaaattagggtgtttaaaaaaatgaaygcagggaagtttagaaagccgcatgcatgctcagggcgaaacacatgccttgaaaagaacctaaactttcaccttgggctgatctctaggattagtgcaa

SEQ ID NO: 53173 - DNA, 201 bp, Homo sapiens
gataaaatgtctgcccatgtgctctaataagagataggctgggaataagatacatttttatgtgcatactaagcagtttaacaacaacaacaaaaaagttmctaaagaccaggccaaagttcctctgctacagggcagtctaaggaagtattccaagacagagcaaaaattccactaagaaagaaataatgaaaacaataa

SEQ ID NO: 53174 - DNA, 201 bp, Homo sapiens
ggtgggtggatcatgaggttaggagatcaagaccatcctggctaacttggtgaaaccctgtctctactaaaaaatagacaaaattagctaggtatggtggygggcgccggtattcccagctacttgggaggctgtggcagaagaatggcgtgaacctgggaggtggagcttgcagtgagctgagatcgcaccactgcactc

SEQ ID NO: 53175 - DNA, 201 bp, Homo sapiens
aatctagaataaggttttgtttgggagaaggcacagttagagcaataaaagctggtaagtctctctgcttcagtatagtgtcattgaagaggcaaatctasacgcacattcatttattttcgaaggtcctacactctgaccatcttgatcctctcacctaagcttgtctagtctagtccagctcaagagagtgtaatattc

SEQ ID NO: 53176 - DNA, 201 bp, Homo sapiens
aggtggagcttgcagtgagctgagatcgcaccactgcactccagcctggatgacagagcaagactccatctcaaaaaaaaaaaaaaaaaaaaagactttcycagataaacaaaagctgaggaagtttattgccagtatgtcctgccctcgccctctgagatatgttaaagggactccttcaggttgaaatgaaaaaacact

SEQ ID NO: 53177 - DNA, 201 bp, Homo sapiens; identical to SEQ ID NO: 10090

SEQ ID NO: 53178 - DNA, 201 bp, Homo sapiens
atataatcaaatgtttgagtatgcctgatttttcatagcatgcatgcatgataaatatattatgtttggatatatttgacttgtataaaaataaacatttrgatatcacactagttaataaaacatgtctctaatatgtaaaggcttctcacaatccattcttggatttttctttctcgttttctttaggcaattacagga

SEQ ID NO: 53179 - DNA, 201 bp, Homo sapiens
aagagttcactcactgtgatttgccttcccatgcagatttcccaaggggagaaagtggccttgtcaagcagattcaaatattccagtttttaaggcaattrcatttctcattgtaaattgaattgacatttagtcccaagattctgtttaacattagtctgcctctaagagatagatctgctcactgagctgacaagatca

SEQ ID NO: 53180 - DNA, 201 bp, Homo sapiens
caactaggatgtgaattttgagtatcctatctaaaactcaaacaacgataggaaaaatccatttgttttttcatttgatttttactgaggactcagctcartcttaaatgaatactagtctttttccaaagcattgttgatcaaagtaaagcctgtgaggcaagggctttttttttttttcctttatctttttttaagaga

SEQ ID NO: 53181 - DNA, 201 bp, Homo sapiens
tttaaaagaaatacaatgttatgagcagagttgaagtaccagtatgtctacctgtcttcctttccagggtaaacctttatcctggagtttgtttccttccrttcatgtttttgtgcatttactacatatgtatgtactattcttatgtcccagttctttcctaaagaaaggattgaaacttctctgaaactagctaactca

SEQ ID NO: 53182 - DNA, 201 bp, Homo sapiens
gatagatagatagatacatacatacatacatacatacatacatacatacaaacatacatagatagacacacacatattctcaagtctaaactatatatatmatgtatataatatatgtaatttctaatgagataaataattatatgaatcagtgcactacaatatattttaatttcattcttaagtggtacttgggttttt

SEQ ID NO: 53183 - DNA, 201 bp, Homo sapiens
agggacaccttatctctaaagaaaaacttttaaaaatttttaaaagaaatacaatgttatgagcagagttgaagtaccagtatgtctacctgtcttccttwccagggtaaacctttatcctggagtttgtttccttccgttcatgtttttgtgcatttactacatatgtatgtactattcttatgtcccagttctttccta

SEQ ID NO: 53184 - DNA, 201 bp, Homo sapiens
tttcaaaaataaagaaaagaaataatatttataataaatagctaatacacagtcatgtgtaccacttggacctttgaaatgttcacatttaccatcttgaytacaagtatttgttttttaagagatataattttggctgggtgcagtggctcatacctgtaatcacatcaccttgggaggccaaggcaggaggatcacttg

SEQ ID NO: 53185 - DNA, 201 bp, Homo sapiens
gacatgacacacagatattctgatttcagggagtttgtgctgtggccttgatacatgtgatttccaaaagttctccttgggattctgaagcacaaagtagwtgagaaactgctatttaatatatgatactttttttctcccatcacctattccccatcattaggccagaaatttgaatttttaagaaataatagtatcaat

SEQ ID NO: 53186 - DNA, 201 bp, Homo sapiens
agacagggtctcactttttcacctaggctggagtgcagtggtgcgatcatagcccattgcagcctcaacctcttgggctcaagcaattctcctacctcagyctcgtaagtatcttgggttacagggacatgctaccatgactggctaatttttgtagtttttgtagagccagggtttctccatgttgcccaggctggtctc

SEQ ID NO: 53187 - DNA, 201 bp, Homo sapiens
ggaaaggtgagcagagattaagcatgaccttatttattccacaagtcacttgacaagagtattcccaggaaatcctctatcattctcgtctactatgtttrtaattctaccagggattcccaaactttttctgtaaagaaacagcaaatatttgcataaatgcaccaagattattaaaatatcttttatggaatggactta

SEQ ID NO: 53188 - DNA, 201 bp, Homo sapiens
gaccaacatggcgaaaccctgtctctactaaaatacaaaaaattagccgggtgtgatggcacacgcctgtagaacctgggaggcagaggttgcagtgagckgagatcacaccactgcactccaccctggtgagacagcgagactccatctccaaaaaaaaaggaaagctcaatctgctgtaaattatgtgcttgtttcaac

SEQ ID NO: 53189 - DNA, 201 bp, Homo sapiens
catgctaattggggtaaaacaaatagattatattatacaactctttcaatctcattatccatttgtcttttgtttttgtgatgaatactattttctaaaawttccacaaagaaaattgttcaattttcaagtcaatttctatccactaagggaaaatcaagcttatgaatagaaacaattacaacctccttccttactaaa

SEQ ID NO: 53190 - DNA, 201 bp, Homo sapiens
aaaaaaatcattgagtcacagtaatttcactgaggactctgaagacattgctttactgttatttcagcattaaaggggaagtggaaaatttgctttttccytctttaatacgtgacttgatttttcaactgggtatcctatagaattgctacttttatagttaattaccatgaccagtaattaactatattgatcttcatt

SEQ ID NO: 53191 - DNA, 201 bp, Homo sapiens
tcttcattgacattcattgtttattcaatacttcctctgcaaaatgaccattataaattatagatttctatttttagtttcaaaagactgaatgttttgamcatttgatttgttctattgttttacttcttagggatactaattatctctatgttgtatgtagttttaactccctgctcttcactcatttattttggccag

SEQ ID NO: 53192 - DNA, 201 bp, Homo sapiens
ccatttgatttgttctattgttttacttcttagggatactaattatctctatgttgtatgtagttttaactccctgctcttcactcatttattttggccarattcttctccctgtgattaactgtgctatctgtggaatgtcttcatatttctcctcttttctagaataggcttgatttttaaatcattttctcactgatt

SEQ ID NO: 53193 - DNA, 201 bp, Homo sapiens
gccagagcaatcaggcaagataaggaaatatagggcatctactttgggaggctgcagtgggaagatcacctgaggtaaggagttccagaccagcctggccmaatggcaaaacccgtctgtactaaaaatacaaaaatcagccagtgtggtggtgggtgcctgtagtcccagctacttggggggctgaggcaggagaatcac

SEQ ID NO: 53194 - DNA, 201 bp, Homo sapiens
tagggccttgtaaataatttgaaatatcacaatattgagttcagaatggagcttcctaagtaataactattattattgttaacattatacaatgttattawacatttcaatatctgtccattctattatattttaattaccttgtgatgatctgtctccagttaaagcaaacattgtgaattgccctgattaaaaacaaat

SEQ ID NO: 53195 - DNA, 201 bp, Homo sapiens
tgtgaagatagatgatatacatccaggtacatgtgtaggggaggattgctattttatttatatcctgcagaggatgtgtatgtgtgtgtgtgtgtgtatgyacgcacatgtgtgtatatgtgtgtgtgttttgggggattagtaaatgttctagtagcctaatcacataatacactgaatgataagcattactcatgactg

SEQ ID NO: 53196 - DNA, 201 bp, Homo sapiens
agtggtccacgaggatttccaggtccaataggtatggtaattttagctatttaatcatatactgtgaagatagatgatatacatccaggtacatgtgtagrggaggattgctattttatttatatcctgcagaggatgtgtatgtgtgtgtgtgtgtgtatgcacgcacatgtgtgtatatgtgtgtgtgttttgggggat

SEQ ID NO: 53197 - DNA, 201 bp, Homo sapiens
aaggctgaggcgggagaatcacttgagccctgggggttgagactgcagcgagcagagatagcaatactgcgctctggcctgaaacatggcaagatcatgtaaaaaaaaaaaaaaaaaaaaagaagagttgagggtaaagataactaatcatgagaaggaccatttattttatgtcgaataatgaaaagttttcactttttt

SEQ ID NO: 53198 - DNA, 201 bp, Homo sapiens
tggcttttttttgaagaaaaggtttttagtgaatatcagagacccacatttacctggcttactccagaactacaatatgtgactttttcacagcaaacacygcatctctgaaaacttattttcctcctaatattttaatgattcctttcctgaatcctcatagtagccatctcaaatttaattattgcattcttttcaatg

SEQ ID NO: 53199 - DNA, 201 bp, Homo sapiens
tttttttttttttaagatggagtttcactcttgtcgcccaggctagagtgcaatggctcaatctcagctcactgcaacctccacgattctcctgcctcagyctcccaagtaagtgggattactaggtaatttttgtattttaagtagagatggggtttcaccatgttggccaggctggtctggaactcctgacctcaagtg

SEQ ID NO: 53200 - DNA, 201 bp, Homo sapiens
ttcacattgtcccatatttcttggaggctttgttcatttctttttattcttttttctctaaacttctcttctcacttcatttcattcatttgatcttcaawcactgaaaccttttcttccagttgatcgaattggctactgaagcttgtgcattcgtcacgtagttctcgtggtgtggttttcagctccatcgggtccttt

SEQ ID NO: 53201 - DNA, 201 bp, Homo sapiens
cagcaatggcaggcgcccctcccccagcctcactgccaccttgcagtttgatctcagactattgtgctagcaacgagcaaggctccatgggtgtgggaccmtctgagccaggcgcgggatataatctcctggtgtgctgtttgctaagaccattggaaaaacacagtattagtgtgggagtgacctgattttccaggtgcc

SEQ ID NO: 53202 - DNA, 201 bp, Homo sapiens
aggcgcccctcccccagcctcactgccaccttgcagtttgatctcagactattgtgctagcaacgagcaaggctccatgggtgtgggaccctctgagccakgcgcgggatataatctcctggtgtgctgtttgctaagaccattggaaaaacacagtattagtgtgggagtgacctgattttccaggtgccgtctgtcaca

SEQ ID NO: 53203 - DNA, 201 bp, Homo sapiens
gctaccggctacatgcctctccagcctcttctttttgaacctcctttgtacctgtttagagaaaaagcataaatagtgtactaccaacctaactaaggttrttatagtctgtttgtttaaaataccatttttttctccttttgtctttttcccactctcgaaggtactcaagaaaattgaacagatgtaatagatcaaatt

SEQ ID NO: 53204 - DNA, 201 bp, Homo sapiens
aggttattatagtctgtttgtttaaaataccatttttttctccttttgtctttttcccactctcgaaggtactcaagaaaattgaacagatgtaatagatsaaattaaaacattttatttcctgaaagccttttttgcctgttgtaatgtgcaggacccctctcctttaatgggagagacaggaagttacctgaatctagg

SEQ ID NO: 53205 - DNA, 201 bp, Homo sapiens
atatataatatatttgccaactaatataatatataatatattaacataatataaattacatataattatacatatatttatattatatattatataattgscaaatatatatggtattacatataatataattgggaaatatatatttataatatatgttatattaatatgataatatatttattatattatatattatat

SEQ ID NO: 53206 - DNA, 201 bp, Homo sapiens
ggactccttcaggttgaaatgaaaaaacactagacattaaactaatgtcatatgaagaaataaagatcttcagtaatggtaagtacatgagaaaatataaragctagtattgttgtattttgtgtttataatttcattttttaatttcctgcatgatttaaaagatctaagtgttaaaaataactatatgtttattgtatt

SEQ ID NO: 53207 - DNA, 201 bp, Homo sapiens
ctgagatcgcaccactgcactccagcctggatgacagagcaagactccatctcaaaaaaaaaaaaaaaaaaaaagactttcccagataaacaaaagctgargaagtttattgccagtatgtcctgccctcgccctctgagatatgttaaagggactccttcaggttgaaatgaaaaaacactagacattaaactaatgtca

SEQ ID NO: 53208 - DNA, 201 bp, Homo sapiens
tcaaaactttccattttttcaaaacgtatagaccatagtagtttgtacttaagtaaagcattacattaatttgtaatgtgcctattacaaataatatacarttgacccttgaacaatgcagaggttgggagcactgatcccttcacagtgaaaaatccacatataacttttgactcccccaaaacttagccactgagagcc

SEQ ID NO: 53209 - DNA, 201 bp, Homo sapiens
actttcatatttgataattatgtatgtaacaaaggctgtgaatgctcacttatgttttacaggaaatcagtaaattagaggagcgtgtttacaatgtatcrgcagaaattatggctatgaaagaagaacaagtgcatttggaacaggaaataaaaggagaagtgaaagtactgaataacatcactaatgatctcagactga

SEQ ID NO: 53210 - DNA, 201 bp, Homo sapiens
taaaacaattttaattatggaagaagacaacactttctaacagtaggctgggcttttttgttttattagatcctaaaaacagcccttcccttcaagagaarctgaagtccttcaaagctgcactgattgccctttacctcctcgtgtttgcagttctcatccctctcattggaatagtggcaggtaacgtaacccagagtt

SEQ ID NO: 53211 - DNA, 201 bp, Homo sapiens
tataaagtctacagtgtttcacattcactcaccgctcactcactgactcacccagagcaacttccagtcctgcaagtttcatttatccaattgccctgtayaggtgcagaacttcgtatcttttataccatatttttactgcatttctctatgtgtagatatgttagaaacacacatacttgccattgtgttccaactgcc

SEQ ID NO: 53212 - DNA, 201 bp, Homo sapiens
gtttacatcacaggtttgatgaaaattggcgatttgaaagacagcccccgcagaagataatggaaagtttggtgaacctgtgagtgatcatagtagttctrattgttaaaactttgtctcctggatagtcaggaagaataggaaccaaaacttggagaaaatttaaagaccaagtgcaggactgcctacaaaggtaaaata

SEQ ID NO: 53213 - DNA, 201 bp, Homo sapiens
catatatttatattatatattatataattgccaaatatatatggtattacatataatataattgggaaatatatatttataatatatgttatattaatatrataatatatttattatattatatattatatatattatatatttgcctattatataatatattatgtaatatattaacataatataaattatatattatat

SEQ ID NO: 53214 - DNA, 201 bp, Homo sapiens
tgtacagctacacaatttatggtttaagccaggtgttattataaaagagtaaaaatgttgtttaaaaaggtttctaaagtattaaaggtactgtaaactarggctaatttattattgaacaaataaaattttttatacattcagtgtagcttaagtgtgcaatgtttataaagtctacagtgtttcacattcactcaccgc

SEQ ID NO: 53215 - DNA, 201 bp, Homo sapiens
atatatccataagcaacaaaaataaagtaattgggatccatcacaataactatgaacaaagtaactatccacatgatctggaatttgcccatatttgtggyttgttttctgtatactgtttttgatggagatattatagtcccctaataatacatatacctacttcagcttaagaaaaaactatattttgccaaattttgt

SEQ ID NO: 53216 - DNA, 201 bp, Homo sapiens
taaggctaatttattattgaacaaataaaattttttatacattcagtgtagcttaagtgtgcaatgtttataaagtctacagtgtttcacattcactcacygctcactcactgactcacccagagcaacttccagtcctgcaagtttcatttatccaattgccctgtacaggtgcagaacttcgtatcttttataccatat

SEQ ID NO: 53217 - DNA, 201 bp, Homo sapiens
tgaaaataaagcacactgacagaaagaaacctcattaggatagaattttgggagattggtgtcttgttattcccagagtctgacttttctaatcacgtagyattgtcagggatatctaaattttaaacttcagattttgtacaaaaaaacctaaaaggactatattttaaaataagaagcatgtacaaataattgtaaagg

SEQ ID NO: 53218 - DNA, 201 bp, Homo sapiens
cttgaggtcaggagttcaagatcagcctggacaacatggtagcagtgagctgagattgcaccactgcactccagcctgggaaacagagtcagtgagactcygtctcaaaataagtaaataaataaataaatacttttttttttttttttttttttttgagacacagggtttcactcttcttgcccgggctagagttcagcg

SEQ ID NO: 53219 - DNA, 201 bp, Homo sapiens
ccatcagagaaatgctaatccaaaccacaatgagataccatctcacaccagttagaatggtgatcattaaaaagtcaggaaacaacagctgctggagaggrtgtggagaaataggaacacttttacactgttggtgggactgtaaactagttcaacccttgtggaagtcagtgtggcaattcctcagggatttagaactag

SEQ ID NO: 53220 - DNA, 201 bp, Homo sapiens
caggaaacaacagctgctggagaggatgtggagaaataggaacacttttacactgttggtgggactgtaaactagttcaacccttgtggaagtcagtgtgkcaattcctcagggatttagaactagaaataccgtttgacccagccatcccattactgggtatatacccaaaggattataaatcatgctggtataaagaca

SEQ ID NO: 53221 - DNA, 201 bp, Homo sapiens
cacttctcttttttttttaaagcggcctaaatggggtgaagagtgagttatctgacaaatttagattttgcaaacctgtgcattgatgagagtgctattgraacacattaagaaagattttcaacgcaggaatgtgtcatttcctttcttcatgtaccagatgctgaaatactatgagataaagattttaggtttcaattg

SEQ ID NO: 53222 - DNA, 201 bp, Homo sapiens
ttgtggaagtcagtgtggcaattcctcagggatttagaactagaaataccgtttgacccagccatcccattactgggtatatacccaaaggattataaatyatgctggtataaagacacatgcacacatatgtttattgcggcggcactattcacaatagcaaagacttggaaccaacccaaatgtccaacgatagcctgg

SEQ ID NO: 53223 - DNA, 201 bp, Homo sapiens
tgttgtaacaaatgggaggcttaaaacagaaatgtattcgctcacagttctgagatgcagaagtctaaaatgcaggtgtcagaaagaccatgtgccctttmgaaggctctagagaagaatcttcctgtgcctcctcccagcttctacgggctactggcagtccttagtgttccttgcctctgtagctgcaccactcatctt

SEQ ID NO: 53224 - DNA, 201 bp, Homo sapiens
ttaaagcggcctaaatggggtgaagagtgagttatctgacaaatttagattttgcaaacctgtgcattgatgagagtgctattgaaacacattaagaaagrttttcaacgcaggaatgtgtcatttcctttcttcatgtaccagatgctgaaatactatgagataaagattttaggtttcaattgtaaagagagagaagtg

SEQ ID NO: 53225 - DNA, 201 bp, Homo sapiens
tatgtttattgcggcggcactattcacaatagcaaagacttggaaccaacccaaatgtccaacgatagcctggattaagaaaatgtggcacatgtacaccrtggagtactatgcagccacaaaaaaggatgagtttatgtcctttgtagggacatggatgaagctggaaaccatcattctcagcaaactatcgcaaggaca

SEQ ID NO: 53226 - DNA, 201 bp, Homo sapiens
cactagaataaatgttaattcatcaattttattacctaattttgacatgtgatatcaatacagaaaggtaaatgaaatgatacgtacagtttaagaaattrttataaaataaacaactatggaaccactcagatccagaaatagatcagcggaaatagatgggctcccagaagcccatcatctgctcctccccaattacaa

SEQ ID NO: 53227 - DNA, 201 bp, Homo sapiens
attatatagcaaatattggctgggtatctactatatgcacttcattgaactagatgtggggaaaggatacaaaaaataagatatagttctttttgtgctcmggaatcttatgatttaaaacatatccccaaataggcataatgtaatttgagcaccttaagtagtatgaaagtactatagataattactagcaccttaagt

SEQ ID NO: 53228 - DNA, 201 bp, Homo sapiens
atcaacctggcaggtggactatatctccacttgcttctattatgggttctttttcttttttccttccatcttttctttcctttccttttctctcttttcctttttttttttttctttttgagacagggtctcactttttcacctaggctggagtgcagtggtgcgatcatagcccattgcagcctcaacctcttgggctca

SEQ ID NO: 53229 - DNA, 201 bp, Homo sapiens
gcatgtttttgcagtggcgggtaccagtttttcctttccatgtttagtgcttccttcaggagctcttgtagggtaggcctggtggtgacaaaatctctcarcatttgcttgtctgtaaagtattttatttctccttcacttatgaagtttagtttggctggatatgaaattctgagttgaaaattctttcctttaagaatg

SEQ ID NO: 53230 - DNA, 201 bp, Homo sapiens
cttgaagactaagtaagattcacacagcatataatgggaggttggcatttgcactgaccaggtaaaaatacttatagaaaaaccatagaactgagattacrgatgttttatgcagtgattagccgttttatgcagtgggtaagagctaatcttctgggagtagactgcctgtgttcaaattccagctcccctgctccctag

SEQ ID NO: 53231 - DNA, 201 bp, Homo sapiens
cttgggctcaagcaattctcctacctcagcctcgtaagtatcttgggttacagggacatgctaccatgactggctaatttttgtagtttttgtagagccakggtttctccatgttgcccaggctggtctcaaactcctaggctcaagccatcctcccgccttggcctcccaaagtgctgggattacaggcgtgagccactg

SEQ ID NO: 53232 - DNA, 201 bp, Homo sapiens
aagtagctcattaagaggccacccaacattcctagaccataaatatttatttcatttttaggtaattaatatggaggattcactctcctctgtctcacaamtctcctgctagcctaccagtctgccaaacctaatcaggaaccagaggtcaggggagtcatttgattctgtccaaaaagatcatccttttggagaaaacaa

SEQ ID NO: 53233 - DNA, 201 bp, Homo sapiens
ttgaagactaagtaagattcacacagcatataatgggaggttggcatttgcactgaccaggtaaaaatacttatagaaaaaccatagaactgagattacaratgttttatgcagtgattagccgttttatgcagtgggtaagagctaatcttctgggagtagactgcctgtgttcaaattccagctcccctgctccctagt

SEQ ID NO: 53234 - DNA, 201 bp, Homo sapiens
gggatctttctcccaatccaactatccatttttgtgtgtgagggagttgacattcttataaaaccccaactgtagaacgaagtgactggtctaacaatggmtctttcaccgaacgtgacccatcagaactaattcctaaagcttttaaacttagaaccatctgtaaaatgtgctgctggtcagaagcagtactgtgtggta

SEQ ID NO: 53235 - DNA, 201 bp, Homo sapiens
cgggcatatgaaattgctataaagtcaatggtatccaccttgcaacaatccttttggctatagcataaattcttttctctcatttgggcccctaggctgayattccatcatgatttcacagacttctggttaagaatttgcttaatgcattttgctctggcttaaattaattgacacttttacaactttgaaactcattta

SEQ ID NO: 53236 - DNA, 201 bp, Homo sapiens
gattagccgttttatgcagtgggtaagagctaatcttctgggagtagactgcctgtgttcaaattccagctcccctgctccctagttgagtaacttgactrgttacttacacatttcagttccctaacctgtaaaatggagaaaatactacttgtacctcatgaagattccgtgagaacaaaataagaaaagctcatattt

SEQ ID NO: 53237 - DNA, 201 bp, Homo sapiens
tacaaaaaaaaaaaggaagaagttaataagttaataataaccatttatttgctaagaaatatataaatgtgagatatgaggtattatcagcaacgtttttwtttaaaaatatatagaaaagatatatatttatttttcattgtttgaaagttaagacaaatggatgaaaaaaacagtgctatgataaatatgaaacaatta

SEQ ID NO: 53238 - DNA, 201 bp, Homo sapiens
agtaatggtctacctgtgtgagcaaaatacaaaaaaaaaaaggaagaagttaataagttaataataaccatttatttgctaagaaatatataaatgtgagrtatgaggtattatcagcaacgtttttttttaaaaatatatagaaaagatatatatttatttttcattgtttgaaagttaagacaaatggatgaaaaaaac

SEQ ID NO: 53239 - DNA, 201 bp, Homo sapiens
tttgcgatttggtttttttgaaaaaatagctcagctgaccagaatgaatgtattctacttgttgagccatccagcatcacgttaaatgcaaaatgtatatwtaaataaaagaagaagaaaaaagaaagaccaaagggatgtagaaaatgaagaataaccattaatatctaagggccaaacacattccacctaaattatcta

SEQ ID NO: 53240 - DNA, 201 bp, Homo sapiens
ggaatgttgaattgcatttgttccattaaaaaaaacagaaatttgcgatttggtttttttgaaaaaatagctcagctgaccagaatgaatgtattctactwgttgagccatccagcatcacgttaaatgcaaaatgtatatataaataaaagaagaagaaaaaagaaagaccaaagggatgtagaaaatgaagaataacca

SEQ ID NO: 53241 - DNA, 201 bp, Homo sapiens
taaaaaagtacttatgatagagcattacattaaaaagttgtttccagattgtttaaaaatgtcatattttaagataataatatgataagggttgagacacrtacaccaaaatcctagagtttaagctaggatggtgagattcatggtaaattgtttttccatattatgtatattttctaaattttctgctgtgaatatata

SEQ ID NO: 53242 - DNA, 201 bp, Homo sapiens
gtttagtgagtggataagtcagtcaagtgcctataatgatacctggattggcttttcctgtgactgtccttttgctttctactgcaaagatgtggaacatkttttcttcttttttattccaataggcttggtagtaagaatataattggagattaaaacaattttaattatggaagaagacaacactttctaacagtaggc

SEQ ID NO: 53243 - DNA, 201 bp, Homo sapiens
tttcttctcaccttgccctttccttctacatggattaagtacacactgctcgtaagggtacagtgctagaaacagggaaatgaagggtgaataagacagtstacaactgaaaagatacacaaacatgagaagagaaagagaagacttcacactttctccatgcatagcagatctatagagtagtccatttataagacctga

SEQ ID NO: 53244 - DNA, 201 bp, Homo sapiens
atccgtagaaggttctgttctaccttgttcaacatagtagaactttcagcatgcaaataacgtacttctgtctgttttgcctcttgaagtccattcaaagmcttattgtttccctcagggtaagttatggtcattttcaggattatctaaaatattacaccatatgtagttcatttattaattcaacacgtttactgaaca

SEQ ID NO: 53245 - DNA, 201 bp, Homo sapiens
ttgagagaatctactaagttcagtccagtcaagaaaagaacctaatagcaccaatacaaattgaggacttaatttactttggaatgttgaattgcatttgytccattaaaaaaaacagaaatttgcgatttggtttttttgaaaaaatagctcagctgaccagaatgaatgtattctacttgttgagccatccagcatcac

SEQ ID NO: 53246 - DNA, 201 bp, Homo sapiens; identical to SEQ ID NO: 9952

SEQ ID NO: 53247 - DNA, 201 bp, Homo sapiens
gcacaatataaatatttccatttcttactaaaatctgtcttacagacgggttccttaagcataaagctgttagtttcacaaataatcttaatttaattttsattttatatacacattcaactgctgttacaaaaatcaaagttattattttatataataaggaggatcacaagcttattatttattccaaatgttgaagat

SEQ ID NO: 53248 - DNA, 201 bp, Homo sapiens
tcctcctatttataaaaaaagattcaaccataaagcagcctcaggtatgtcctttaggaggtattctggaagaaggcaatgttatcataggagatgacagytccatgcctgttattgtttctgaagatctttcagtgggagaagatatggaggggaagacagtggcattgatgagcctgaccctgtgtaggcctaggctaa

SEQ ID NO: 53249 - DNA, 201 bp, Homo sapiens
ggtaatttttgtattttaagtagagatggggtttcaccatgttggccaggctggtctggaactcctgacctcaagtgatctacccaccttggcctcccaawgtgtgtacaatcttttatctttaattaacatttataatttaacatttgttaacataatttttgggctgttatctaagtttttaattgtatgtgtcctgag

SEQ ID NO: 53250 - DNA, 201 bp, Homo sapiens
aatttaactgcatatttaggatgacactcttaatgtaataatagctacagtagtaatgcttatcaaacagcttctttttttttttttttttttttgagacwgagtcttgctctgtcagccaggctggagtgcagtgcagtggcacaatctcggcacactgcaacctccgcctcccgggctcaagcaattctcctgcctcag

SEQ ID NO: 53251 - DNA, 201 bp, Homo sapiens
tggcacaatctcggcacactgcaacctccgcctcccgggctcaagcaattctcctgcctcagcctcccgagcagctgggactgcaggcacccaccaccacrcctggctaatttttgtattcttagtagagacggggtttcaccatgtttgccaggctggtctcgaactcctgacctcaggtgatccacacacagcctcttt

SEQ ID NO: 53252 - DNA, 201 bp, Homo sapiens
aattatttttaattctcgcaataattctttaaatttatattgtgatcatattttacatatctaaagaaagttcaattcaaataagttaaaatatttgcctragatcacacagctaaatgatgtcacagtcaatactcaaatctagatttcagattcaaaagttgatgctctttcttctttgctaccaaggatgaatatcag

SEQ ID NO: 53253 - DNA, 201 bp, Homo sapiens
ataaaaggtataaatagatacatatagagagatataggaaaacagaaaacctcagccatgactgaatagtgataagattgtgtttaacattttcctcattstctataattattcatgttttgtttttttttttttgagatggaatctcactctgttgcccaggctggagtgcagtggcgtgatctcggctcactgcaacct

SEQ ID NO: 53254 - DNA, 201 bp, Homo sapiens
aaaacaaaaagaaagaaagaaaaaagaaagaatatgataaaaaaactaaatagggaaaaatcttaggaaaacgaatgcatgtcaagtatgaaaagacagayggtaaatatgtattaaacataaagagctgattcacatgcttaggtaaaagaaacctgtggggatgtataagcagtgaatatgaatagataataacccaag

SEQ ID NO: 53255 - DNA, 201 bp, Homo sapiens
gccaggctgatctcgaactcctggcctcaggtgatctgcccgtcttggcctcccaaggtgctgggattacaggcatgaaccactgcgcctggctgaccatsgaatgcttttgaacccaaacatgaggaattgaaagcaaattggaaactatctggaaggtggtagaaattttgaacctgtttgaagtgataattaatggaa

SEQ ID NO: 53256 - DNA, 201 bp, Homo sapiens
cacttttaggtattatttaactcttatcaaaatctaaatgattctaaaataagctttattattcaatggtagtgaattttgcttgaaactgccatattcayatataagtctggaatatttataaatttatgttatctttttaaagatcactaagacagtagagcccaagaagttcaaaatagttttcctttcactttttag

SEQ ID NO: 53257 - DNA, 201 bp, Homo sapiens
atagaggtgaaaaggactgtacgactacaaaattaaatgcctgtttctaggagggtcactggtggtagcatgtggagggagtgtgtggatgctatataggrttttttgaaattaaatacacttttcctcctcccagtgaaaataatttccactgaaatttgacaaatgtaaacaccatgtgcagttttcaaagaagggaat

SEQ ID NO: 53258 - DNA, 201 bp, Homo sapiens
gaatatttataaatttatgttatctttttaaagatcactaagacagtagagcccaagaagttcaaaatagttttcctttcactttttagtttcacatatgrtgaattatcctaaagaaacattttaaaagaagaaagctaaattatgaaaataatggccggggcagtggctcacatctgtaatcccagcactttgggaggc

SEQ ID NO: 53259 - DNA, 201 bp, Homo sapiens
ctactcgggagaaccacttgaacccaggaggtggaggttgcagggagccgagatcatgccattgcactccagcctgggtgacagtgcgagactccgtctcaaaaaaaaaaaaaaaaaaaaaagaaagaaaaagtagcctcagcttttaggtatgatgaaaaacctggatgattcctcgtttctaggaagcaaaatcactgt

SEQ ID NO: 53260 - DNA, 201 bp, Homo sapiens
taaatttatgttatctttttaaagatcactaagacagtagagcccaagaagttcaaaatagttttcctttcactttttagtttcacatatgatgaattatsctaaagaaacattttaaaagaagaaagctaaattatgaaaataatggccggggcagtggctcacatctgtaatcccagcactttgggaggccaaggaggg

SEQ ID NO: 53261 - DNA, 201 bp, Homo sapiens
aggaggtggaggttgcagggagccgagatcatgccattgcactccagcctgggtgacagtgcgagactccgtctcaaaaaaaaaaaaaaaaaaaaaagaargaaaaagtagcctcagcttttaggtatgatgaaaaacctggatgattcctcgtttctaggaagcaaaatcactgtctagtcacttaacactttatgctga

SEQ ID NO: 53262 - DNA, 201 bp, Homo sapiens
tatgtaaaataaggttttgcgtatatatgaaatatatgtaaaataaggttttgcgtatatatgaaatatatgtaaaataaggttttatatatataagcaartctttgctacataataattcaacacatatatatatgttgttttatatatatatatatatatatatatatatgtatgtgtgttgaattattaggtagcaaa

SEQ ID NO: 53263 - DNA, 201 bp, Homo sapiens
gcatcataagtagaagaaattttattccacacacagtgagggttgcacatgaatgtagaaaagagaagagttataaaaaatgtaaaaattctcttctcatktggcttttcaaatctctagggaaaaaataaaccatttcataagcaatgagggagaatctgactatcatttgtggaagaaaaactagacccttcctctaca

SEQ ID NO: 53264 - DNA, 201 bp, Homo sapiens
tggaggttgcagggagccgagatcatgccattgcactccagcctgggtgacagtgcgagactccgtctcaaaaaaaaaaaaaaaaaaaaaagaaagaaaargtagcctcagcttttaggtatgatgaaaaacctggatgattcctcgtttctaggaagcaaaatcactgtctagtcacttaacactttatgctgaatgtct

SEQ ID NO: 53265 - DNA, 201 bp, Homo sapiens
ataagcaagtctttgctacataataattcaacacatatatatatgttgttttatatatatatatatatatatatatatatgtatgtgtgttgaattattakgtagcaaacacttggaaccaacccaaatgtccctcagtgatagactgggtaaagaaaatgtggcatatatacaccatggactactatgcagccataaaaa

SEQ ID NO: 53266 - DNA, 201 bp, Homo sapiens
tccaagctatcaattttaattattttatatctcccaagaccaccattagttctcaacattctgtattctctgttcctttgtcatttctttatatcctcgtrtaaattattcttatgactctttgccagagttgcaattgtttcctgcccagactgtaatcctttttgcacccttgtagaatacagccttcctaaaggaagt

SEQ ID NO: 53267 - DNA, 201 bp, Homo sapiens
ttctttgctcatccataagaagcaacccctaatccattcaagttttatcgattgcagcaattcagccacatcctcaggctccacttctaattctagttctmcacttctcttattatttataccacatctgtagtgactttctccattaaagtcttgaacccctcacagtcattcatgagggttggaatcaacttcttccaa

SEQ ID NO: 53268 - DNA, 201 bp, Homo sapiens
aaaaaaaatagccattttcagttttcatttaagcatatgaaaccctggatttgtgtaagtatatagtacatactcataagtaaatctgtgtatcgcatgtktgtgtgtgtgtgtgtgtgtgtgtgtgtgtgtttatgtttatgtttatttaccctgggattacaatgaaatatgtaagaacaggtccatgatagataaagt

SEQ ID NO: 53269 - DNA, 201 bp, Homo sapiens
ttctgcacgtgtatcccagaacctaaagaataataaaaaaaatttcaagtttgaaaaattcgtttgaaatattaaaataatgaggtgattttaaggaaaaygcgtaataccaaatgatacgtgcatgatgatatgaactatgttacaggtatacatacatccaaagactcgagtttcatttaaaaaattaagggttttttt

SEQ ID NO: 53270 - DNA, 201 bp, Homo sapiens
tgatatgaactatgttacaggtatacatacatccaaagactcgagtttcatttaaaaaattaagggtttttttcctttattagggtgatgagatgacagaratttcatcctaacatatctataatattattaaaatgttttataataaaaacaaaaaagtaaggtatatggttcccaacaaattaaccttgaaattctttc

SEQ ID NO: 53271 - DNA, 201 bp, Homo sapiens; identical to SEQ ID NO: 9966

SEQ ID NO: 53272 - DNA, 201 bp, Homo sapiens
gctttcaaaaagtttttatagactttatatacttataaggaaacacagatatacaaatacgtatacacatacaaacatgctcacacatacaatcacaaacwcaataggaaacatgccatgcctagtaagataatttgggaactaaaaagtgtccctggcaaggtttctgattttgagatcatattccttttttcttttcct

SEQ ID NO: 53273 - DNA, 201 bp, Homo sapiens
ctgttaacactcttacaattgatcagctcaggaaaacctttgctttgtcattttcttgctgtttgtttgtgtttgcaatcagtagcattcttaatccatgrtttccttacaggatggtgtgtaggccctttgctgattagattagttctactttaattaaaaacagataatgtatttgataaaccaggcacacataaattg

SEQ ID NO: 53274 - DNA, 201 bp, Homo sapiens
atccatgatttccttacaggatggtgtgtaggccctttgctgattagattagttctactttaattaaaaacagataatgtatttgataaaccaggcacacrtaaattgaaatacacgggaagataacaaaaggaggaagatgctgatattaagttttcctttttccggtttattttatgtgcaaatataccccaagaccct

SEQ ID NO: 53275 - DNA, 201 bp, Homo sapiens
atagaatggaaggaatggatcaaaggaaatcaggagtttttgtgcagtcagatatgggtcttatagatgagagcggtctagaaaagcagttctgggctcarattgcgtgactgtgctttgccggcatattcctaactatatcacatattctccactatacagtaagtagatgataataataagtgggtatgataataaata

SEQ ID NO: 53276 - DNA, 201 bp, Homo sapiens
acaggatggtgtgtaggccctttgctgattagattagttctactttaattaaaaacagataatgtatttgataaaccaggcacacataaattgaaatacaygggaagataacaaaaggaggaagatgctgatattaagttttcctttttccggtttattttatgtgcaaatataccccaagaccctttgacatacagatac

SEQ ID NO: 53277 - DNA, 201 bp, Homo sapiens
gaatgtgtacacttgagtggtggtttcttaaaatcacagcatgacaattatttatgaatagtgttcctcccaaatcagaggaattcacatgcaaatatagktaagttgcccatagttgtcccaaatttttgaaaggcatcagtgaaatgtaaaagaagcagcttagaagtttccaaccctttaagtcttaaatgagtactt

SEQ ID NO: 53278 - DNA, 201 bp, Homo sapiens
gccgaagtccaaaaattggaatagaatggaaggaatggatcaaaggaaatcaggagtttttgtgcagtcagatatgggtcttatagatgagagcggtctaraaaagcagttctgggctcagattgcgtgactgtgctttgccggcatattcctaactatatcacatattctccactatacagtaagtagatgataataata

SEQ ID NO: 53279 - DNA, 201 bp, Homo sapiens
tgtaggccctttgctgattagattagttctactttaattaaaaacagataatgtatttgataaaccaggcacacataaattgaaatacacgggaagataasaaaaggaggaagatgctgatattaagttttcctttttccggtttattttatgtgcaaatataccccaagaccctttgacatacagatacgcttggatcat

SEQ ID NO: 53280 - DNA, 201 bp, Homo sapiens
ataatgtatttgataaaccaggcacacataaattgaaatacacgggaagataacaaaaggaggaagatgctgatattaagttttcctttttccggtttatyttatgtgcaaatataccccaagaccctttgacatacagatacgcttggatcatcaggttattacatgtacccatgattattaaggctcaaactttcttct

SEQ ID NO: 53281 - DNA, 201 bp, Homo sapiens
gtgtaggtaactttgttagagctcttcttactttgcattttagtagtttacatgttaacagagtataaagtgttctgaagcaggagattaatttttgattyctactagagagcacagaacttgcatacagaaaataatcaacacttttttgtttaattagtgaaggaattaatggctttgccccactcaaagagaaacact

SEQ ID NO: 53282 - DNA, 201 bp, Homo sapiens
catattaccttatacacaagcacttaaaaaattttcactgtgtctgaaactgttccacatagcaaaagacagagataccaaattccacaatacatttgtcwcatccatgtgtcctcagaggaaaaataaccagaataagaatcagaggctctagatgccagtatttgctctggcatgattgtatatgtgatctcagttgct

SEQ ID NO: 53283 - DNA, 201 bp, Homo sapiens
ctggatctattctttgtaaatttgagaaagtcatacaccctttctcagtctcagtttatgtatctatgaaatggagataattatcattatttaacaaggtkattataaaaagtaaatttagaaatgtatgtgaaaagacctagcatattaccttatacacaagcacttaaaaaattttcactgtgtctgaaactgttccac

SEQ ID NO: 53284 - DNA, 201 bp, Homo sapiens
atcactaagctttaagtgtcatcatgttctgttgcctggatctattctttgtaaatttgagaaagtcatacaccctttctcagtctcagtttatgtatctrtgaaatggagataattatcattatttaacaaggttattataaaaagtaaatttagaaatgtatgtgaaaagacctagcatattaccttatacacaagcac

SEQ ID NO: 53285 - DNA, 201 bp, Homo sapiens
acccaggaggtggaggttgcagggagccgagatcatgccattgcactccagcctgggtgacagtgcgagactccgtctcaaaaaaaaaaaaaaaaaaaaargaaagaaaaagtagcctcagcttttaggtatgatgaaaaacctggatgattcctcgtttctaggaagcaaaatcactgtctagtcacttaacactttatg

SEQ ID NO: 53286 - DNA, 201 bp, Homo sapiens
ctctgggggccaaaggggcattgggaccctttgggctcccaggcctggcacacaatggcctctcaagccattgcaagggacacaaagctataggcgacggyaaggtcagggcggccgctgcttgggagcgagagggaaggagcaaaagtgagtcctaaaaagctcggccatctgggaccttcagggatggggctgtcggga

SEQ ID NO: 53287 - DNA, 201 bp, Homo sapiens
gcaggagcatttgctcctctctggggcagcgtcccccctgcctgcatttcccggctgctagggaagccagaggaagccaggtgactttgcctttccgtgcrctggcaaggttaatttgcacaacaaattcctacgaaagcaaatgtcagccttattattcctccctaagcaatatgttcaactaatatcttcttgatttcc

SEQ ID NO: 53288 - DNA, 201 bp, Homo sapiens
gtctcagaaactgaaaaaaatacttccctctctctgttgcaccagcatctttcaccatatatagacacacacgcacacaatgcacacacacacgcacacayacatgcacacatgtacacatatgcacgcagaagcacacacatgcacacactttttctctctctctgaatggtgcttcttcttttcatttgtgcaaggtgc

SEQ ID NO: 53289 - DNA, 201 bp, Homo sapiens
agttttatttctgaagtcaggaggtgcctgctttatctgggagtgccgagctggagcgggggagctgtgtctgtgcggagcggccggctccagctctgcaycttggtctcaccatgggctggtggggcggagagtccctctctgcctttttgggtgttgtgaattcatgagggcagatggtggctgctgtttctggagctg

SEQ ID NO: 53290 - DNA, 201 bp, Homo sapiens
cacagttacgctgtggcttgggtgtggtctggagctactgcctcaggacccaccaccatcctggcagtgtggtcccttcagaaaagctgaaaatgcaaaartcaggcacatgcacctccccccatgagctgctcaagagagaggagcagtcacgcatccttatggagaaaaggagaagcaggacccagaaagggtttccct

SEQ ID NO: 53291 - DNA, 201 bp, Homo sapiens
gaaacacacaaaggagtgacaaaaaagttttatttctgaagtcaggaggtgcctgctttatctgggagtgccgagctggagcgggggagctgtgtctgtgyggagcggccggctccagctctgcatcttggtctcaccatgggctggtggggcggagagtccctctctgcctttttgggtgttgtgaattcatgagggcag

SEQ ID NO: 53292 - DNA, 201 bp, Homo sapiens
gcggccggttcccgggctcagagggctgcctcctcacagtacgagcccatcgtcaccaagggcaatgaggcccttgtccaccacatggaagtcttccagtkcgcccccgagatggacagcgtcccccacttcagcgggccctgcgactccaagatgaaacccgaccgcctcaactactgccgccacgtgctggccgcctgg

SEQ ID NO: 53293 - DNA, 201 bp, Homo sapiens
agcacgctgttgaccaagcaggacctggcctgtgcatgaacgggggctagacctgcaacgctggccctcctcctggggggccacattctcactcaaattgytcctgagatgtcagcttggtaggtgggttccttgggtctgcaggacataaatcaaagtagtaaaagtgggggctgctgggaggatgtgctccttgaatgc

SEQ ID NO: 53294 - DNA, 201 bp, Homo sapiens
tgcaggacataaatcaaagtagtaaaagtgggggctgctgggaggatgtgctccttgaatgcttcttgttaacctcaacacagagatacactcacacttgyccagctttgacgcagggccagggctcttctgtgccatcggcagatgggagttccatgccctcttctttgcccagaccacaccctgcaggttgtcaccgtc

SEQ ID NO: 53295 - DNA, 201 bp, Homo sapiens
caaggctcaccagagaactcccaagagtgtctttcccctggcctgggagacaatttcacaccaatgccacactctattgcacaggtgattatgcacttggwcctcacctgcctgggctgtgggtgggggcgaacggtgcccctctgggtgcaatcagtggggaggggctcatggcctgagcttggctttgcaggatggcct

SEQ ID NO: 53296 - DNA, 201 bp, Homo sapiens
ttgccccagggacaggactcgagttgcagggaggtgttgctggtgcccactgggctccctgcccgtcagctgctccccagcctggctgttccttgtccccrccaggttcaacaacgaggatgtctgcacctgccctcaggcgtccgtgtctcagcagttcacctctgttccctggaactccttcaaccgcgacgtactgaa

SEQ ID NO: 53297 - DNA, 201 bp, Homo sapiens
agcgacaaccccacccccacctcaccccccactcacactcttgctctcaggctggttatcctcttcctcttgcagagacagcagccgtgtcccccctaccmcgctccagcagtacccgcacctcctacacccagataagcgtaaccccgtggttgctgagagttgccacttgccccacactgaggctatgcacagccgtgg

SEQ ID NO: 53298 - DNA, 201 bp, Homo sapiens
cttgtgggggattttatctaaaataagttccttatttagaggcttaggggaagtgctttgttacctgaaaatgacctacatgccccaagccaaagggactytgggctcgcccaccttccgaatgattggggtgtgagtccagcagcccaggttgctattcctgcccctgctgtgtgaccctgagttagttactttccttcc

SEQ ID NO: 53299 - DNA, 201 bp, Homo sapiens
cgaggggccaggttctctctccacaggggcgggggaagcacacaggggacagggaggggtgctgggttctctctcctcgggacagggagcgcagccaggtkctctctcctcgggacagggtggtgccgttgcgtgcattccccagctgcagccacgagaaacaatttggagcggaacccgggctctgacctcccctcatcc

SEQ ID NO: 53300 - DNA, 201 bp, Homo sapiens
aaaagtttcccttcaaactggaggggactttaggcccttccacaagctgcagggggtccccgaagtgggcgagcccaccgcctacaatgggtcctgctccmgccttcctttccacatgggactggccaccagggcttctttgtggatgaaacccaactctctccacagaaacacacaaaggagtgacaaaaaagttttatt

SEQ ID NO: 53301 - DNA, 201 bp, Homo sapiens
catgaggcctgcacacccatgggatccagcctgacctactgtgcttgtacccgtggaccgactgagcaggtgcagacaccctgcccctacccataggtgtygaacaagccccacagggctcagccaaaactgttaggatgggctcttgactcctttccgtccaaatttacctccactcttgtttcacagggtggagaaagg

SEQ ID NO: 53302 - DNA, 201 bp, Homo sapiens
ccactgatgtgggccaggtggtggcgcgtggctgggcacagcatgaggcctgcacacccatgggatccagcctgacctactgtgcttgtacccgtggaccractgagcaggtgcagacaccctgcccctacccataggtgttgaacaagccccacagggctcagccaaaactgttaggatgggctcttgactcctttccgt

SEQ ID NO: 53303 - DNA, 201 bp, Homo sapiens
aacaacgaggatgtctgcacctgccctcaggcgtccgtgtctcagcagttcacctctgttccctggaactccttcaaccgcgacgtactgaaggccctgtrcagcttcgcgcccatctccatgcactgcaacaagtcctcagccgtccgcttccaggtgcgctgccatgggcccgggtggggcatgcagtcaggcaggcct

SEQ ID NO: 53304 - DNA, 201 bp, Homo sapiens
cacatgcccactgatgtgggccaggtggtggcgcgtggctgggcacagcatgaggcctgcacacccatgggatccagcctgacctactgtgcttgtacccrtggaccgactgagcaggtgcagacaccctgcccctacccataggtgttgaacaagccccacagggctcagccaaaactgttaggatgggctcttgactcc

SEQ ID NO: 53305 - DNA, 201 bp, Homo sapiens
ctcctccctgccagctctccaaacccttcctgacccggcaccccatctggccgtctttctgcactcaccctccttaacccagaaagttcttctgtcacctstcagtgtttgagttgactctgctctgagccaagtctgcaccccgagcttgggcatcatggggatctcagtttgaggacaaaataggaaagacatgctttc

SEQ ID NO: 53306 - DNA, 201 bp, Homo sapiens
tgagtctctcctccctgccagctctccaaacccttcctgacccggcaccccatctggccgtctttctgcactcaccctccttaacccagaaagttcttctstcacctctcagtgtttgagttgactctgctctgagccaagtctgcaccccgagcttgggcatcatggggatctcagtttgaggacaaaataggaaagaca

SEQ ID NO: 53307 - DNA, 201 bp, Homo sapiens
cacccgcacctgattccatggaggctttaagtggctcacgttgatcacatctttccatagcattcaactagttttcatagaaacagcagctctttcttccyagtgagtgtagcctgtttgcgttaattgatcttgcgagctgcctggcatccacaggtgtggaaacaaagacagccagctcttggtctgcctagcaggtgg

SEQ ID NO: 53308 - DNA, 201 bp, Homo sapiens
gcttctagtccagctggagagatctgtcaacccagcctggggggtggagctggagggatcaagcagaatgtcctgaaggcagctgccctcagtctacttgygggagaggacaggagggagaggtgccgtggtgagactgaccctcgggcccacgggtggatgatggcaaaggtcctgtggcaggtgtgggagaagcagggc

SEQ ID NO: 53309 - DNA, 201 bp, Homo sapiens
gcctgagcttggctttgcaggatggcctggccactgtggggcagagagcactgcctgcgagggccaggggaaggctggcactttctccaaatttcacgttygtgcaaagacacagtcattcctttctacagcgtagagctcagagctgaagcagcctccagacctgctgtcatgggtatttaaggacctaaatgttgctgt

SEQ ID NO: 53310 - DNA, 201 bp, Homo sapiens
agagtgaatgtccgggatgcagcagacacctgcttacaaggcacaggtgaggaggttttggaactaatctgaggcatgaaggtgaggtgctctcaggcgayggaggtggcatgtcctgatgggaaagccaggccttcggaggctgagacccttcccaaggctcaccagagaactcccaagagtgtctttcccctggcctgg

SEQ ID NO: 53311 - DNA, 201 bp, Homo sapiens
gagctgggtgtgctgtggagcccgtgaccctcacctctgcctctgctggcttttgttatcccgtgctgggaacaccagtgcctgcccaccccggaggctcktcgtatcaccggctcgctgtggccgctccccagtcccgagagtgaatgtccgggatgcagcagacacctgcttacaaggcacaggtgaggaggttttgga

SEQ ID NO: 53312 - DNA, 201 bp, Homo sapiens
tgaatgtcccttccccaggtagcctacccgacttgcagggatctggacgtggccattgggggacatccctctgtctgtcacaccacacgccagaagctcaragagattccagggagggaggcggattctcatgttctccgagaccctcctgggccagagccctgcctgttggaccctgtgatgtcagtgggtgcagcagcc

SEQ ID NO: 53313 - DNA, 201 bp, Homo sapiens
ttaaaaagctgaaattggttctaaacaaggtcagccgtcgatgcgccttggagggaagccaggcgctgagcagcaggaatggggcttatttcctgacaccrtggccgtgacaccctgcacctccccggcctaccccacccccaaccccactcccacccccattcccatccccacccccaccgccacctctggagggcaacg

SEQ ID NO: 53314 - DNA, 201 bp, Homo sapiens
gctgtcagcctatgacatgaatgtgcccctaaggctagattctgggtttctccagagagacgagaaacaggagggaaaaggaaggaagggagggaggaggytggggaggagggacagcttctagtccagctggagagatctgtcaacccagcctggggggtggagctggagggatcaagcagaatgtcctgaaggcagctg

SEQ ID NO: 53315 - DNA, 201 bp, Homo sapiens
catttccagctcctggtgcggaggctcaaggctggcgtcctgtttgggatgtccgaccgtggcgagcttgagaacgcagatctcgtggtgctctggaccgmtggggacactgcctattttgcggtgagtctctcctccctgccagctctccaaacccttcctgacccggcaccccatctggccgtctttctgcactcaccc

SEQ ID NO: 53316 - DNA, 201 bp, Homo sapiens
ccattcaggaccagggcataaatggccaggtgggaccagagagctcaccccagccatgcccgccctcagtcgctgggccagcctgcccggccccagcatgygggaggcagccttcatgtacagcacagcagtggccatcttcctggtcatcctggtggccgcactgcagggctcggctccccgtgagagccccctccccta

SEQ ID NO: 53317 - DNA, 201 bp, Homo sapiens
cctgacccggcaccccatctggccgtctttctgcactcaccctccttaacccagaaagttcttctgtcacctctcagtgtttgagttgactctgctctgasccaagtctgcaccccgagcttgggcatcatggggatctcagtttgaggacaaaataggaaagacatgctttccatggtccttgactgcccgccccaaatc

SEQ ID NO: 53318 - DNA, 201 bp, Homo sapiens
cagaggcaagaggagttgttttggcctcatcttaaaggaaacaagtagggagatggttgggccccctggaagtgccctgcaccccagtccacagccctggstttgaacctcagcttggccacttcccagccctgtggtcttgtgtggagtcttcagttcaggctccatcctcagtttcttaatctgtgaaatagggctgat

SEQ ID NO: 53319 - DNA, 201 bp, Homo sapiens
gtctctcagtgggtctccctggtggtcttccatgtgacctggcctcgggccaccgtgtccctgccccttagggcccagtgcaaggggagcagccggagatrgggagggcagaggtcactgatccagatcccaggaagcatcctcggagaatgcagcaggtccaatgcctccctgggcctcagtttaccttctccaagcagg

SEQ ID NO: 53320 - DNA, 201 bp, Homo sapiens
catgtgaccactgggaggctggcccagggagcttcagggactctccaattagcaaacggcaaggagaactaacaggtgtggccacaccataatcaggagasacagtctccgtgactcgaagaagcaccatgttattcctttggaagaggcccttgagtgtgggctgaggctcataaagggacagcaagtcatctgagagca

SEQ ID NO: 53321 - DNA, 201 bp, Homo sapiens
gcccatcgtcaccaagggcaatgaggcccttgtccaccacatggaagtcttccagtgcgcccccgagatggacagcgtcccccacttcagcgggccctgcractccaagatgaaacccgaccgcctcaactactgccgccacgtgctggccgcctgggccctgggtgccaaggtgcgtgccctgcgaccccagcatggtgt

SEQ ID NO: 53322 - DNA, 201 bp, Homo sapiens
agcatggtgtctcctgcctgggcccctggcatccccacacctctgtttccccagcttcaccgtctcagaggcttcaagaaggggctcccaagggggctcaygaggccaccagaagggccaggcctgaggtggccccctcgcctctgtgatgtctgaaatgcttcaagccttttttttattttccacagaaacgcaagtgcc

SEQ ID NO: 53323 - DNA, 201 bp, Homo sapiens
ggcttcaagaaggggctcccaagggggctcacgaggccaccagaagggccaggcctgaggtggccccctcgcctctgtgatgtctgaaatgcttcaagccktttttttattttccacagaaacgcaagtgccccaggaccttatgccctcagtgggtcctgattctgtttcccaactggagtcagggttttgtgtacaggt

SEQ ID NO: 53324 - DNA, 201 bp, Homo sapiens
ggagagagagagagagagagagagggagagagagagaaccaataacgaggcaaggaagggagggcaggcaccctctctggtgacacctccacactgtaccraatgccaaatgcaggtggtgtgagcagggcgcactaacctgcctaaaaataaagcaccaggggaggggaaggtaagaaacgaaccagtctgaagctgcga

SEQ ID NO: 53325 - DNA, 201 bp, Homo sapiens
tattgaatagttaacaaatttttcaacaaatgggaggcatttttctggtgatttgcctttttattgctgcatagtattccacaggatggggttttcaccaygcacctgagcagggcaggactaggtgaggcagtgaagtgccgggtacaggatctcagggagcacccgtcctcagggctatgcacgctgggtggaggcaca

SEQ ID NO: 53326 - DNA, 201 bp, Homo sapiens
gatctcagggagcacccgtcctcagggctatgcacgctgggtggaggcacaggttggcgcttagactggcgccaacagcaggtcctgtccttggcttctgstgagttcagagagtgactactaaaatctcctcctttgcttgccctatcttggtccaagcctgtgctgaactgtctccctatcaatcagtgtctaggctgt

SEQ ID NO: 53327 - DNA, 201 bp, Homo sapiens
ggcagggactcggttccccagagcatgcctggcacggtgcagtgaacagacgagtggacgcagtgtacacgtgggtgcggcgaaagctgctggatggcagygtctgcgtggcatggcccggggctgacgggtctcctccaacttgcaggggggcttcgggatcctggaggagatgtgtgtcaactacgtgcactactaccc

SEQ ID NO: 53328 - DNA, 201 bp, Homo sapiens
tacttctcacagtgacctgcaaagtaagtgttgacgtacccatttcacagatggggagactgaggcttgctgggatcacactgccagcagtcacgcagagkgaagattcaaataccagtctgtctgactttgaaagctgtggccgtgacagcagatttcgttgtaatgaggtttagagtggattttccttcctagtaaatg

SEQ ID NO: 53329 - DNA, 201 bp, Homo sapiens
gaactcccaagagtgtctttcccctggcctgggagacaatttcacaccaatgccacactctattgcacaggtgattatgcacttggtcctcacctgcctgrgctgtgggtgggggcgaacggtgcccctctgggtgcaatcagtggggaggggctcatggcctgagcttggctttgcaggatggcctggccactgtggggc

SEQ ID NO: 53330 - DNA, 201 bp, Homo sapiens
ttgaaagctgtggccgtgacagcagatttcgttgtaatgaggtttagagtggattttccttcctagtaaatgggtcgattgggatttgttcttcatgtggstgagcccccagagcatcccagtcttccaagcaaaggttcctcaaggctgaagggagacggagctctcagccggcatggcacccattgtctccggcaggaa

SEQ ID NO: 53331 - DNA, 201 bp, Homo sapiens
ctccctccacctggccgacacctggcatctctgggccagggtcggcctctgggggccaaaggggcattgggaccctttgggctcccaggcctggcacacartggcctctcaagccattgcaagggacacaaagctataggcgacggcaaggtcagggcggccgctgcttgggagcgagagggaaggagcaaaagtgagtcc

SEQ ID NO: 53332 - DNA, 201 bp, Homo sapiens
agaggagaacagattctacacagggtcggactcagttcccttttgatgtctgtggtggcagagggtggggagggacaggaactcacacaggagggcaatcrtcccgatctgacgggggcgggatggatgagaaaagctgggaaaggaggaatccggcccagagaacaatgctggcaaaaacgcgtcctggccaacaggtgc

SEQ ID NO: 53333 - DNA, 201 bp, Homo sapiens
gggcgggggaagcacacaggggacagggaggggtgctgggttctctctcctcgggacagggagcgcagccaggttctctctcctcgggacagggtggtgcygttgcgtgcattccccagctgcagccacgagaaacaatttggagcggaacccgggctctgacctcccctcatcctcagccttcccccagggatgggccgt

SEQ ID NO: 53334 - DNA, 201 bp, Homo sapiens
tccaagaggtggctgggaagtggctggggaagcagccacccatcttgcccctccagcctcagtttacctcctgcccccttccttgcagggtgaatggaacytgcagcccctgcccaaggtcatctccacactggaagagcccaccccacagtgccccaccagccagggccgaagccctgctggccccaccgttgtcagcat

SEQ ID NO: 53335 - DNA, 201 bp, Homo sapiens
ttctctctcctcgggacagggtggtgccgttgcgtgcattccccagctgcagccacgagaaacaatttggagcggaacccgggctctgacctcccctcatyctcagccttcccccagggatgggccgtgagatgaatgtggtcaccggcccaatccaggggtctatggccaaaccgcagacccggaggaagcaggccaggc

SEQ ID NO: 53336 - DNA, 201 bp, Homo sapiens
aatgcaaggaagggcgcagccacggggccatccgattggattcgctccctcccgcccggccccagtctccgcagattttctctgcggttgcatttttcatytgagcgtcccttcctcttgactccagtggaatttttctgaccttggctgacaaggtgtgcagccccctccagctcagggcaccctctttggggtgcttgc

SEQ ID NO: 53337 - DNA, 201 bp, Homo sapiens
gaagcaggccaggccatctggggagccggctcccctcctctcctcccctggctcccacaaagctgtctcatccagaagccaggcccgcctgtgagcaaggkgaggctgcaggtgttccttcagcctgaagcgtgtgaaagccaacagcccccaccctggtctccagccgcagccccctccccagactcagggggccaaacc

SEQ ID NO: 53338 - DNA, 201 bp, Homo sapiens
  misc_feature (1)...(201): n = A,T,C or G, or insertion/deletion polymorphism (see Tables 1-2)
gtagagacagggtttcgccatgttggtcaggctggtctcgaactcccaacctcaggtgatccacacacctcggcctcccaaagtgctgggattacaaggcntgagccaccgtgcccggccccctggacctctgaccatcagtttcatgtgaccactgggaggctggcccagggagcttcagggactctccaattagcaaac

SEQ ID NO: 53339 - DNA, 201 bp, Homo sapiens
ttgcttccttaccctggggtcggattgctcccttttaaaatccattaatgcaaggaagggcgcagccacggggccatccgattggattcgctccctcccgyccggccccagtctccgcagattttctctgcggttgcatttttcatttgagcgtcccttcctcttgactccagtggaatttttctgaccttggctgacaag

SEQ ID NO: 53340 - DNA, 201 bp, Homo sapiens
gttgcttccttaccctggggtcggattgctcccttttaaaatccattaatgcaaggaagggcgcagccacggggccatccgattggattcgctccctcccrcccggccccagtctccgcagattttctctgcggttgcatttttcatttgagcgtcccttcctcttgactccagtggaatttttctgaccttggctgacaa

SEQ ID NO: 53341 - DNA, 201 bp, Homo sapiens
tggccaggccccgttgtcactggggagtggcctggcctgttcactcacccagctccagtctgcaccaccgtcgctccacttggggttgtcactgcctgagkttaggacgtcagcagaagccagcctcatgtggcagaggcgatggggaattacagcctgcaaaggctgatggcatcagagagattcaggaaagcaaagggc

SEQ ID NO: 53342 - DNA, 201 bp, Homo sapiens
agggacagtgctgtcctgtggccaggccccgttgtcactggggagtggcctggcctgttcactcacccagctccagtctgcaccaccgtcgctccacttgkggttgtcactgcctgaggttaggacgtcagcagaagccagcctcatgtggcagaggcgatggggaattacagcctgcaaaggctgatggcatcagagaga

SEQ ID NO: 53343 - DNA, 201 bp, Homo sapiens
ttggcacagagcttcagggccagagggtgcctctaatccagtagctgaggaaagctttcagtggtgctctgggcacctctgtgacctgccctgggcccagycctcatgctgatcccactgtagccaccctactcagtgccccaggccctggacacctcaggccatgggatatcccaagcattcaaactctcacggccacct

SEQ ID NO: 53344 - DNA, 201 bp, Homo sapiens
gccccagccctggagccagccacagactcctgggttctgcttccctgggagcttccaggggagtgtcactggggctcacgataccgaccccttctgggatsagtggccccttgcttttggcacagagcttcagggccagagggtgcctctaatccagtagctgaggaaagctttcagtggtgctctgggcacctctgtgac

SEQ ID NO: 53345 - DNA, 201 bp, Homo sapiens
tgatgctgtctcagaaactgaaaaaaatacttccctctctctgttgcaccagcatctttcaccatatatagacacacacgcacacaatgcacacacacacrcacacacacatgcacacatgtacacatatgcacgcagaagcacacacatgcacacactttttctctctctctgaatggtgcttcttcttttcatttgtgc

SEQ ID NO: 53346 - DNA, 201 bp, Homo sapiens
gctgtctcagaaactgaaaaaaatacttccctctctctgttgcaccagcatctttcaccatatatagacacacacgcacacaatgcacacacacacgcacrcacacatgcacacatgtacacatatgcacgcagaagcacacacatgcacacactttttctctctctctgaatggtgcttcttcttttcatttgtgcaagg

SEQ ID NO: 53347 - DNA, 201 bp, Homo sapiens
ttgcaccagcatctttcaccatatatagacacacacgcacacaatgcacacacacacgcacacacacatgcacacatgtacacatatgcacgcagaagcayacacatgcacacactttttctctctctctgaatggtgcttcttcttttcatttgtgcaaggtgcagaagtggcctaagagataggtgctaggctgtgcct

SEQ ID NO: 53348 - DNA, 201 bp, Homo sapiens
cctatgggggcgaggcctccagcacctgccaacgccaggtggcaggtgctgatggtcacattggcttttcctcagggagatgtgctcatcacctcctgcaygtacaacacggaagaccgggagctggccacagtggtaagtcacccccgcttccccctgcacctgcccagggcgagtgttcagcctgagccatctgaggaa

SEQ ID NO: 53349 - DNA, 201 bp, Homo sapiens
catccctcagcgccaggaactcaggtccatgtcacagccctattctttgtgttttaatccaatgtggattcacctgatgtttactgagcccagactgccastggtttattttattttattttatattttatttttttttgagacggagtctcgctctgtcacccaggctgtgtgttctcagcttgctgcaacctccacctc

SEQ ID NO: 53350 - DNA, 201 bp, Homo sapiens
ctcagcttgctgcaacctccacctcccgagttcaaccgattctcctgcctcagcctcctgaatagctgggactacaggcacccaccaccacgcctggctartttttgtatttttagtagagatggattttcaccatgttggccaggctggtctcaaactcctcatgtaatccctcatgctgggattacaggcatgagccat

SEQ ID NO: 53351 - DNA, 201 bp, Homo sapiens
ccagctttgacgcagggccagggctcttctgtgccatcggcagatgggagttccatgccctcttctttgcccagaccacaccctgcaggttgtcaccgtcytgcaggctgatttccagcttaggttcctttgaacgtggaagaagaacatcaaagcacttatgaaacaatctgagcacagaactcaagttgtttacgagtt

SEQ ID NO: 53352 - DNA, 201 bp, Homo sapiens
ttcaaccgattctcctgcctcagcctcctgaatagctgggactacaggcacccaccaccacgcctggctaatttttgtatttttagtagagatggattttsaccatgttggccaggctggtctcaaactcctcatgtaatccctcatgctgggattacaggcatgagccatagcacccagccagtgtttgtattttcacag

SEQ ID NO: 53353 - DNA, 201 bp, Homo sapiens
atgccgtgcgggctaatgagccaataaagctcacacttgggctggcacccactggaggtgggtatgtttgcactccgggccgtcgctccaggagagagaascttgctcctgagcctcctccctgtgccaggcgtggtaccaagtgcttccccctgagcgtcctgaagctgcctcagctggcctgggtgggtctccccttcc

SEQ ID NO: 53354 - DNA, 201 bp, Homo sapiens
catagcacccagccagtgtttgtattttcacaggtgagacataaaggctcagagagggcaggcacttgaccaaagtcacacagctgatagatggctgagcygggatttgacccagggtcttgtgcctcacagctgttaccccacccttcctgtctcccttggatttcaggtgacaagtgtcctaggttcctgatcacaaac

SEQ ID NO: 53355 - DNA, 201 bp, Homo sapiens
agttctgtggcttccctggcccatgtcgtcctcttggcagtggccacatcacagcaccaggtgggatcaaaggggagggcagctccccaggtggacctgarcttctcacactctgacaagccctcgcctgctgatccaagacacagtggcctttgaaattcgatttccttccccaggtgaaagaggagaacagattctaca

SEQ ID NO: 53356 - DNA, 201 bp, Homo sapiens
agtgtgacggtgccagcagacactaggagaggagggcgcttgtatttcctgtggccactgtaacaaatgaccaaaaactctgaggcttaaaacaacacgatttttttttttttacagttctggaggtcagaagctctaaaatcaaggtgtctgcagagctggctccttttgggggctctgggaggggaatctgttcccacc

SEQ ID NO: 53357 - DNA, 201 bp, Homo sapiens
ttgtgggggattttatctaaaataagttccttatttagaggcttaggggaagtgctttgttacctgaaaatgacctacatgccccaagccaaagggactcygggctcgcccaccttccgaatgattggggtgtgagtccagcagcccaggttgctattcctgcccctgctgtgtgaccctgagttagttactttccttccc

SEQ ID NO: 53358 - DNA, 201 bp, Homo sapiens
ctgaggaaagctttcagtggtgctctgggcacctctgtgacctgccctgggcccagtcctcatgctgatcccactgtagccaccctactcagtgccccagrccctggacacctcaggccatgggatatcccaagcattcaaactctcacggccacctacgcttatgagcagaggcagaggcatggtgccaccgctgcctcc

SEQ ID NO: 53359 - DNA, 201 bp, Homo sapiens
gttggagggaagggcaggtgtaaacaactctggccatctgtttgagcctgcaatccattaatagatgccaaatagacaaatacggaatctaagaaaacagmacagctggctgtttgccagatgaggaaactaaggcccggagacggggagtggatgtacccaggggttcggggtgtgctggggcagacctggtgccagaag

SEQ ID NO: 53360 - DNA, 201 bp, Homo sapiens
ccagatgccaagttccaaatacagggagaggtgtgtgcataaacagggaggtggtagtaaagcagggcatattccaggacacaggcgctccggcctggccrgagtgcagggacgggaaggggagctggggcagctgctgttggatcacccatacctgagggtggagtgagcagggtcagcttttagcatggcaaggccagg

SEQ ID NO: 53361 - DNA, 201 bp, Homo sapiens
agggttttgtgtacaggtggtcccagggctggctggcggtggggccagtgttgaggcctccacaggctgagacgatgggggtctccccagctcttacaccygtctagagaaggggttttgggggaaggctcagccctaggcaccagctcctctccccaactccctgacccgagtctcacaggatgttcctggggcgtgtaa

SEQ ID NO: 53362 - DNA, 201 bp, Homo sapiens
ggcgtgtaatgagctgcctgtcaggaggaagcatcgctctaatcctgctgcgccccctccaccacccctgaggctcaggccccaacagttgactgggtttkcccctgcccagacctggggccctctcaggacacacccgtctgtctgacaccttgccccacacaggcattttactacccagaggaagccggccttgccttc

SEQ ID NO: 53363 - DNA, 201 bp, Homo sapiens
ctacccagaggaagccggccttgccttcgggggtccagggtcctccagatatctccgcctggaagttcactaccacaacccactggtgatagaaggtaggsggctctgctgccatcctcctcagaagccctaggactcagctgtgttgagccagtgagcaaatcccgcccttcgtctgcccagcatggtgcccccgctgta

SEQ ID NO: 53364 - DNA, 201 bp, Homo sapiens
cccagaggaagccggccttgccttcgggggtccagggtcctccagatatctccgcctggaagttcactaccacaacccactggtgatagaaggtaggcggytctgctgccatcctcctcagaagccctaggactcagctgtgttgagccagtgagcaaatcccgcccttcgtctgcccagcatggtgcccccgctgtacag

SEQ ID NO: 53365 - DNA, 201 bp, Homo sapiens
tcactaccacaacccactggtgatagaaggtaggcggctctgctgccatcctcctcagaagccctaggactcagctgtgttgagccagtgagcaaatcccrcccttcgtctgcccagcatggtgcccccgctgtacagctcctcttggcacgaggcccttgcgtctgcctcatccgctgtccatcttccatggctgtggtg

SEQ ID NO: 53366 - DNA, 201 bp, Homo sapiens
ttttcattgttgtttgtttttttacttaaacttcatcagaagcctcttccctgtgaattaaaaccccttgtcaatttcacactccttgccgcctgacatcsctttcctgtacataacccagggggcagagcctcctgctgcacagcccctccagaccaccccgccatgtccgccatgtccaccatgtccaccatgcatccg

SEQ ID NO: 53367 - DNA, 201 bp, Homo sapiens
cagtctgaagctgcgagctggttttttcctccttatctgagacccactggtattcgaaggcatctaatttatcctgggcccactgggctgtggtcaggagsccagggcctatgcagagttagtcgcgtaaggtgccgcagcctggagatccaggaagatccttcccagaagcatttgggagccagattaactgctaagtca

SEQ ID NO: 53368 - DNA, 201 bp, Homo sapiens
tgggctgtggtcaggaggccagggcctatgcagagttagtcgcgtaaggtgccgcagcctggagatccaggaagatccttcccagaagcatttgggagccrgattaactgctaagtcaaacatcctcagcaccaagggaaggaagggctaatactggcttgctgagaatagtgtggggtggacgtctgatggggttgaaaa

SEQ ID NO: 53369 - DNA, 201 bp, Homo sapiens; identical to SEQ ID NO: 10134

SEQ ID NO: 53370 - DNA, 201 bp, Homo sapiens
tcagtgttgagagaagtggggcgaccccaggctccagccagcataggggtgcctgcccgactgggtcccagagcacaccagggctgtgctttctggtggcygctagcctcatgtggctacttacgattaattttaaattaattaaaatgatacaaggtcgggtgctgtggctcatgcctgtaatcccagcactttgggagg

SEQ ID NO: 53371 - DNA, 201 bp, Homo sapiens
ttcgtgtccatgtgatcttgagttggacatgggcatctggggtccggcaaagccaaggtctggcagccaatatgacttccaccggacaacacacctcccaycccagcaattccagatgcctgggaaacagcagcaacacggtggcttccccggacccgggcaagcacagcggccagagcagcgccgaggctgggggccaat

SEQ ID NO: 53372 - DNA, 201 bp, Homo sapiens
caatttcacactccttgccgcctgacatccctttcctgtacataacccagggggcagagcctcctgctgcacagcccctccagaccaccccgccatgtccrccatgtccaccatgtccaccatgcatccgggggcatggggccaggcctttagatcctccgccaaccatgagcccagccggtactcagagcctggctgctg

SEQ ID NO: 53373 - DNA, 201 bp, Homo sapiens
aagacatgtcagtgttgtttaacttgaattttctatttgtggacttgaggatcttttcctctgcctcttggccatttgttcctgttttctgttcattcctrtgctcggtttttccagtaggtggtttgtttttcttactgttggtttctaggagttcttcttatatgatggatgttatttcatagtttgtgtatatgttac

SEQ ID NO: 53374 - DNA, 201 bp, Homo sapiens
ctcctgctgcacagcccctccagaccaccccgccatgtccgccatgtccaccatgtccaccatgcatccgggggcatggggccaggcctttagatcctccrccaaccatgagcccagccggtactcagagcctggctgctgattcactaggcatggagtttcaggaacggtggggctacctggatgacacctggttgtgag

SEQ ID NO: 53375 - DNA, 201 bp, Homo sapiens
ggagaccgccttcatcctcactggctactgcacggacaagtgcacccagctggtgagtggggctgggcccggcactgcaccctccctcctcccgcgtcccycagtggaggcctggcaggtcgtggcccacgaagggtggcaggcacagctttggtttcccctgaccctgaatccccctgcggtcctccctcttttctgtat

SEQ ID NO: 53376 - DNA, 201 bp, Homo sapiens
ctggctactgcacggacaagtgcacccagctggtgagtggggctgggcccggcactgcaccctccctcctcccgcgtccctcagtggaggcctggcaggtsgtggcccacgaagggtggcaggcacagctttggtttcccctgaccctgaatccccctgcggtcctccctcttttctgtatgcaagggaaccctgctgctg

SEQ ID NO: 53377 - DNA, 201 bp, Homo sapiens
atcttccatggctgtggtgggctcccagggacaggacctcgaggggctcactcctcacagcttcgccagggcccagcagtggccccacacctccctcctcrtccctataatacgggctgccatcggcgcagcactgtgcatcccaggggaaaggacaaggagaattttcataagggaagctgccagatgccaagttccaaa

SEQ ID NO: 53378 - DNA, 201 bp, Homo sapiens
tctcagaaactgaaaaaaatacttccctctctctgttgcaccagcatctttcaccatatatagacacacacgcacacaatgcacacacacacgcacacacrcatgcacacatgtacacatatgcacgcagaagcacacacatgcacacactttttctctctctctgaatggtgcttcttcttttcatttgtgcaaggtgca

SEQ ID NO: 53379 - DNA, 201 bp, Homo sapiens
tctaatcctgctgcgccccctccaccacccctgaggctcaggccccaacagttgactgggtttgcccctgcccagacctggggccctctcaggacacaccygtctgtctgacaccttgccccacacaggcattttactacccagaggaagccggccttgccttcgggggtccagggtcctccagatatctccgcctggaag

SEQ ID NO: 53380 - DNA, 201 bp, Homo sapiens
tccacagaaccgctgggttgaaggaagctggagggatcaattgtccttgtcatccaacttcctgtgtctgtagatggggaggaggcgctgggttggaaagygcttctctgaggacgccagctgcgcattcaggagggcggagcaggatatgaccccagagctctgaccccggaggagcaggaggggtgcctggggcctcaa

SEQ ID NO: 53381 - DNA, 201 bp, Homo sapiens
cctggacccaccccattcaggaccagggcataaatggccaggtgggaccagagagctcaccccagccatgcccgccctcagtcgctgggccagcctgcccrgccccagcatgcgggaggcagccttcatgtacagcacagcagtggccatcttcctggtcatcctggtggccgcactgcagggctcggctccccgtgagag

SEQ ID NO: 53382 - DNA, 201 bp, Homo sapiens
ttgagatgtgtcatggcccaccagctgcacccccactggcctgggccctggccctgttgtgacccactgggtcacaggagctgatggtttataacttgctygggaacactcagcctgtgaccttcgcacatgaatctgctgggctccttgtagtggacgacagggactgtaccccagaggtgccgtggcatgcacagtggc

SEQ ID NO: 53383 - DNA, 201 bp, Homo sapiens
tgggggctctgagagggcgaccagctgaaccctgtctcggctgcaggacggcactgtccacttggtctacgggatcctggaggagccgttccggtcactgsaggccatcaacggctcgggcctgcagatggggctgcagagggtgcagctcctgaagcccaatatccccgaaccggagttgccctcagacgcgtgcaccat

SEQ ID NO: 53384 - DNA, 201 bp, Homo sapiens; identical to SEQ ID NO: 10112

SEQ ID NO: 53385 - DNA, 201 bp, Homo sapiens
agttgccctcagacgcgtgcaccatggaggtccaagctcccaatatccagatccccagccaggagaccacgtactggtgctacattaaggagcttccaaasggcttctctcggcaccacattatcaaggtacgtgcgggtccagggccgaggtcctcgcccagccctgccttcctcccgggcctgggttgtccctgaccct

SEQ ID NO: 53386 - DNA, 201 bp, Homo sapiens
gcaccatggaggtccaagctcccaatatccagatccccagccaggagaccacgtactggtgctacattaaggagcttccaaagggcttctctcggcaccayattatcaaggtacgtgcgggtccagggccgaggtcctcgcccagccctgccttcctcccgggcctgggttgtccctgaccctggagagctgtccacagtc

SEQ ID NO: 53387 - DNA, 201 bp, Homo sapiens
ttttacagatgggcattcggaagcccatggaggagggctgctggggaggggagggtgggcggccggttcccgggctcagagggctgcctcctcacagtacsagcccatcgtcaccaagggcaatgaggcccttgtccaccacatggaagtcttccagtgcgcccccgagatggacagcgtcccccacttcagcgggccctg

SEQ ID NO: 53388 - DNA, 201 bp, Homo sapiens
caatgaggcccttgtccaccacatggaagtcttccagtgcgcccccgagatggacagcgtcccccacttcagcgggccctgcgactccaagatgaaacccraccgcctcaactactgccgccacgtgctggccgcctgggccctgggtgccaaggtgcgtgccctgcgaccccagcatggtgtctcctgcctgggcccctg

SEQ ID NO: 53389 - DNA, 201 bp, Homo sapiens
tgggtttgcccctgcccagacctggggccctctcaggacacacccgtctgtctgacaccttgccccacacaggcattttactacccagaggaagccggccytgccttcgggggtccagggtcctccagatatctccgcctggaagttcactaccacaacccactggtgatagaaggtaggcggctctgctgccatcctcct

SEQ ID NO: 53390 - DNA, 201 bp, Homo sapiens
ggtttgcccctgcccagacctggggccctctcaggacacacccgtctgtctgacaccttgccccacacaggcattttactacccagaggaagccggccttkccttcgggggtccagggtcctccagatatctccgcctggaagttcactaccacaacccactggtgatagaaggtaggcggctctgctgccatcctcctca

SEQ ID NO: 53391 - DNA, 201 bp, Homo sapiens
ggggacgcgtgtcctcagtctgatgggccgaccacaaacccgagagtgtttgggggagatgagggcactaaggcaggcagtggagccctgatcccacagarggccaagcccaggcctcggtggggacttgcccaagtcctttgagatgtgtcatggcccaccagctgcacccccactggcctgggccctggccctgttgtg

SEQ ID NO: 53392 - DNA, 201 bp, Homo sapiens
gggagatgagggcactaaggcaggcagtggagccctgatcccacagagggccaagcccaggcctcggtggggacttgcccaagtcctttgagatgtgtcawggcccaccagctgcacccccactggcctgggccctggccctgttgtgacccactgggtcacaggagctgatggtttataacttgctcgggaacactcagc

SEQ ID NO: 53393 - DNA, 201 bp, Homo sapiens
ctggtgagcaccgcggacatctcagatggccgttctgcaggttgaggccctcggtgccagcgtccccgtgggcagttctgtggcttccctggcccatgtcstcctcttggcagtggccacatcacagcaccaggtgggatcaaaggggagggcagctccccaggtggacctgagcttctcacactctgacaagccctcgcc

SEQ ID NO: 53394 - DNA, 201 bp, Homo sapiens
gttccttgtccccaccaggttcaacaacgaggatgtctgcacctgccctcaggcgtccgtgtctcagcagttcacctctgttccctggaactccttcaacygcgacgtactgaaggccctgtacagcttcgcgcccatctccatgcactgcaacaagtcctcagccgtccgcttccaggtgcgctgccatgggcccgggtg

SEQ ID NO: 53395 - DNA, 201 bp, Homo sapiens
ctccaccagactcttacccagcagcacgtccctcctgcctgggcctggtgagcgaggggctcaaggggaaactgaggcaggagctggcacttctgtgtggrtgaggagggcaccaatctgaggccccgcccgctccctgcttcggctcctctgtgttcccgggctgccgactctcaggaggctttgccacctgaagaacag

SEQ ID NO: 53396 - DNA, 201 bp, Homo sapiens
ccaccctgttcccaactctcccctttctgaggctccgcaactctcctgcctgcatgaatgtgggcagcattggtctgaggcattgttcccagtcttgaggwggccttgggagcctcaggcatcttcttaagaagctcagtgtcccgcccgccaggcccgggaatgcccatggctaacagaacctgtgacctgctggcaagt

SEQ ID NO: 53397 - DNA, 201 bp, Homo sapiens
ctgcatgaatgtgggcagcattggtctgaggcattgttcccagtcttgaggaggccttgggagcctcaggcatcttcttaagaagctcagtgtcccgcccrccaggcccgggaatgcccatggctaacagaacctgtgacctgctggcaagtgacagccctggttcctggctgcagaggaggaaccaactccactgtcggg

SEQ ID NO: 53398 - DNA, 201 bp, Homo sapiens
ctgaccctgcttttcaagaggccctttggcacctgcgaccccaaggattacctcattgaagtaaggggtggccgcgagtacccaggagggcgtgggctgcktgtatcatgctgccatcctgtgccaatgtcatagtacctttcctgtccctgataagtctggggcctgggcctggccagctatgacagagagaaagccaag

SEQ ID NO: 53399 - DNA, 201 bp, Homo sapiens
ccccactccctatgatgctctcgcgccttctggagcagcagtggtaccagctggaggctgtggaaaaattgagaggagacaaaagtgggaagagcaggccrtggagagagtgtctaaacacagggactatttggagattgtcttatttttggtttgaaatgggcccacctgctagtattgtacaaacggctctgctcgcta

SEQ ID NO: 53400 - DNA, 201 bp, Homo sapiens
gttgccccagggacaggactcgagttgcagggaggtgttgctggtgcccactgggctccctgcccgtcagctgctccccagcctggctgttccttgtcccsaccaggttcaacaacgaggatgtctgcacctgccctcaggcgtccgtgtctcagcagttcacctctgttccctggaactccttcaaccgcgacgtactga

SEQ ID NO: 53401 - DNA, 201 bp, Homo sapiens
agaattgcttgacctgggaggtggaggttgtagtgagctgagatcacaccactgtactccagcttgggcaacagagtaaaaccctgtctcaaaaaaaaaamaacaacaacaaaaaaaaacaaaatggaacctttctgcgtcccattcatacccccaacttttcacatggcccaaggctgtctcactgcacactgtggtata

SEQ ID NO: 53402 - DNA, 201 bp, Homo sapiens
cggtcaccagctccaagagcagcaacccagcgaggggcttaaagctggcagtggggactcagagggtgcctgccctgcccctcccatgcgatggcaggccrtagggttgccgtgagaggctggaggttgtcgcggcctctagtcacggtcctgtcttatagagtccctgctcccctcagagccacgttggagaaatgactg

SEQ ID NO: 53403 - DNA, 201 bp, Homo sapiens
ggtcgtggcccacgaagggtggcaggcacagctttggtttcccctgaccctgaatccccctgcggtcctccctcttttctgtatgcaagggaaccctgctrctgagaggccatttgtgtgtgtatgcacctccctctccagcaataaccatggctcccactagtccacacccacgtgccaggcttccacgagctgcatttt

SEQ ID NO: 53404 - DNA, 201 bp, Homo sapiens
gcagccacgtgatgcatcacgcagcggggctgcttccgggagccaaaggggatgctgttcacaattacctgggtcccaggcacaagccagggctgtcctgscaaatgggccaccttgccagtggatccgtgccagctgcttcggtaaccatggtggtctccaataattatcctgtgaattgtgtggctcaagtggagcaga

SEQ ID NO: 53405 - DNA, 201 bp, Homo sapiens
tgatgcatcacgcagcggggctgcttccgggagccaaaggggatgctgttcacaattacctgggtcccaggcacaagccagggctgtcctggcaaatgggmcaccttgccagtggatccgtgccagctgcttcggtaaccatggtggtctccaataattatcctgtgaattgtgtggctcaagtggagcagacctgggtta

SEQ ID NO: 53406 - DNA, 201 bp, Homo sapiens
gtacctttcctgtccctgataagtctggggcctgggcctggccagctatgacagagagaaagccaaggaggatggccagaggcagtggtggggccaaagcmcttaggatggtccagctctgctattgcccctgagccctcaaagacgcagctctttgccaacacgtagctgacatggtttctagatgcggggcttgtgctg

SEQ ID NO: 53407 - DNA, 201 bp, Homo sapiens
aggactaccagctgctgcaggtgcagaggaccccagaaggcctgaccctgcttttcaagaggccctttggcacctgcgaccccaaggattacctcattgargtaaggggtggccgcgagtacccaggagggcgtgggctgcgtgtatcatgctgccatcctgtgccaatgtcatagtacctttcctgtccctgataagtct

SEQ ID NO: 53408 - DNA, 201 bp, Homo sapiens
aaaaaaaaaatccaaaattacatgtatttataaagtaataaagcagtgcttgttctcagggttgtgccagtgcagggtgggcacctgctatcaatcaccaycttagatgtggcaccctggtttctctctcctttcctgttcatgtcccaccctgttcccaactctcccctttctgaggctccgcaactctcctgcctgcat

SEQ ID NO: 53409 - DNA, 201 bp, Homo sapiens
tgcctcatccgctgtccatcttccatggctgtggtgggctcccagggacaggacctcgaggggctcactcctcacagcttcgccagggcccagcagtggcsccacacctccctcctcgtccctataatacgggctgccatcggcgcagcactgtgcatcccaggggaaaggacaaggagaattttcataagggaagctgcc

SEQ ID NO: 53410 - DNA, 201 bp, Homo sapiens
cctgttgccagctcgctgtgaggctcgggacaactgcccccctcctctggacctcactttgcccatctgtaaaatggagatgggaactagatgatctgtayggcctgaccaactctgggagttcatgggagccataaaacattgcaaaagccataggcttcttatgctgctctaagagccccccaacctcttagggaaagc

SEQ ID NO: 53411 - DNA, 201 bp, Homo sapiens
aaccctctggaagcacctcacagggggaggccaatgcctgtgtgtgctcagcccagtggccccaggccaggtataggggcctttgcctggagttctgggcrtcccctgcacagggcggcccatcggctttccgcaaactcaaagagcaaattagccacccacacgggtctgcactgtggagtgcccagaaagctatgaaag

SEQ ID NO: 53412 - DNA, 201 bp, Homo sapiens
gggttggtggagggaacaaatgttccggccacactggctcacggcgggcccagtagtcactggttgaatggatgttaagtgaatgtaggtggaatgtgttkagaagagaaaagtatttgatggccggtgcaaataggggatcctgggggtcgtcagcccgggatttggccccagccagggccatgcaagcctcaagggtcc

SEQ ID NO: 53413 - DNA, 201 bp, Homo sapiens
ctcaactactgccgccacgtgctggccgcctgggccctgggtgccaaggtgcgtgccctgcgaccccagcatggtgtctcctgcctgggcccctggcatcyccacacctctgtttccccagcttcaccgtctcagaggcttcaagaaggggctcccaagggggctcacgaggccaccagaagggccaggcctgaggtggcc

SEQ ID NO: 53414 - DNA, 201 bp, Homo sapiens
acacacaggcagttatcagggggaagagaaggtgggcagaggagccaccccatctcaaggcagcgtgcagggcagagcctaagagagggtcctcctgcaagggccagacaaggaggagggcatgggcaggaaccgcgtccaaatcaacagcaaagacaaaggtcacctagaaagggggactccaccagactcttacccagc

SEQ ID NO: 53415 - DNA, 201 bp, Homo sapiens
caacccagcctgcagcagccattacccacccgccaaggtgacaggagaggtgaggccgttgccggtgaaggcagcatctggggtggcctggcggaggcagyggggctggggaggaggtggcaggacggttgccccagggacaggactcgagttgcagggaggtgttgctggtgcccactgggctccctgcccgtcagctgc

SEQ ID NO: 53416 - DNA, 201 bp, Homo sapiens; identical to SEQ ID NO: 10126

SEQ ID NO: 53417 - DNA, 201 bp, Homo sapiens
ggggagcagagtgagttcagtttgagacaagctgagtttgagggcaagaatccaagaggtggctgggaagtggctggggaagcagccacccatcttgcccytccagcctcagtttacctcctgcccccttccttgcagggtgaatggaacctgcagcccctgcccaaggtcatctccacactggaagagcccaccccacag

SEQ ID NO: 53418 - DNA, 201 bp, Homo sapiens
atccaagaggtggctgggaagtggctggggaagcagccacccatcttgcccctccagcctcagtttacctcctgcccccttccttgcagggtgaatggaayctgcagcccctgcccaaggtcatctccacactggaagagcccaccccacagtgccccaccagccagggccgaagccctgctggccccaccgttgtcagca

SEQ ID NO: 53419 - DNA, 201 bp, Homo sapiens
acgagaaacaggagggaaaaggaaggaagggagggaggaggctggggaggagggacagcttctagtccagctggagagatctgtcaacccagcctgggggktggagctggagggatcaagcagaatgtcctgaaggcagctgccctcagtctacttgcgggagaggacaggagggagaggtgccgtggtgagactgaccct

SEQ ID NO: 53420 - DNA, 201 bp, Homo sapiens
ccagaaggcctgaccctgcttttcaagaggccctttggcacctgcgaccccaaggattacctcattgaagtaaggggtggccgcgagtacccaggagggcrtgggctgcgtgtatcatgctgccatcctgtgccaatgtcatagtacctttcctgtccctgataagtctggggcctgggcctggccagctatgacagagag

SEQ ID NO: 53421 - DNA, 201 bp, Homo sapiens
cgaacaggaggcagggctggtatgggtgcaggtgccaaccccgactgtgccgcctctcggctaagcacctgtgcagtgactgagtgggctcgcaaacagakggctctgcaggtggagcaccccaggcaagtccccaccatcagccccattctgcaggcgcggccccggggccagggatgggagggtcttgccgggcatcca

SEQ ID NO: 53422 - DNA, 201 bp, Homo sapiens
ctgcgaccccaaggattacctcattgaagtaaggggtggccgcgagtacccaggagggcgtgggctgcgtgtatcatgctgccatcctgtgccaatgtcayagtacctttcctgtccctgataagtctggggcctgggcctggccagctatgacagagagaaagccaaggaggatggccagaggcagtggtggggccaaag

SEQ ID NO: 53423 - DNA, 201 bp, Homo sapiens
gctaagcacctgtgcagtgactgagtgggctcgcaaacagagggctctgcaggtggagcaccccaggcaagtccccaccatcagccccattctgcaggcgyggccccggggccagggatgggagggtcttgccgggcatccagcgaggagactgcatattccctgcccaatctggcttcacggcggcggaactgacgccac

SEQ ID NO: 53424 - DNA, 201 bp, Homo sapiens
acaggcctggagcacctgctgctaacaacaagcaaaattacaaaacaaaactttaaaaaccaggttgaggaggcagaggtgcggggacctgggagggcctygtcagaaatgtggctgtcacatggagcccaggggagaggggaggaggtgaaggaaggctctgtgcaggggctgcgtgcgggaaggcccagaggaccaaga

SEQ ID NO: 53425 - DNA, 201 bp, Homo sapiens
tgaatctaatgccctccctggccagaagccacacttagcgggctctggcttccactgtagaggctggggcaaaatggacacccccagaggtcagggaggcytgagggaggacacagtggccgggggtctggtctgcagctctctgaggtctcctctcccccacccctcggctctgcctgccccaggagatccgcatgttga

SEQ ID NO: 53426 - DNA, 201 bp, Homo sapiens
ccctgagaggcttcaaattcaggccagatctgctctgggcaagaggaagctgtgggtttgggagcttcagagacaggggagcaggcctgtcactcaccctsttttccttaaaggctgtcacccccagcagtgcaccctgcagcctgcctatcccctgtgcagctccagctccgtctgtccccagcaatgcaccccacgccc

SEQ ID NO: 53427 - DNA, 201 bp, Homo sapiens
agagtgtctaaacacagggactatttggagattgtcttatttttggtttgaaatgggcccacctgctagtattgtacaaacggctctgctcgctaggccakgcctgcagtggctacgggcctatccttcactggtcagcctggagcagctcctcggacctcagtctgctcatccgtgggtagaggcgacgcagaccccatc

SEQ ID NO: 53428 - DNA, 201 bp, Homo sapiens
accctcagatccacagggactgaggcccagcatccccagatcagctggcaatgaatgcggagctctgccggggaatgccctcttcccctgtggattggccyggcttggctccttcatgcctggagcccagtgcttgtctctgcaggacgcctggagtgaccagaaggggcagatccacctggatccccagcaggactacca

SEQ ID NO: 53429 - DNA, 201 bp, Homo sapiens
gctgcaggtgcagaggaccccagaaggcctgaccctgcttttcaagaggccctttggcacctgcgaccccaaggattacctcattgaagtaaggggtggcygcgagtacccaggagggcgtgggctgcgtgtatcatgctgccatcctgtgccaatgtcatagtacctttcctgtccctgataagtctggggcctgggcct

SEQ ID NO: 53430 - DNA, 201 bp, Homo sapiens
agggcgtgggctgcgtgtatcatgctgccatcctgtgccaatgtcatagtacctttcctgtccctgataagtctggggcctgggcctggccagctatgacrgagagaaagccaaggaggatggccagaggcagtggtggggccaaagcacttaggatggtccagctctgctattgcccctgagccctcaaagacgcagctc

SEQ ID NO: 53431 - DNA, 201 bp, Homo sapiens
tattcacagagatgagagtgaggtgtgtcacctggtaggtgtgggtgggcagggatgtggcatcctctcaggagcccaactctgggggctctgagagggcraccagctgaaccctgtctcggctgcaggacggcactgtccacttggtctacgggatcctggaggagccgttccggtcactggaggccatcaacggctcgg

SEQ ID NO: 53432 - DNA, 201 bp, Homo sapiens
gcaatgaatgcggagctctgccggggaatgccctcttcccctgtggattggcccggcttggctccttcatgcctggagcccagtgcttgtctctgcaggamgcctggagtgaccagaaggggcagatccacctggatccccagcaggactaccagctgctgcaggtgcagaggaccccagaaggcctgaccctgcttttca

SEQ ID NO: 53433 - DNA, 201 bp, Homo sapiens
caggacccaccaccatcctggcagtgtggtcccttcagaaaagctgaaaatgcaaaaatcaggcacatgcacctccccccatgagctgctcaagagagagragcagtcacgcatccttatggagaaaaggagaagcaggacccagaaagggtttccctgtaagattcctcagggcccagcaggcctcagccccaagattga

SEQ ID NO: 53434 - DNA, 201 bp, Homo sapiens
tgaatggatgttaagtgaatgtaggtggaatgtgtttagaagagaaaagtatttgatggccggtgcaaataggggatcctgggggtcgtcagcccgggatktggccccagccagggccatgcaagcctcaagggtcccttattcacagagatgagagtgaggtgtgtcacctggtaggtgtgggtgggcagggatgtggca

SEQ ID NO: 53435 - DNA, 201 bp, Homo sapiens
agggactgaggcccagcatccccagatcagctggcaatgaatgcggagctctgccggggaatgccctcttcccctgtggattggcccggcttggctccttmatgcctggagcccagtgcttgtctctgcaggacgcctggagtgaccagaaggggcagatccacctggatccccagcaggactaccagctgctgcaggtgc

SEQ ID NO: 53436 - DNA, 201 bp, Homo sapiens
tgagtgtagcctgtttgcgttaattgatcttgcgagctgcctggcatccacaggtgtggaaacaaagacagccagctcttggtctgcctagcaggtgggarcagatggggggtgaccggccctgcctcctggctgagggtggctggggtcatagggataatctgtccgcagggggaagtgagagggcctccacttaccgct

SEQ ID NO: 53437 - DNA, 201 bp, Homo sapiens
tgggctccttgtagtggacgacagggactgtaccccagaggtgccgtggcatgcacagtggcgtggtcctatgggggcgaggcctccagcacctgccaacrccaggtggcaggtgctgatggtcacattggcttttcctcagggagatgtgctcatcacctcctgcacgtacaacacggaagaccgggagctggccacagt

SEQ ID NO: 53438 - DNA, 201 bp, Homo sapiens
ctacctcatggggagactcactcaggagttcatggagagacgttggaaagagtggagcagacaggacactcccaggggacgcgtgtcctcagtctgatggrccgaccacaaacccgagagtgtttgggggagatgagggcactaaggcaggcagtggagccctgatcccacagagggccaagcccaggcctcggtggggac

SEQ ID NO: 53439 - DNA, 201 bp, Homo sapiens
gggaacactcagcctgtgaccttcgcacatgaatctgctgggctccttgtagtggacgacagggactgtaccccagaggtgccgtggcatgcacagtggcrtggtcctatgggggcgaggcctccagcacctgccaacgccaggtggcaggtgctgatggtcacattggcttttcctcagggagatgtgctcatcacctcc

SEQ ID NO: 53440 - DNA, 201 bp, Homo sapiens
ccagcggatgttgacccctgctcaaggttgagaagcactcacaccaagaagcttctcagcacccggggctggtgtggggagaagctgtaggacaagaggtygacctttgccccgtggagctcaaggtgcaccagggagacaggcctggagcacctgctgctaacaacaagcaaaattacaaaacaaaactttaaaaaccag

SEQ ID NO: 53441 - DNA, 201 bp, Homo sapiens
tatggagaaaaggagaagcaggacccagaaagggtttccctgtaagattcctcagggcccagcaggcctcagccccaagattgaggccaaattattggaggggtgtgtgtgtgtgtgtgtgtgtgtaaaactgagtatgtgagcatgagcccagagctgggggtgcaggccacgcaggtgtgagagtccacctccccatct

SEQ ID NO: 53442 - DNA, 201 bp, Homo sapiens
gccgacacctggcatctctgggccagggtcggcctctgggggccaaaggggcattgggaccctttgggctcccaggcctggcacacaatggcctctcaagycattgcaagggacacaaagctataggcgacggcaaggtcagggcggccgctgcttgggagcgagagggaaggagcaaaagtgagtcctaaaaagctcggc

SEQ ID NO: 53443 - DNA, 201 bp, Homo sapiens
ggagaaaaggagaagcaggacccagaaagggtttccctgtaagattcctcagggcccagcaggcctcagccccaagattgaggccaaattattggaggggtgtgtgtgtgtgtgtgtgtgtgtaaaactgagtatgtgagcatgagcccagagctgggggtgcaggccacgcaggtgtgagagtccacctccccatctcgc

SEQ ID NO: 53444 - DNA, 201 bp, Homo sapiens
agagtcacacagcaggaagaggcatggccttgaaggtgcgctttgggcccgggctctaacctcagggctgccctgcctcccactggggctgcaggagctgkcccggccacagccccatatgcatgaggacggctgcgtcctgtccctgccttggcaggaaatggcctgtacgaacctcatttccttcactctggagctgcc

SEQ ID NO: 53445 - DNA, 201 bp, Homo sapiens
ctcagggctgccctgcctcccactggggctgcaggagctggcccggccacagccccatatgcatgaggacggctgcgtcctgtccctgccttggcaggaartggcctgtacgaacctcatttccttcactctggagctgcctacgggatttctttctgggctgatggctccaccctcaaggctgtgaaccccagaagtgcc

SEQ ID NO: 53446 - DNA, 201 bp, Homo sapiens
cagcctcagtttacctcctgcccccttccttgcagggtgaatggaacctgcagcccctgcccaaggtcatctccacactggaagagcccaccccacagtgycccaccagccagggccgaagccctgctggccccaccgttgtcagcattggtgggggcaaaggctgaggggggacctactcctccccctcctccatgctgt

SEQ ID NO: 53447 - DNA, 201 bp, Homo sapiens
ggcagtgtggtcccttcagaaaagctgaaaatgcaaaaatcaggcacatgcacctccccccatgagctgctcaagagagaggagcagtcacgcatccttayggagaaaaggagaagcaggacccagaaagggtttccctgtaagattcctcagggcccagcaggcctcagccccaagattgaggccaaattattggagggg

SEQ ID NO: 53448 - DNA, 201 bp, Homo sapiens
cctaaggctagattctgggtttctccagagagacgagaaacaggagggaaaaggaaggaagggagggaggaggctggggaggagggacagcttctagtccrgctggagagatctgtcaacccagcctggggggtggagctggagggatcaagcagaatgtcctgaaggcagctgccctcagtctacttgcgggagaggaca

SEQ ID NO: 53449 - DNA, 201 bp, Homo sapiens
cctgcctatcccctgtgcagctccagctccgtctgtccccagcaatgcaccccacgcccatgtcccccactccctatgatgctctcgcgccttctggagcmgcagtggtaccagctggaggctgtggaaaaattgagaggagacaaaagtgggaagagcaggccgtggagagagtgtctaaacacagggactatttggaga

SEQ ID NO: 53450 - DNA, 201 bp, Homo sapiens
agaaaaggagaagcaggacccagaaagggtttccctgtaagattcctcagggcccagcaggcctcagccccaagattgaggccaaattattggaggggtgtgtgtgtgtgtgtgtgtgtgtaaaactgagtatgtgagcatgagcccagagctgggggtgcaggccacgcaggtgtgagagtccacctccccatctcgctg

SEQ ID NO: 53451 - DNA, 201 bp, Homo sapiens
aaggccaggcagggcagggaagcagcttcgtttggacaattctggtgggctctgggtggctggggtggtctctagttgcctggttcctggccctagggtgwtttagggttggggcaatattggcctggggtgtgagagtcaggtggaggaggtagctagggatatgggcttggtgtgggtcggaatgttaggaatatgatt

SEQ ID NO: 53452 - DNA, 201 bp, Homo sapiens
tggggcaatattggcctggggtgtgagagtcaggtggaggaggtagctagggatatgggcttggtgtgggtcggaatgttaggaatatgattctcacacamgcgtgaatgttggagggcaggacaggtgtaaacaactctgaccatctgtttgagccttcaatcaattaatagatgccaaatagacaaatatggaatctaa

SEQ ID NO: 53453 - DNA, 201 bp, Homo sapiens
gcctacccgacttgcagggatctggacgtggccattgggggacatccctctgtctgtcacaccacacgccagaagctcagagagattccagggagggaggyggattctcatgttctccgagaccctcctgggccagagccctgcctgttggaccctgtgatgtcagtgggtgcagcagcccccgagatggatgcgggtgag

SEQ ID NO: 53454 - DNA, 201 bp, Homo sapiens
gggcaatattggcctggggtgtgagagtcaggtggaggaggtagctagggatatgggcttggtgtgggtcggaatgttaggaatatgattctcacacacgygtgaatgttggagggcaggacaggtgtaaacaactctgaccatctgtttgagccttcaatcaattaatagatgccaaatagacaaatatggaatctaaga

SEQ ID NO: 53455 - DNA, 201 bp, Homo sapiens
caaagctgtctcatccagaagccaggcccgcctgtgagcaaggggaggctgcaggtgttccttcagcctgaagcgtgtgaaagccaacagcccccaccctkgtctccagccgcagccccctccccagactcagggggccaaacccacttttcacagccatctgtaacccaaacgtctgcccacagctttgttcgagctcag

SEQ ID NO: 53456 - DNA, 201 bp, Homo sapiens
cagaaactgaaaaaaatacttccctctctctgttgcaccagcatctttcaccatatatagacacacacgcacacaatgcacacacacacgcacacacacaygcacacatgtacacatatgcacgcagaagcacacacatgcacacactttttctctctctctgaatggtgcttcttcttttcatttgtgcaaggtgcagaa

SEQ ID NO: 53457 - DNA, 201 bp, Homo sapiens
cccaggcctccatgtgcgctgtggcagacaatgccagtcgatcacctctctttcctgacccagacacagcctcatgctcttcagccaagtgccccagggargcccgccaccgatcagtcaagcctggagtaaaagatgaagcctatttgcttcgctgttttcacgtggggcttatcaagtatttactaagcaccttctaga

SEQ ID NO: 53458 - DNA, 201 bp, Homo sapiens
agaaactgaaaaaaatacttccctctctctgttgcaccagcatctttcaccatatatagacacacacgcacacaatgcacacacacacgcacacacacatgcacacatgtacacatatgcacgcagaagcacacacatgcacacactttttctctctctctgaatggtgcttcttcttttcatttgtgcaaggtgcagaag

SEQ ID NO: 53459 - DNA, 201 bp, Homo sapiens
gtagcatttgcccatttccatggtgcaaatgctctggacagccctgatggagggggcaggagacgtgcaccggccgctctgggtgcatcgactggttcccsggctgcctgtctggatgccgtttaacctcggaacctcggcttccctggtcacgttggttatggacccatccctgactccggagaaaggcgagcattactg

SEQ ID NO: 53460 - DNA, 201 bp, Homo sapiens
ctgttctcccacctcccacagctattgtgaagctgggaaaggctcacgcacagaacttgctgtgggcacggggctgtgctcagctaacagtcgcctgtggttttttttttttttcctggctgcataagtaataccttccgccactgttggagttatctccacatgcacagagaagggtataagtcagcttgggccttagca

SEQ ID NO: 53461 - DNA, 201 bp, Homo sapiens
aggggcttaaagctggcagtggggactcagagggtgcctgccctgcccctcccatgcgatggcaggccgtagggttgccgtgagaggctggaggttgtcgyggcctctagtcacggtcctgtcttatagagtccctgctcccctcagagccacgttggagaaatgactggtggacggtgcggggctgcagtggaaagggcc

SEQ ID NO: 53462 - DNA, 201 bp, Homo sapiens
tgttctcccacctcccacagctattgtgaagctgggaaaggctcacgcacagaacttgctgtgggcacggggctgtgctcagctaacagtcgcctgtggttttttttttttttcctggctgcataagtaataccttccgccactgttggagttatctccacatgcacagagaagggtataagtcagcttgggccttagcat

SEQ ID NO: 53463 - DNA, 201 bp, Homo sapiens
tgccccagggacaggactcgagttgcagggaggtgttgctggtgcccactgggctccctgcccgtcagctgctccccagcctggctgttccttgtccccascaggttcaacaacgaggatgtctgcacctgccctcaggcgtccgtgtctcagcagttcacctctgttccctggaactccttcaaccgcgacgtactgaag

SEQ ID NO: 53464 - DNA, 201 bp, Homo sapiens
tccccagcctggctgttccttgtccccaccaggttcaacaacgaggatgtctgcacctgccctcaggcgtccgtgtctcagcagttcacctctgttccctsgaactccttcaaccgcgacgtactgaaggccctgtacagcttcgcgcccatctccatgcactgcaacaagtcctcagccgtccgcttccaggtgcgctgc

SEQ ID NO: 53465 - DNA, 201 bp, Homo sapiens
taaaaccccttgtcaatttcacactccttgccgcctgacatccctttcctgtacataacccagggggcagagcctcctgctgcacagcccctccagaccaccccgccatgtccgccatgtccaccatgtccaccatgcatccgggggcatggggccaggcctttagatcctccgccaaccatgagcccagccggtactcag

SEQ ID NO: 53466 - DNA, 201 bp, Homo sapiens
agactcggccaggaggcacttgcctgtgtcgctagtgaggcttagggccacccaggtagggtgagtggagctgcctgggaagggccctgctctgacccatrgggctgcacagattcctgtgcacaaagacactctgtggctcaggttccagccaagaaagacctgggacagccctgattctgagccgtcagccgtctggag

SEQ ID NO: 53467 - DNA, 201 bp, Homo sapiens
cacgtgctggccgcctgggccctgggtgccaaggtgcgtgccctgcgaccccagcatggtgtctcctgcctgggcccctggcatccccacacctctgtttycccagcttcaccgtctcagaggcttcaagaaggggctcccaagggggctcacgaggccaccagaagggccaggcctgaggtggccccctcgcctctgtga

SEQ ID NO: 53468 - DNA, 201 bp, Homo sapiens
ctgtgatgtctgaaatgcttcaagccttttttttattttccacagaaacgcaagtgccccaggaccttatgccctcagtgggtcctgattctgtttcccamctggagtcagggttttgtgtacaggtggtcccagggctggctggcggtggggccagtgttgaggcctccacaggctgagacgatgggggtctccccagct

SEQ ID NO: 53469 - DNA, 201 bp, Homo sapiens
gcttctgagccatgtgtgcacctgcagggctgagagctctgagctgccccccgcaggcaggcagcatggagagctggtggccttcagatgtccacgggcakgcacaactcaaagcgggcatctggccttgctaacagatacctacgaggcagaaacgccttccccatctcggagcctttcccatcaatgagcaggtttccc

SEQ ID NO: 53470 - DNA, 201 bp, Homo sapiens
aggccccaacagttgactgggtttgcccctgcccagacctggggccctctcaggacacacccgtctgtctgacaccttgccccacacaggcattttactayccagaggaagccggccttgccttcgggggtccagggtcctccagatatctccgcctggaagttcactaccacaacccactggtgatagaaggtaggcggc

SEQ ID NO: 53471 - DNA, 201 bp, Homo sapiens
gctcgaatccctcggggcaggggcggctggaacagccttctagacagcttggcctctgcatgctccccatcccacaccctggctcgggctccccagcaagygctcgggagccagtcagccccaggtgcaggtgctcttaggcaggaggagggtgtcacctccagcctggcacagctggtgacgcctggcacttttgctgca

SEQ ID NO: 53472 - DNA, 201 bp, Homo sapiens
cccattcatacccccaacttttcacatggcccaaggctgtctcactgcacactgtggtatagcgctctgccggtgacgatgtaggcactttcttttttttkttgtttttgagacagagtttccctcttgttgcccaggctggagtgcaatggcataatctcggctcaccacaacctccgcttcctgggttcaagcaattct

SEQ ID NO: 53473 - DNA, 201 bp, Homo sapiens
gggaagcccgccaccgatcagtcaagcctggagtaaaagatgaagcctatttgcttcgctgttttcacgtggggcttatcaagtatttactaagcaccttytagaagcttggaaagggctacaagccatggtccctgagcccaagacacttacaggtttgctttctgggaggattggggtggattagagactgccttccag

SEQ ID NO: 53474 - DNA, 201 bp, Homo sapiens
ggcaccaatctgaggccccgcccgctccctgcttcggctcctctgtgttcccgggctgccgactctcaggaggctttgccacctgaagaacagggaggtcsagcaaggtaagaagagctttccagctcctgttccgacctgagagccgagaggcaccatcctgaagaatggccttggtcccaggcctccatgtgcgctgtg

SEQ ID NO: 53475 - DNA, 201 bp, Homo sapiens
actcttacccagcagcacgtccctcctgcctgggcctggtgagcgaggggctcaaggggaaactgaggcaggagctggcacttctgtgtgggtgaggaggrcaccaatctgaggccccgcccgctccctgcttcggctcctctgtgttcccgggctgccgactctcaggaggctttgccacctgaagaacagggaggtcga

SEQ ID NO: 53476 - DNA, 201 bp, Homo sapiens
gtctgctcatccgtgggtagaggcgacgcagaccccatcccactggggactgggccagacagcctgtgaggcagtcagctggtgcctggccagagggtgtytgaaaggcctcttggctgcagggtgcatctgcttttgggacagctcttcagagccatctcagaagggacagcatccgcctgtctacttcaactcccactg

SEQ ID NO: 53477 - DNA, 201 bp, Homo sapiens
ccggaggggtccctggagctctcatggaatgtcagctacacccaggaggccatccatttccagctcctggtgcggaggctcaaggctggcgtcctgtttgsgatgtccgaccgtggcgagcttgagaacgcagatctcgtggtgctctggaccgatggggacactgcctattttgcggtgagtctctcctccctgccagct

SEQ ID NO: 53478 - DNA, 201 bp, Homo sapiens
actgcctattttgcggtgagtctctcctccctgccagctctccaaacccttcctgacccggcaccccatctggccgtctttctgcactcaccctccttaayccagaaagttcttctgtcacctctcagtgtttgagttgactctgctctgagccaagtctgcaccccgagcttgggcatcatggggatctcagtttgagga

SEQ ID NO: 53479 - DNA, 201 bp, Homo sapiens
aaaaccccttgtcaatttcacactccttgccgcctgacatccctttcctgtacataacccagggggcagagcctcctgctgcacagcccctccagaccaccccgccatgtccgccatgtccaccatgtccaccatgcatccgggggcatggggccaggcctttagatcctccgccaaccatgagcccagccggtactcaga

SEQ ID NO: 53480 - DNA, 201 bp, Homo sapiens
ttgctctcaggctggttatcctcttcctcttgcagagacagcagccgtgtcccccctaccccgctccagcagtacccgcacctcctacacccagataagcrtaaccccgtggttgctgagagttgccacttgccccacactgaggctatgcacagccgtggcaatctcgtgaagccatgtagtttctgtttccattgatgg

SEQ ID NO: 53481 - DNA, 201 bp, Homo sapiens
aaaccccttgtcaatttcacactccttgccgcctgacatccctttcctgtacataacccagggggcagagcctcctgctgcacagcccctccagaccaccccgccatgtccgccatgtccaccatgtccaccatgcatccgggggcatggggccaggcctttagatcctccgccaaccatgagcccagccggtactcagag

SEQ ID NO: 53482 - DNA, 201 bp, Homo sapiens
caggcccaagaagcctcttcccgcgatcacacccaattgccagcccagagaagggtcccagggtcctgcccaaacacctggggggcacttgtagcctgccratctcgggcagggaaactgagactcccagataagtacctcacctggggcccaagagcggcagtgattgggaatcctagccagctctggaacctgccacag

SEQ ID NO: 53483 - DNA, 201 bp, Homo sapiens
aaccccttgtcaatttcacactccttgccgcctgacatccctttcctgtacataacccagggggcagagcctcctgctgcacagcccctccagaccaccccgccatgtccgccatgtccaccatgtccaccatgcatccgggggcatggggccaggcctttagatcctccgccaaccatgagcccagccggtactcagagc

SEQ ID NO: 53484 - DNA, 201 bp, Homo sapiens
agcctaggtgacagtagacacggagcaggcccaagaagcctcttcccgcgatcacacccaattgccagcccagagaagggtcccagggtcctgcccaaacrcctggggggcacttgtagcctgccgatctcgggcagggaaactgagactcccagataagtacctcacctggggcccaagagcggcagtgattgggaatcc

SEQ ID NO: 53485 - DNA, 201 bp, Homo sapiens
accccttgtcaatttcacactccttgccgcctgacatccctttcctgtacataacccagggggcagagcctcctgctgcacagcccctccagaccaccccgccatgtccgccatgtccaccatgtccaccatgcatccgggggcatggggccaggcctttagatcctccgccaaccatgagcccagccggtactcagagcc

SEQ ID NO: 53486 - DNA, 201 bp, Homo sapiens
ccttgtcaatttcacactccttgccgcctgacatccctttcctgtacataacccagggggcagagcctcctgctgcacagcccctccagaccaccccgccatgtccgccatgtccaccatgtccaccatgcatccgggggcatggggccaggcctttagatcctccgccaaccatgagcccagccggtactcagagcctgg

SEQ ID NO: 53487 - DNA, 201 bp, Homo sapiens
cttgtcaatttcacactccttgccgcctgacatccctttcctgtacataacccagggggcagagcctcctgctgcacagcccctccagaccaccccgccatgtccgccatgtccaccatgtccaccatgcatccgggggcatggggccaggcctttagatcctccgccaaccatgagcccagccggtactcagagcctggc

SEQ ID NO: 53488 - DNA, 201 bp, Homo sapiens
acaagtcctcagccgtccgcttccaggtgcgctgccatgggcccgggtggggcatgcagtcaggcaggcctcatggggggccccagtgaggggtgatgggyctgcactccaaactgctggcaaaagcactcgcacaagacaatgagagcaagtgccaggtggtgacacataggcctagacagccagccagccagcagagag

SEQ ID NO: 53489 - DNA, 201 bp, Homo sapiens
ttgtcaatttcacactccttgccgcctgacatccctttcctgtacataacccagggggcagagcctcctgctgcacagcccctccagaccaccccgccatgtccgccatgtccaccatgtccaccatgcatccgggggcatggggccaggcctttagatcctccgccaaccatgagcccagccggtactcagagcctggct

SEQ ID NO: 53490 - DNA, 201 bp, Homo sapiens
ggagggcaggcaccctctctggtgacacctccacactgtaccgaatgccaaatgcaggtggtgtgagcagggcgcactaacctgcctaaaaataaagcacyaggggaggggaaggtaagaaacgaaccagtctgaagctgcgagctggttttttcctccttatctgagacccactggtattcgaaggcatctaatttatcc

SEQ ID NO: 53491 - DNA, 201 bp, Homo sapiens
tgtcaatttcacactccttgccgcctgacatccctttcctgtacataacccagggggcagagcctcctgctgcacagcccctccagaccaccccgccatgtccgccatgtccaccatgtccaccatgcatccgggggcatggggccaggcctttagatcctccgccaaccatgagcccagccggtactcagagcctggctg

SEQ ID NO: 53492 - DNA, 201 bp, Homo sapiens
ctgagaatagtgtggggtggacgtctgatggggttgaaaacttggcatttggtgtagccttgaggggaagagatagctaaaaaatatcagagcctgcagcmaggggctctggttgctacactagggtgaatgattaaattgggtggggacagaggcggggagaggcctggatgactcccaggttcctgactaggtgaatgg

SEQ ID NO: 53493 - DNA, 201 bp, Homo sapiens
tgctcggcccaccacgtaggggacctgccaagtaccaccttctgccacttgcttttccctggacagcaagctcttcagcacagaggccacgcgctgctcarcttggtggctttgccacaccctgtccacgggaggctcgccttaaaggcctgttgactgagtgaagatgaacctgtcaggcttcaggggctcaggagagga

SEQ ID NO: 53494 - DNA, 201 bp, Homo sapiens
aaggtcgtgtcggtccatccggtgagtgcccagcgggaaggctgtcccactcactgccaccagctggggtggctgagagggctgggggtgccaccagaagragagggacacagaaagtgatagggggagggagagccatccagggcagggggagggtgcctgtgggtggctctgggctgggctacctcatggggagactca

SEQ ID NO: 53495 - DNA, 201 bp, Homo sapiens
acctctggcagcgcagggatggagcccgcaggtgatgagcttgggaggtgagttgtggaggctgcgctcacatcaatgcccagtgccctccccgaggggcmaggttctctctccacaggggcgggggaagcacacaggggacagggaggggtgctgggttctctctcctcgggacagggagcgcagccaggttctctctcc

SEQ ID NO: 53496 - DNA, 201 bp, Homo sapiens
taccccgctccagcagtacccgcacctcctacacccagataagcgtaaccccgtggttgctgagagttgccacttgccccacactgaggctatgcacagcygtggcaatctcgtgaagccatgtagtttctgtttccattgatggaggaggaaactgaggctcagagacctaaagttaggtgccaaggtcacccagagtaa

SEQ ID NO: 53497 - DNA, 201 bp, Homo sapiens
cccgcgatcacacccaattgccagcccagagaagggtcccagggtcctgcccaaacacctggggggcacttgtagcctgccgatctcgggcagggaaactragactcccagataagtacctcacctggggcccaagagcggcagtgattgggaatcctagccagctctggaacctgccacagcgacaaccccacccccacc

SEQ ID NO: 53498 - DNA, 201 bp, Homo sapiens; identical to SEQ ID NO: 10114

SEQ ID NO: 53499 - DNA, 201 bp, Homo sapiens
tcctccttatctgagacccactggtattcgaaggcatctaatttatcctgggcccactgggctgtggtcaggaggccagggcctatgcagagttagtcgcrtaaggtgccgcagcctggagatccaggaagatccttcccagaagcatttgggagccagattaactgctaagtcaaacatcctcagcaccaagggaaggaa

SEQ ID NO: 53500 - DNA, 201 bp, Homo sapiens
ctgtgttgagccagtgagcaaatcccgcccttcgtctgcccagcatggtgcccccgctgtacagctcctcttggcacgaggcccttgcgtctgcctcatcygctgtccatcttccatggctgtggtgggctcccagggacaggacctcgaggggctcactcctcacagcttcgccagggcccagcagtggccccacacctc

SEQ ID NO: 53501 - DNA, 201 bp, Homo sapiens
atgagaaaagctgggaaaggaggaatccggcccagagaacaatgctggcaaaaacgcgtcctggccaacaggtgccaggtttcgtctctgggcagaactgycccatgctctttgtctgcacgggaggagggggcggcagctggtgtaagtgccacgccaagctttgcccagtccctttgttctgccatagagtaaagattg

SEQ ID NO: 53502 - DNA, 201 bp, Homo sapiens
gtctgcccagcatggtgcccccgctgtacagctcctcttggcacgaggcccttgcgtctgcctcatccgctgtccatcttccatggctgtggtgggctccyagggacaggacctcgaggggctcactcctcacagcttcgccagggcccagcagtggccccacacctccctcctcgtccctataatacgggctgccatcgg

SEQ ID NO: 53503 - DNA, 201 bp, Homo sapiens
cagggtcttgtgcctcacagctgttaccccacccttcctgtctcccttggatttcaggtgacaagtgtcctaggttcctgatcacaaactcagggtggagrcaggacagctttgtcagtcctttattctctctagaggaggtgctcagtatatcacagcagtggctgatgtcgggtgcttgccacagctcagcactgctct

SEQ ID NO: 53504 - DNA, 201 bp, Homo sapiens
ggtgcccccgctgtacagctcctcttggcacgaggcccttgcgtctgcctcatccgctgtccatcttccatggctgtggtgggctcccagggacaggaccycgaggggctcactcctcacagcttcgccagggcccagcagtggccccacacctccctcctcgtccctataatacgggctgccatcggcgcagcactgtgc

SEQ ID NO: 53505 - DNA, 201 bp, Homo sapiens
cccagggtcttgtgcctcacagctgttaccccacccttcctgtctcccttggatttcaggtgacaagtgtcctaggttcctgatcacaaactcagggtggrgacaggacagctttgtcagtcctttattctctctagaggaggtgctcagtatatcacagcagtggctgatgtcgggtgcttgccacagctcagcactgct

SEQ ID NO: 53506 - DNA, 201 bp, Homo sapiens
cacatgggactggccaccagggcttctttgtggatgaaacccaactctctccacagaaacacacaaaggagtgacaaaaaagttttatttctgaagtcagraggtgcctgctttatctgggagtgccgagctggagcgggggagctgtgtctgtgcggagcggccggctccagctctgcatcttggtctcaccatgggctg

SEQ ID NO: 53507 - DNA, 201 bp, Homo sapiens
gctcctcgctgtctctcagtgggtctccctggtggtcttccatgtgacctggcctcgggccaccgtgtccctgccccttagggcccagtgcaaggggagcrgccggagatggggagggcagaggtcactgatccagatcccaggaagcatcctcggagaatgcagcaggtccaatgcctccctgggcctcagtttaccttc

SEQ ID NO: 53508 - DNA, 201 bp, Homo sapiens
gcccaggagctctgcctcacgttgtataaatcacagcttcttgtggtccataagtcacggcgctagcgctgtgaaatgccaggccccagcctggagagccrctccggccctctgtcatctttacagcctaggtgacagtagacacggagcaggcccaagaagcctcttcccgcgatcacacccaattgccagcccagagaa

SEQ ID NO: 53509 - DNA, 201 bp, Homo sapiens
ctcatggggagagagggagatggatgggcctcggagtcccctcgcatcagctaagcggctgctgcttctgcaaggcacttcacttcatcacagaagggaastcacgagcccaggagctctgcctcacgttgtataaatcacagcttcttgtggtccataagtcacggcgctagcgctgtgaaatgccaggccccagcctgg

SEQ ID NO: 53510 - DNA, 201 bp, Homo sapiens; identical to SEQ ID NO: 10133

SEQ ID NO: 53511 - DNA, 201 bp, Homo sapiens
gcagtgactgagtgggctcgcaaacagagggctctgcaggtggagcaccccaggcaagtccccaccatcagccccattctgcaggcgcggccccggggccrgggatgggagggtcttgccgggcatccagcgaggagactgcatattccctgcccaatctggcttcacggcggcggaactgacgccacgtcccagggcgtt

SEQ ID NO: 53512 - DNA, 201 bp, Homo sapiens
tgcagtgactgagtgggctcgcaaacagagggctctgcaggtggagcaccccaggcaagtccccaccatcagccccattctgcaggcgcggccccggggcmagggatgggagggtcttgccgggcatccagcgaggagactgcatattccctgcccaatctggcttcacggcggcggaactgacgccacgtcccagggcgt

SEQ ID NO: 53513 - DNA, 201 bp, Homo sapiens
tgcaccccacccctgccccgcccccacaccctgccaccacacgacctcctgggtctactgtttcctgacaccatagggatggctccaggctggcttctttytcctgggccagccccacccgccccccacccatgtggcctgtgctccccacttgggtgtctggtgtctgatcgtagggaggcctctggcacatggcagatg

SEQ ID NO: 53514 - DNA, 201 bp, Homo sapiens
ggagatgtgctcatcacctcctgcacgtacaacacggaagaccgggagctggccacagtggtaagtcacccccgcttccccctgcacctgcccagggcgartgttcagcctgagccatctgaggaaggatgacaggtcttgactcctcacttagggcatgggctcgtcccctcaataagccagtcgttctcagctccctga

SEQ ID NO: 53515 - DNA, 201 bp, Homo sapiens
cgaggcctccagcacctgccaacgccaggtggcaggtgctgatggtcacattggcttttcctcagggagatgtgctcatcacctcctgcacgtacaacacrgaagaccgggagctggccacagtggtaagtcacccccgcttccccctgcacctgcccagggcgagtgttcagcctgagccatctgaggaaggatgacagg

SEQ ID NO: 53516 - DNA, 201 bp, Homo sapiens
acgtctgatggggttgaaaacttggcatttggtgtagccttgaggggaagagatagctaaaaaatatcagagcctgcagccaggggctctggttgctacaytagggtgaatgattaaattgggtggggacagaggcggggagaggcctggatgactcccaggttcctgactaggtgaatgggaagccaggggagggggcat

SEQ ID NO: 53517 - DNA, 201 bp, Homo sapiens
aagcttgctcctgagcctcctccctgtgccaggcgtggtaccaagtgcttccccctgagcgtcctgaagctgcctcagctggcctgggtgggtctcccctkcctgccctctgagctgcctctcagggacaagttcagctctttgatggtttctggagacagtaacagatgcacttgtgttcagccacttcagcaaaacgct

SEQ ID NO: 53518 - DNA, 201 bp, Homo sapiens
tgtgttcagccacttcagcaaaacgctgcccagcctcatggggagagagggagatggatgggcctcggagtcccctcgcatcagctaagcggctgctgctkctgcaaggcacttcacttcatcacagaagggaactcacgagcccaggagctctgcctcacgttgtataaatcacagcttcttgtggtccataagtcacgg

SEQ ID NO: 53519 - DNA, 201 bp, Homo sapiens
ggctgcttccgggagccaaaggggatgctgttcacaattacctgggtcccaggcacaagccagggctgtcctggcaaatgggccaccttgccagtggatcygtgccagctgcttcggtaaccatggtggtctccaataattatcctgtgaattgtgtggctcaagtggagcagacctgggttacagctaccctgacatccc

SEQ ID NO: 53520 - DNA, 201 bp, Homo sapiens
ctggcgccaacagcaggtcctgtccttggcttctggtgagttcagagagtgactactaaaatctcctcctttgcttgccctatcttggtccaagcctgtgmtgaactgtctccctatcaatcagtgtctaggctgttctcaacttttcaccaatagaaagaagcttctgggaaatccttgtccatgtaggaaaccattttc

SEQ ID NO: 53521 - DNA, 201 bp, Homo sapiens
aatatgccttcattatgtaagcaacacacacatgcacttgccactcacaagcgcaggcactgcagctaaagagaacgctcccctcatccgctgccgcctcyccctgagatagccacttcttggctctttgtgtccttccagacctttttcctgtatatttcaggaagctcttgcaggtgttagaaaccttttgtgttttta

SEQ ID NO: 53522 - DNA, 201 bp, Homo sapiens
cactagtccacacccacgtgccaggcttccacgagctgcattttaaaatatgccttcattatgtaagcaacacacacatgcacttgccactcacaagcgcwggcactgcagctaaagagaacgctcccctcatccgctgccgcctccccctgagatagccacttcttggctctttgtgtccttccagacctttttcctgta

SEQ ID NO: 53523 - DNA, 201 bp, Homo sapiens
acagccagctcttggtctgcctagcaggtgggagcagatggggggtgaccggccctgcctcctggctgagggtggctggggtcatagggataatctgtccrcagggggaagtgagagggcctccacttaccgctcacctccatccatcccaccttctcccaggacgaaacgactcctcaggcatccgcttgtactacacag

SEQ ID NO: 53524 - DNA, 201 bp, Homo sapiens
ttggggacgctgggtggatgacctcacccgctgcctgttctcccacctcccacagctattgtgaagctgggaaaggctcacgcacagaacttgctgtgggyacggggctgtgctcagctaacagtcgcctgtggttttttttttttttcctggctgcataagtaataccttccgccactgttggagttatctccacatgca

SEQ ID NO: 53525 - DNA, 201 bp, Homo sapiens
tgtctctcagtgggtctccctggtggtcttccatgtgacctggcctcgggccaccgtgtccctgccccttagggcccagtgcaaggggagcagccggagayggggagggcagaggtcactgatccagatcccaggaagcatcctcggagaatgcagcaggtccaatgcctccctgggcctcagtttaccttctccaagcag

SEQ ID NO: 53526 - DNA, 201 bp, Homo sapiens
taacagtcgcctgtggttttttttttttttcctggctgcataagtaataccttccgccactgttggagttatctccacatgcacagagaagggtataagtmagcttgggccttagcatgacacgggatttattgctcatttaaaccctgaaagcaaatggatttttgaaaactcctgaagcatcagggaagtctgtctctt

SEQ ID NO: 53527 - DNA, 201 bp, Homo sapiens
tctctctcctttcctgttcatgtcccaccctgttcccaactctcccctttctgaggctccgcaactctcctgcctgcatgaatgtgggcagcattggtctraggcattgttcccagtcttgaggaggccttgggagcctcaggcatcttcttaagaagctcagtgtcccgcccgccaggcccgggaatgcccatggctaac

SEQ ID NO: 53528 - DNA, 201 bp, Homo sapiens
catgtcccaccctgttcccaactctcccctttctgaggctccgcaactctcctgcctgcatgaatgtgggcagcattggtctgaggcattgttcccagtcytgaggaggccttgggagcctcaggcatcttcttaagaagctcagtgtcccgcccgccaggcccgggaatgcccatggctaacagaacctgtgacctgctg

SEQ ID NO: 53529 - DNA, 201 bp, Homo sapiens
aaagcgggcatctggccttgctaacagatacctacgaggcagaaacgccttccccatctcggagcctttcccatcaatgagcaggtttccctatcttaggmagaaacctccgttaccccacttgggtgctagaaaatgtttaacaaccagctctggggtgaggtgggtgtgactgtagcatttgcccatttccatggtgca

SEQ ID NO: 53530 - DNA, 201 bp, Homo sapiens
cctagcagctcaggactggatgaaaaaaataaaaaacaaaccaagctttttctgcgacaggagctttaggagtggtgcttctgagccatgtgtgcacctgyagggctgagagctctgagctgccccccgcaggcaggcagcatggagagctggtggccttcagatgtccacgggcaggcacaactcaaagcgggcatctgg

SEQ ID NO: 53531 - DNA, 201 bp, Homo sapiens
acatgaatctgctgggctccttgtagtggacgacagggactgtaccccagaggtgccgtggcatgcacagtggcgtggtcctatgggggcgaggcctccarcacctgccaacgccaggtggcaggtgctgatggtcacattggcttttcctcagggagatgtgctcatcacctcctgcacgtacaacacggaagaccggga

SEQ ID NO: 53532 - DNA, 201 bp, Homo sapiens
cccactggcctgggccctggccctgttgtgacccactgggtcacaggagctgatggtttataacttgctcgggaacactcagcctgtgaccttcgcacatkaatctgctgggctccttgtagtggacgacagggactgtaccccagaggtgccgtggcatgcacagtggcgtggtcctatgggggcgaggcctccagcacc

SEQ ID NO: 53533 - DNA, 201 bp, Homo sapiens
aggcttcaggggctcaggagaggatgaaggactcggaaagaaagtcgctcctgagtgggactaggggctgcttctttgggagctgggggctgttgcggccmcctcgctcttccccgtgaggtttctgatggtggctctaacctggccggggagaaagacctagaaaatgcaagtgttccagggaagcaaactgcccagggt

SEQ ID NO: 53534 - DNA, 201 bp, Homo sapiens
aaggggtaggttatgcttagagcatttttggcacccagggaagatgttagtatctgtaccaccctcttggtttgatcagaaagggcaatgcatgtacactrgtgagaagatggacagcagaaaagcatgaagaagatgaaaccaccccccagctcccggctccaagttttgaagtgagcactggtcacccagctatgtgtc

SEQ ID NO: 53535 - DNA, 201 bp, Homo sapiens
ttcatgatttaatccccatctgaattttaaccaattgcaacaccctttttattattatcctctgatgtaatcagcctggagatacaggagccgtttgagtytggatggtgtaggggtgtcgagggaagaaggcagaggcaagaggagttgttttggcctcatcttaaaggaaacaagtagggagatggttgggccccctgg

SEQ ID NO: 53536 - DNA, 201 bp, Homo sapiens
agggagatggatgggcctcggagtcccctcgcatcagctaagcggctgctgcttctgcaaggcacttcacttcatcacagaagggaactcacgagcccagsagctctgcctcacgttgtataaatcacagcttcttgtggtccataagtcacggcgctagcgctgtgaaatgccaggccccagcctggagagccactccgg

SEQ ID NO: 53537 - DNA, 201 bp, Homo sapiens
tttagcatggcaaggccaggtgatgctgtctcagaaactgaaaaaaatacttccctctctctgttgcaccagcatctttcaccatatatagacacacacgmacacaatgcacacacacacgcacacacacatgcacacatgtacacatatgcacgcagaagcacacacatgcacacactttttctctctctctgaatggtg

SEQ ID NO: 53538 - DNA, 201 bp, Homo sapiens
gagaagggtcccagggtcctgcccaaacacctggggggcacttgtagcctgccgatctcgggcagggaaactgagactcccagataagtacctcacctggkgcccaagagcggcagtgattgggaatcctagccagctctggaacctgccacagcgacaaccccacccccacctcaccccccactcacactcttgctctca

SEQ ID NO: 53539 - DNA, 201 bp, Homo sapiens
ttttagcatggcaaggccaggtgatgctgtctcagaaactgaaaaaaatacttccctctctctgttgcaccagcatctttcaccatatatagacacacacrcacacaatgcacacacacacgcacacacacatgcacacatgtacacatatgcacgcagaagcacacacatgcacacactttttctctctctctgaatggt

SEQ ID NO: 53540 - DNA, 201 bp, Homo sapiens
ggtggcagagggtggggagggacaggaactcacacaggagggcaatcgtcccgatctgacgggggcgggatggatgagaaaagctgggaaaggaggaatcyggcccagagaacaatgctggcaaaaacgcgtcctggccaacaggtgccaggtttcgtctctgggcagaactgtcccatgctctttgtctgcacgggagga

SEQ ID NO: 53541 - DNA, 201 bp, Homo sapiens
gaggccaccagaagggccaggcctgaggtggccccctcgcctctgtgatgtctgaaatgcttcaagccttttttttattttccacagaaacgcaagtgccscaggaccttatgccctcagtgggtcctgattctgtttcccaactggagtcagggttttgtgtacaggtggtcccagggctggctggcggtggggccagtg

SEQ ID NO: 53542 - DNA, 201 bp, Homo sapiens
attttacagatgggcattcggaagcccatggaggagggctgctggggaggggagggtgggcggccggttcccgggctcagagggctgcctcctcacagtaygagcccatcgtcaccaagggcaatgaggcccttgtccaccacatggaagtcttccagtgcgcccccgagatggacagcgtcccccacttcagcgggccct

SEQ ID NO: 53543 - DNA, 201 bp, Homo sapiens
agctgctatgaggagggcaggctaggccactcagggaagctgttcttcctttacagcaattaaacccaaggtcagggccacaggagggagtctcgggctcygctctgggagtcagagggctccttcttgttcctagcagctcaggactggatgaaaaaaataaaaaacaaaccaagctttttctgcgacaggagctttagg

SEQ ID NO: 53544 - DNA, 201 bp, Homo sapiens
tgggttgtccctgaccctggagagctgtccacagtcctggttggaccaggtgtcctcttatcactggaacctcaggcacctgcctgagcaggggagcagcragtggtcttggcttccccatcactctgctcactcccctaccctcaaagggccttggagctcccacttccctgcctggaccaaagtgaccaacatcttgac

SEQ ID NO: 53545 - DNA, 201 bp, Homo sapiens
acactctctcccacttccctaaagcgcccactggtgaagcgtgggcccatgtaaaaggcaccttggccagggctcatggggaagagcggcttccggccagrcagcactcactgccccttgcagggccttggggccttcgaccccgctgaccgctgactgtgagaacgcctctctccagcctcaggaatacagacccgcctc

SEQ ID NO: 53546 - DNA, 201 bp, Homo sapiens
gtcacctccagcctggcacagctggtgacgcctggcacttttgctgcagctgctatgaggagggcaggctaggccactcagggaagctgttcttcctttasagcaattaaacccaaggtcagggccacaggagggagtctcgggctccgctctgggagtcagagggctccttcttgttcctagcagctcaggactggatga

SEQ ID NO: 53547 - DNA, 201 bp, Homo sapiens
  misc_feature (1)...(201): n = A,T,C or G, or insertion/deletion polymorphism (see Tables 1-2)
tgctacattaaggagcttccaaagggcttctctcggcaccacattatcaaggtacgtgcgggtccagggccgaggtcctcgcccagccctgccttcctccngggcctgggttgtccctgaccctggagagctgtccacagtcctggttggaccaggtgtcctcttatcactggaacctcaggcacctgcctgagcagggga

SEQ ID NO: 53548 - DNA, 201 bp, Homo sapiens
cacaccctggctcgggctccccagcaagcgctcgggagccagtcagccccaggtgcaggtgctcttaggcaggaggagggtgtcacctccagcctggcacwgctggtgacgcctggcacttttgctgcagctgctatgaggagggcaggctaggccactcagggaagctgttcttcctttacagcaattaaacccaaggtc

SEQ ID NO: 53549 - DNA, 201 bp, Homo sapiens
ccagccctgtggtcttgtgtggagtcttcagttcaggctccatcctcagtttcttaatctgtgaaatagggctgatgattctcactgtgcaaaacttccaygaaaggggtaggttatgcttagagcatttttggcacccagggaagatgttagtatctgtaccaccctcttggtttgatcagaaagggcaatgcatgtaca

SEQ ID NO: 53550 - DNA, 201 bp, Homo sapiens
ttggagggttgggaatatgattctcacacaagcgtgaatgttggagggaagggcaggtgtaaacaactctggccatctgtttgagcctgcaatccattaayagatgccaaatagacaaatacggaatctaagaaaacagaacagctggctgtttgccagatgaggaaactaaggcccggagacggggagtggatgtaccca

SEQ ID NO: 53551 - DNA, 201 bp, Homo sapiens
ctcgaatccctcggggcaggggcggctggaacagccttctagacagcttggcctctgcatgctccccatcccacaccctggctcgggctccccagcaagcsctcgggagccagtcagccccaggtgcaggtgctcttaggcaggaggagggtgtcacctccagcctggcacagctggtgacgcctggcacttttgctgcag

SEQ ID NO: 53552 - DNA, 201 bp, Homo sapiens
tcctcagtttcttaatctgtgaaatagggctgatgattctcactgtgcaaaacttccatgaaaggggtaggttatgcttagagcatttttggcacccaggkaagatgttagtatctgtaccaccctcttggtttgatcagaaagggcaatgcatgtacactggtgagaagatggacagcagaaaagcatgaagaagatgaa

SEQ ID NO: 53553 - DNA, 201 bp, Homo sapiens
ctctggacctcactttgcccatctgtaaaatggagatgggaactagatgatctgtatggcctgaccaactctgggagttcatgggagccataaaacattgyaaaagccataggcttcttatgctgctctaagagccccccaacctcttagggaaagcaacccaccttgcccttgaagacaaaactcttttaactctagcac

SEQ ID NO: 53554 - DNA, 201 bp, Homo sapiens
tatatctttttttttcattgttgtttgtttttttacttaaacttcatcagaagcctcttccctgtgaattaaaaccccttgtcaatttcacactccttgcygcctgacatccctttcctgtacataacccagggggcagagcctcctgctgcacagcccctccagaccaccccgccatgtccgccatgtccaccatgtcca

SEQ ID NO: 53555 - DNA, 201 bp, Homo sapiens
ttctgaacccaggcattgccccagagcaggtgcagttcgtgtccatgtgatcttgagttggacatgggcatctggggtccggcaaagccaaggtctggcarccaatatgacttccaccggacaacacacctcccaccccagcaattccagatgcctgggaaacagcagcaacacggtggcttccccggacccgggcaagca

SEQ ID NO: 53556 - DNA, 201 bp, Homo sapiens
ggcatagtccccgctcttcacaaagtccagcgagacctaggagcagaggtggggatgaggatcactctctgttggtaggtacagggctcacgtctgcctgyttctctggaggagggggtcttggtcttgctacctgccctgtgggcaaactcatccctgtgccagggactcctttctgaacccaggcattgccccagagca

SEQ ID NO: 53557 - DNA, 201 bp, Homo sapiens
cacctggggcccaagagcggcagtgattgggaatcctagccagctctggaacctgccacagcgacaaccccacccccacctcaccccccactcacactctygctctcaggctggttatcctcttcctcttgcagagacagcagccgtgtcccccctaccccgctccagcagtacccgcacctcctacacccagataagcgt

SEQ ID NO: 53558 - DNA, 201 bp, Homo sapiens
ttctatattagaaaagcagcaagtcagtaatcccccgtggcatcacagctaagtagctgtggccaccggcagtttcacagcatcctgaaagctggcactgrtcgtgactatcagtgaaagaagtttaattttcaggttagaaaatgtgatctggcagtttatgcattcttcagagtaatgtaataatacctatgtgatgct

SEQ ID NO: 53559 - DNA, 201 bp, Homo sapiens
gccagggtgcatgccgggcatagcacatgtgtccctgagaggcccctgatcaggggtggaaacccagcaaagtgaaaatcagaaatagtgattctccagtycctgttcacagataaagaaagaaagaaataataagcaatactaggcctggtgtggtagttcacacctgtaatcccagcactttgggaggccaaggcaggc

SEQ ID NO: 53560 - DNA, 201 bp, Homo sapiens
ttggtattaaaatgctttgaggtaggctggatgaacccagcttagtgaagatgacatgaaaacccttagctaatggggtctttattgagtagaactcaggkaagttcagatgtaagcagtgtctctcagtaaacatgaaaagactgaagatgcagacaatcaaatacttaagtctcttgaagagctgggtggtgggcgggg

SEQ ID NO: 53561 - DNA, 201 bp, Homo sapiens
ttcccgggccccactccagacctagggagtcaggaacttggcggggccaggggggtggaagggcctgcaatctttgtctgaaccagctcacagggtggttytgatgcctgccttccactcgaagtctgcttgtcacgaacgcctgtctcagctcagggacatccccggcttaggaagtatgctcaggtgtgtgcagggcca

SEQ ID NO: 53562 - DNA, 201 bp, Homo sapiens
agaaattttgcttgttggcatatgtttggtgttttgattcagtttggaggatgaactagttaatttccctgggagtacatgcctattaaaaatatagcatsctgcatctgaccaagatgctatcttactatcttattgtgcctatcttttatgcggagagagaaaggggggtgttgggaaggagaccagactgtggaaaca

SEQ ID NO: 53563 - DNA, 201 bp, Homo sapiens
actcagggaccagaaggcggctgcaggacgcgaccgagcaggaccccaggcccgggaacgacgtcgcgagcgctgagactgccgggcctcccagcccatcwggcattcgagcgcaggaccgggcgccccggcaccgccgcgcgccacccgctaggatgccggtggccccagcgccctcagccgacggaggtgagaggcggg

SEQ ID NO: 53564 - DNA, 201 bp, Homo sapiens
gccggagtgggctctggtgcaccagcagaggctgggggagagtgctgcccccgcctggagcccaagtctctgcgtgcctgggggtagagcgcggagagggmccaggcaggcgccggaggggacccgcgcggaaaaggaagaagcccaaacaaaaacgctgtccggcgccaggcgcccacctgcaagcccaagccggtgctc

SEQ ID NO: 53565 - DNA, 201 bp, Homo sapiens
ctgcagatacatgactaacaaggatagctggccatgcccagggctggtgttggttgaggaggtggtgatggtgcggggcatgtgtgtgtgtgtgtgtgtgygcgcttgaggagttgtggaagtgttcatatctgtaaagtattatttcatggatgcagaccttaatgctaggttgaataactttgttgccatagaagaaga

SEQ ID NO: 53566 - DNA, 201 bp, Homo sapiens; identical to SEQ ID NO: 10145

SEQ ID NO: 53567 - DNA, 201 bp, Homo sapiens
gcctcactgaaagaggaatttcagtgatgccatgggtcagatcctgggtctctcttagggaaacctgccataaagcatgagagccacattactcctcaggscttctgggctccgattccgcagactagttttggaggcatcaccacgcctcaaggttgctctgttatatcagggtaactgactttctctaggaacggagac

SEQ ID NO: 53568 - DNA, 201 bp, Homo sapiens
agcatctttggcaagcacacagcaacaatgatgttgtgtgtttcttttgcatcacataatgccaggttgagccagtattagtgacactgagtttgatcttyctgtaaggtacagccagatgtctccataaaaaaatggaaaatggaaaacctttttcttttttttttccaattagcacccgttcgcctgcacactttcacc

SEQ ID NO: 53569 - DNA, 201 bp, Homo sapiens
atgacttaaggcccctagaagttcatgaacctggtgtgggtgtgtgtttcccactcagatgtgctgtgtaacttgcacctgagggtaacacgaactctccstgggcaagatgtaaccagggaaagaaaggagaaggcagagctcagagcaagcagaaagccaagcaggagaccaaaagaggcctcagaggccatgtttgca

SEQ ID NO: 53570 - DNA, 201 bp, Homo sapiens
aaaaggggcctcaggaatcactgacattggaaccaaggtttgtctgcagcttgtcggtttctgggacagaaacccaacatactggagtgggtatcccagcratctgtaggataaaccaggacactgtggtgtcatggatagctggctgtctgccaggtgatggcccctctggttgcaatgtgagccgggcaggtcatccat

SEQ ID NO: 53571 - DNA, 201 bp, Homo sapiens
gttctctttaaaaacaaggacaaaaccaaccagcgttcaaaggaacctcccatcagagtcccctaaagtattttaggttcagtgagcatttgcctgaataraacctaaaagagtagtcttaacacattactaactttttctaagagaaattgattcctgttttgtcatctgatgcaatttgctcttataaagagacatttt

SEQ ID NO: 53572 - DNA, 201 bp, Homo sapiens
cgctaatgaggaggagcgtctctaccctgcagctgtctgtactcctgtgtcttccgtaatgtgccaagctctctgaatatatgcaaaactagtctgcaaaragccatatgtctcagcatctggctttatttctaagtgttcaggtggaatttaagccgcgatcaaatttacaatgtcactgccagctctggacacttactt

SEQ ID NO: 53573 - DNA, 201 bp, Homo sapiens
ctcccaaagagctcatccctaatgtgacatcctggaatcagatggcacggacaccggcccagccccttcccagctctgtgactaaggacaagtgacacccyccctcccccagcctcggtctcctcctgtgtacattcagaaggcagatgctgccatgaggccatgtgtgctatgtccatggtgcaaggtggcacgcatgcc

SEQ ID NO: 53574 - DNA, 201 bp, Homo sapiens
tgctgtgttgagttctctttaaaaacaaggacaaaaccaaccagcgttcaaaggaacctcccatcagagtcccctaaagtattttaggttcagtgagcatytgcctgaataaaacctaaaagagtagtcttaacacattactaactttttctaagagaaattgattcctgttttgtcatctgatgcaatttgctcttataa

SEQ ID NO: 53575 - DNA, 201 bp, Homo sapiens
atactcatcttccagaaggcgtcttattcctcctcgacaaaaaaaaaatgtgttggtattaaaatgctttgaggtaggctggatgaacccagcttagtgargatgacatgaaaacccttagctaatggggtctttattgagtagaactcaggtaagttcagatgtaagcagtgtctctcagtaaacatgaaaagactgaag

SEQ ID NO: 53576 - DNA, 201 bp, Homo sapiens
aggctgggggagagtgctgcccccgcctggagcccaagtctctgcgtgcctgggggtagagcgcggagagggaccaggcaggcgccggaggggacccgcgmggaaaaggaagaagcccaaacaaaaacgctgtccggcgccaggcgcccacctgcaagcccaagccggtgctcggccagttacaaaagaaatggtcaggat

SEQ ID NO: 53577 - DNA, 201 bp, Homo sapiens
gtacatgctcttccccaaggattgtacgtattatacaaatagatggaaagaaaagtgaacacgtttgtagaactttcataagcacacagttgctgtgttgrgttctctttaaaaacaaggacaaaaccaaccagcgttcaaaggaacctcccatcagagtcccctaaagtattttaggttcagtgagcatttgcctgaata

SEQ ID NO: 53578 - DNA, 201 bp, Homo sapiens
tgccttaagattttccttaagcttttggaaatgtataatgtttgagaaaaaagaaaaagaatagactgagtggaatcgtatctagtttcagttaataacaygtttcagttgatgttactgttatagctactgggcataaagtctccttcccttttttgaatcctatttttgaggcattgaagctgtgtctgtaagagacaa

SEQ ID NO: 53579 - DNA, 201 bp, Homo sapiens
aagggaagcacattcaggcccacatgaaacttgggacagaagtggcttctcagagccgtgcaccaggcactttgaacaagttggaaggctacagtgccggragactccacagtagcacaggcgaagtggcttaggcgaaaacgctgggaagtaccccagctcccgggggccagagcctctagggctggcagcctcagcagg

SEQ ID NO: 53580 - DNA, 201 bp, Homo sapiens
agctttaaggcccaggaagagggcagcagatgggggtggggcagtgggtgagtgagaggcccgtgtgtggggagacccactgaggacagggatcgttaggsaaacggagcctcactgaaagaggaatttcagtgatgccatgggtcagatcctgggtctctcttagggaaacctgccataaagcatgagagccacattact

SEQ ID NO: 53581 - DNA, 201 bp, Homo sapiens
cagaccttaatgctaggttgaataactttgttgccatagaagaagaaccgcacgtcaggcttttttcattagcaaaccagtaagcactcactttgggcctytgaaatcacttccatcacctaacaccagagatacaaactgaagctagcccttaagagcctccccctaagatttagagagaatgatttctcaaccagtttt

SEQ ID NO: 53582 - DNA, 201 bp, Homo sapiens
tgtctgagctttaaggcccaggaagagggcagcagatgggggtggggcagtgggtgagtgagaggcccgtgtgtggggagacccactgaggacagggatckttagggaaacggagcctcactgaaagaggaatttcagtgatgccatgggtcagatcctgggtctctcttagggaaacctgccataaagcatgagagccac

SEQ ID NO: 53583 - DNA, 201 bp, Homo sapiens
ttcccatggtgtcccccaatcacttaggaatttagcctgtgtctaaagaccctctctgcagcctgacgtggctagccatcccagtacttccacgtttttcrtgcctttctccaacagcgttgccgtggccccttaggcggcgatcgttttatcaatggtcgctccctctttttatctgttggcaggagccctttttcaacg

SEQ ID NO: 53584 - DNA, 201 bp, Homo sapiens
tcccggcaactccagacaccaaatcgcttcccatggtgtcccccaatcacttaggaatttagcctgtgtctaaagaccctctctgcagcctgacgtggctmgccatcccagtacttccacgtttttcatgcctttctccaacagcgttgccgtggccccttaggcggcgatcgttttatcaatggtcgctccctcttttta

SEQ ID NO: 53585 - DNA, 201 bp, Homo sapiens
ggacttgggcgcgccacggcggccggagcgctccacatcagcacccctcccccagagccgctgcaggaacagggaggaggccttttccaccgcacccggarcgtttacaacgggctggagctgaatacctggatgaaagtggagaggctgttcgtggagaagttccatcagtcgttttccttggacaattaacaagttagg

SEQ ID NO: 53586 - DNA, 201 bp, Homo sapiens
aatcccagaactttgggaagccgaggcaggtagatcacccgaggtcaggagttcaagactagcctgatcaacatggtgaaaccccgtctctattaaaaaakacaaaaattagccaggcacagtggtgggcgcctgtaatcccagctactcaggaggctgaggcaggagaattgcttgaacccaggaggcggaggttgcagt

SEQ ID NO: 53587 - DNA, 201 bp, Homo sapiens
tggaggccggcctgggaacaggggccgaagggcgagccggaccctaggggattggtagggtcggggagaaggggtccaggctaggggcgggcggggcgcasggagaccaggcggcttgagcgggaggtggggagctggaggagtgccgggttcgcgggcgggggacggggagaggggggcggggagaggggcgggagtcgg

SEQ ID NO: 53588 - DNA, 201 bp, Homo sapiens
gtgctgatttgtccagctgggagtcaatccggatttgtacttattgttatacttcttcttttcagctgttcttataccagaagaatccttcaccccttttwcttgacattgattttttttggaagagctcaggactgcagaatgcccacactctggtagtccagtttttcccatggtgtcatttaactcatggctcaaact

SEQ ID NO: 53589 - DNA, 201 bp, Homo sapiens
aagggaggctgggatcacctcccgccccttctagcatctctactgagagtgacaactccaggctgtccacccccatcctgagccttccacactcttctccrtgccactaacactcagtatctgacgcctgcagtgcgaagcctccagagtccccagactgacctgggcactccacccttgctggttctactttacttggac

SEQ ID NO: 53590 - DNA, 201 bp, Homo sapiens
tgcgatagcacgtgcctgtagtcccagctactcgggaggctgaggctggagagttgctcaaacccgggaggcggagattgcagtgagccaagatcgcaccrctgcactccagcctgggtgacagagcgaccctctgtctcaaaaaataataataataataaataaaacaacaacaaaatgcatcagagagccaaaacattc

SEQ ID NO: 53591 - DNA, 201 bp, Homo sapiens
tgggattcagctccagttgtgcacatgacggtaacttacttgataatgcacgccttccccgtcagcttccttctctccctacttccgggatcttcactcarataaactacataacctcaagtcctctctcagggtctccttctggaggaaccccaactaagaggaagtagaaacactgtctctcccatctgaatgactcag

SEQ ID NO: 53592 - DNA, 201 bp, Homo sapiens
ctgcatgaaggaagatctaaatctggacttgttttatcctccccttcccttcttctcacctttattctgcctccaccttcttctttctttgtcttcccccrctggcttctctgtcatttcccacagtgggttcccccaatccctgtggtcctcatgtcctgttcttgttctctttgtgctggatctcacatcctacagcat

SEQ ID NO: 53593 - DNA, 201 bp, Homo sapiens; identical to SEQ ID NO: 10142

SEQ ID NO: 53594 - DNA, 201 bp, Homo sapiens
gcctttcataagtgatagacttggtgaataaataccccagctgtctccccgccttgctgggtgaactctggggtgtcagctctgtctctcggggttccccrgtgggattcagctccagttgtgcacatgacggtaacttacttgataatgcacgccttccccgtcagcttccttctctccctacttccgggatcttcactc

SEQ ID NO: 53595 - DNA, 201 bp, Homo sapiens
tgcttgtcacgaacgcctgtctcagctcagggacatccccggcttaggaagtatgctcaggtgtgtgcagggccagtcagaaattgtttccagaaacagcytttcataagtgatagacttggtgaataaataccccagctgtctccccgccttgctgggtgaactctggggtgtcagctctgtctctcggggttccccagt

SEQ ID NO: 53596 - DNA, 201 bp, Homo sapiens
ggaccctgggatctgtgacatgaagtggtgtgaaagcataattataaattagaggggggaaagccatcaataagagacaggtaagggctggaaactctcaytagtgagtggttctcaaagtcaagacttcagagcagctgcaccagcatcacctcgagattttttgaaatgcaaattcccgggccccactccagacctagg

SEQ ID NO: 53597 - DNA, 201 bp, Homo sapiens
cctagggagtcaggaacttggcggggccaggggggtggaagggcctgcaatctttgtctgaaccagctcacagggtggttctgatgcctgccttccactcsaagtctgcttgtcacgaacgcctgtctcagctcagggacatccccggcttaggaagtatgctcaggtgtgtgcagggccagtcagaaattgtttccagaa

SEQ ID NO: 53598 - DNA, 201 bp, Homo sapiens
acccgtagcagtctgtttaccttgtaaagggattacttagaagacatttttgtacatgctcttccccaaggattgtacgtattatacaaatagatggaaaraaaagtgaacacgtttgtagaactttcataagcacacagttgctgtgttgagttctctttaaaaacaaggacaaaaccaaccagcgttcaaaggaacctc

SEQ ID NO: 53599 - DNA, 201 bp, Homo sapiens
tgtgaccaacacacattttcctgagaagaggcctcagacaaacaaaaaaatatcatgcatgcacatttactcagataatgactgtctgttgcagcctttaygctaaacagagctaagagtagagatagtgcagattaactcagacccagaaacttggggaggcaccctgggatcctggaagcagatgctgggagggcagag

SEQ ID NO: 53600 - DNA, 201 bp, Homo sapiens; identical to SEQ ID NO: 10143

SEQ ID NO: 53601 - DNA, 201 bp, Homo sapiens
catacacaaaggctttattataaggaattggcccatgcaattatggaagctgacacatccaatgtctataggtccaaggtcccagttccagtcctaagagkattctcctagttagagacttctctctaactagggagagtgttggctttttgtcttcaataacagtctactcaggccctcaactaattgggtgaggctcac

SEQ ID NO: 53602 - DNA, 201 bp, Homo sapiens; identical to SEQ ID NO: 10144

SEQ ID NO: 53603 - DNA, 201 bp, Homo sapiens
aatgcaaaaaataatcacctttgataccaatgtgcaccaatatgcctaactagctagccagctggagataatttaccagggaatgtttcaaagccctaacyttgaagtttggaaacaggtggtcttctatgctgcagagaaactatgcattaggtctcttttcaattagaaacctttactatttccaatgtatgtttgtta

SEQ ID NO: 53604 - DNA, 201 bp, Homo sapiens
ggtttctgcaaattacagaagagccagccaagatcacccaggagcttgtgcccccagatgggccaaagaaagagcctatgaaggagaagcagaagcagacrgctggcctggctcaccttcccacgccagtggggcaggggtctgcttcaggaaatggaagctgtccaggaaatgagcagagattcacaagacagcactttg

SEQ ID NO: 53605 - DNA, 201 bp, Homo sapiens
gctcatgagtgatgggagagatctgggcaggcaacctcctctcatcctgcatcatcagcctggacttggaacttggctgctttttctttctgcagttagcrgagggccttggccaacacataagcctttctgccagcacttggcattccagctgacctcgacccaaggcctctgtgacttcaggaggcggcagctgggaag

SEQ ID NO: 53606 - DNA, 201 bp, Homo sapiens
ttcaggtttctgcaaattacagaagagccagccaagatcacccaggagcttgtgcccccagatgggccaaagaaagagcctatgaaggagaagcagaagcrgacggctggcctggctcaccttcccacgccagtggggcaggggtctgcttcaggaaatggaagctgtccaggaaatgagcagagattcacaagacagcac

SEQ ID NO: 53607 - DNA, 201 bp, Homo sapiens
tcagaagcaggctaaactcacctaggggagagtcctatcccaggtagtggtcatgcttggggacaggtggtgactaggaggggcacaaggaaggctgcagsgtccggcccatcttgttgctggcctgggtgctggtctcactgatctctgtgtggtggggcaggtcagcctcccaggcctgctggtgcctgcagtgcccag

SEQ ID NO: 53608 - DNA, 201 bp, Homo sapiens
gatttctcaaccagttttcatctttgaaagtgccatttctccctttatcattgtgatttttattcaaatgcatgagtctctgattttctaccatatacaaagggtagagactacagtttcctatagaagaaacttcacatagtggccgaaggatcttatttctcaaaattcaggaactggtttcctctttctggaaattat

SEQ ID NO: 53609 - DNA, 201 bp, Homo sapiens
attgcttgaacccaggaggcggaggttgcagtgagctgagattacaccattgcactccagcctgggcaacagagcaagcctccgtcttaaaaaaaaaaaaaggaacaattcctgaagcttctgatgatttctggctgaccatgaggttggaagtgggaacacattaagggcttaatgatgggacacagtgatgtaaccact

SEQ ID NO: 53610 - DNA, 201 bp, Homo sapiens
tgtgtttcttagcatttcaggaattaaaccacattcagaaccccaaataacctttcccctttcttcttacccactatcataggtggtattttaatgaagcrtctgtgccttgggtgctatttacaccaattttggtaggtcatactattttgagaatggtcttttgatagggagaaatttctaagacccatggtaataaaa

SEQ ID NO: 53611 - DNA, 201 bp, Homo sapiens
ccgtgcctgcacttggcgatcccaggagcacagaaatgcaccagacagatcatgaagggctaatgcttggaaaccacaccatttcctgacagagtgaaggratccctgtggatttatcaaaagggaggagggaatttaagctaattctcttcacctgctgtattctcaaatctccaaaacaccagataacttaggtttttt

SEQ ID NO: 53612 - DNA, 201 bp, Homo sapiens
gaggatgctggcacagggcactgttcacagactgcctttgctccatgccttttccatgagcatgagtggctgttcgtgtgggaaacggcagagccctcgcrgtccccatcagcactgtgcagtggtaccggaggtggcaggagacagcctgatggcccaggttgtcttcatacccggcttcatgccagggtgcatgccggg

SEQ ID NO: 53613 - DNA, 201 bp, Homo sapiens
atgcttacacctcctggtctgaccgggctctcctttgcagagccttttattccttcccttcctctgaacactggctggctgctttcagggaagaagttcarggcagtggcagggagctccttgcacatcgccatgacaaatgttttatggaaacagtgagctgatgggacgaggggtcggggctagaaagtcagccaaaag

SEQ ID NO: 53614 - DNA, 201 bp, Homo sapiens
tttgattttttttactttatctttttctctctgttctctagttcattggtttccactctaatatttattaatttcccttcttctcactttgggtttaattygttctgtcttttcttattgtagttacttacaatggaagcttacacacttgatttaagattttttttctaatgtagacatttacagctataaatttccctt

SEQ ID NO: 53615 - DNA, 201 bp, Homo sapiens
ggcctgcgttagtgagacctgacctgccacaacacatcttactcggaatgctgcccataacttcaaaaaatcagctttgacggagccctactgaacacacstagcatctctcttccttcagcttagggtcaaggggctggggttgatggcaccattgaaagaaacagctttattgccgtgtcattgatatgccataaaatt

SEQ ID NO: 53616 - DNA, 201 bp, Homo sapiens; identical to SEQ ID NO: 10151

SEQ ID NO: 53617 - DNA, 201 bp, Homo sapiens; identical to SEQ ID NO: 10157

SEQ ID NO: 53618 - DNA, 201 bp, Homo sapiens
gacatgttctgaaactccactctgcccggccttggcttcgacgtgtctggtgaatgtgtgggctgtgaggctccccgaacgtagacctcagactgcaacgytggccgttacagggtctggcacacgggcccacgtcaggcccatcgccacagtgatggttgttctgtgactgtttctggtggcctctgctccacactccag

SEQ ID NO: 53619 - DNA, 201 bp, Homo sapiens
tcattcatgcagcatcttactgagctcatgtgggctcgtgggctcgtgggctcgccaggtcggtaaaacccagctccttctccagaggctgcgtctcaccsagggatggtggcttctgctgccccctcctctctgtaactgtggccggccgtcatgctgagccaccccctcaatacaaggctccagatgtttcctgctcac

SEQ ID NO: 53620 - DNA, 201 bp, Homo sapiens
ggtctggcacacgggcccacgtcaggcccatcgccacagtgatggttgttctgtgactgtttctggtggcctctgctccacactccaggctgacgctgtgycccttccactgggaccctcgggtggcttccatgcacttgtgccctaaatcctgctcctagactaaacttcatctcctgtgttctcattctgcagcatggc

SEQ ID NO: 53621 - DNA, 201 bp, Homo sapiens
aagctttgttgctagtggccccgaacagtgaaaaaaccacagtgtctgtcaataggagacagaataaatgaattgtggcggattaacaatggcgtgcttckcagaaatgaaaaagaacgaacgattgatacacgtgacaatataggtgaatcttcaaaacagcatgcggtgtgatgcggccagacataaaagagcatgtat

SEQ ID NO: 53622 - DNA, 201 bp, Homo sapiens
tttataagggcactggcttttaatatttaatttaaccactcagtcagtactgaaacagttgttagggaggcctgcgttagtgagacctgacctgccacaamacatcttactcggaatgctgcccataacttcaaaaaatcagctttgacggagccctactgaacacacctagcatctctcttccttcagcttagggtcaag

SEQ ID NO: 53623 - DNA, 201 bp, Homo sapiens
gcacgcctctctccatgtgcagtaggaaggatgtcctcgtggtgaccccttggctggctcccattgtctgggagggcacattcaacatcgacatcctcaaygagcagttcaggctccagaacaccaccattgggttaactgtgtttgccatcaagaagtaagtcagtgaggtggccgagggtagagacccaggcagtggcg

SEQ ID NO: 53624 - DNA, 201 bp, Homo sapiens
ggaagggtggtcagaggaggcagaagctgagtggagtttccaggtgggggcggccgtgtgccagaggcgcatgtgggtggcaccctgccagctccatgtgrccgcacgcctctctccatgtgcagtaggaaggatgtcctcgtggtgaccccttggctggctcccattgtctgggagggcacattcaacatcgacatcctc

SEQ ID NO: 53625 - DNA, 201 bp, Homo sapiens
tctggaagggtggtcagaggaggcagaagctgagtggagtttccaggtgggggcggccgtgtgccagaggcgcatgtgggtggcaccctgccagctccatrtgaccgcacgcctctctccatgtgcagtaggaaggatgtcctcgtggtgaccccttggctggctcccattgtctgggagggcacattcaacatcgacatc

SEQ ID NO: 53626 - DNA, 201 bp, Homo sapiens
ggttggtttcccggggaagggcggctgcctctggaagggtggtcagaggaggcagaagctgagtggagtttccaggtgggggcggccgtgtgccagaggcrcatgtgggtggcaccctgccagctccatgtgaccgcacgcctctctccatgtgcagtaggaaggatgtcctcgtggtgaccccttggctggctcccattg

SEQ ID NO: 53627 - DNA, 201 bp, Homo sapiens
gatgtaaatctcagttggggctgcttcgttctctcctctcagattctcctgacatctgaattcagaggcccacatggctgtcctctttccctttgctttcwctgacttgcgtctcttgtttcctgtccctttgttctccaaagcccctgcaaaggcctgataggtacctcctacctggggaggggcagcgggggttgggtg

SEQ ID NO: 53628 - DNA, 201 bp, Homo sapiens
tactaggggaagttggtggctcctctccctggcaggaactggtctgggctcctggctcagcctggccatgaggctgtcctggcctccctcggtgggttcgrcagtgacctcgacgtgctcatttcagtgtggttcattccggtctcccaggggaagggggtgctgagtggaaggaggtcaatgggaagccggggtggctct

SEQ ID NO: 53629 - DNA, 201 bp, Homo sapiens
atccatgctggccggggtgctggctgtgggcgggggtcccactctgggaactccccctccccttcctgggcccgctctctatgctctgcccagtgtagacrtgctcaactctgtggccttgaagggtcacctggatacctctggagtcagccttgacctcccttctgacctccagtccccaactccaggcttacccagagt

SEQ ID NO: 53630 - DNA, 201 bp, Homo sapiens
tagacgcctttcaggcttgcccttgtgaaaacgatagtcccctcttacctgcgggggataggttccgagatccccagtggatgtctgaaaccacagatagyaccaaaccctacagagagtatgttttctcctgtacacacatacctatgatagggtttaatttataaattaggcaccgggtgggattaacaaccataatta

SEQ ID NO: 53631 - DNA, 201 bp, Homo sapiens
ctgaccgttgtacagcagtgccacatctcctagtttccagaacatttaatgtgttgctgtggaggcctggcagctctgaagtagccccttgcgcccaggasaaaccgggcctggaggggtggggtggggtaagctgaagcttccagtatcccacgtgggcattctgttgctgagggcaaccgcccctccctgcaagggagg

SEQ ID NO: 53632 - DNA, 201 bp, Homo sapiens
ggagtttccaggtgggggcggccgtgtgccagaggcgcatgtgggtggcaccctgccagctccatgtgaccgcacgcctctctccatgtgcagtaggaagkatgtcctcgtggtgaccccttggctggctcccattgtctgggagggcacattcaacatcgacatcctcaacgagcagttcaggctccagaacaccaccat

SEQ ID NO: 53633 - DNA, 201 bp, Homo sapiens; identical to SEQ ID NO: 10149

SEQ ID NO: 53634 - DNA, 201 bp, Homo sapiens; identical to SEQ ID NO: 10150

SEQ ID NO: 53635 - DNA, 201 bp, Homo sapiens
agataattaagtctattagcaacattagaaaatttaagttaaaatttaaatgactctagcaagaattagcctttaggtgccctgggtccccctccccacckccccccaccccgccgccttctgagaagcgttttgtaatttttcttatttataaaatgggtttgattcaaaactgacttttcctcttcacagtctcacagg

SEQ ID NO: 53636 - DNA, 201 bp, Homo sapiens
gagggagggctgggaatgatttgcccggttggagtcgcatttgcctctggttggtttcccggggaagggcggctgcctctggaagggtggtcagaggaggmagaagctgagtggagtttccaggtgggggcggccgtgtgccagaggcgcatgtgggtggcaccctgccagctccatgtgaccgcacgcctctctccatgt

SEQ ID NO: 53637 - DNA, 201 bp, Homo sapiens
gtggggtggcggccagccttgtcctcccagagggtagatgggaaaggtcattcatgcagcatcttactgagctcatgtgggctcgtgggctcgtgggctcrccaggtcggtaaaacccagctccttctccagaggctgcgtctcacccagggatggtggcttctgctgccccctcctctctgtaactgtggccggccgtca

SEQ ID NO: 53638 - DNA, 201 bp, Homo sapiens; identical to SEQ ID NO: 10155

SEQ ID NO: 53639 - DNA, 201 bp, Homo sapiens
cctttgctttctctgacttgcgtctcttgtttcctgtccctttgttctccaaagcccctgcaaaggcctgataggtacctcctacctggggaggggcagcrggggttgggtgctggggagggtttgttcctatctctttgccagcaaagctcagcttgctgtgtgttcccgcaggtccaatgttgagggagggctgggaat

SEQ ID NO: 53640 - DNA, 201 bp, Homo sapiens
ataagcatgagccactgcacctggccccaacatcatttattgaacagactgtcgtttccacattgtgtttcttggcatttctgtcaaaaatcagttgaccrtaaatgcatggattcacttccgggctctctattctgtttcattggtctgtttgtttttatgccaataccatgatgttttgattattatagctttatagta

SEQ ID NO: 53641 - DNA, 201 bp, Homo sapiens
tggcgggagggtcaatgcccagtcatggttcagcggctgtgcacacccctgcttacctgcatcccacgctttccatgcaaactcacgtggcggcgctttgygcttgcaggatggtctacccccagccaaaggtgctgacaccgtggtgagtaaagttactgacactgaaactgaacgcagctcaaggggctgttctgaagg

SEQ ID NO: 53642 - DNA, 201 bp, Homo sapiens
ccctccaggccctttcctgtgtcctcgggcccctcgggtccctgcaccaggccagcagcaatcgggtgtcagaggttcaagtccaggctgactcctgggaygcaccgactttgcccaggagggctggggagagggcagccccaaagtgtcatctttgattattctttgtccccaaagccagccttgggcatgtgcccagca

SEQ ID NO: 53643 - DNA, 201 bp, Homo sapiens
gttgttgttggtttttgtctgtgtcttttggtgtttcgtgttgctggcttttccagcacacagtcgcagatatatgaggcagaaagaaaacccagggaackcctgtcatgtcattcctcaggtcccaaggtccctacatggtctgccttcttctctccaccttttagtgtttggcatacatacgtttatgtatgtagttat

SEQ ID NO: 53644 - DNA, 201 bp, Homo sapiens
ctcattatagttttgatttgcatttccccaaggacaaatgatggcaagtggcttttcttgtgctttttagccatttgtatatgtttttggtgaaatgcctrttgaaatgttttgcctttttaaaaattgagttgtctcctttgttcagttttgagagttctttacatacacagtatcatatatatatatatatatatatat

SEQ ID NO: 53645 - DNA, 201 bp, Homo sapiens
taattattttggctgagggccaacttgttgggtttgttgttgttggtttttgtctgtgtcttttggtgtttcgtgttgctggcttttccagcacacagtcrcagatatatgaggcagaaagaaaacccagggaacgcctgtcatgtcattcctcaggtcccaaggtccctacatggtctgccttcttctctccacctttta

SEQ ID NO: 53646 - DNA, 201 bp, Homo sapiens
ggccaagaagagatcaaactgttcctggaccaaactgagggtggggctgctatctctcgcggcccaataacgagatgcagatgaactggggagaaagagastttttatttctgtaaccagttacaaggagaagacctggaaattatctccagaccaactcaaaattacaaagttttccagagcttatataccttctaagct

SEQ ID NO: 53647 - DNA, 201 bp, Homo sapiens
atttctttcacaaatgttttatagttttcagcatacagatctttcacttccttggttggatttatttgcaagtattttttgtagctattgtaaatgacatygttttcttgatttctttgttagggtatagaaatgctacagattgttgtatgttaattttatatcctgcaactttactgatttcatttattctaacatctt

SEQ ID NO: 53648 - DNA, 201 bp, Homo sapiens
tatgggacagctttctaattatttgtatcttcaatttctttcacaaatgttttatagttttcagcatacagatctttcacttccttggttggatttatttrcaagtattttttgtagctattgtaaatgacattgttttcttgatttctttgttagggtatagaaatgctacagattgttgtatgttaattttatatcctg

SEQ ID NO: 53649 - DNA, 201 bp, Homo sapiens
tcaggcttgttggggcgggcaggagagcagggtagtggagtcagagggagtgatcccccgaaaggcaggaagaggacatgagagagccttggagatgacgrtgaggatgtggttggtgggcggtgagctgggtgtcatgtgctggctccttagagaatgctcagctccttcacacccatcataatccctggaggactgaga

SEQ ID NO: 53650 - DNA, 201 bp, Homo sapiens
tccctcaggggcaggaacacagcccccaggcttgtcccacttgtccctctgaatagttaagggctgcccacagggaacttccctccctccctcccttcctycctgcctccctccctcccttctttccccttttcttctttcatcctcccctttcttccttccttactgtggtaaaatacacataacatgaaatttaccatc

SEQ ID NO: 53651 - DNA, 201 bp, Homo sapiens
gtcaggcttgttggggcgggcaggagagcagggtagtggagtcagagggagtgatcccccgaaaggcaggaagaggacatgagagagccttggagatgacsgtgaggatgtggttggtgggcggtgagctgggtgtcatgtgctggctccttagagaatgctcagctccttcacacccatcataatccctggaggactgag

SEQ ID NO: 53652 - DNA, 201 bp, Homo sapiens
tatcgctgagttctcaggaaggaacggtaaatacttcccgggtcattctttcacccacgggaaaacaggtttggagagatctgggacagtgctctggtccyaggcaggaagggctgagtggggcctgggactcaggtctgactgcaaacacctgcctcctccctgtgctgccagcgccttccgggttcttccctgtccctc

SEQ ID NO: 53653 - DNA, 201 bp, Homo sapiens
gataaggcatactgaggcctgacttggtgagggctcctgccccggaggtgcagccctggaggagcgggaggcagaggagtggaaaattcatgaagaaaacygggtatggtgtaggtcgaggccctgccctcagtaatgctcaccatttgtcagtgtttactgtgaggcagcactgtgttcaatatcgctgagttctcagga

SEQ ID NO: 53654 - DNA, 201 bp, Homo sapiens
tggttcagcggctgtgcacacccctgcttacctgcatcccacgctttccatgcaaactcacgtggcggcgctttgtgcttgcaggatggtctacccccagycaaaggtgctgacaccgtggtgagtaaagttactgacactgaaactgaacgcagctcaaggggctgttctgaaggtattagagggcggtttccttgatgt

SEQ ID NO: 53655 - DNA, 201 bp, Homo sapiens
gcaggccagtgaaccccaacgccaaaggccagggagagccgggtggggtacccagagccagcacacagccctttaatttagaggagtgctgtgtacacatytggggagagatgttttactttgatttggaatcaggtggcggataaggcatactgaggcctgacttggtgagggctcctgccccggaggtgcagccctgga

SEQ ID NO: 53656 - DNA, 201 bp, Homo sapiens
ttaagtcaagtggaaagcaatggcccctgaggtcacttagtccctcttgccagtttgtaagtgctgaatcagagactctgagctttggccctttcccgagktcccgggattatgagctgacacagcccccaagcaaccacagtgattccagcctgggagtgtggccttggcgggagggtcaatgcccagtcatggttcagc

SEQ ID NO: 53657 - DNA, 201 bp, Homo sapiens
acctgtccttaattttcttggcgccagaagatgaattgagtatttacccagacaacaacgtcgcttcagagggagggatgcagaacgcagggccacggggygcaggctgcaggccagtgaaccccaacgccaaaggccagggagagccgggtggggtacccagagccagcacacagccctttaatttagaggagtgctgtg

SEQ ID NO: 53658 - DNA, 201 bp, Homo sapiens
acgtccctcccagccttaagtcaagtggaaagcaatggcccctgaggtcacttagtccctcttgccagtttgtaagtgctgaatcagagactctgagcttyggccctttcccgagttcccgggattatgagctgacacagcccccaagcaaccacagtgattccagcctgggagtgtggccttggcgggagggtcaatgcc

SEQ ID NO: 53659 - DNA, 201 bp, Homo sapiens
gcccacagtgaattgagacacaaccccttacgtccctcccagccttaagtcaagtggaaagcaatggcccctgaggtcacttagtccctcttgccagtttrtaagtgctgaatcagagactctgagctttggccctttcccgagttcccgggattatgagctgacacagcccccaagcaaccacagtgattccagcctggg

SEQ ID NO: 53660 - DNA, 201 bp, Homo sapiens
acagttaaaatggccccggctcatgtctcctgagcctctacaatcctttaggtggggacagtactgcggcccacacgtccccacaggctgcgtgtgacacytgacagtgctttgtgccactgtggagcaggtgtcactctcccacttctcagagaggaagccgggctctggaagccagcagcccacaaggaggcccagcag

SEQ ID NO: 53661 - DNA, 201 bp, Homo sapiens
ctctcagattctcctgacatctgaattcagaggcccacatggctgtcctctttccctttgctttctctgacttgcgtctcttgtttcctgtccctttgttstccaaagcccctgcaaaggcctgataggtacctcctacctggggaggggcagcgggggttgggtgctggggagggtttgttcctatctctttgccagcaa

SEQ ID NO: 53662 - DNA, 201 bp, Homo sapiens
aggccaagctggccacactgcttttgattttttttaaattgtgatgaaatacgcttaacataaaatttgccatcttagtcattttggagtgttcagtagckttaagtccattcacattgctgtgcagccatcaccaccatccatctccagaactcttttcatcttgccaacctgaagctctgtccccataaaatagcaact

SEQ ID NO: 53663 - DNA, 201 bp, Homo sapiens
ataggtacctcctacctggggaggggcagcgggggttgggtgctggggagggtttgttcctatctctttgccagcaaagctcagcttgctgtgtgttcccrcaggtccaatgttgagggagggctgggaatgatttgcccggttggagtcgcatttgcctctggttggtttcccggggaagggcggctgcctctggaaggg

SEQ ID NO: 53664 - DNA, 201 bp, Homo sapiens
agaaacaacttaatgagacccagtgtctacaaaaagtagaataattagccgggcatgttggtgcatgtctgtagtcccacctaatcaggaggctgaggggsaaagatcacttaagctcaggagttcgaggttgcagcgagctgtgatcgtgccactgcactccagcctgggtgacagagtaagatcctgtctaaaaaaaat

SEQ ID NO: 53665 - DNA, 201 bp, Homo sapiens
ttacagactcgagccaccacgaccggctaatttttgtatttttagtggagatggaggattcaccatgttggccaggctggtctcgaacttctgacctcaastgatccgcccgcctcggcctctgaaagtgctaggattgtaggcatgagccaccgcgcccggcctcgtacggtaattctgtgtgatgttttgaggaattgc

SEQ ID NO: 53666 - DNA, 201 bp, Homo sapiens; identical to SEQ ID NO: 10179

SEQ ID NO: 53667 - DNA, 201 bp, Homo sapiens; identical to SEQ ID NO: 10180

SEQ ID NO: 53668 - DNA, 201 bp, Homo sapiens
ctgattttctttctaattattctatccattactgagagtggggtaggattttggtgtccaattattgtttttttgtttttttttttttgtttgtttgtttktttttttgaggtggagtctcactttgtcacccaggctggagtgcagtggtatgatcacagctcactgcagcccccacctcccaaggcttaggtcacctca

SEQ ID NO: 53669 - DNA, 201 bp, Homo sapiens; identical to SEQ ID NO: 10182

SEQ ID NO: 53670 - DNA, 201 bp, Homo sapiens
ttcccgggtcattctttcacccacgggaaaacaggtttggagagatctgggacagtgctctggtcccaggcaggaagggctgagtggggcctgggactcargtctgactgcaaacacctgcctcctccctgtgctgccagcgccttccgggttcttccctgtccctcctttgtggtctttgttttcccttttttgtcttaa

SEQ ID NO: 53671 - DNA, 201 bp, Homo sapiens; identical to SEQ ID NO: 10185

SEQ ID NO: 53672 - DNA, 201 bp, Homo sapiens
tttgttctccaaagcccctgcaaaggcctgataggtacctcctacctggggaggggcagcgggggttgggtgctggggagggtttgttcctatctctttgycagcaaagctcagcttgctgtgtgttcccgcaggtccaatgttgagggagggctgggaatgatttgcccggttggagtcgcatttgcctctggttggttt

SEQ ID NO: 53673 - DNA, 201 bp, Homo sapiens
tcacgctgctggccgcaccatgcactttttggaggaagggaccaacaggcagtcttcgttctgtgtcctgagtcttggcacacttcctttctgcagttacrgggtcctaagccccagaagtctaatgccaggaagcctggaacgggggttctggtgagtgcagggaagagcaggtggagcatccatgctggccggggtgct

SEQ ID NO: 53674 - DNA, 201 bp, Homo sapiens
gtgggacgtggcgaggcgcctgagctttgctgagaacttgccctacctgcctcgaggccttgcagcttcaccgggaactcttgtgctcacgctgctggccrcaccatgcactttttggaggaagggaccaacaggcagtcttcgttctgtgtcctgagtcttggcacacttcctttctgcagttacggggtcctaagcccc

SEQ ID NO: 53675 - DNA, 201 bp, Homo sapiens
atgcctgacctcgtgatccacccacctcggcctcccaaagtgctggggttacgggcgtgagccaccacgcctggccttagtttttgtatttttagtagagrtgaggtttcaccatgttggccaggctggtcttgaactcctgatctcaggtgatccacctgcctcggcctcccaaagtgctgagattacaggcatgagcca

SEQ ID NO: 53676 - DNA, 201 bp, Homo sapiens
gtctggggccttggagggctgtttcccaggatgtgggcctttatcagtgctgacctaggcaatcaaggccaagctggccacactgcttttgattttttttwaattgtgatgaaatacgcttaacataaaatttgccatcttagtcattttggagtgttcagtagctttaagtccattcacattgctgtgcagccatcacca

SEQ ID NO: 53677 - DNA, 201 bp, Homo sapiens
tacacagcaagaccctgacaaaaaaaaaaaaaaaaagaaaaagaaggtcacaaaaaaacagaaaactgcaaaatattgatgacaaaaattaaagaagacakaaataaatggagaaatataccatgctcatggattggaagacttacattgctaaactgtcacttctccccagatggatctacagagtccacataatctcac

SEQ ID NO: 53678 - DNA, 201 bp, Homo sapiens
aattctgggtcccaagctgttagtcgcttccagacacagaaggtcccagaaccaagagtgaagtcacctgtcacctctactggggcatctctggacacggyctggaaacactccctgacgtggcctcagggactgcactgatcaaggcactggtggcggggggtgagggagctggggctctggagctccagcaggtgccca

SEQ ID NO: 53679 - DNA, 201 bp, Homo sapiens
ggaataggtgcagttcaagcctggagggaggaagctctagggtgcagaggcgggtgtgtggaggcctcgcgtgcagcttataatgagggagcacgtggccrgcctggccataagaggggcagctgcgtggggaggcgtggctcaggccaggctgagggggagtgagcgggcgccagcctgcggcctgctaccagcctccag

SEQ ID NO: 53680 - DNA, 201 bp, Homo sapiens
ggtcccagaaccaagagtgaagtcacctgtcacctctactggggcatctctggacacggtctggaaacactccctgacgtggcctcagggactgcactgaycaaggcactggtggcggggggtgagggagctggggctctggagctccagcaggtgcccatacgtgagcaatatcccagggaccaccctcctgcccacctc

SEQ ID NO: 53681 - DNA, 201 bp, Homo sapiens
tcaagatgatgaacacagctgccaccccaggagtctgtcctgccccacgggttatgctgtcttagttggtctcatgtcagggagccttggaggaccagggwcgggcagttggtctctatactcctggggttctggcactggctctggcccatgaccgcacccaagacaaacgtcttgaagactaagaggttaggtctttga

SEQ ID NO: 53682 - DNA, 201 bp, Homo sapiens
cgggcaggtgggctcggccgcgctgtgggtgcctgggacccgcagggaggatgggcgcggtggcgcggcctggcggggggctcgtctccggggtccccggstcctggtgagagcggggtccctcgacgccgtggcggtctccagcctctcctcgcccctccacgctccccgccttccatgagctgctattttcagcaccta

SEQ ID NO: 53683 - DNA, 201 bp, Homo sapiens
tgaacagataattaagtctattagcaacattagaaaatttaagttaaaatttaaatgactctagcaagaattagcctttaggtgccctgggtccccctccycaccgccccccaccccgccgccttctgagaagcgttttgtaatttttcttatttataaaatgggtttgattcaaaactgacttttcctcttcacagtctc

SEQ ID NO: 53684 - DNA, 201 bp, Homo sapiens
cgggccggggtgggggcgcccagggctgcgaggcttcaggccggccgccgccccagcctccgagaccctgcgtcctggggagccggcgggcaggtgggctyggccgcgctgtgggtgcctgggacccgcagggaggatgggcgcggtggcgcggcctggcggggggctcgtctccggggtccccgggtcctggtgagagcg

SEQ ID NO: 53685 - DNA, 201 bp, Homo sapiens
cctcggccccgggtgcccgcgagggagccgctaccgcagggaatgcggggtgcacccgacagccgggccggggtgggggcgcccagggctgcgaggcttcrggccggccgccgccccagcctccgagaccctgcgtcctggggagccggcgggcaggtgggctcggccgcgctgtgggtgcctgggacccgcagggaggat

SEQ ID NO: 53686 - DNA, 201 bp, Homo sapiens
atggtttcatttttataaggataaattagagtttataaaaattaacacttcccttcaaaagaaaaattaaggaaaaatgaataaataagccaccgactgaragaaaatatttgttttctaagaagtattttgtttttcattttatgggttcatagtaggtgtatatatttatggggtccctgagatattgtggttcagtca

SEQ ID NO: 53687 - DNA, 201 bp, Homo sapiens
ctggccggtgagtgcaggcctcggccccgggtgcccgcgagggagccgctaccgcagggaatgcggggtgcacccgacagccgggccggggtgggggcgcycagggctgcgaggcttcaggccggccgccgccccagcctccgagaccctgcgtcctggggagccggcgggcaggtgggctcggccgcgctgtgggtgcct

SEQ ID NO: 53688 - DNA, 201 bp, Homo sapiens
cgccaggcaagggcgggggtcgtagcggggcggagcggggctttgtccacggaccgcgcgaagaggcctcagggcccggcgcgggcgccggagggggactygctcgcagggggaacgcgaaggttcctcagtctgcgggacgcagagctccgtggggccgcgagccggggccggggaagcgactctgcctagggggacgtc

SEQ ID NO: 53689 - DNA, 201 bp, Homo sapiens
gagggagggggccgctccttccccagtctctaccctgacttggccctcgtcctgcagccactcagagagcacgatggagctggagcttcagttttgaccaratgcgtgtcgccggcttttgtgtgtgtgtgtgtgtgatggagtctcgctctgtcgcccaggctggagtgcattggcaccatctctgcccactgcaacctc

SEQ ID NO: 53690 - DNA, 201 bp, Homo sapiens
acatgtgtgccatgtgggagctggggcaggtcctctttcctcctgtggctccgagggagggggccgctccttccccagtctctaccctgacttggccctcrtcctgcagccactcagagagcacgatggagctggagcttcagttttgaccaaatgcgtgtcgccggcttttgtgtgtgtgtgtgtgtgatggagtctcgc

SEQ ID NO: 53691 - DNA, 201 bp, Homo sapiens
gcctcccttcagtggctcccatgtcacagaattgtcctgcagccctggcacatgtgtgccatgtgggagctggggcaggtcctctttcctcctgtggctcygagggagggggccgctccttccccagtctctaccctgacttggccctcgtcctgcagccactcagagagcacgatggagctggagcttcagttttgacca

SEQ ID NO: 53692 - DNA, 201 bp, Homo sapiens
catctcctgtgttctcattctgcagcatggctgttagggaacctgaccatctgcagcgcgtctcgttgccaaggtataatgtcagtgcctcccttcagtgsctcccatgtcacagaattgtcctgcagccctggcacatgtgtgccatgtgggagctggggcaggtcctctttcctcctgtggctccgagggagggggccg

SEQ ID NO: 53693 - DNA, 201 bp, Homo sapiens
tccatgcacttgtgccctaaatcctgctcctagactaaacttcatctcctgtgttctcattctgcagcatggctgttagggaacctgaccatctgcagcgygtctcgttgccaaggtataatgtcagtgcctcccttcagtggctcccatgtcacagaattgtcctgcagccctggcacatgtgtgccatgtgggagctgg

SEQ ID NO: 53694 - DNA, 201 bp, Homo sapiens
ttccatgcacttgtgccctaaatcctgctcctagactaaacttcatctcctgtgttctcattctgcagcatggctgttagggaacctgaccatctgcagcrcgtctcgttgccaaggtataatgtcagtgcctcccttcagtggctcccatgtcacagaattgtcctgcagccctggcacatgtgtgccatgtgggagctg

SEQ ID NO: 53695 - DNA, 201 bp, Homo sapiens
gcttcgacgtgtctggtgaatgtgtgggctgtgaggctccccgaacgtagacctcagactgcaacgctggccgttacagggtctggcacacgggcccacgycaggcccatcgccacagtgatggttgttctgtgactgtttctggtggcctctgctccacactccaggctgacgctgtgccccttccactgggaccctcgg

SEQ ID NO: 53696 - DNA, 201 bp, Homo sapiens; identical to SEQ ID NO: 10158

SEQ ID NO: 53697 - DNA, 201 bp, Homo sapiens; identical to SEQ ID NO: 10160

SEQ ID NO: 53698 - DNA, 201 bp, Homo sapiens; identical to SEQ ID NO: 10161

SEQ ID NO: 53699 - DNA, 201 bp, Homo sapiens
gtgggaggagggccagatctggactgggtttggagatgctcaggtggggctcagagcatcacctgtggggcagagggaccatcttggcagatgaaggcccrtcgcagggtgtgatgcctgaattacaaggcgggacaggtaaagtggggcaggtgagagaaggagggtgagtgatgtgatttttctactcctgttttccag

SEQ ID NO: 53700 - DNA, 201 bp, Homo sapiens
tgggaaaggtcattcatgcagcatcttactgagctcatgtgggctcgtgggctcgtgggctcgccaggtcggtaaaacccagctccttctccagaggctgygtctcacccagggatggtggcttctgctgccccctcctctctgtaactgtggccggccgtcatgctgagccaccccctcaatacaaggctccagatgttt

SEQ ID NO: 53701 - DNA, 201 bp, Homo sapiens
gatctggactgggtttggagatgctcaggtggggctcagagcatcacctgtggggcagagggaccatcttggcagatgaaggcccgtcgcagggtgtgatrcctgaattacaaggcgggacaggtaaagtggggcaggtgagagaaggagggtgagtgatgtgatttttctactcctgttttccaggaaaaccaaaatgcc

SEQ ID NO: 53702 - DNA, 201 bp, Homo sapiens
agcagatgtacagtggtattgtgggggaccaatattgagtactctgccaaacaattggagcagcatttgcgctccgatccaattggccatccctttcaccytggcatttcaacaaccagacaggaagcaggtaacccaaaggaaaagagaaacccctcacgggtcctttgacctctcatatttacatagacagtatcgggg

SEQ ID NO: 53703 - DNA, 201 bp, Homo sapiens
ggtttggagatgctcaggtggggctcagagcatcacctgtggggcagagggaccatcttggcagatgaaggcccgtcgcagggtgtgatgcctgaattacraggcgggacaggtaaagtggggcaggtgagagaaggagggtgagtgatgtgatttttctactcctgttttccaggaaaaccaaaatgccacgcacttcga

SEQ ID NO: 53704 - DNA, 201 bp, Homo sapiens
gcttgctgtgtgttcccgcaggtccaatgttgagggagggctgggaatgatttgcccggttggagtcgcatttgcctctggttggtttcccggggaagggmggctgcctctggaagggtggtcagaggaggcagaagctgagtggagtttccaggtgggggcggccgtgtgccagaggcgcatgtgggtggcaccctgcca

SEQ ID NO: 53705 - DNA, 201 bp, Homo sapiens
acccagctactcgggaggctgaggcaggagaattgcttgaacccgggaggcggaggctgtagtgagccgaaggtgcccctttgcactccagcctgggcaaygagcaaaactccatctcaaaaacaacaacaaaacaacaacaacaacaaaaacaatatactgtaataaaggttacgtgaatgtggtctctctaaaaaaaaa

SEQ ID NO: 53706 - DNA, 201 bp, Homo sapiens
ggacacacttagataccactcctcatccactagcatggctaaaggataaaagagtgaccatcaagtgttggcaaggactgtggttctcgtacattcctggygggaatggaaaattcagtcaccactttggaacacagtttggcagtttcttacaaagttaaacatacacttaccatatgacccatcttttccattccttgg

SEQ ID NO: 53707 - DNA, 201 bp, Homo sapiens
ccctgccagctccatgtgaccgcacgcctctctccatgtgcagtaggaaggatgtcctcgtggtgaccccttggctggctcccattgtctgggagggcacrttcaacatcgacatcctcaacgagcagttcaggctccagaacaccaccattgggttaactgtgtttgccatcaagaagtaagtcagtgaggtggccgagg

SEQ ID NO: 53708 - DNA, 201 bp, Homo sapiens
acagcagctggagtgatctttccagaacataaggtaggaggctctccatgatctgatcctgccttcctgacctccccagcctcatctctccctcctctgcyctcgccctctgtgctccagccaacgtggcctgtcactcgtccacctgccatactgtcctgactccaggcctttgcctgtgctatggcctctgttgggacc

SEQ ID NO: 53709 - DNA, 201 bp, Homo sapiens
ggcctccctcggtgggttcgacagtgacctcgacgtgctcatttcagtgtggttcattccggtctcccaggggaagggggtgctgagtggaaggaggtcamtgggaagccggggtggctctcagagtctgcaggagcagtcgggctgatgagctgggaggagcagaccgcctccctcttctctgagtgggaggagggccag

SEQ ID NO: 53710 - DNA, 201 bp, Homo sapiens
cgggcgcggggcacagggtcctgcggggctggagggctacaggctgcggcgcgcgcgagccggaaggccggggatcgtgggttctggggccgcagcttcaygggttcgtctcccccgcctccccgggggagcaggatgtcagggggtcgcccccgcccgggagacagggtgtcaaggggcccccggggacggggcttcagg

SEQ ID NO: 53711 - DNA, 201 bp, Homo sapiens
tgggactctgggccaggccagagagggagctagccaggcaaccgcagacacatacttgacttctcggcagctgtgggcagctgggccagcgacagtggcgraggccaggaatgacttactcttaggaataggtgcagttcaagcctggagggaggaagctctagggtgcagaggcgggtgtgtggaggcctcgcgtgcagc

SEQ ID NO: 53712 - DNA, 201 bp, Homo sapiens
aaccatttttgccacattgaaggaaaattatttccaccaagatttccctacagccaaacgatctaccaactacaaaaatggaaaaaataatttaggacatrtaaagttcaaatgttttgcctcccacgtttcggtttcaagaagctattcgagataaatcgctccgtggtcacaggacttagaaaggtggaggtaaacaca

SEQ ID NO: 53713 - DNA, 201 bp, Homo sapiens
cttgtctcctaaatcatgggggtttgggaagttccttcagacccccagtaaacttatttgtggagtcctggggaatttcttcagatccccaataaaacttrtttaatcctaaatgggtcctgttaagaattccttcgttattttgtcatgcttgaaggcccaggaaaggtctaggcaaaactcttggtgggattttgttat

SEQ ID NO: 53714 - DNA, 201 bp, Homo sapiens
gccatcttggacattcaaattgtggccattactgacagttaaaatggccccggctcatgtctcctgagcctctacaatcctttaggtggggacagtactgyggcccacacgtccccacaggctgcgtgtgacacctgacagtgctttgtgccactgtggagcaggtgtcactctcccacttctcagagaggaagccgggct

SEQ ID NO: 53715 - DNA, 201 bp, Homo sapiens
cgccccagggccgccgggcggaaggcggaggccgagaccagacgcggagccatggccgaggtgttgcggacgctggccggtgagtgcaggcctcggccccrggtgcccgcgagggagccgctaccgcagggaatgcggggtgcacccgacagccgggccggggtgggggcgcccagggctgcgaggcttcaggccggccgc

SEQ ID NO: 53716 - DNA, 201 bp, Homo sapiens
gcggattaacaatggcgtgcttctcagaaatgaaaaagaacgaacgattgatacacgtgacaatataggtgaatcttcaaaacagcatgcggtgtgatgcrgccagacataaaagagcatgtatcagaggattccgtgtatgggaaacgccagggaatcagatccatggttgtcagggtcaggagggaccttactggggtg

SEQ ID NO: 53717 - DNA, 201 bp, Homo sapiens
gggtgggagggaaaggaagcattaaagatgcccccagctttcacggagatgagaacggtgccccgggagggcgggacgggatcagggtcctgtgaacgggktatcagtgtaaactcctctgagagatatcaggaaaagcaggaagaagcctctgggacccttcgggaggtaactcctcttcgcagcggggcgcgctctccc

SEQ ID NO: 53718 - DNA, 201 bp, Homo sapiens; identical to SEQ ID NO: 10166

SEQ ID NO: 53719 - DNA, 201 bp, Homo sapiens; identical to SEQ ID NO: 10177

SEQ ID NO: 53720 - DNA, 201 bp, Homo sapiens; identical to SEQ ID NO: 10178

SEQ ID NO: 53721 - DNA, 201 bp, Homo sapiens; identical to SEQ ID NO: 10181

SEQ ID NO: 53722 - DNA, 201 bp, Homo sapiens
tcatgtattgctgcgggataattaaggaatcagagagaccgatggggttgaggaggaattatttaattatttaggcgcaccgacccaatcagattaacatscaaaggaccgggccccaaacaaagagtcaagctaccttttaagcattttgtggggtggggggagatttgtgcagggggaagagtattacagaagcgagaa

SEQ ID NO: 53723 - DNA, 201 bp, Homo sapiens; identical to SEQ ID NO: 10184

SEQ ID NO: 53724 - DNA, 201 bp, Homo sapiens; identical to SEQ ID NO: 10183

SEQ ID NO: 53725 - DNA, 201 bp, Homo sapiens; identical to SEQ ID NO: 10186

SEQ ID NO: 53726 - DNA, 201 bp, Homo sapiens; identical to SEQ ID NO: 10190

SEQ ID NO: 53727 - DNA, 201 bp, Homo sapiens; identical to SEQ ID NO: 10187

SEQ ID NO: 53728 - DNA, 201 bp, Homo sapiens; identical to SEQ ID NO: 10192

SEQ ID NO: 53729 - DNA, 201 bp, Homo sapiens; identical to SEQ ID NO: 10191

SEQ ID NO: 53730 - DNA, 201 bp, Homo sapiens
tggagatgctcaggtggggctcagagcatcacctgtggggcagagggaccatcttggcagatgaaggcccgtcgcagggtgtgatgcctgaattacaaggygggacaggtaaagtggggcaggtgagagaaggagggtgagtgatgtgatttttctactcctgttttccaggaaaaccaaaatgccacgcacttcgaccta

SEQ ID NO: 53731 - DNA, 201 bp, Homo sapiens
tgaattacaaggcgggacaggtaaagtggggcaggtgagagaaggagggtgagtgatgtgatttttctactcctgttttccaggaaaaccaaaatgccacrcacttcgacctatgatccttttcctaataatgcttgtcttggtcttgtttgggtaagacacatttgaccatcgaggctggcctggtttggggagaagtga

SEQ ID NO: 53732 - DNA, 201 bp, Homo sapiens
tgcagcttataatgagggagcacgtggccggcctggccataagaggggcagctgcgtggggaggcgtggctcaggccaggctgagggggagtgagcgggcrccagcctgcggcctgctaccagcctccagccacctgccctcagccctccttagtaagagggggtgctggtggtcccccatcgctgggaagaggatgaagt

SEQ ID NO: 53733 - DNA, 201 bp, Homo sapiens; identical to SEQ ID NO: 10195

SEQ ID NO: 53734 - DNA, 201 bp, Homo sapiens
gttgcccaggctggagtgcagtggtgcgattttggttcactgcaacctccacctcccaagttcaagcgattctcctgcctcagcgtcccaagtagctgggrttacagactcgagccaccacgaccggctaatttttgtatttttagtggagatggaggattcaccatgttggccaggctggtctcgaacttctgacctcaa

SEQ ID NO: 53735 - DNA, 201 bp, Homo sapiens; identical to SEQ ID NO: 10146

SEQ ID NO: 53736 - DNA, 201 bp, Homo sapiens
aaggcactggtggcggggggtgagggagctggggctctggagctccagcaggtgcccatacgtgagcaatatcccagggaccaccctcctgcccacctccmggtgtgggacgtggcgaggcgcctgagctttgctgagaacttgccctacctgcctcgaggccttgcagcttcaccgggaactcttgtgctcacgctgctg

SEQ ID NO: 53737 - DNA, 201 bp, Homo sapiens
ctaaactgtcacttctccccagatggatctacagagtccacataatctcacttaaaactccagaagaaatttttgtaaagttgacagctgattctaaaatkttacatagtaatcagaataggttgatattaggatagacagatagttcaatggaatagaatgcagagtttagaaatagacctacacagaaatagtccattg

SEQ ID NO: 53738 - DNA, 201 bp, Homo sapiens
tggagaaatataccatgctcatggattggaagacttacattgctaaactgtcacttctccccagatggatctacagagtccacataatctcacttaaaacyccagaagaaatttttgtaaagttgacagctgattctaaaattttacatagtaatcagaataggttgatattaggatagacagatagttcaatggaataga

SEQ ID NO: 53739 - DNA, 201 bp, Homo sapiens
tttctagtgataataactctttcaaccaattgccaataaaaaaattttgaatctacctataacctggaacctccccgctccaccttcgagttgtcctaccwttctggacagaagcaatgtggatcttgcatgtatttgattgatgtctcatgtctccctaaaatgtatacaattaggctgtgcccagatcaccctgggcac

SEQ ID NO: 53740 - DNA, 201 bp, Homo sapiens
tgggaggctgaggcatgagaattgcttgaacccaggagggagaggttgcagtgactggagatcacaccactgcactccagactgggcaacagggcaagacwcagtctaaaaaaaaaaaaaaaagaaaaaagaaaaacaagaataaatcaattatttttctataatacttgccacaatcaattgaaccatgaaaaattttaa

SEQ ID NO: 53741 - DNA, 201 bp, Homo sapiens
tgcccacaattgcgtggctgggggtggggaaggcaattctgggtcccaagctgttagtcgcttccagacacagaaggtcccagaaccaagagtgaagtcayctgtcacctctactggggcatctctggacacggtctggaaacactccctgacgtggcctcagggactgcactgatcaaggcactggtggcggggggtgag

SEQ ID NO: 53742 - DNA, 201 bp, Homo sapiens
gtaatttttcttatttataaaatgggtttgattcaaaactgacttttcctcttcacagtctcacaggtccttccccaggtccaagaggctcttctgtgtcctgatgacaagtagctgcctagccgtggtggcacctcctatcacatgttaagggacccctccccagggccacacctggcagaaggtggcttatgatgttcg

SEQ ID NO: 53743 - DNA, 201 bp, Homo sapiens
gatcacttgaggccaggagtttgagagcagcctggcccacatggcaagactccatctttacaaaaatacaaaaaaaaaaaaaaagttgagtgtggtggtgygcctgtaatcccacctacttgggaggctgaggcatgagaattgcttgaacccaggagggagaggttgcagtgactggagatcacaccactgcactccaga

SEQ ID NO: 53744 - DNA, 201 bp, Homo sapiens
aattgcgtggctgggggtggggaaggcaattctgggtcccaagctgttagtcgcttccagacacagaaggtcccagaaccaagagtgaagtcacctgtcasctctactggggcatctctggacacggtctggaaacactccctgacgtggcctcagggactgcactgatcaaggcactggtggcggggggtgagggagctg

SEQ ID NO: 53745 - DNA, 201 bp, Homo sapiens
tggggtaagctgaagcttccagtatcccacgtgggcattctgttgctgagggcaaccgcccctccctgcaagggaggggaaggagcaggcaggcacacccktcctccctccacatttcactggagttgacctgtgtcctactgtggttgcacctggaccagcccagagggactggagtgactcttcccgcaggtagggcac

SEQ ID NO: 53746 - DNA, 201 bp, Homo sapiens
agatcacttgaggccaggagtttgagagcagcctggcccacatggcaagactccatctttacaaaaatacaaaaaaaaaaaaaaagttgagtgtggtggtrcgcctgtaatcccacctacttgggaggctgaggcatgagaattgcttgaacccaggagggagaggttgcagtgactggagatcacaccactgcactccag

SEQ ID NO: 53747 - DNA, 201 bp, Homo sapiens
caggcgcctaaattgcttgggcggagtccggctgctctctccctccaggccctttcctgtgtcctcgggcccctcgggtccctgcaccaggccagcagcartcgggtgtcagaggttcaagtccaggctgactcctgggacgcaccgactttgcccaggagggctggggagagggcagccccaaagtgtcatctttgatta

SEQ ID NO: 53748 - DNA, 201 bp, Homo sapiens
caaggtctcaagatacaaagtcaatgaataaatcaggctgggtgtggtggctcacacctgcaatcccagcactttgggaggccaagataggtagatcactygaggccaggagtttgagagcagcctggcccacatggcaagactccatctttacaaaaatacaaaaaaaaaaaaaaagttgagtgtggtggtgcgcctgta

SEQ ID NO: 53749 - DNA, 201 bp, Homo sapiens
ttactcttgatttcttcctgtatattcaagttattgtctggtgacctttccttgctccagtatatataataacttcattgcctccttgctcctttatgctrttattgtcatatatattatatatgtttatgctgtgagcccatcagctaagtcagcttagcaaggtctcaagatacaaagtcaatgaataaatcaggctgg

SEQ ID NO: 53750 - DNA, 201 bp, Homo sapiens
tcagtaagacaagtaaggagaaaaacacttttcaagtcttttatattacactgtatatttatcactgactttactcttgatttcttcctgtatattcaagytattgtctggtgacctttccttgctccagtatatataataacttcattgcctccttgctcctttatgctattattgtcatatatattatatatgtttatg

SEQ ID NO: 53751 - DNA, 201 bp, Homo sapiens
ccgctctctatgctctgcccagtgtagacatgctcaactctgtggccttgaagggtcacctggatacctctggagtcagccttgacctcccttctgacctycagtccccaactccaggcttacccagagttcccatgcatggtctctgctcccccatccccacccctcctccaccagccatcctcaactctccctttgctc

SEQ ID NO: 53752 - DNA, 201 bp, Homo sapiens
aaaaattatttagtctgacgttagcatttctcctcaagctcccttacggttgtttgcatagcaaatctactatccttttgctttgacctatttgtatcttwgtttctaaagtatgtatgtctctcacaggcagcatatagtcaaagcttaaaaaaaaaatccagtctaacgatctctgccttttgattggcatgttcattc

SEQ ID NO: 53753 - DNA, 201 bp, Homo sapiens; identical to SEQ ID NO: 10156

SEQ ID NO: 53754 - DNA, 201 bp, Homo sapiens
aggtatgtatatatttctgtttgttatattttcgtgatgtattcactttatatcatggcagaatgtttctctttagtaagatttttgatcttaaaaaagtyggccagatggggtggctcatgcctgtaatcccagcactttgggaggccaaggcaggtggatcacctgaggtcaggagttcaagactagcctggcgaacat

SEQ ID NO: 53755 - DNA, 201 bp, Homo sapiens
ttgatgggagggggcctcatggtttgtagacatgttctgaaactccactctgcccggccttggcttcgacgtgtctggtgaatgtgtgggctgtgaggctycccgaacgtagacctcagactgcaacgctggccgttacagggtctggcacacgggcccacgtcaggcccatcgccacagtgatggttgttctgtgactgt

SEQ ID NO: 53756 - DNA, 201 bp, Homo sapiens; identical to SEQ ID NO: 10162

SEQ ID NO: 53757 - DNA, 201 bp, Homo sapiens
aaaaaggagggacccaccccttgcaaagtcatggactgtcactccaggaccaacaccctccaaaccaatgttcaaaagggtttagtctgtctttttttttaattcctttagttaccaaagaacatcttatcatcaatgtaacccgatcaccctgccctcaaacgatcacattcaatgcttgccttgtcatgccctgtggag

SEQ ID NO: 53758 - DNA, 201 bp, Homo sapiens
agtgattctcctgcctcagtttcctgagtagctgggactacaggcacccaccaccacgcccggctagtttttgtatttttaaactttttttttcttttttytttttcttcttttttttttttttgagatggagtctcgctctgtcgcccgggctggagtgcagtggtgcaatctcggctcactgcaacctccgtctcccag

SEQ ID NO: 53759 - DNA, 201 bp, Homo sapiens
ggtttaagtgattctcctgcctcagtttcctgagtagctgggactacaggcacccaccaccacgcccggctagtttttgtatttttaaactttttttttcytttttctttttcttcttttttttttttttgagatggagtctcgctctgtcgcccgggctggagtgcagtggtgcaatctcggctcactgcaacctccgtc

SEQ ID NO: 53760 - DNA, 201 bp, Homo sapiens
aggtttaagtgattctcctgcctcagtttcctgagtagctgggactacaggcacccaccaccacgcccggctagtttttgtatttttaaactttttttttyttttttctttttcttcttttttttttttttgagatggagtctcgctctgtcgcccgggctggagtgcagtggtgcaatctcggctcactgcaacctccgt

SEQ ID NO: 53761 - DNA, 201 bp, Homo sapiens
ctctccctccaggccctttcctgtgtcctcgggcccctcgggtccctgcaccaggccagcagcaatcgggtgtcagaggttcaagtccaggctgactcctsggacgcaccgactttgcccaggagggctggggagagggcagccccaaagtgtcatctttgattattctttgtccccaaagccagccttgggcatgtgccc

SEQ ID NO: 53762 - DNA, 201 bp, Homo sapiens
gggctggggagagggcagccccaaagtgtcatctttgattattctttgtccccaaagccagccttgggcatgtgcccagcacagggagagctgctgcctcygtgggcttgagtcatttttgcttccttgcccctctctgctctgtttggtttaaaaaacaaaaaccaacacccatgggtgaggcgaggcgaggcgaggctt

SEQ ID NO: 53763 - DNA, 201 bp, Homo sapiens
tttgtaatttttcttatttataaaatgggtttgattcaaaactgacttttcctcttcacagtctcacaggtccttccccaggtccaagaggctcttctgtgtcctgatgacaagtagctgcctagccgtggtggcacctcctatcacatgttaagggacccctccccagggccacacctggcagaaggtggcttatgatgt

SEQ ID NO: 53764 - DNA, 201 bp, Homo sapiens
cactgcactccaacctgggtgatagagtgagactctgtctcaaaaaaacaaaaaaattatttagtctgacgttagcatttctcctcaagctcccttacggytgtttgcatagcaaatctactatccttttgctttgacctatttgtatcttagtttctaaagtatgtatgtctctcacaggcagcatatagtcaaagctta

SEQ ID NO: 53765 - DNA, 201 bp, Homo sapiens
gtcaggagttcaagactagcctggcgaacatggtgaaaccccgtctctactgaaaatacaaaaaaattagccagccatgatggtgtgtgcctgtaatcccwgctacttgggaggctgaggcacgagaattgcttgaacccgggaggctgaggttacagtcagccaagatcgtgccactgcactccaacctgggtgatagag

SEQ ID NO: 53766 - DNA, 201 bp, Homo sapiens
tgccatcaagaagtaagtcagtgaggtggccgagggtagagacccaggcagtggcgagtgactgtggacattgaggtctctccttgtgttcaagacagagwggggtggcggccagccttgtcctcccagagggtagatgggaaaggtcattcatgcagcatcttactgagctcatgtgggctcgtgggctcgtgggctcgc

SEQ ID NO: 53767 - DNA, 201 bp, Homo sapiens
cccttcaattctgtgagtttttgcttcatgtattgctgcgggataattaaggaatcagagagaccgatggggttgaggaggaattatttaattatttaggygcaccgacccaatcagattaacatccaaaggaccgggccccaaacaaagagtcaagctaccttttaagcattttgtggggtggggggagatttgtgcagg

SEQ ID NO: 53768 - DNA, 201 bp, Homo sapiens
gccaaggcaggtggatcacctgaggtcaggagttcaagactagcctggcgaacatggtgaaaccccgtctctactgaaaatacaaaaaaattagccagccrtgatggtgtgtgcctgtaatcccagctacttgggaggctgaggcacgagaattgcttgaacccgggaggctgaggttacagtcagccaagatcgtgccac

SEQ ID NO: 53769 - DNA, 201 bp, Homo sapiens
ttcagacccccagtaaacttatttgtggagtcctggggaatttcttcagatccccaataaaacttgtttaatcctaaatgggtcctgttaagaattccttygttattttgtcatgcttgaaggcccaggaaaggtctaggcaaaactcttggtgggattttgttatattccagcctttttataagggcactggcttttaat

SEQ ID NO: 53770 - DNA, 201 bp, Homo sapiens
ggccaaggcaggtggatcacctgaggtcaggagttcaagactagcctggcgaacatggtgaaaccccgtctctactgaaaatacaaaaaaattagccagcyatgatggtgtgtgcctgtaatcccagctacttgggaggctgaggcacgagaattgcttgaacccgggaggctgaggttacagtcagccaagatcgtgcca

SEQ ID NO: 53771 - DNA, 201 bp, Homo sapiens
attttcgtgatgtattcactttatatcatggcagaatgtttctctttagtaagatttttgatcttaaaaaagttggccagatggggtggctcatgcctgtratcccagcactttgggaggccaaggcaggtggatcacctgaggtcaggagttcaagactagcctggcgaacatggtgaaaccccgtctctactgaaaata

SEQ ID NO: 53772 - DNA, 201 bp, Homo sapiens
acatccaaaggaccgggccccaaacaaagagtcaagctaccttttaagcattttgtggggtggggggagatttgtgcagggggaagagtattacagaagcragaaacaaagacagttattcagttaagacatgcattacattatttcttacttttcaaggaacaacacgttttatgactcaagattatctgtttagtgacc

SEQ ID NO: 53773 - DNA, 201 bp, Homo sapiens
acttaggctggtcacgaactcctgggctcaagtgacccacccacctcggcctcccaaagtgctgggattacaagcgtgagtcaccatgcctggcccaaccrttactggtgaattgactgtttcacccttcaattctgtgagtttttgcttcatgtattgctgcgggataattaaggaatcagagagaccgatggggttgag

SEQ ID NO: 53774 - DNA, 201 bp, Homo sapiens
tatttactcaagggaaatgaaaacacaggtccacaaatacctgcacatgagtgtttacagaagctttgttgctagtggccccgaacagtgaaaaaaccacrgtgtctgtcaataggagacagaataaatgaattgtggcggattaacaatggcgtgcttctcagaaatgaaaaagaacgaacgattgatacacgtgacaat

SEQ ID NO: 53775 - DNA, 201 bp, Homo sapiens
aaaaggagggacccaccccttgcaaagtcatggactgtcactccaggaccaacaccctccaaaccaatgttcaaaagggtttagtctgtctttttttttamttcctttagttaccaaagaacatcttatcatcaatgtaacccgatcaccctgccctcaaacgatcacattcaatgcttgccttgtcatgccctgtggaga

SEQ ID NO: 53776 - DNA, 201 bp, Homo sapiens
aaattaacacttcccttcaaaagaaaaattaaggaaaaatgaataaataagccaccgactgagagaaaatatttgttttctaagaagtattttgtttttcrttttatgggttcatagtaggtgtatatatttatggggtccctgagatattgtggttcagtcatacaatggaaaattcacatcatggagaactggtatcca

SEQ ID NO: 53777 - DNA, 201 bp, Homo sapiens
ggctgaggcatgagaattgcttgaacccaggagggagaggttgcagtgactggagatcacaccactgcactccagactgggcaacagggcaagacacagtytaaaaaaaaaaaaaaaagaaaaaagaaaaacaagaataaatcaattatttttctataatacttgccacaatcaattgaaccatgaaaaattttaaatacc

SEQ ID NO: 53778 - DNA, 201 bp, Homo sapiens
agatatgggacagctttctaattatttgtatcttcaatttctttcacaaatgttttatagttttcagcatacagatctttcacttccttggttggatttawttgcaagtattttttgtagctattgtaaatgacattgttttcttgatttctttgttagggtatagaaatgctacagattgttgtatgttaattttatatc

SEQ ID NO: 53779 - DNA, 201 bp, Homo sapiens
cagccatgacgccttggtgaacaccacggctgcttccagcttttggctatggtgagttccgttgctaggaacacagatgtgcacatgtctcttccagaccycctttcaattccttgggtgtatacacaaaagcaggattgccagctcatacggtaataatatttttatttttatttttattttttgagaaggagtcttgct

SEQ ID NO: 53780 - DNA, 201 bp, Homo sapiens
tccgaggcgggtggatcacttgaagtcaggagatcgagaccagcctggccaacatggtgaaacctgtctctactaaaaatacaaaaaattagccaggcgtrgtggtgggcgcctgtaaacccagctactcgggaggctgaggcaggagaattgcttgaacccgggaggcggaggctgtagtgagccgaaggtgcccctttg

SEQ ID NO: 53781 - DNA, 201 bp, Homo sapiens
acctgatctcagatatgggacagctttctaattatttgtatcttcaatttctttcacaaatgttttatagttttcagcatacagatctttcacttccttgkttggatttatttgcaagtattttttgtagctattgtaaatgacattgttttcttgatttctttgttagggtatagaaatgctacagattgttgtatgtta

SEQ ID NO: 53782 - DNA, 201 bp, Homo sapiens
cgctccttccccagtctctaccctgacttggccctcgtcctgcagccactcagagagcacgatggagctggagcttcagttttgaccaaatgcgtgtcgcyggcttttgtgtgtgtgtgtgtgtgatggagtctcgctctgtcgcccaggctggagtgcattggcaccatctctgcccactgcaacctctgcctcctgggc

SEQ ID NO: 53783 - DNA, 201 bp, Homo sapiens
tgtggcccacatgtcccaacaggctgtgtgtggcacctgacagtgctttgtgccactgtggagcaggtgttactccctcatacgaattttaggattatttyatttatttcagtgaaaaatgtcaatgaaattttgatagggattgcattgaatctgtagattgtttggggttgtatggacattttaacaatattaattctt

SEQ ID NO: 53784 - DNA, 201 bp, Homo sapiens
gagttctcactatgttgcccaggctggtctagaactcctggcttccagcaattctgctggctcagcctcccaaagtcctgggattataggcacgagccacratgcctgtcctcaaaatattttactgtactgtactcacctattattggcctttggttgaccatgggtaactgaaactccagcaagcgaaggtgtggataa

SEQ ID NO: 53785 - DNA, 201 bp, Homo sapiens
aggcaaccgcagacacatacttgacttctcggcagctgtgggcagctgggccagcgacagtggcggaggccaggaatgacttactcttaggaataggtgcrgttcaagcctggagggaggaagctctagggtgcagaggcgggtgtgtggaggcctcgcgtgcagcttataatgagggagcacgtggccggcctggccata

SEQ ID NO: 53786 - DNA, 201 bp, Homo sapiens
caagtcatttgtatctactgattttctttctaattattctatccattactgagagtggggtaggattttggtgtccaattattgtttttttgttttttttkttttgtttgtttgtttttttttttgaggtggagtctcactttgtcacccaggctggagtgcagtggtatgatcacagctcactgcagcccccacctccca

SEQ ID NO: 53787 - DNA, 201 bp, Homo sapiens
acctgtttcaaatgaattattttcagttagtttacagagttgtgaaataaattttataacttttccatccccagcccaccaaaactccctggaactcctcygcagtcattccccattcccacctggcctcagacaatcactttctgtctctccagtcttgccttttctggacagttcctatgaatggagtcctgtgttaca

SEQ ID NO: 53788 - DNA, 201 bp, Homo sapiens
tcagagaactgacatttgattttttttactttatctttttctctctgttctctagttcattggtttccactctaatatttattaatttcccttcttctcaytttgggtttaatttgttctgtcttttcttattgtagttacttacaatggaagcttacacacttgatttaagattttttttctaatgtagacatttacagc

SEQ ID NO: 53789 - DNA, 201 bp, Homo sapiens
agaacgtgacttcggctcttgccaggtggagtgttctagagatgtcagttggtgtccagtgatgtcaagtcatttgtatctactgattttctttctaattwttctatccattactgagagtggggtaggattttggtgtccaattattgtttttttgtttttttttttttgtttgtttgtttttttttttgaggtggagtc

SEQ ID NO: 53790 - DNA, 201 bp, Homo sapiens
aagaccaacatcccaagaaagatgagacagaagccagatcacctttttgggcctggcttcagaagtcacccagcatcacttctgctgcatttatttcttakaaacacagaatatcagaccccatctcttgatgggagggggcctcatggtttgtagacatgttctgaaactccactctgcccggccttggcttcgacgtgt

SEQ ID NO: 53791 - DNA, 201 bp, Homo sapiens
gactgccccattttacattcccatcagcagtgtataacggttctaattttcttttcctttttcttttcttgagacaaggttttgctctgtcacccaggctrgagtgcagtggcatgatcttggctcactgcagcctcaatctcttgggctcaattggtcctcccacctcagcctcctgagtagctgggactacaggtgagt

SEQ ID NO: 53792 - DNA, 201 bp, Homo sapiens
cagcgtctcctccctttctagggctgagaaacattccatctagagacagactcactccgtgcagccatgacgccttggtgaacaccacggctgcttccagsttttggctatggtgagttccgttgctaggaacacagatgtgcacatgtctcttccagacctcctttcaattccttgggtgtatacacaaaagcaggattg

SEQ ID NO: 53793 - DNA, 201 bp, Homo sapiens
gtgaaacccagtctctactaaaaatacaaaaataagccgggcatggtggcacacatctgtggtgccagctactcaggaggctgaggcgggagaatcgcttraacctgggaggcagaggttgcagtgagctgagatctcaccactgcactccagcctgggagagagagcgagactctgccaaaaaaaaaaaaaaaaagttaa

SEQ ID NO: 53794 - DNA, 201 bp, Homo sapiens
gctccccattcccgccttccccaggcgcccaccattctcctctctatttctacgaatttgatgactccagtccctcagatatgtggaattgtggctgggcrcggtggttcacatctgtaatcccagcactttcagaggccaaggcaggcaaatcaccttaggtcaggagttctagaacagcctggccaacatggtgaaacc

SEQ ID NO: 53795 - DNA, 201 bp, Homo sapiens
tttcttccttccttactgtggtaaaatacacataacatgaaatttaccatctcaactatttaaacacgcacagttccatggtgttgagttcactcacatcrttgtacagccatcaccagcatccatctacaacactcttttcatcttcccagactgaaactcaacaccgttcacagctccccattcccgccttccccaggc

SEQ ID NO: 53796 - DNA, 201 bp, Homo sapiens
cttgatcttttcagagaactgacatttgattttttttactttatctttttctctctgttctctagttcattggtttccactctaatatttattaatttccmttcttctcactttgggtttaatttgttctgtcttttcttattgtagttacttacaatggaagcttacacacttgatttaagattttttttctaatgtaga

SEQ ID NO: 53797 - DNA, 201 bp, Homo sapiens
tggtgaaatgcctgttgaaatgttttgcctttttaaaaattgagttgtctcctttgttcagttttgagagttctttacatacacagtatcatatatatatrtatatatatatatatataccagatatatgatttgcaaatattttcaaccatcaatagtttgtcttaacacttttttattggtgttttgaagtagaaaagt

SEQ ID NO: 53798 - DNA, 201 bp, Homo sapiens
ctgtcactccaggaccaacaccctccaaaccaatgttcaaaagggtttagtctgtctttttttttaattcctttagttaccaaagaacatcttatcatcartgtaacccgatcaccctgccctcaaacgatcacattcaatgcttgccttgtcatgccctgtggagacctttagagtcaaaaacagctagcttcttcagaa

SEQ ID NO: 53799 - DNA, 201 bp, Homo sapiens
cagtatcatatatatatatatatatatatatatataccagatatatgatttgcaaatattttcaaccatcaatagtttgtcttaacacttttttattggtrttttgaagtagaaaagttttacattttgatccattccaatttattaactttttcttttattgtgtatctggtatcatatctaagaaatcttaatccagtg

SEQ ID NO: 53800 - DNA, 201 bp, Homo sapiens
ggtccctcgacgccgtggcggtctccagcctctcctcgcccctccacgctccccgccttccatgagctgctattttcagcacctaccgcccgaccctggaytaggacaaggctctgggctgccctgcccgccccccagcccttccctcgggcacggcggccaggcgcccgggttgaccgggaacagcctccataccccaaa

SEQ ID NO: 53801 - DNA, 201 bp, Homo sapiens
cttgggccagagtccctcaggggcaggaacacagcccccaggcttgtcccacttgtccctctgaatagttaagggctgcccacagggaacttccctccctycctcccttccttcctgcctccctccctcccttctttccccttttcttctttcatcctcccctttcttccttccttactgtggtaaaatacacataacatg

SEQ ID NO: 53802 - DNA, 201 bp, Homo sapiens
actgttccctcttctgaaccaagtccttccctggcccagccgcttgtgagtaacacatcagtttcatgcttacacctcctggtcttgtgagtaacacatcrgtttcatgcttacacctcctggtctgaccgggctctcctttgcagagccttttattccttcccttcctctgaacactggctggctgctttcagggaagaa

SEQ ID NO: 53803 - DNA, 201 bp, Homo sapiens
aaaaacctcccccacctctccccatccatagtcagataagctcttgctcctagatgataaagaagaacaacaaagccaactcctgttaaataaatttgaargggaagaactataaaacagaagaggggaaattgttgggacaactaagttcctcttcaaagattcaacttcctggccataacttggaaacaaatcctaccc

SEQ ID NO: 53804 - DNA, 201 bp, Homo sapiens
ttcttggcatttctgtcaaaaatcagttgaccgtaaatgcatggattcacttccgggctctctattctgtttcattggtctgtttgtttttatgccaataycatgatgttttgattattatagctttatagtatatcttgaagttaggtagtgtattgtctccagctttgttctttttgcttaagattgctttggctattt

SEQ ID NO: 53805 - DNA, 201 bp, Homo sapiens
ttaggatagacagatagttcaatggaatagaatgcagagtttagaaatagacctacacagaaatagtccattgattttttaagagttgctttttgataagrgtgctaaggtaatgtgatagagaaaggaaagtattttcaattcaaatggctgaaatgactggatatccattgagggaagaaagggactttagcctttcac

SEQ ID NO: 53806 - DNA, 201 bp, Homo sapiens
tagcaatccaaaggccgaaaaaggagggacccaccccttgcaaagtcatggactgtcactccaggaccaacaccctccaaaccaatgttcaaaagggtttrgtctgtctttttttttaattcctttagttaccaaagaacatcttatcatcaatgtaacccgatcaccctgccctcaaacgatcacattcaatgcttgcct

SEQ ID NO: 53807 - DNA, 201 bp, Homo sapiens
ctgaattacaaggcgggacaggtaaagtggggcaggtgagagaaggagggtgagtgatgtgatttttctactcctgttttccaggaaaaccaaaatgccaygcacttcgacctatgatccttttcctaataatgcttgtcttggtcttgtttgggtaagacacatttgaccatcgaggctggcctggtttggggagaagtg

SEQ ID NO: 53808 - DNA, 201 bp, Homo sapiens
atgcatggattcacttccgggctctctattctgtttcattggtctgtttgtttttatgccaataccatgatgttttgattattatagctttatagtatatyttgaagttaggtagtgtattgtctccagctttgttctttttgcttaagattgctttggctatttaggggtctttgtggccattactgacagttaaaatgg

SEQ ID NO: 53809 - DNA, 201 bp, Homo sapiens
ggcatttctgtcaaaaatcagttgaccgtaaatgcatggattcacttccgggctctctattctgtttcattggtctgtttgtttttatgccaataccatgmtgttttgattattatagctttatagtatatcttgaagttaggtagtgtattgtctccagctttgttctttttgcttaagattgctttggctatttagggg

SEQ ID NO: 53810 - DNA, 201 bp, Homo sapiens
gggattacaagcgtgagtcaccatgcctggcccaaccattactggtgaattgactgtttcacccttcaattctgtgagtttttgcttcatgtattgctgcrggataattaaggaatcagagagaccgatggggttgaggaggaattatttaattatttaggcgcaccgacccaatcagattaacatccaaaggaccgggcc

SEQ ID NO: 53811 - DNA, 201 bp, Homo sapiens
agggagggggccgctccttccccagtctctaccctgacttggccctcgtcctgcagccactcagagagcacgatggagctggagcttcagttttgaccaamtgcgtgtcgccggcttttgtgtgtgtgtgtgtgtgatggagtctcgctctgtcgcccaggctggagtgcattggcaccatctctgcccactgcaacctct

SEQ ID NO: 53812 - DNA, 201 bp, Homo sapiens
cccctttgcactccagcctgggcaacgagcaaaactccatctcaaaaacaacaacaaaacaacaacaacaacaaaaacaatatactgtaataaaggttacrtgaatgtggtctctctaaaaaaaaatgtgtatatatcttagtttgtgggttttttgttgttgtagttttgtttattattaagagacagggtcttgctctg

SEQ ID NO: 53813 - DNA, 201 bp, Homo sapiens
ctcaggagttcgaggttgcagcgagctgtgatcgtgccactgcactccagcctgggtgacagagtaagatcctgtctaaaaaaaataaaaatagagggccrggtgaggtggcttatgcctgtaatcccagcacattgggaggctgaggcaggtggattgcttaagcccaggagttcaagaccagcctgggcaacatggtga

SEQ ID NO: 53814 - DNA, 201 bp, Homo sapiens
tgatgtcaagtcatttgtatctactgattttctttctaattattctatccattactgagagtggggtaggattttggtgtccaattattgtttttttgttkttttttttttgtttgtttgtttttttttttgaggtggagtctcactttgtcacccaggctggagtgcagtggtatgatcacagctcactgcagcccccac

SEQ ID NO: 53815 - DNA, 201 bp, Homo sapiens
ccagcgccttccgggttcttccctgtccctcctttgtggtctttgttttcccttttttgtcttaatatgtttcaacggatgtatacaataaaccgcacatraaaggtacagctggatacatcttgacccagtcaagatgatgaacacagctgccaccccaggagtctgtcctgccccacgggttatgctgtcttagttggt

SEQ ID NO: 53816 - DNA, 201 bp, Homo sapiens
gctgcgaggcttcaggccggccgccgccccagcctccgagaccctgcgtcctggggagccggcgggcaggtgggctcggccgcgctgtgggtgcctgggayccgcagggaggatgggcgcggtggcgcggcctggcggggggctcgtctccggggtccccgggtcctggtgagagcggggtccctcgacgccgtggcggtc

SEQ ID NO: 53817 - DNA, 201 bp, Homo sapiens
ggaaaacaatcacaatcattgattactatctctccctgggcttcctggggtggactgggctcagctgggtggttcactttggggcctcagcagtcatgggmagacagtggctggggtcactgcaaagacttccctgcatctctggcagttgatgctggctgtcatctgagacacctacccagggcctctccctggggcctg

SEQ ID NO: 53818 - DNA, 201 bp, Homo sapiens; identical to SEQ ID NO: 10196

SEQ ID NO: 53819 - DNA, 201 bp, Homo sapiens; identical to SEQ ID NO: 10147

SEQ ID NO: 53820 - DNA, 201 bp, Homo sapiens
actttagcctttcacacaatacacaaaaattatggaattctgaagaaaataagagaaaatgttcatgaacttggggtaggcaaaaatttaatagatgaggsaaaaaaaaaaaaaggcccaaaccataaaaatggtttcatttttataaggataaattagagtttataaaaattaacacttcccttcaaaagaaaaattaag

SEQ ID NO: 53821 - DNA, 201 bp, Homo sapiens
ctcacccctacactgggttcccaaatcctgccagccctgctcttcagcagctcgcgtgcccactggcctccctgccttcgacgtcctgctccagggctccrgtggggctgccctcatctctgtgacagcctcagacttgtctccccatccccatcagccctgtcccccttcttctcacagcagctggagtgatctttccag

SEQ ID NO: 53822 - DNA, 201 bp, Homo sapiens
cagttacggggtcctaagccccagaagtctaatgccaggaagcctggaacgggggttctggtgagtgcagggaagagcaggtggagcatccatgctggccrgggtgctggctgtgggcgggggtcccactctgggaactccccctccccttcctgggcccgctctctatgctctgcccagtgtagacatgctcaactctgt

SEQ ID NO: 53823 - DNA, 201 bp, Homo sapiens
atgtctgtagtcccacctaatcaggaggctgagggggaaagatcacttaagctcaggagttcgaggttgcagcgagctgtgatcgtgccactgcactccarcctgggtgacagagtaagatcctgtctaaaaaaaataaaaatagagggccaggtgaggtggcttatgcctgtaatcccagcacattgggaggctgaggca

SEQ ID NO: 53824 - DNA, 201 bp, Homo sapiens; identical to SEQ ID NO: 10159

SEQ ID NO: 53825 - DNA, 201 bp, Homo sapiens
gatgtatacaataaaccgcacataaaaggtacagctggatacatcttgacccagtcaagatgatgaacacagctgccaccccaggagtctgtcctgccccrcgggttatgctgtcttagttggtctcatgtcagggagccttggaggaccagggtcgggcagttggtctctatactcctggggttctggcactggctctgg

SEQ ID NO: 53826 - DNA, 201 bp, Homo sapiens
tggagcagcatttgcgctccgatccaattggccatccctttcaccttggcatttcaacaaccagacaggaagcaggtaacccaaaggaaaagagaaacccytcacgggtcctttgacctctcatatttacatagacagtatcggggttgcgctggggggtacaaaatgaattcaaagctcgaaaccaaatagccaccaggt

SEQ ID NO: 53827 - DNA, 201 bp, Homo sapiens
aaacaaaaatgtagactggatacattatatatactataatcaacagtgattcatcaattacaccagagatgccataaaaagaatagctcaacaattaggcyctaccagccagatggcctgggaaaacaggatagcccttgacatgatattggccaaaaaaaggcggagtctgtgtcatgattggggtccaatgttgcactt

SEQ ID NO: 53828 - DNA, 201 bp, Homo sapiens
agagatgccataaaaagaatagctcaacaattaggccctaccagccagatggcctgggaaaacaggatagcccttgacatgatattggccaaaaaaaggcrgagtctgtgtcatgattggggtccaatgttgcacttttatccccaataacacagccctggacgggacaatcacaaaagccttacaagccttaccacccta

SEQ ID NO: 53829 - DNA, 201 bp, Homo sapiens
accttatttgggaaggtttaagcattagcctgtcggggtcagcttagattatgcggcccaaccccagccaataggggaaggacacagaaacagaaactgcsttaccccagccaataggggaaggacacagaaacagaaactgcgttaccccagccaataggggaaggacacagaaacagaaactgcgttaccccagccaat

SEQ ID NO: 53830 - DNA, 201 bp, Homo sapiens
ttaccccagccaataggggaaggacacagaaacagaaactgcgttagggataaaaaccccttccctcctttgttcagtgtgctcttgggattgtaacaggmacaggcagcacccttctacagaagtaaaagtgacttgctgagaaattttctaagtgcgggtttcttttcgctacaccaagcacttgtttccaacacatgc

SEQ ID NO: 53831 - DNA, 201 bp, Homo sapiens; identical to SEQ ID NO: 10170

SEQ ID NO: 53832 - DNA, 201 bp, Homo sapiens; identical to SEQ ID NO: 10172

SEQ ID NO: 53833 - DNA, 201 bp, Homo sapiens
cccataacttcaaaaaatcagctttgacggagccctactgaacacacctagcatctctcttccttcagcttagggtcaaggggctggggttgatggcaccrttgaaagaaacagctttattgccgtgtcattgatatgccataaaattcacctgtttcaaatgaattattttcagttagtttacagagttgtgaaataaat

SEQ ID NO: 53834 - DNA, 201 bp, Homo sapiens; identical to SEQ ID NO: 10173

SEQ ID NO: 53835 - DNA, 201 bp, Homo sapiens
ttgtagtatgtatcagtatttaattcctttttattactgaataatccattgtacagatagaccacattttgtttatccattcatcagctgaaggacatttyggctgtttctgcttttttagctattttaaactgcacgcagcactgctatgaacatttgtgtacaagactttgtgtgaacatgttttcatttctcttgggt

SEQ ID NO: 53836 - DNA, 201 bp, Homo sapiens; identical to SEQ ID NO: 10175

SEQ ID NO: 53837 - DNA, 201 bp, Homo sapiens
agtgctgaatcagagactctgagctttggccctttcccgagttcccgggattatgagctgacacagcccccaagcaaccacagtgattccagcctgggagkgtggccttggcgggagggtcaatgcccagtcatggttcagcggctgtgcacacccctgcttacctgcatcccacgctttccatgcaaactcacgtggcgg

SEQ ID NO: 53838 - DNA, 201 bp, Homo sapiens
ggaaattatctccagaccaactcaaaattacaaagttttccagagcttatataccttctaagctatatgtctatgtgtaagtgtgcattcatctcaagacrtaagtaattgacttatgttaatctataactaaggtctgagtcctgaagaccttcctctggatcctcagtaaatttacttaatctaaaacccttatcttgt

SEQ ID NO: 53839 - DNA, 201 bp, Homo sapiens; identical to SEQ ID NO: 10176

SEQ ID NO: 53840 - DNA, 201 bp, Homo sapiens
gtcccggctctcctccattctggtgggtctcaccagagattggccaagaagagatcaaactgttcctggaccaaactgagggtggggctgctatctctcgyggcccaataacgagatgcagatgaactggggagaaagagactttttatttctgtaaccagttacaaggagaagacctggaaattatctccagaccaactc

SEQ ID NO: 53841 - DNA, 201 bp, Homo sapiens
ggcttactgcagccttcacctcctaggctcaagtgatccttccacctcagcctcctgggaccagaggcatgcaccactatgcccagctaattgtttttttkttttttttcttgatagaaatgagttctcactatgttgcccaggctggtctagaactcctggcttccagcaattctgctggctcagcctcccaaagtcctg

SEQ ID NO: 53842 - DNA, 201 bp, Homo sapiens
aggatagcccttgacatgatattggccaaaaaaaggcggagtctgtgtcatgattggggtccaatgttgcacttttatccccaataacacagccctggacrggacaatcacaaaagccttacaagccttaccaccctagcaaatgaattagccgagaactctggaatagatgacccctttgcaggtgtcatggagaaatgg

SEQ ID NO: 53843 - DNA, 201 bp, Homo sapiens
gaaaattcatgaagaaaaccgggtatggtgtaggtcgaggccctgccctcagtaatgctcaccatttgtcagtgtttactgtgaggcagcactgtgttcartatcgctgagttctcaggaaggaacggtaaatacttcccgggtcattctttcacccacgggaaaacaggtttggagagatctgggacagtgctctggtcc

SEQ ID NO: 53844 - DNA, 201 bp, Homo sapiens
tgtgtgatggagtctcgctctgtcgcccaggctggagtgcattggcaccatctctgcccactgcaacctctgcctcctgggctcaagtgattctcctgcckcagcctcctgagtagctgggattacaggcgcccaccaccacacctggctaatttttgtatttttagcagagacagcgtttcaccatgttggccaggctag

SEQ ID NO: 53845 - DNA, 201 bp, Homo sapiens
catcctcaactctccctttgctctcacccctacactgggttcccaaatcctgccagccctgctcttcagcagctcgcgtgcccactggcctccctgccttygacgtcctgctccagggctccggtggggctgccctcatctctgtgacagcctcagacttgtctccccatccccatcagccctgtcccccttcttctcaca

SEQ ID NO: 53846 - DNA, 201 bp, Homo sapiens
tagcaggagggggacacctgtttgctgtccttggaccctagaaagaggatgctggcagagccgtggtcacttctctgtcagatgtaggtggggcaggcaargcagttggccccagacaccaaaggaagtggctgacccacaaggccctgggactctgggccaggccagagagggagctagccaggcaaccgcagacacata

SEQ ID NO: 53847 - DNA, 201 bp, Homo sapiens
gtgggctcgccaggtcggtaaaacccagctccttctccagaggctgcgtctcacccagggatggtggcttctgctgccccctcctctctgtaactgtggcyggccgtcatgctgagccaccccctcaatacaaggctccagatgtttcctgctcactgaccagagatagcaggagggggacacctgtttgctgtccttgga

SEQ ID NO: 53848 - DNA, 201 bp, Homo sapiens
cgctgctggccgcaccatgcactttttggaggaagggaccaacaggcagtcttcgttctgtgtcctgagtcttggcacacttcctttctgcagttacgggktcctaagccccagaagtctaatgccaggaagcctggaacgggggttctggtgagtgcagggaagagcaggtggagcatccatgctggccggggtgctggc

SEQ ID NO: 53849 - DNA, 201 bp, Homo sapiens
cgtgggctcgtgggctcgccaggtcggtaaaacccagctccttctccagaggctgcgtctcacccagggatggtggcttctgctgccccctcctctctgtractgtggccggccgtcatgctgagccaccccctcaatacaaggctccagatgtttcctgctcactgaccagagatagcaggagggggacacctgtttgct

SEQ ID NO: 53850 - DNA, 201 bp, Homo sapiens
tctatgctctgcccagtgtagacatgctcaactctgtggccttgaagggtcacctggatacctctggagtcagccttgacctcccttctgacctccagtcyccaactccaggcttacccagagttcccatgcatggtctctgctcccccatccccacccctcctccaccagccatcctcaactctccctttgctctcaccc

SEQ ID NO: 53851 - DNA, 201 bp, Homo sapiens
cgcttgaacctgggaggcagaggttgcagtgagctgagatctcaccactgcactccagcctgggagagagagcgagactctgccaaaaaaaaaaaaaaaaagttaatagaatcgcatggcatttttccttgttggactggattttacttagcataaggcatcaaggctcacccacgctgtagcaggtgtcagcgtctcctc

SEQ ID NO: 53852 - DNA, 201 bp, Homo sapiens
caagacagagtggggtggcggccagccttgtcctcccagagggtagatgggaaaggtcattcatgcagcatcttactgagctcatgtgggctcgtgggctygtgggctcgccaggtcggtaaaacccagctccttctccagaggctgcgtctcacccagggatggtggcttctgctgccccctcctctctgtaactgtggc

SEQ ID NO: 53853 - DNA, 201 bp, Homo sapiens
ccttgcagatacgtggctttcctgaagctgttcctggagacggcggagaagcacttcatggtgggccaccgtgtccactactatgtcttcaccgaccagcyggccgcggtgccccgcgtgacgctggggaccggtcggcagctgtcagtgctggaggtgcgcgcctacaagcgctggcaggacgtgtccatgcgccgcatg

SEQ ID NO: 53854 - DNA, 201 bp, Homo sapiens
ggtctctccttgtgttcaagacagagtggggtggcggccagccttgtcctcccagagggtagatgggaaaggtcattcatgcagcatcttactgagctcaygtgggctcgtgggctcgtgggctcgccaggtcggtaaaacccagctccttctccagaggctgcgtctcacccagggatggtggcttctgctgccccctcc

SEQ ID NO: 53855 - DNA, 201 bp, Homo sapiens
aacgagcagttcaggctccagaacaccaccattgggttaactgtgtttgccatcaagaagtaagtcagtgaggtggccgagggtagagacccaggcagtgkcgagtgactgtggacattgaggtctctccttgtgttcaagacagagtggggtggcggccagccttgtcctcccagagggtagatgggaaaggtcattcat

SEQ ID NO: 53856 - DNA, 201 bp, Homo sapiens
gtgctcttgggattgtaacaggcacaggcagcacccttctacagaagtaaaagtgacttgctgagaaattttctaagtgcgggtttcttttcgctacaccragcacttgtttccaacacatgcaaaccagaatggaggtctccctggacctgggtttgggccacaagcttgcaagaccttgggcaagactgttccctcttc

SEQ ID NO: 53857 - DNA, 201 bp, Homo sapiens
aactcataagccaatcttatgtggaaaatgtaatcatgctaaacctccttgtattttcccatttaagtgaagcccaaatccctccacctcagagcactgarcccattcctttagagtctgtgttttttgagtggtggtcgtcaaacttagagttcgaataaactctataacattggattttgaacctttcaattatttcag

SEQ ID NO: 53858 - DNA, 201 bp, Homo sapiens
tttttgcttccttgcccctctctgctctgtttggtttaaaaaacaaaaaccaacacccatgggtgaggcgaggcgaggcgaggcttgccttgatccacccrcttcctcccctgcagcctcgggccccatcctcccgcgtggccgcactaggggtgctgggggcggagtggggaccagacctgagtgggttctgggttcagc

SEQ ID NO: 53859 - DNA, 201 bp, Homo sapiens
ttgatcttttcagagaactgacatttgattttttttactttatctttttctctctgttctctagttcattggtttccactctaatatttattaatttcccytcttctcactttgggtttaatttgttctgtcttttcttattgtagttacttacaatggaagcttacacacttgatttaagattttttttctaatgtagac

SEQ ID NO: 53860 - DNA, 201 bp, Homo sapiens
ctctcccacttctcagagaggaagccgggctctggaagccagcagcccacaaggaggcccagcaggcttcgggcccaggtggggaggtctgcacatctcarggcctttccctgggaacaaccagggacagaggccacacacccagcctcctctctgcccacagtgaattgagacacaaccccttacgtccctcccagcctt

SEQ ID NO: 53861 - DNA, 201 bp, Homo sapiens
gtagccccttgcgcccaggacaaaccgggcctggaggggtggggtggggtaagctgaagcttccagtatcccacgtgggcattctgttgctgagggcaacsgcccctccctgcaagggaggggaaggagcaggcaggcacacccttcctccctccacatttcactggagttgacctgtgtcctactgtggttgcacctgga

SEQ ID NO: 53862 - DNA, 201 bp, Homo sapiens
cgcaatgcctgggaaagggagagataaggctcactagccacagaaaaacagccagttaatttttaaaggactccagccctttctcttcctcaaggggaatyggttttttacatacaactgagtttttgcttacacagtttttaatttcttttaattcctgttctagtattttggggctaggttgtcaggtatgtatatatt

SEQ ID NO: 53863 - DNA, 201 bp, Homo sapiens
ctccctgcttttaaaggccatcttggacattcaaattgtggccattactgacagttaaaatggccccggctcatgtctcctgagcctctacaatcctttargtggggacagtactgcggcccacacgtccccacaggctgcgtgtgacacctgacagtgctttgtgccactgtggagcaggtgtcactctcccacttctca

SEQ ID NO: 53864 - DNA, 201 bp, Homo sapiens
aagggagagataaggctcactagccacagaaaaacagccagttaatttttaaaggactccagccctttctcttcctcaaggggaattggttttttacatayaactgagtttttgcttacacagtttttaatttcttttaattcctgttctagtattttggggctaggttgtcaggtatgtatatatttctgtttgttatat

SEQ ID NO: 53865 - DNA, 201 bp, Homo sapiens
ctgctgcatttatttcttagaaacacagaatatcagaccccatctcttgatgggagggggcctcatggtttgtagacatgttctgaaactccactctgccyggccttggcttcgacgtgtctggtgaatgtgtgggctgtgaggctccccgaacgtagacctcagactgcaacgctggccgttacagggtctggcacacgg

SEQ ID NO: 53866 - DNA, 201 bp, Homo sapiens
ccgcttcctcccctgcagcctcgggccccatcctcccgcgtggccgcactaggggtgctgggggcggagtggggaccagacctgagtgggttctgggttcrgcttcgcagcaggagcagctggggcatcatcagttgggcaggtgacccaggatctgaagcaggaatcttccaggtggaggtggggccgcccctctgcttg

SEQ ID NO: 53867 - DNA, 201 bp, Homo sapiens
tatttttagtagaggcaggatttcaccgtgttggtcaggctagactcgaatgcctgacctcgtgatccacccacctcggcctcccaaagtgctggggttaygggcgtgagccaccacgcctggccttagtttttgtatttttagtagagatgaggtttcaccatgttggccaggctggtcttgaactcctgatctcaggtg

SEQ ID NO: 53868 - DNA, 201 bp, Homo sapiens
cgtgaatgtggtctctctaaaaaaaaatgtgtatatatcttagtttgtgggttttttgttgttgtagttttgtttattattaagagacagggtcttgctckgttacccaggctggagtgcagtggtgtgatcatggcttactgcagccttcacctcctaggctcaagtgatccttccacctcagcctcctgggaccagagg

SEQ ID NO: 53869 - DNA, 201 bp, Homo sapiens
gaaacagaaactgcgttaccccagccaataggggaaggacacagaaacagaaactgcgttaccccagccaataggggaaggacacagaaacagaaactgcrttagggataaaaaccccttccctcctttgttcagtgtgctcttgggattgtaacaggcacaggcagcacccttctacagaagtaaaagtgacttgctgag

SEQ ID NO: 53870 - DNA, 201 bp, Homo sapiens
tttaccttatttgggaaggtttaagcattagcctgtcggggtcagcttagattatgcggcccaaccccagccaataggggaaggacacagaaacagaaacwgccttaccccagccaataggggaaggacacagaaacagaaactgcgttaccccagccaataggggaaggacacagaaacagaaactgcgttaccccagcc

SEQ ID NO: 53871 - DNA, 201 bp, Homo sapiens
ataagctcttgctcctagatgataaagaagaacaacaaagccaactcctgttaaataaatttgaaggggaagaactataaaacagaagaggggaaattgttgggacaactaagttcctcttcaaagattcaacttcctggccataacttggaaacaaatcctacccctacaaccttttcaaaaatcacacctttaccttat

SEQ ID NO: 53872 - DNA, 201 bp, Homo sapiens
cgccatctcaactcactgcaacctccgcctcccaggtttaagtgattctcctgcctcagtttcctgagtagctgggactacaggcacccaccaccacgccyggctagtttttgtatttttaaactttttttttcttttttctttttcttcttttttttttttttgagatggagtctcgctctgtcgcccgggctggagtgc

SEQ ID NO: 53873 - DNA, 201 bp, Homo sapiens
gactttagcctttcacacaatacacaaaaattatggaattctgaagaaaataagagaaaatgttcatgaacttggggtaggcaaaaatttaatagatgagscaaaaaaaaaaaaaggcccaaaccataaaaatggtttcatttttataaggataaattagagtttataaaaattaacacttcccttcaaaagaaaaattaa

SEQ ID NO: 53874 - DNA, 201 bp, Homo sapiens
gatgctggcagagccgtggtcacttctctgtcagatgtaggtggggcaggcaaagcagttggccccagacaccaaaggaagtggctgacccacaaggcccygggactctgggccaggccagagagggagctagccaggcaaccgcagacacatacttgacttctcggcagctgtgggcagctgggccagcgacagtggcgg

SEQ ID NO: 53875 - DNA, 201 bp, Homo sapiens
cctgagatattgtggttcagtcatacaatggaaaattcacatcatggagaactggtatccatcctcttgagcaattatcctttgtgttacaaacaatccarctatactcttttagttatttttattctttttttttttttttttttgagatggagtctcgctctgtcacccaggctggagtgtggtggcgccatctcaact

SEQ ID NO: 53876 - DNA, 201 bp, Homo sapiens
tgtatacaataaaccgcacataaaaggtacagctggatacatcttgacccagtcaagatgatgaacacagctgccaccccaggagtctgtcctgccccacrggttatgctgtcttagttggtctcatgtcagggagccttggaggaccagggtcgggcagttggtctctatactcctggggttctggcactggctctggcc

SEQ ID NO: 53877 - DNA, 201 bp, Homo sapiens
ctgctaccagcctccagccacctgccctcagccctccttagtaagagggggtgctggtggtcccccatcgctgggaagaggatgaagtgagtcgcagcccraggactcgctcaggacagggcaggagaacgtggtgcatctgctgctctaagccttccaatggccgctggcgggcgggtgcaggacgggcctcctgcagcc

SEQ ID NO: 53878 - DNA, 201 bp, Homo sapiens
agcctgcggcctgctaccagcctccagccacctgccctcagccctccttagtaagagggggtgctggtggtcccccatcgctgggaagaggatgaagtgartcgcagcccgaggactcgctcaggacagggcaggagaacgtggtgcatctgctgctctaagccttccaatggccgctggcgggcgggtgcaggacgggcc

SEQ ID NO: 53879 - DNA, 201 bp, Homo sapiens
cgtgcagcttataatgagggagcacgtggccggcctggccataagaggggcagctgcgtggggaggcgtggctcaggccaggctgagggggagtgagcggrcgccagcctgcggcctgctaccagcctccagccacctgccctcagccctccttagtaagagggggtgctggtggtcccccatcgctgggaagaggatgaa

SEQ ID NO: 53880 - DNA, 201 bp, Homo sapiens
cgcgtgcagcttataatgagggagcacgtggccggcctggccataagaggggcagctgcgtggggaggcgtggctcaggccaggctgagggggagtgagcrggcgccagcctgcggcctgctaccagcctccagccacctgccctcagccctccttagtaagagggggtgctggtggtcccccatcgctgggaagaggatg

SEQ ID NO: 53881 - DNA, 201 bp, Homo sapiens
atgggagggggcctcatggtttgtagacatgttctgaaactccactctgcccggccttggcttcgacgtgtctggtgaatgtgtgggctgtgaggctcccygaacgtagacctcagactgcaacgctggccgttacagggtctggcacacgggcccacgtcaggcccatcgccacagtgatggttgttctgtgactgtttc

SEQ ID NO: 53882 - DNA, 201 bp, Homo sapiens
ccctagcaaatgaattagccgagaactctggaatagatgacccctttgcaggtgtcatggagaaatggtttggaaaatggaagggactcatgacctaaatmtttacctcccttgcaacagttacaggtgtactcatccttgtgggctgctgtatcataccttgtattcgtgggttaacccaaaggctcatagaagcagctc

SEQ ID NO: 53883 - DNA, 201 bp, Homo sapiens
cctgcttagcttggttgggaggctccaagaccaacatcccaagaaagatgagacagaagccagatcacctttttgggcctggcttcagaagtcacccagcrtcacttctgctgcatttatttcttagaaacacagaatatcagaccccatctcttgatgggagggggcctcatggtttgtagacatgttctgaaactccac

SEQ ID NO: 53884 - DNA, 201 bp, Homo sapiens
tggggtcactgcaaagacttccctgcatctctggcagttgatgctggctgtcatctgagacacctacccagggcctctccctggggcctgggctcctgctyagcttggttgggaggctccaagaccaacatcccaagaaagatgagacagaagccagatcacctttttgggcctggcttcagaagtcacccagcatcactt

SEQ ID NO: 53885 - DNA, 201 bp, Homo sapiens
agcctcagacttgtctccccatccccatcagccctgtcccccttcttctcacagcagctggagtgatctttccagaacataaggtaggaggctctccatgwtctgatcctgccttcctgacctccccagcctcatctctccctcctctgccctcgccctctgtgctccagccaacgtggcctgtcactcgtccacctgcca

SEQ ID NO: 53886 - DNA, 201 bp, Homo sapiens
tgatccttccacctcagcctcctgggaccagaggcatgcaccactatgcccagctaattgttttttttttttttttcttgatagaaatgagttctcactaygttgcccaggctggtctagaactcctggcttccagcaattctgctggctcagcctcccaaagtcctgggattataggcacgagccacgatgcctgtcctc

SEQ ID NO: 53887 - DNA, 201 bp, Homo sapiens
gcactttgggaggtcaaggtggccagatcacttgagcccagaagtttgagaccagcctgggtgacatagtgagaccctgtctctacaaaaaaaaaaaaaaattagctgggcatggtggcatgcacctgtagcccctgctactcaggaggctgaggtgagaggatgacttgagcccagtaggcagagattgcagtgcattcc

SEQ ID NO: 53888 - DNA, 201 bp, Homo sapiens
acgtcctgctccagggctccggtggggctgccctcatctctgtgacagcctcagacttgtctccccatccccatcagccctgtcccccttcttctcacagyagctggagtgatctttccagaacataaggtaggaggctctccatgatctgatcctgccttcctgacctccccagcctcatctctccctcctctgccctcg

SEQ ID NO: 53889 - DNA, 201 bp, Homo sapiens
tggcttactgcagccttcacctcctaggctcaagtgatccttccacctcagcctcctgggaccagaggcatgcaccactatgcccagctaattgttttttktttttttttcttgatagaaatgagttctcactatgttgcccaggctggtctagaactcctggcttccagcaattctgctggctcagcctcccaaagtcct

SEQ ID NO: 53890 - DNA, 201 bp, Homo sapiens
ggaggccaagataggtagatcacttgaggccaggagtttgagagcagcctggcccacatggcaagactccatctttacaaaaatacaaaaaaaaaaaaaaagttgagtgtggtggtgcgcctgtaatcccacctacttgggaggctgaggcatgagaattgcttgaacccaggagggagaggttgcagtgactggagatca

SEQ ID NO: 53891 - DNA, 201 bp, Homo sapiens
cctgtcctcaaaatattttactgtactgtactcacctattattggcctttggttgaccatgggtaactgaaactccagcaagcgaaggtgtggataagggmactactgtacgtgactttaatatacataaaatcaccttaaagacaatgattgtttccagaacatgagcctctgagacagcagggagatactaggggaagt

SEQ ID NO: 53892 - DNA, 201 bp, Homo sapiens
tccaccaagatttccctacagccaaacgatctaccaactacaaaaatggaaaaaataatttaggacatgtaaagttcaaatgttttgcctcccacgtttckgtttcaagaagctattcgagataaatcgctccgtggtcacaggacttagaaaggtggaggtaaacacacacaagcattataagataagaagtaacagatg

SEQ ID NO: 53893 - DNA, 201 bp, Homo sapiens
ctccgatccaattggccatccctttcaccttggcatttcaacaaccagacaggaagcaggtaacccaaaggaaaagagaaacccctcacgggtcctttgayctctcatatttacatagacagtatcggggttgcgctggggggtacaaaatgaattcaaagctcgaaaccaaatagccaccaggtttgagtctgtattatt

SEQ ID NO: 53894 - DNA, 201 bp, Homo sapiens
tggatcacctgaggtcaggagttcaagactagcctggcgaacatggtgaaaccccgtctctactgaaaatacaaaaaaattagccagccatgatggtgtgygcctgtaatcccagctacttgggaggctgaggcacgagaattgcttgaacccgggaggctgaggttacagtcagccaagatcgtgccactgcactccaac

SEQ ID NO: 53895 - DNA, 201 bp, Homo sapiens
aatcagaataggttgatattaggatagacagatagttcaatggaatagaatgcagagtttagaaatagacctacacagaaatagtccattgattttttaakagttgctttttgataagggtgctaaggtaatgtgatagagaaaggaaagtattttcaattcaaatggctgaaatgactggatatccattgagggaagaaa

SEQ ID NO: 53896 - DNA, 201 bp, Homo sapiens
aaccagtcagtcagccctaatccatccccaagcagatgtacagtggtattgtgggggaccaatattgagtactctgccaaacaattggagcagcatttgcrctccgatccaattggccatccctttcaccttggcatttcaacaaccagacaggaagcaggtaacccaaaggaaaagagaaacccctcacgggtcctttga

SEQ ID NO: 53897 - DNA, 201 bp, Homo sapiens
gctgcgggataattaaggaatcagagagaccgatggggttgaggaggaattatttaattatttaggcgcaccgacccaatcagattaacatccaaaggacygggccccaaacaaagagtcaagctaccttttaagcattttgtggggtggggggagatttgtgcagggggaagagtattacagaagcgagaaacaaagaca

SEQ ID NO: 53898 - DNA, 201 bp, Homo sapiens
aaattttacatagtaatcagaataggttgatattaggatagacagatagttcaatggaatagaatgcagagtttagaaatagacctacacagaaatagtcmattgattttttaagagttgctttttgataagggtgctaaggtaatgtgatagagaaaggaaagtattttcaattcaaatggctgaaatgactggatatcc

SEQ ID NO: 53899 - DNA, 201 bp, Homo sapiens
gaagccctacgggacagcccccaagggccattcgacttccagctcttgatgccaattttacctcatgtctctcatggcaaggggaaaatctgacgttcctsggaaacctgatgggatgtactgggcctaaacctttccaagagctaaccagtcagtcagccctaatccatccccaagcagatgtacagtggtattgtgggg

SEQ ID NO: 53900 - DNA, 201 bp, Homo sapiens
gaaaaaggagggacccaccccttgcaaagtcatggactgtcactccaggaccaacaccctccaaaccaatgttcaaaagggtttagtctgtctttttttttaattcctttagttaccaaagaacatcttatcatcaatgtaacccgatcaccctgccctcaaacgatcacattcaatgcttgccttgtcatgccctgtgga

SEQ ID NO: 53901 - DNA, 201 bp, Homo sapiens
actgcagcccccacctcccaaggcttaggtcacctcagcctcctgagtagctgcaactacaggcaagtaccatcatgcctagctgatttttgcattttttrtagacagggttttgccatgttacttaggctggtcacgaactcctgggctcaagtgacccacccacctcggcctcccaaagtgctgggattacaagcgtga

SEQ ID NO: 53902 - DNA, 201 bp, Homo sapiens
acaacactcttttcatcttcccagactgaaactcaacaccgttcacagctccccattcccgccttccccaggcgcccaccattctcctctctatttctacraatttgatgactccagtccctcagatatgtggaattgtggctgggcgcggtggttcacatctgtaatcccagcactttcagaggccaaggcaggcaaatc

SEQ ID NO: 53903 - DNA, 201 bp, Homo sapiens; identical to SEQ ID NO: 10152

SEQ ID NO: 53904 - DNA, 201 bp, Homo sapiens
gctcgtgggctcgtgggctcgccaggtcggtaaaacccagctccttctccagaggctgcgtctcacccagggatggtggcttctgctgccccctcctctckgtaactgtggccggccgtcatgctgagccaccccctcaatacaaggctccagatgtttcctgctcactgaccagagatagcaggagggggacacctgttt

SEQ ID NO: 53905 - DNA, 201 bp, Homo sapiens
aaggcgaggtgggcaagttcaatgccaagcgtgacgggggaactgtgccccgggccctcaggtgatataggagttaagaagaaattattgaggcaaccagrtgcggtgactcaggcctgtaaccccagcactttgggaggccgagggtggatcacctgtccttaattttcttggcgccagaagatgaattgagtatttacc

SEQ ID NO: 53906 - DNA, 201 bp, Homo sapiens
tataatgtcagtgcctcccttcagtggctcccatgtcacagaattgtcctgcagccctggcacatgtgtgccatgtgggagctggggcaggtcctctttcmtcctgtggctccgagggagggggccgctccttccccagtctctaccctgacttggccctcgtcctgcagccactcagagagcacgatggagctggagctt

SEQ ID NO: 53907 - DNA, 201 bp, Homo sapiens
tttacatacaactgagtttttgcttacacagtttttaatttcttttaattcctgttctagtattttggggctaggttgtcaggtatgtatatatttctgtytgttatattttcgtgatgtattcactttatatcatggcagaatgtttctctttagtaagatttttgatcttaaaaaagttggccagatggggtggctcat

SEQ ID NO: 53908 - DNA, 201 bp, Homo sapiens
acacatacctatgatagggtttaatttataaattaggcaccgggtgggattaacaaccataattaatagtaaaatagaacaattataacaatatactgtcygaggcgggtggatcacttgaagtcaggagatcgagaccagcctggccaacatggtgaaacctgtctctactaaaaatacaaaaaattagccaggcgtagt

SEQ ID NO: 53909 - DNA, 201 bp, Homo sapiens
cccaggctggagtgcagtggcatgatcttggctcactgcagcctcaatctcttgggctcaattggtcctcccacctcagcctcctgagtagctgggactamaggtgagtaccaccacatccagctaatttttgtatttttggtagagatggggttttgccatgttgcccaggctgttctcaaactcctgggctcaagtgat

SEQ ID NO: 53910 - DNA, 201 bp, Homo sapiens
ggctcttgccaggtggagtgttctagagatgtcagttggtgtccagtgatgtcaagtcatttgtatctactgattttctttctaattattctatccattaytgagagtggggtaggattttggtgtccaattattgtttttttgtttttttttttttgtttgtttgtttttttttttgaggtggagtctcactttgtcacc

SEQ ID NO: 53911 - DNA, 201 bp, Homo sapiens
tgtgttctctctctctctggtcaatgtagctaaagctttgtcaattctcttgatcttttcagagaactgacatttgattttttttactttatctttttctytctgttctctagttcattggtttccactctaatatttattaatttcccttcttctcactttgggtttaatttgttctgtcttttcttattgtagttactt

SEQ ID NO: 53912 - DNA, 201 bp, Homo sapiens
gtctcctcttttagtcctgattttagttatttgtgttctctctctctctggtcaatgtagctaaagctttgtcaattctcttgatcttttcagagaactgmcatttgattttttttactttatctttttctctctgttctctagttcattggtttccactctaatatttattaatttcccttcttctcactttgggtttaa

SEQ ID NO: 53913 - DNA, 201 bp, Homo sapiens
caaagatttaatcttatattttcttctaaccgctttctagtttatgtgtaagaatctgtccattttacctaagttgcataatttgttggcaaacagttgtwcatagtatttccttgaaatccttttaatctctgtaagattggaattgctgtctcctcttttagtcctgattttagttatttgtgttctctctctctctgg

SEQ ID NO: 53914 - DNA, 201 bp, Homo sapiens
ctcctttgttcagttttgagagttctttacatacacagtatcatatatatatatatatatatatatatataccagatatatgatttgcaaatattttcaaycatcaatagtttgtcttaacacttttttattggtgttttgaagtagaaaagttttacattttgatccattccaatttattaactttttcttttattgtgt

SEQ ID NO: 53915 - DNA, 201 bp, Homo sapiens
ggctgagggttccactgtctgtacgtctgcagcaatacataccattcttgtgggtaaaaggtggtatctcattatagttttgatttgcatttccccaaggwcaaatgatggcaagtggcttttcttgtgctttttagccatttgtatatgtttttggtgaaatgcctgttgaaatgttttgcctttttaaaaattgagttg

SEQ ID NO: 53916 - DNA, 201 bp, Homo sapiens
aaactcctgggctcaagtgatctgcccacctcggcctccccaagtcctgggattataggtgtgagccgctgcgcctggctgagggttccactgtctgtacrtctgcagcaatacataccattcttgtgggtaaaaggtggtatctcattatagttttgatttgcatttccccaaggacaaatgatggcaagtggcttttct

SEQ ID NO: 53917 - DNA, 201 bp, Homo sapiens
aggacagggcaggagaacgtggtgcatctgctgctctaagccttccaatggccgctggcgggcgggtgcaggacgggcctcctgcagcccaggggtgcacrgccggcggctcccccagcccccgtccgcctgccttgcagatacgtggctttcctgaagctgttcctggagacggcggagaagcacttcatggtgggccac

SEQ ID NO: 53918 - DNA, 201 bp, Homo sapiens
tcaggacagggcaggagaacgtggtgcatctgctgctctaagccttccaatggccgctggcgggcgggtgcaggacgggcctcctgcagcccaggggtgcrcggccggcggctcccccagcccccgtccgcctgccttgcagatacgtggctttcctgaagctgttcctggagacggcggagaagcacttcatggtgggcc

SEQ ID NO: 53919 - DNA, 201 bp, Homo sapiens
aggatataaccaaacaaattgctgcaactcataagccaatcttatgtggaaaatgtaatcatgctaaacctccttgtattttcccatttaagtgaagcccwaatccctccacctcagagcactgagcccattcctttagagtctgtgttttttgagtggtggtcgtcaaacttagagttcgaataaactctataacattgg

SEQ ID NO: 53920 - DNA, 201 bp, Homo sapiens
agatgaattgagtatttacccagacaacaacgtcgcttcagagggagggatgcagaacgcagggccacggggcgcaggctgcaggccagtgaaccccaacsccaaaggccagggagagccgggtggggtacccagagccagcacacagccctttaatttagaggagtgctgtgtacacatctggggagagatgttttactt

SEQ ID NO: 53921 - DNA, 201 bp, Homo sapiens
tcggctcagaataaatctcttcaaatatttttcagagtttgactctttttgtcgacaataagctcatcagattaaagctgttggaactttaaattacttcsagccttgaaagaatgtgattctgacaccctagtcaagcagcaagtcgctgtgaactttgcttctccaattatagattaacgctcttcctttcttgatttg

SEQ ID NO: 53922 - DNA, 201 bp, Homo sapiens; identical to SEQ ID NO: 10164

SEQ ID NO: 53923 - DNA, 201 bp, Homo sapiens
ttggaattcagcaaagctgaccagcatgaacattaacacagaccttaagtctgattagtggcatttacaatctatactctctgaagcgtgctacctggagkcttcctttgcatgataaaactttggtctccacaaccccttatcataacctagacactcctttctagtgataataactctttcaaccaattgccaataaaa

SEQ ID NO: 53924 - DNA, 201 bp, Homo sapiens
tataagcatgagccactgcacctggccccaacatcatttattgaacagactgtcgtttccacattgtgtttcttggcatttctgtcaaaaatcagttgacygtaaatgcatggattcacttccgggctctctattctgtttcattggtctgtttgtttttatgccaataccatgatgttttgattattatagctttatagt

SEQ ID NO: 53925 - DNA, 201 bp, Homo sapiens
aatttttcttatttataaaatgggtttgattcaaaactgacttttcctcttcacagtctcacaggtccttccccaggtccaagaggctcttctgtgtcctratgacaagtagctgcctagccgtggtggcacctcctatcacatgttaagggacccctccccagggccacacctggcagaaggtggcttatgatgttcgca

SEQ ID NO: 53926 - DNA, 201 bp, Homo sapiens; identical to SEQ ID NO: 10168

SEQ ID NO: 53927 - DNA, 201 bp, Homo sapiens; identical to SEQ ID NO: 10171

SEQ ID NO: 53928 - DNA, 201 bp, Homo sapiens
ggtgctggtggtcccccatcgctgggaagaggatgaagtgagtcgcagcccgaggactcgctcaggacagggcaggagaacgtggtgcatctgctgctctragccttccaatggccgctggcgggcgggtgcaggacgggcctcctgcagcccaggggtgcacggccggcggctcccccagcccccgtccgcctgccttgc

SEQ ID NO: 53929 - DNA, 201 bp, Homo sapiens; identical to SEQ ID NO: 10174

SEQ ID NO: 53930 - DNA, 201 bp, Homo sapiens
tgcggtgactcaggcctgtaaccccagcactttgggaggccgagggtggatcacctgtccttaattttcttggcgccagaagatgaattgagtatttaccyagacaacaacgtcgcttcagagggagggatgcagaacgcagggccacggggcgcaggctgcaggccagtgaaccccaacgccaaaggccagggagagccg

SEQ ID NO: 53931 - DNA, 201 bp, Homo sapiens
ttatctgtttagtgaccttgcagctgcacagctagagaaacagagtcttcgcaatgcctgggaaagggagagataaggctcactagccacagaaaaacagmcagttaatttttaaaggactccagccctttctcttcctcaaggggaattggttttttacatacaactgagtttttgcttacacagtttttaatttctttt

SEQ ID NO: 53932 - DNA, 201 bp, Homo sapiens
acgcagcactgctatgaacatttgtgtacaagactttgtgtgaacatgttttcatttctcttgggttgatacccagcagaggaattgctgggtcatacagraagtctgatttaacattttaagaaactagcaaactgttttccaaagtgactgccccattttacattcccatcagcagtgtataacggttctaattttctt

SEQ ID NO: 53933 - DNA, 201 bp, Homo sapiens
agaataatcaacgtgtggggaaatgacaggacccaggagagcggttttaggcttccaagtttgggaaaccggcaaggtgagtattgggaggaaactaaggyggaagtttcattcacagagccctagggtgccttctttcctctggctgatgcgtctctctcctataatttccatcctgcctcagacagcagagggacaggg

SEQ ID NO: 53934 - DNA, 201 bp, Homo sapiens
tagaactgggttatggagcaacttcaacaaagaataatcaacgtgtggggaaatgacaggacccaggagagcggttttaggcttccaagtttgggaaaccrgcaaggtgagtattgggaggaaactaaggcggaagtttcattcacagagccctagggtgccttctttcctctggctgatgcgtctctctcctataatttc

SEQ ID NO: 53935 - DNA, 201 bp, Homo sapiens
gagtgatgctctggaactgctgggtcagtagcccagcccctggccccttggatgggatcatttgaagccctgttttctgcaccatttttcaagttccctgrtggggctgagtctggttgcaaatcgtgaaagctgccctatagtacttttaccagctgcctccctttctctgtctcacttcctcattcccctcctgatgtc

SEQ ID NO: 53936 - DNA, 201 bp, Homo sapiens
aaagggaacacaacccagagagacctcctgggtttctacaagcccaggagggcccactgaggaggaaagcaaggtgccagagcaggctgaaatgcgcggarctcatccaccacccagggttgctaccagcaagggccacgctcatgagcacgcacagcagtagccaccctgaggggccacttcatgctgctgtcagtggag

SEQ ID NO: 53937 - DNA, 201 bp, Homo sapiens
tggccagtgatgaagcctggctgggtctggtgggccagcaggtcccgctaaggaggctcatggtgcatacagtttgtccttgttaagtggcgatggggatgggggggttcattgtttttccttaagattattaggtggctttacagaattgaagtctgtgtccgaaggctccccattccaaccccgaaatagagacagagg

SEQ ID NO: 53938 - DNA, 201 bp, Homo sapiens
ggggctcatgctggcgttcatatcgattccccagtgagccaaccccactgagaagccctgttctgtaaactcttcttcaaccttccctcacctctgcttcycttcttcagccccacagtgaagaacatctgagctcaaatccagataagtgacataagtgacctgctttgtaaagccatagagatggcctgtccttggaaa

SEQ ID NO: 53939 - DNA, 201 bp, Homo sapiens
agcagctacagggaatagagtgtagcaaactcctaatcatccctcaaaaccctgccctggtgtcctctcccttgtaaactttccttgaacaaggcagaacyagctacatcagcaccataccatccctccatcactacagatatcactctgtactataattatccatttatttttctaggccttgcactccctaaggccagg

SEQ ID NO: 53940 - DNA, 201 bp, Homo sapiens
ctgggtctggtgggccagcaggtcccgctaaggaggctcatggtgcatacagtttgtccttgttaagtggcgatggggatgggggggttcattgtttttcyttaagattattaggtggctttacagaattgaagtctgtgtccgaaggctccccattccaaccccgaaatagagacagaggttgcaaagcattgatgaagg

SEQ ID NO: 53941 - DNA, 201 bp, Homo sapiens
ggtgctgcaagatgtgttgttttcctccaatgcttgaattcttggctccaagagaacattttatttagcctagcctcctaggccatctttttgttggggartcatttgttgcaggataatatcaaaagcacttggacagagaaatcgattagaactgccagtgaaaccaactctggctgtgtagtatgtgctggtgtggga

SEQ ID NO: 53942 - DNA, 201 bp, Homo sapiens
gttgcaaagcattgatgaaggggctcatgctggcgttcatatcgattccccagtgagccaaccccactgagaagccctgttctgtaaactcttcttcaacyttccctcacctctgcttcccttcttcagccccacagtgaagaacatctgagctcaaatccagataagtgacataagtgacctgctttgtaaagccataga

SEQ ID NO: 53943 - DNA, 201 bp, Homo sapiens
agtttctgcttgggcagaaggagcaacttgcagcctctctaagtccctttcaacgttcctcagctccgcgcttacagagggtggatctcagaaccaggagracaaacagctgctcattgagtcctgagagtgcctgagtgggggcgtccaaggaggccgtggtgtgggcggagcagctggtacagtttgcgcatgggcagt

SEQ ID NO: 53944 - DNA, 201 bp, Homo sapiens
ctgccagtgaaaccaactctggctgtgtagtatgtgctggtgtgggaaaggacctagcctggggctgtggcaatcccgattcatggtgctttcaagtcagrttttcttggaattctgggtttgctggggtcttctgagtggggttgcctgtgctcccctagagggcagccatgaaatgggagcggtggtgcagatgggagg

SEQ ID NO: 53945 - DNA, 201 bp, Homo sapiens
gaattaatatggaccctttaattatgaaatgtttgagacagaaaggatctctgagaccacctagtcaggcccctactcctacaggtgtgaacatggaagcyggtgacatacctgaagtcacctcattccagctagaagccaggccacctgactaggagagggcaggccattgctctttgccctgaccctggtggggttcta

SEQ ID NO: 53946 - DNA, 201 bp, Homo sapiens
agtgttcccggagaaagtctttggaaggagcactggagtaggagtcagggaagctgagctgtccacctgattccaccacgacctgagtgacctttttcaartcacttttcctctccccgtctcagtttctgcttgggcagaaggagcaacttgcagcctctctaagtccctttcaacgttcctcagctccgcgcttacaga

SEQ ID NO: 53947 - DNA, 201 bp, Homo sapiens
tctctgaccactcaagctagaggaggcccccttaccctcagtctaacacatcatcttgtttttatttcttatatatttgtttacccatttataatctagaktctagacattagactacaagttccttgagggtggagatcttttcttttctgttcacaatgtatacccaacagctagcagagtgcctggcacatagtaggt

SEQ ID NO: 53948 - DNA, 201 bp, Homo sapiens
catcccagcctggacttgacacgttgctctctgtttttacctaaaagagccagaagcgctatcacgaagatatctttggtgctgtatttccttacgaggcraagaaggacagggtggcggtgcagcccagcagcctggagatgtcagcgctctgagggcctacaggaggggttaaagctgccggcacagaacttaaggatg

SEQ ID NO: 53949 - DNA, 201 bp, Homo sapiens
ggtggagctgcgtgggggatgggaggggactgagcatggggcttcatcttcactgcccactccccacctctccccagctgtgcccctctcatcagaccccyaagagttgttgatctgggtgttgtggaccacagcgttctcatcaaaacggggattgaggtggaaggcgatgtggttcccagagtgcgggttgatgtggaa

SEQ ID NO: 53950 - DNA, 201 bp, Homo sapiens
ctcccacagccaagagcattacttccagtgccatattttaccactaaggtgagaagtggtatttgttgaaggcctactgtgggctgattcctgggtttcastgctttccaatgagggaagcagcctcagctcctgtgtccctggtgaggtaatgaggcttagaaagattaagcaacttgcccaagctcgcccaggtggaag

SEQ ID NO: 53951 - DNA, 201 bp, Homo sapiens
actccttagctcacttccacatgtttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctt

SEQ ID NO: 53952 - DNA, 201 bp, Homo sapiens
ctccttagctcacttccacatgtttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctccttt

SEQ ID NO: 53953 - DNA, 201 bp, Homo sapiens
tagctcacttccacatgtttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctc

SEQ ID NO: 53954 - DNA, 201 bp, Homo sapiens
agctcacttccacatgtttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctct

SEQ ID NO: 53955 - DNA, 201 bp, Homo sapiens
ctcacttccacatgtttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttt

SEQ ID NO: 53956 - DNA, 201 bp, Homo sapiens
tccacatgtttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttc

SEQ ID NO: 53957 - DNA, 201 bp, Homo sapiens
ccacatgtttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttcc

SEQ ID NO: 53958 - DNA, 201 bp, Homo sapiens
cacatgtttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttcct

SEQ ID NO: 53959 - DNA, 201 bp, Homo sapiens
acatgtttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttcctt

SEQ ID NO: 53960 - DNA, 201 bp, Homo sapiens
agtataagaaaagttaaattgcctatgatcttatcacttaatgctagtcactgttaacatttactaacattccctcgaggtgtttttctgtgcttgtacgmacacacacacacacagccagcatcagactgtgtatacagtttaaggcattatttatatgagggcaaaactagacacagtctaacatccagccatggacaa

SEQ ID NO: 53961 - DNA, 201 bp, Homo sapiens
ttaaaacggtttccccactcctggatgtctcagagtcttggatgtggtaatgtgcatcattaatctggaagagaaggaaagacttgtgtgcagggattccmaaacttacacagtagatgagtttttcatggtgttctggagaacacagtttgagaaacactttcacaatgaatccaggcctcaacatacatcagctgctct

SEQ ID NO: 53962 - DNA, 201 bp, Homo sapiens
aaactcctggcctcaagtgatccacctgtctctgcctcccaaagtgctgggattacaggtgtgagccactgcacccatcctgtagctaccactgagcttaraactgatctggctcccaggagttgctgtgtcttggaagaataagtgaatgagagcccacgtccacaagagtggtggccggacttttatatacacatatat

SEQ ID NO: 53963 - DNA, 201 bp, Homo sapiens
gcctggggacaggcaccacacaatggcggatccactttggatccactcagtatctccatagctctttattgctgtgattgccccagtcatttagggaactygtcactcatgcagagcgtcactcagcggtggtgcttaggagcatcagcttgcatcggggcaggcttggttccaaagcccaggcctcctccatgtggctcc

SEQ ID NO: 53964 - DNA, 201 bp, Homo sapiens
acttctgtgacgtccagcgctacaacatcctggaggtaacccagccagcccagctggccagatgaaggtgtgggcctgggggtggcttcagggaccgactygccgctatcactctgcctctgtaggaagtgggcaggagaatgggcctggaaacgcacaagctggcctcgctctggaaagaccaggctgtcgttgagatca

SEQ ID NO: 53965 - DNA, 201 bp, Homo sapiens
aggtgggttggcgggagtctgctgaaaagaaaccaggaaattcaatgggagagcgcatgtgtgcgcgagcactcacccacgcgcacccatgcattctagasgggctccactgtgaggctgacctcatgagcctttggcccttggactcccccatccacctcccttttcatgttagccttcctggaacttcctgccgtgttc

SEQ ID NO: 53966 - DNA, 201 bp, Homo sapiens
gtgggtgtactgggaccgtgctagaggcctctgctggggagactgcagaggtgcctgggcaggctgtagtgtggggaggagttggggggaggaggtgggtycacccagagtgcaacatccactcaggtgagggaggggtgatgttactggaagaggaagcagccgtgcaaaggggatttcatcctgaaagcaatgagagcc

SEQ ID NO: 53967 - DNA, 201 bp, Homo sapiens
ttttgtcacgagaaaagtcaggcccagagagaagtggcttttccaagatcacatggtaggtcagcagtgaagctgtgcctcgaacctgggacctttcaggytaaaggaaaccagaacatgccacgcccagatatgccgatatggcatcctgattatctccagctgaaggcatttgagaaagagcagctagagagagggcta

SEQ ID NO: 53968 - DNA, 201 bp, Homo sapiens
agaggttgcaaagcattgatgaaggggctcatgctggcgttcatatcgattccccagtgagccaaccccactgagaagccctgttctgtaaactcttcttmaaccttccctcacctctgcttcccttcttcagccccacagtgaagaacatctgagctcaaatccagataagtgacataagtgacctgctttgtaaagcca

SEQ ID NO: 53969 - DNA, 201 bp, Homo sapiens
caaccagccggccctggtccaaggcatcctggagcgagtggtggatggccccacaccccaccagacagtgcgcctggaggccctggatgagagtggtgagycccgggctagaaagccagtgctgcctggcaccctctggccgccccacctggctgaggggctgagcctgggcctgccggtgacagccatccctgtccttcc

SEQ ID NO: 53970 - DNA, 201 bp, Homo sapiens
tgaaaccaagagcctattctaagtgactggtgattctataccttcgtaaacaattaggaaatgagcatggtgtgtgtgtgtgtgtgtgtgtgtgtgtgtgygcgcgtgtgtgtgtacgcatgtgtgtattttagggacaaaggcaaatgtgggagcatctaggtgaagacacatggaattcagaaccaagtcgagctatgt

SEQ ID NO: 53971 - DNA, 201 bp, Homo sapiens
tcacacagcactgcaccacacaaagtgagccacagacatgtacctgggactccctggcggaaagagtggcttctggtggtaccacctccacttttctttgkcttttttttttttttttttttttttttgagactcggtcttgctctgtctcccaggctggagtgcagtggcacaatctctgctcactgcagcctcgatctc

SEQ ID NO: 53972 - DNA, 201 bp, Homo sapiens
ggcatttctccacagcagcctcggaacctctatcgccaccctccggggggcccacctgtcccccgcctgcccttcaaggtgctctttgatttctccccagmagaattcacctgctgcatccatcatcagaagaggccaggaatgcggcctgctgggtgggcagggccaagaagaaggcagccgtgcaggcccaggaagccg

SEQ ID NO: 53973 - DNA, 201 bp, Homo sapiens
cgatctcctggatcaagtaatcctcccaccacagcttcctgaggagctgggaccacaggtgtgcaccactatgcttagctaattttttaaatttttagtaragacagggtctcactatgttgcccaggctggtcttgaactcctgagctcaagcgatcctcctgccttggcctcccaaagtgctgggattacaggtgtgtg

SEQ ID NO: 53974 - DNA, 201 bp, Homo sapiens
ggggggcccacctgtcccccgcctgcccttcaaggtgctctttgatttctccccagcagaattcacctgctgcatccatcatcagaagaggccaggaatgyggcctgctgggtgggcagggccaagaagaaggcagccgtgcaggcccaggaagccgtaggagacttgccaacctccaggagggggccagccctggaccct

SEQ ID NO: 53975 - DNA, 201 bp, Homo sapiens
tttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttt

SEQ ID NO: 53976 - DNA, 201 bp, Homo sapiens
ttaccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttcctttttttt

SEQ ID NO: 53977 - DNA, 201 bp, Homo sapiens
accttctcacagcttgccacccctggaagcctacaactgcattcgtcttgtcacctttctcttctttctttctttctctctttcctttcctttcttttccyttcctttcctttcctttcctttcctttcctttcctttcctttcctttcctttcctttcctttcctttcctcctttccctcttttttttcctttttttttt

SEQ ID NO: 53978 - DNA, 201 bp, Homo sapiens
ccttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttttttg

SEQ ID NO: 53979 - DNA, 201 bp, Homo sapiens
ttctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttttttgag

SEQ ID NO: 53980 - DNA, 201 bp, Homo sapiens
tctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttttttgaga

SEQ ID NO: 53981 - DNA, 201 bp, Homo sapiens
ctcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttttttgagac

SEQ ID NO: 53982 - DNA, 201 bp, Homo sapiens
tcacagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttttttgagaca

SEQ ID NO: 53983 - DNA, 201 bp, Homo sapiens
acagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttttttgagacagg

SEQ ID NO: 53984 - DNA, 201 bp, Homo sapiens
cagcttgccacccctggaagcctacaactgcattcgtcttgtcacctttctcttctttctttctttctctctttcctttcctttcttttcctttcctttcctttcctttcctttcctttcctttcctttcctttcctttcctttcctttcctttcctttcctcctttccctcttttttttccttttttttttgagacaggc

SEQ ID NO: 53985 - DNA, 201 bp, Homo sapiens
ggcaggacgagaagcggagacccaagagaagagagattccattgaaagtcttggtcaagtgagtggcagtggcagtggctagtagtgatgtgtgaactatmtctctcccttctagtcagcctctgcctccagtccttgaagggcaagaacacaaggaatggttatgctttttgcttttgtttttgagacagggtcttactc

SEQ ID NO: 53986 - DNA, 201 bp, Homo sapiens
gccctcccttgtgggagttcagtgacaggggtggggcgcaggccagccttctctcccaggctcatgatgggtgtgaagggtcctctaccactccagcatcygcgagccgagccaagccaggaccccgccctgccctcacatctcctttcttttctgaaggtagaggcctggaaaacccatgtctggcaggacgagaagcgg

SEQ ID NO: 53987 - DNA, 201 bp, Homo sapiens
tcctggcctcaagtgatccgcttgcctcagcctcccaaagcgctgggattataggcataagccacggtgccgggccagctttctttattgtttggtttccyccactagaatgtaagctccatggggcagggaccttgtctgtctgtttgctgctgcacctctggcctagaagagtgtctggcacatggtagatgctaaaat

SEQ ID NO: 53988 - DNA, 201 bp, Homo sapiens
agtcaccatcctctttgcgacagagacaggaaaatcagaggcgctggcctgggacctgggggccttattcagctgtgccttcaaccccaaggtactggctyagtgggatggctgttgttttttctgcttgtgtgcaggggagtctaggaaaagttaaaacggtttccccactcctggatgtctcagagtcttggatgtggt

SEQ ID NO: 53989 - DNA, 201 bp, Homo sapiens
atgaatgatgagggccacatccgcgatctggcctggcacaaactgggtcttcagtccttgtctgacgtgtgcatgaatgagtgatgctgggaggggacctrtgagctgtggctgctcttgcttgctgtgcgaggatgacaacctccacctcctcttaagcccacacacagccgctgggctcctgtgtagggctaagccctc

SEQ ID NO: 53990 - DNA, 201 bp, Homo sapiens
gactcacagcctttggacctcagcaaaggtacctgcttctctgcagcacatggggcttgtttgtgttggggtctgagccctaagcccatggtcaaggagamccccaggtctttctgaacagagacagctggcctcggggcctccctctcactgcatgcaagagcctgttagggcataatactcaaggtgctgagggaggct

SEQ ID NO: 53991 - DNA, 201 bp, Homo sapiens
cacaaactgggtcttcagtccttgtctgacgtgtgcatgaatgagtgatgctgggaggggacctatgagctgtggctgctcttgcttgctgtgcgaggatracaacctccacctcctcttaagcccacacacagccgctgggctcctgtgtagggctaagccctcaggcccatccgctgctcttactcatagaaacacttc

SEQ ID NO: 53992 - DNA, 201 bp, Homo sapiens
tcaatgaaaacaaaatgaagttaatgaattttagctagatactattccctggccaaggcctgctctttgtttgttttgtttgttttttggtttttggtgtktgtttgtttatttatttatttatttacttaggtggagttttgcttttgttgcccagggtacagtgcaatggtgcgatctcagctcactgcaaactctgcc

SEQ ID NO: 53993 - DNA, 201 bp, Homo sapiens
gctctttgtttgttttgtttgttttttggtttttggtgtgtgtttgtttatttatttatttatttacttaggtggagttttgcttttgttgcccagggtasagtgcaatggtgcgatctcagctcactgcaaactctgcctccctggttcaagtgattcttctgcctcagcctcccgagtagctgcgattacaggcacgcg

SEQ ID NO: 53994 - DNA, 201 bp, Homo sapiens
gaatgtgtcgagggtcaaaccacagaaaccaagtccctctcacaggtctgcaggccaagcatggggtggtcatgggagttggtgacaaggctgggggatgragaggaccagaagggggtccagctccattctccagctggagggggagagtctggggctggctctccaggctgttggtgctgggtgctgggtgccaggtgc

SEQ ID NO: 53995 - DNA, 201 bp, Homo sapiens
acctccgtctcctggcttcaagtgattctcgtgtagctgggactattggcactaccaccatgcctggtttcagtatgttggccagtctggtctcaaactcytgacctccagtaatccacccaccgcggcctccaaaagtgctgggattacaggcatgagccaccatgcccggtctggaccaaggatctttatttgtggaat

SEQ ID NO: 53996 - DNA, 201 bp, Homo sapiens
gtcaagtgagtggcagtggcagtggctagtagtgatgtgtgaactatatctctcccttctagtcagcctctgcctccagtccttgaagggcaagaacacarggaatggttatgctttttgcttttgtttttgagacagggtcttactctgtcacccaggctggggtgtagtggtgccatcacagctcactgcagcctctgc

SEQ ID NO: 53997 - DNA, 201 bp, Homo sapiens
gtagctttggctcagctctgctcatgcccttttggctctgcgggaggaagaagataagaggaagagggaagatggggatggggaggcagttggtcagaccraccatgaacaattcactcccaccctctggactcagtttccctatttgtcaaatgaggttactggcagagggaactccaagatgcccctccacccttggat

SEQ ID NO: 53998 - DNA, 201 bp, Homo sapiens
caaggaaaggtttcttctgatatccatgtatgtccaaggcggatgctttctttaggcagaggctgtagccaagccctcggggggctccaagggctgctggraaggggtgggcccccctcctccccagagggaagctcctggggccctcttaagcacccctgcctgtggggatgcctcatcccaagctcagggtggtggcct

SEQ ID NO: 53999 - DNA, 201 bp, Homo sapiens
agtgacctttttcaagtcacttttcctctccccgtctcagtttctgcttgggcagaaggagcaacttgcagcctctctaagtccctttcaacgttcctcasctccgcgcttacagagggtggatctcagaaccaggaggacaaacagctgctcattgagtcctgagagtgcctgagtgggggcgtccaaggaggccgtggt

SEQ ID NO: 54000 - DNA, 201 bp, Homo sapiens
ttcttttcctttcctttcctttcctttcctttcctttcctttcctttcctttcctttcctttcctttcctttcctttcctcctttccctcttttttttccttttttttttgagacaggctagggtgcagtggcgcgaccatagctctctgcagcctctaactcccagactcaattgatcctcccacctgatcctcctgagt

SEQ ID NO: 54001 - DNA, 201 bp, Homo sapiens
cccccatctacacaagaccaccacatagccacacaaccccaccgccccagaggagcctttcccatggactacaaagggtagggcgccccctggatgtgtgragcatgacggccctgagtgtatctgtcagaggcggcaaaaaatgccagtggctaagaggatgggcttggggatgagcaagtggctttgccactcagtagc

SEQ ID NO: 54002 - DNA, 201 bp, Homo sapiens
caggtctatggggctataagttcttttctttctttccctctttccttcctttccttcctgtcctttcctcccttcccctcccttcccttccctttctttcttttttttttttggaaacagccttgactgcccagcctcaagcaatccttctgcctcagcctcccgagtagctgggactacaggcacaagacaccatgcctg

SEQ ID NO: 54003 - DNA, 201 bp, Homo sapiens
tccacagaaaggccattttgttcagagttacccactctccttaatcaggagttcattctttaaatagttttgatgctgtttcaaaaggctttggtgctgaytggaaatctcaaggttgttgttgttggtggtggtggtagtgtgtgtgtgtgtgtgtgtgtgtgtgtttcaaagcctttctgactgagtccctccctccct

SEQ ID NO: 54004 - DNA, 201 bp, Homo sapiens
acccactctccttaatcaggagttcattctttaaatagttttgatgctgtttcaaaaggctttggtgctgactggaaatctcaaggttgttgttgttggtggtggtggtagtgtgtgtgtgtgtgtgtgtgtgtgtgtttcaaagcctttctgactgagtccctccctccctttgggatatttttgaagtctgggagggga

SEQ ID NO: 54005 - DNA, 201 bp, Homo sapiens
gaacttgaaccccagctttctgacactggagtccttaattgctctgttgtgttgcattctcagcatttagcacagagcctggcacatacttgaagcttaayataggtttgcatgaatgaatgagtgcatgaatgcataatttaataaatggcatcctatgtgtccaatacgtctctctggctgggattaactcagaatcaa

SEQ ID NO: 54006 - DNA, 201 bp, Homo sapiens
ggtagttcacacctgtaattccagcactttgggaggctgaggcaggaggattacttgaggccagtagttcgagaccagcctgggcaacatagtgagactctataaaataataataataataataataataataataataaggaaaaaaattagctgagcaagatggcacatgcctgcagtcctagctacttgggaggctga

SEQ ID NO: 54007 - DNA, 201 bp, Homo sapiens
gtagttcacacctgtaattccagcactttgggaggctgaggcaggaggattacttgaggccagtagttcgagaccagcctgggcaacatagtgagactctataaaataataataataataataataataataataataaggaaaaaaattagctgagcaagatggcacatgcctgcagtcctagctacttgggaggctgag

SEQ ID NO: 54008 - DNA, 201 bp, Homo sapiens
tcgcgcccttccgcagtttctggcagcaacggctccatgactcccagcacaagggtaaggctggaggcttcccaggtgggaggggcaccagggggccagcrcctgcctaggagcagaactgcagccccacaaacggttcctgacctctctcgagggaaggcctcccaagtttgcttccctgtgcgggcctctgcgggttag

SEQ ID NO: 54009 - DNA, 201 bp, Homo sapiens
acctgtaattccagcactttgggaggctgaggcaggaggattacttgaggccagtagttcgagaccagcctgggcaacatagtgagactctataaaataataataataataataataataataataataaggaaaaaaattagctgagcaagatggcacatgcctgcagtcctagctacttgggaggctgaggcaggagga

SEQ ID NO: 54010 - DNA, 201 bp, Homo sapiens
ccctcagccccctagaagagctccaccttgtgcacacaactctgggggagaaggtggcacagatacccccctgcccttagggagcttctagtttaaggtckttcctccagtgactacctaggtcacctcttaactactgtgtctgtttcagtctcacagccatagagagcctggggacaggcaccacacaatggcggatcc

SEQ ID NO: 54011 - DNA, 201 bp, Homo sapiens
gtctcagctacaggtacgggactgaggcgggaggattgcttgagcccaggtggttggggcttcagtgagctatgatggcaccactgtactccagcctgggygactgagtgagaccctgtctcaaaacaaaaacaaagcaatatttataatagtagcaatagctactatgtgccaagcccagacacctctttgagtccttgc

SEQ ID NO: 54012 - DNA, 201 bp, Homo sapiens
cagggtttgtcctggcaacaaggaaaggtttcttctgatatccatgtatgtccaaggcggatgctttctttaggcagaggctgtagccaagccctcggggrgctccaagggctgctgggaaggggtgggcccccctcctccccagagggaagctcctggggccctcttaagcacccctgcctgtggggatgcctcatccca

SEQ ID NO: 54013 - DNA, 201 bp, Homo sapiens
ggggaaaaagacatcaacaacaatgtggagaaagccccctgtgccacctccaggtgagttttccctgggggaacctcctgcttgtctccttgggcacccakgccctgtcggcaccgatgactcagaattcctctctctgctcctcctctctcacctgaggtctgatctcctcattgcttcttgaaagtccctgttggaatt

SEQ ID NO: 54014 - DNA, 201 bp, Homo sapiens
gtatgttggccagtctggtctcaaactcctgacctccagtaatccacccaccgcggcctccaaaagtgctgggattacaggcatgagccaccatgcccggyctggaccaaggatctttatttgtggaataaaaggaagaaaaagaaaaacccaacggccacctcagcaggatgccccaagggtggtgttcagatgtcactg

SEQ ID NO: 54015 - DNA, 201 bp, Homo sapiens
gtgcttcgaagttacacgaaacacacggctcagtgtttggcccatggtaagggcctaaaaagtggtagccccagtggtggggatgctgctgctgctgaccrttaaccgcagtctgctccaccttcttccaggcagcctgtgagacgtttgatgtccgaggcaaacagcacattcagatccccaagctctacacctccaatg

SEQ ID NO: 54016 - DNA, 201 bp, Homo sapiens
gctgctagcctgtggccatgttggggtctgagccccagccttccagctgcgaaggcagccaagtgtcgtagagaaggtgtcacagaggcgattccaggctktagtggtgaactctccactctgcacccccaggtgctgtgccctgtgccctgtctaagatagtcctgaaggtttctgcatatttaagatatccccaatgtc

SEQ ID NO: 54017 - DNA, 201 bp, Homo sapiens
acgaaacacacggctcagtgtttggcccatggtaagggcctaaaaagtggtagccccagtggtggggatgctgctgctgctgaccattaaccgcagtctgmtccaccttcttccaggcagcctgtgagacgtttgatgtccgaggcaaacagcacattcagatccccaagctctacacctccaatgtgacctgggacccgc

SEQ ID NO: 54018 - DNA, 201 bp, Homo sapiens
gccagagactgagtccggagtagggagaaaaacctgactcacacccactggggttcagccagtggaagagaggagatctaggtgggagaaagccaggtggwccccaaggaggaggtgccacaggggtggagaagaggtgcagggagccggagcagccagagaggagccaggtggccaggagagctggccccagaggagggt

SEQ ID NO: 54019 - DNA, 201 bp, Homo sapiens
tgtgtgcattttacaggtggcacagaaagtcacactgttagtaagtggagagctgagattcagacctggatagtctaactgctgagtccaagtcctccacyactccactgtcccactactcttgggacaatttaatgagatcagatgtgaagagcactcaacccttggtaggaggccagtggttcttagtcttcccaatca

SEQ ID NO: 54020 - DNA, 201 bp, Homo sapiens
cttcgatgcccgcagctgttccactgcccgggaaatgtttgaacacatctgcagacacgtgcgttactccaccaacaatggcaacatcaggtcggtgcacrtttcccagggctgcagaggggcttgccttgcctgagaatcttagccaaaagatgcagcacttgggtctaggggaggcatctccagctccaggagaaacca

SEQ ID NO: 54021 - DNA, 201 bp, Homo sapiens
aggcctcccaagtttgcttccctgtgcgggcctctgcgggttagaatggctgcctttccgtctcccgcatagtagccagggctccctctcctgggagtggrggtaacaggaaagtccctgcttttgatctccgattggctgagggaattctgcatccgcactttcagttctgtgactatggatgagtgatctgaatgcgct

SEQ ID NO: 54022 - DNA, 201 bp, Homo sapiens
ctttcctatgacatatttaatatatttctgtgaatggcctacctgtttgtatttacaaattcatatttaaaggaaacttgtatcactctcacaaatggaargcagcaaaacataaattcaatgaaaacaaaatgaagttaatgaattttagctagatactattccctggccaaggcctgctctttgtttgttttgtttgtt

SEQ ID NO: 54023 - DNA, 201 bp, Homo sapiens
cagagcaggtgctgagcagggttagggtctaaaccagattcaagcacaatctaagtataacagttgggaagacagatggctcatgaaggtccatgtgatarggaagctgggcaaccccaggggctcatcccagcctggacttgacacgttgctctctgtttttacctaaaagagccagaagcgctatcacgaagatatctt

SEQ ID NO: 54024 - DNA, 201 bp, Homo sapiens
accagccccgggctctgaggatctgacagtgggtggcgcagagccaggccttgcccttggggagctctccagcatacaccccaccctcccctcccagcgcyctgcaaagcaggcgtcaatgccattgttaatgcacagaggaggaacctgactgttagacaggttgatgggttttccagggtcgcacggcttctgggagat

SEQ ID NO: 54025 - DNA, 201 bp, Homo sapiens; identical to SEQ ID NO: 10259

SEQ ID NO: 54026 - DNA, 201 bp, Homo sapiens
tggggtgggcagcccacctggacctttgtccactgagttctgggccttatttcctccccgtcatccacagcctgcccaaagccaggggaatggctggaatkaccttgaagggctctctcttcccagaggtcaactggagcccttagcttacctctgagcactgggcaggacagtgcccaacaggatgatggacttggatgg

SEQ ID NO: 54027 - DNA, 201 bp, Homo sapiens
ctcccaagcaagccttcctgagcccgtggcacccagatttttacccccaggtgcacagggctttggggttggggggtagggtatccccattggttcctctygagagagaggaggctgggtttgatagagacctcattgctctctgtagctcccacagccaagagcattacttccagtgccatattttaccactaaggtgag

SEQ ID NO: 54028 - DNA, 201 bp, Homo sapiens
gtggggtcatgggggagcgtccaacaatattccaggcggggaggactcccagaggagcgacatttaggcagagcatggaagggcaattaggcgtgtgctgrgggcaggctggcagaggatgcttccgggaccagggacagcatatgcaaaaacatggtggcccgagagggccttgagtgagctgcagaggctgcgtgagct

SEQ ID NO: 54029 - DNA, 201 bp, Homo sapiens
agccactcgggaggctgaggcacaagaatcgcttgaagccaggaggtggaggttgcagtgatatgagatctcgccactacactccagcctgggtgacagaractccatctcaaaaaaataaaaaagaaagtgggatcagagaaacagagcctggcagtgacccccactgtccaggagaaagtgagagaacctgagacgtgg

SEQ ID NO: 54030 - DNA, 201 bp, Homo sapiens
ctactggcccagcccctgctctaggcagttctcataattgcaaaaatacctctgcgtattgagatttactctgtagcagacattgggctgggctcttcttsctggccgttgaatgaaccaaattcagtcctgactcacagcctttgtactccctgttccctttgcatgacatgccttttcctcagaatttttctaggctca

SEQ ID NO: 54031 - DNA, 201 bp, Homo sapiens
ttataatagtagcaatagctactatgtgccaagcccagacacctctttgagtccttgctgtcaccctatcaggtaagtgtgcttcgaagttacacgaaacmcacggctcagtgtttggcccatggtaagggcctaaaaagtggtagccccagtggtggggatgctgctgctgctgaccattaaccgcagtctgctccacct

SEQ ID NO: 54032 - DNA, 201 bp, Homo sapiens; identical to SEQ ID NO: 10249

SEQ ID NO: 54033 - DNA, 201 bp, Homo sapiens
gcccagacacctctttgagtccttgctgtcaccctatcaggtaagtgtgcttcgaagttacacgaaacacacggctcagtgtttggcccatggtaagggcytaaaaagtggtagccccagtggtggggatgctgctgctgctgaccattaaccgcagtctgctccaccttcttccaggcagcctgtgagacgtttgatgtc

SEQ ID NO: 54034 - DNA, 201 bp, Homo sapiens
agggcctaaaaagtggtagccccagtggtggggatgctgctgctgctgaccattaaccgcagtctgctccaccttcttccaggcagcctgtgagacgtttsatgtccgaggcaaacagcacattcagatccccaagctctacacctccaatgtgacctgggacccgcaccactacaggctcgtgcaggactcacagccttt

SEQ ID NO: 54035 - DNA, 201 bp, Homo sapiens
aagggctggctttgcaccacacatcctgactcctggggactcccagcaccagccctgatgctggcaggatgtggatacgtcccagaaaatctgtgagcctytgctgtctcctcaccgtggctgactgtgtccttccactgcctgagcgtctccaggacttcctcaccaccctccttcagggtaaacttcaaaagatgggcc

SEQ ID NO: 54036 - DNA, 201 bp, Homo sapiens
ccatagagatggcctgtccttggaaatttctgttcaagaccaaattccaccagtatgcaatgaatggggaaaaagacatcaacaacaatgtggagaaagcyccctgtgccacctccaggtgagttttccctgggggaacctcctgcttgtctccttgggcacccatgccctgtcggcaccgatgactcagaattcctctct

SEQ ID NO: 54037 - DNA, 201 bp, Homo sapiens
cctgaggaactggattcttactgggctgagcaggatgtgttggcatcacctggatgcagagtcgggcttcctggcagtggcccagtggctggcagaacccmacacatgaacactgagccacttttcctatgcaagccctaacccctaatgccggagagacccacaatggaacacacacccagacggtgcttcgggttggct

SEQ ID NO: 54038 - DNA, 201 bp, Homo sapiens
cccctgtggggccgccgacccctgggagttccgggaggaaagggagggatctggggtttaggagacgctcggagccccttggcccataaagaaggcactgrggtcacactggtgtggctgcctgtagcagggacagcgatgacaggtgggtctcaagagtccagtgagcttggccctttttcagaaggacctgggggaggt

SEQ ID NO: 54039 - DNA, 201 bp, Homo sapiens
tcctggtggaactctcctgtgaggatggccaaggcctgaactacctgccgggggagcaccttggggtttgcccaggcaaccagccggccctggtccaaggyatcctggagcgagtggtggatggccccacaccccaccagacagtgcgcctggaggccctggatgagagtggtgagtcccgggctagaaagccagtgctgc

SEQ ID NO: 54040 - DNA, 201 bp, Homo sapiens
ggtggcaactcaggttgtttcatcacggccagccaaccacatccaacccccaacctcaccaggccgggcagatggtcaagggcctggcctgtgccctcccyactcccaatgggagaggcccaatgcctggccctgcctcctccatgagcccagaaaagccaaaatgaggacgatccaaaaagaaagcaagagacttacaat

SEQ ID NO: 54041 - DNA, 201 bp, Homo sapiens
cggagccccttggcccataaagaaggcactggggtcacactggtgtggctgcctgtagcagggacagcgatgacaggtgggtctcaagagtccagtgagcwtggccctttttcagaaggacctgggggaggtgctggtgcctggacagaagtgaagcagcctgcaggacgtgggaaatcaaataggagcttcttgtcctct

SEQ ID NO: 54042 - DNA, 201 bp, Homo sapiens
tgcccccctgctcactcagccaggccctcacctacttcctggacatcaccacacccccacccagctgctgctccaaaagctggcccaggtggccacagaaragcctgagagacgaggctggaggccctgtgccaggtgaagatcagggctggtgggcagtgggggtatgtggggggtcccagcatgtggggagccagagtc

SEQ ID NO: 54043 - DNA, 201 bp, Homo sapiens
cgtgtttcaccaggagatgctgaactacgtcctgtcccctttctactactatcaggttaggggccttcctcttctctccttcctgggggctcagatgtggytgtatgtgtgtgtgtgtgtgtgcacctcattgttacacatgtagggcacgacgggaagcaggagtatgttgttagagctttccaggccccactcaaggat

SEQ ID NO: 54044 - DNA, 201 bp, Homo sapiens
aactaacttgcacccctctcacaagtctcccttcctctcaggagctgctcccgaaattcgccaactcaccctgggcctctgtctggcgttgtatcctctcytctgcccttccccagcacctttgcctgcctccatcagagtttctatcaggccgtgtgaaaatgactgattttccttggcttccccacccagttagactag

SEQ ID NO: 54045 - DNA, 201 bp, Homo sapiens
tcgtctcagcaccatggacagtgcctggcacatggacttgtttgttgagtgagtgaatgaatgaatgaatactgggttgtgacagtcttttccccaaagcrggacaggcgccctgagtcactgacatcacccttggcttttagccctcagagtacagcaagtggaagttcaccaacagccccacattcctggaggtgctag

SEQ ID NO: 54046 - DNA, 201 bp, Homo sapiens
caaagcgggacaggcgccctgagtcactgacatcacccttggcttttagccctcagagtacagcaagtggaagttcaccaacagccccacattcctggagytgctagaggagttcccgtccctgcgggtgtctgctggcttcctgctttcccagctccccattctgaagcccaggttctactccatcagctcctcccggga

SEQ ID NO: 54047 - DNA, 201 bp, Homo sapiens
ccacacatcctgactcctggggactcccagcaccagccctgatgctggcaggatgtggatacgtcccagaaaatctgtgagcctctgctgtctcctcaccrtggctgactgtgtccttccactgcctgagcgtctccaggacttcctcaccaccctccttcagggtaaacttcaaaagatgggcccttgtttcctcctctg

SEQ ID NO: 54048 - DNA, 201 bp, Homo sapiens
ctttcctttcctttcctttcctttcctttcctttcctttcctttcctttcctttcctttcctttcctttcctcctttccctcttttttttccttttttttytgagacaggctagggtgcagtggcgcgaccatagctctctgcagcctctaactcccagactcaattgatcctcccacctgatcctcctgagtagctagga

SEQ ID NO: 54049 - DNA, 201 bp, Homo sapiens
aatttttatatttttagtagagatggtgtttttccatgttgcccaggttggttccgaactcctggcctcaagtgatccgcttgcctcagcctcccaaagcrctgggattataggcataagccacggtgccgggccagctttctttattgtttggtttcctccactagaatgtaagctccatggggcagggaccttgtctgt

SEQ ID NO: 54050 - DNA, 201 bp, Homo sapiens
ggcgcgaccatagctctctgcagcctctaactcccagactcaattgatcctcccacctgatcctcctgagtagctaggactacagtagctgggcatgccascatacccagctaatttattttcaatttttctgtagagattggatctcactatgttgcccaggctggtctcgaactcctggcctcaagcaatctgcccacc

SEQ ID NO: 54051 - DNA, 201 bp, Homo sapiens
tggccaacatgctgcttgaggtgggcggcctggagttcccagggtgccccttcaatggctggtacatgggcacagagatcggagtccgggacttctgtgaygtccagcgctacaacatcctggaggtaacccagccagcccagctggccagatgaaggtgtgggcctgggggtggcttcagggaccgactcgccgctatca

SEQ ID NO: 54052 - DNA, 201 bp, Homo sapiens
atgataacatccccctcaatgcagtggccaaagtcagaaagtgggatgagctgggtgtggtggctcacgcctgtaatctcagcactttgggaggccgtggygggtggatcacttgaggtcaggagtctgagacaatcctggccaacatggcaaaaccccgtctctactaaaaatacaaaaataattagacaggaatggtgg

SEQ ID NO: 54053 - DNA, 201 bp, Homo sapiens
gagtgatgtaacagcaagatcaggtcacccacaggccctggcagtcacagtcataaattagctaactgtacacaagctggggacactccctttggaaaccaaaaaaaaaaaaaaaaaaaagagacctttatgcaaaaacaactctctggatggcatggggtgagtataaatacttcttggctgccagtgtgttcataactt

SEQ ID NO: 54054 - DNA, 201 bp, Homo sapiens
cctctgcgtattgagatttactctgtagcagacattgggctgggctcttcttcctggccgttgaatgaaccaaattcagtcctgactcacagcctttgtaytccctgttccctttgcatgacatgccttttcctcagaatttttctaggctcatttcttcttgtcaaaaggtatttcctataatgtcacctcctctgagaa

SEQ ID NO: 54055 - DNA, 201 bp, Homo sapiens
agattctagaaaggagcagcccaggcctcttctgccctcctgccaatgctcttagctgtccctctcctgtcgggatcatatagggctgcagtgacttcaaragtcctactggcccagcccctgctctaggcagttctcataattgcaaaaatacctctgcgtattgagatttactctgtagcagacattgggctgggctct

SEQ ID NO: 54056 - DNA, 201 bp, Homo sapiens
ttacccactctccttaatcaggagttcattctttaaatagttttgatgctgtttcaaaaggctttggtgctgactggaaatctcaaggttgttgttgttgktggtggtggtagtgtgtgtgtgtgtgtgtgtgtgtgtgtttcaaagcctttctgactgagtccctccctccctttgggatatttttgaagtctgggaggg

SEQ ID NO: 54057 - DNA, 201 bp, Homo sapiens
cccactctccttaatcaggagttcattctttaaatagttttgatgctgtttcaaaaggctttggtgctgactggaaatctcaaggttgttgttgttggtgktggtggtagtgtgtgtgtgtgtgtgtgtgtgtgtgtttcaaagcctttctgactgagtccctccctccctttgggatatttttgaagtctgggaggggag

SEQ ID NO: 54058 - DNA, 201 bp, Homo sapiens
ccttaatcaggagttcattctttaaatagttttgatgctgtttcaaaaggctttggtgctgactggaaatctcaaggttgttgttgttggtggtggtggtrgtgtgtgtgtgtgtgtgtgtgtgtgtgtttcaaagcctttctgactgagtccctccctccctttgggatatttttgaagtctgggaggggaggagagaag

SEQ ID NO: 54059 - DNA, 201 bp, Homo sapiens
tgggttcaggggatggaactgggtgtgcacagggggtcttctcagaaccgtgcaggcacagagacctgggtctaaggtctgtactcagaatgtgtcgaggrtcaaaccacagaaaccaagtccctctcacaggtctgcaggccaagcatggggtggtcatgggagttggtgacaaggctgggggatggagaggaccagaag

SEQ ID NO: 54060 - DNA, 201 bp, Homo sapiens
ccatctcaaaaaaataaaaaagaaagtgggatcagagaaacagagcctggcagtgacccccactgtccaggagaaagtgagagaacctgagacgtggggaygacaagacagttgcccttgtgactgtagggtgaaggatgtggttcatcaggactctgttccagaggagagaatgtcaggctcttatttttacccagtgtt

SEQ ID NO: 54061 - DNA, 201 bp, Homo sapiens
acacaagttgctacagtttagttggagtgagagacaagctaaacttgtcagctgacaaccaggtccttggccaggtagccccatatgtaaaccaacttccrtggtgggctgtgagccttctcctgcaagctgtggccaggtttccagaagaaaggaaaaaacagtgtttttattcatcctggcttgagaactctgtcattc

SEQ ID NO: 54062 - DNA, 201 bp, Homo sapiens
ataaggaatgaaattataggccgggcatggtggctaacccttgtaatcctagcactttgagaggctgaagtgggcagatcacttgagcttcagagttcgasaccagcatggacaacatggtgaaacccagtctctaccaaaaacacaaaaatattagctgggtgtggtggtgcatgcctgtagtcccagctactcaggagg

SEQ ID NO: 54063 - DNA, 201 bp, Homo sapiens
atgtttaccttctcacagcttgccacccctggaagcctacaactgcattcgtcttgtcacctttctcttctttctttctttctctctttcctttcctttcytttcctttcctttcctttcctttcctttcctttcctttcctttcctttcctttcctttcctttcctttcctttcctcctttccctcttttttttcctttt

SEQ ID NO: 54064 - DNA, 201 bp, Homo sapiens
cctctcggggaaacgtctctcagcctagcctccctttgcaggtgacagaagtgaatgtggggcatggtcttccgtggctgcccacggggtggcaactcagrttgtttcatcacggccagccaaccacatccaacccccaacctcaccaggccgggcagatggtcaagggcctggcctgtgccctccccactcccaatggga

SEQ ID NO: 54065 - DNA, 201 bp, Homo sapiens
ggcagaggatgcttccgggaccagggacagcatatgcaaaaacatggtggcccgagagggccttgagtgagctgcagaggctgcgtgagctttgtggtttrggggtgaggcagcgaggttgattggggtcagactgggaggaatttgtatgccctgctggggaatttgggctttatttgaagggctgggggctgtgaagat

SEQ ID NO: 54066 - DNA, 201 bp, Homo sapiens
cccaagctctacacctccaatgtgacctgggacccgcaccactacaggctcgtgcaggactcacagcctttggacctcagcaaaggtacctgcttctctgyagcacatggggcttgtttgtgttggggtctgagccctaagcccatggtcaaggagacccccaggtctttctgaacagagacagctggcctcggggcctcc

SEQ ID NO: 54067 - DNA, 201 bp, Homo sapiens
ttcatcaactcagattcagctccctcatcagttcaaggagggagggaacacccacagcccagagttgttaacagtattaggaggtgtgtgggagagatctstaggaaccaggcactaaaccaagccttctgtatgtatatgatcagttacattgtggggtaggcactgtgtgcattttacaggtggcacagaaagtcacac

SEQ ID NO: 54068 - DNA, 201 bp, Homo sapiens
tgtcttagaaagcgttttgctctggggccaccagtctcatgcgagactgtgccttggccagtacggatgtggtccctgggaaggcagcgtgtcgaggcgaktgtgggccacagcatcctcgcctgagggactggggaccctcttgggtttggagcaggccaaggaagccttcttaggagagtgggccccgtttccttctcc

SEQ ID NO: 54069 - DNA, 201 bp, Homo sapiens
agtcctccaccactccactgtcccactactcttgggacaatttaatgagatcagatgtgaagagcactcaacccttggtaggaggccagtggttcttagtsttcccaatcatgcagcctgaacgcaggggagattctgcattgattattcattcactcactcagctattcagtgggtgcctggcactggggtgggtatgga

SEQ ID NO: 54070 - DNA, 201 bp, Homo sapiens
ggccacccatagatccttccccactctaagacaaggcagggcctggggtctaggagagacctgagagaaaaccctgttttttccccttgcagaagtctccrgaatctctggtcaagctggatgcaaccccattgtcctccccacggcatgtgaggatcaaaaactggggcagcgggatgactttccaagacacacttcacc

SEQ ID NO: 54071 - DNA, 201 bp, Homo sapiens
acaatttaatgagatcagatgtgaagagcactcaacccttggtaggaggccagtggttcttagtcttcccaatcatgcagcctgaacgcaggggagattcygcattgattattcattcactcactcagctattcagtgggtgcctggcactggggtgggtatggaaatacaacagagatcagccctgccctcagggagcat

SEQ ID NO: 54072 - DNA, 201 bp, Homo sapiens
cacctgggggcctctcagctcaccccgatgggagaaggggatgagctcagtgggcaggaggacgccttccgcagctgggccgtgcaaaccttcaaggtcakttcccagccagagctgccccacagcagggacatgacagggtgcattcatgcctaggacatctgtgctgggcgtcccaggtggcatgacctctgcctgtgg

SEQ ID NO: 54073 - DNA, 201 bp, Homo sapiens
ccccaaagccagccctggagggagctgtctctggtgagaggcatcttgcccttctgatgtcctatttcagttcctgcttctgtggattgaattaatccccrtgtaaggccatctcattgttgatcttcctgctgtcttcctgtcccccagggcaaaaatagaggaacatctggccagggtggaagcggtaacaaaggagat

SEQ ID NO: 54074 - DNA, 201 bp, Homo sapiens
tagtcttcccaatcatgcagcctgaacgcaggggagattctgcattgattattcattcactcactcagctattcagtgggtgcctggcactggggtgggtrtggaaatacaacagagatcagccctgccctcagggagcatctagaggcggcagtggagagataggcatagaaataattagatgattttcattgtgctgaa

SEQ ID NO: 54075 - DNA, 201 bp, Homo sapiens
agctcatccgctatgctggctaccagatgccagatggcagcatcagaggggaccctgccaacgtggaattcactcaggtacccggcccagcctcagccgcyggccattggggcggggagccccgtggtgagcgagtgacagagtggagcccagaggagacacgcagcccgggcttacagactcacagggcccgtcttgttc

SEQ ID NO: 54076 - DNA, 201 bp, Homo sapiens
tattcattcactcactcagctattcagtgggtgcctggcactggggtgggtatggaaatacaacagagatcagccctgccctcagggagcatctagaggcrgcagtggagagataggcatagaaataattagatgattttcattgtgctgaagccaagaaggaaaggtcagggtcactgagggaagcagagcagggggtga

SEQ ID NO: 54077 - DNA, 201 bp, Homo sapiens
cactggggtgggtatggaaatacaacagagatcagccctgccctcagggagcatctagaggcggcagtggagagataggcatagaaataattagatgattytcattgtgctgaagccaagaaggaaaggtcagggtcactgagggaagcagagcagggggtgacgctgccatagagcgggaggccaacatctcgtccaggt

SEQ ID NO: 54078 - DNA, 201 bp, Homo sapiens
tgccatagagcgggaggccaacatctcgtccaggtggtctcggctccaccactggccgctgccccctgccctgccctctgtaactgagcattgcctgggtkggcaaagctgggagctgcccacacttccgagccctctgtcctcaagaagcaaaaacacagtttctaaaaccttggcagagactctatttgccctgctaga

SEQ ID NO: 54079 - DNA, 201 bp, Homo sapiens
atctcgtccaggtggtctcggctccaccactggccgctgccccctgccctgccctctgtaactgagcattgcctgggttggcaaagctgggagctgcccayacttccgagccctctgtcctcaagaagcaaaaacacagtttctaaaaccttggcagagactctatttgccctgctagagaacagccacccagaccaggag

SEQ ID NO: 54080 - DNA, 201 bp, Homo sapiens
gccacccagaccaggagaggagaggcagacgtgtcctgtgagatcaaagtttaatcccgaggaaaaccagggggacctctgcagttggttggaggccttcytcaagtgctgggccattgtaaagggaacacaacccagagagacctcctgggtttctacaagcccaggagggcccactgaggaggaaagcaaggtgccaga

SEQ ID NO: 54081 - DNA, 201 bp, Homo sapiens
ggctcttagtttatctttgacaaagttaatatattatgctgaatttaacttgggaaagacaagaaggaaatgagtggacagtggtagcaaagtgttgggayggtgagatcaagggtgactttttttccctttgcttctcaacttctccctaatgtagttgttattttacttttatgatggaaaaatgcatatgtatgggaa

SEQ ID NO: 54082 - DNA, 201 bp, Homo sapiens
acttctgatcagcctcaaagcctctgtctacccagtctttgatgggcatggtctggatgggctgttgcaggtcttcgatgcccgcagctgttccactgccygggaaatgtttgaacacatctgcagacacgtgcgttactccaccaacaatggcaacatcaggtcggtgcacgtttcccagggctgcagaggggcttgcct

SEQ ID NO: 54083 - DNA, 201 bp, Homo sapiens
gtgggcaggccctcaacatctttgggcttactgtccccgtagggtggaagatggaaggtcacgttgctgacagttaagaacctgggcttggcatcagggcracctgggtctgagtcctgactttgctctttcctgtacttatgttcctgggcctggtgcttaacctcctagagccttgagatccttggctataaaatagat

SEQ ID NO: 54084 - DNA, 201 bp, Homo sapiens
gctcagctatctttgtttttaaaaaagactaataggcaatgagagaggtattaaaggtctattagcaccaatatgagactgtctctccagtgctccgaagratgaaaatgtaattgaaggggaataactaaaaaataaattatgaaaagggagtaaatactcaccatgggatttgacgctagttctgctgggtcacatacc

SEQ ID NO: 54085 - DNA, 201 bp, Homo sapiens
agctgtggccaggtttccagaagaaaggaaaaaacagtgtttttattcatcctggcttgagaactctgtcattccctctctttctagaaactgaagaaatygctcttcatgctgaaagagctcaacaacaaattcaggtaaagctttttccgttgtcctactcctagccctgccctgtggacccaaagtctgggttcaggg

SEQ ID NO: 54086 - DNA, 201 bp, Homo sapiens
acaacaaattcaggtaaagctttttccgttgtcctactcctagccctgccctgtggacccaaagtctgggttcaggggatggaactgggtgtgcacagggkgtcttctcagaaccgtgcaggcacagagacctgggtctaaggtctgtactcagaatgtgtcgagggtcaaaccacagaaaccaagtccctctcacaggtc

SEQ ID NO: 54087 - DNA, 201 bp, Homo sapiens; identical to SEQ ID NO: 10266

SEQ ID NO: 54088 - DNA, 201 bp, Homo sapiens
gtcacgttgctgacagttaagaacctgggcttggcatcagggcgacctgggtctgagtcctgactttgctctttcctgtacttatgttcctgggcctggtrcttaacctcctagagccttgagatccttggctataaaatagatgcaaaaatacctccctcccagactcagtgagaccctgcctgtgggttgcttcaccca

SEQ ID NO: 54089 - DNA, 201 bp, Homo sapiens
ggaagcagcctcagctcctgtgtccctggtgaggtaatgaggcttagaaagattaagcaacttgcccaagctcgcccaggtggaaggcatcaaatccaaartggcagccagttctgtctgactgtatccagcacactttctatcctccccagggccagggccaaatttgggctgcgctgcaaatgttccctggggctcgac

SEQ ID NO: 54090 - DNA, 201 bp, Homo sapiens
acctctttgagtccttgctgtcaccctatcaggtaagtgtgcttcgaagttacacgaaacacacggctcagtgtttggcccatggtaagggcctaaaaagkggtagccccagtggtggggatgctgctgctgctgaccattaaccgcagtctgctccaccttcttccaggcagcctgtgagacgtttgatgtccgaggcaa

SEQ ID NO: 54091 - DNA, 201 bp, Homo sapiens
ttactgttgtcatgctcaggtgcagaggggggaatattgctggaagctttgtttggggagggaggtctcccagcagtggggtggttcccacctcacccagyagctccttatggcaggggtgtccttggggataaatatcatcagtgttttgtctttgtgctttttttctctaatcaaggaaaagttgtcgagacactcttc

SEQ ID NO: 54092 - DNA, 201 bp, Homo sapiens
aaattcgccaactcaccctgggcctctgtctggcgttgtatcctctcttctgcccttccccagcacctttgcctgcctccatcagagtttctatcaggccrtgtgaaaatgactgattttccttggcttccccacccagttagactagactctaatgcagagaaagggctgtgtctttcccttctataacgccgatgcctt

SEQ ID NO: 54093 - DNA, 201 bp, Homo sapiens
gcttggtggtgttggaacccatttgcttctcccagaggaaaattgtatttttccaagtcacaagtacataccttgaacccctgcttccctgagcaagagawcctgggggtgtgaacggggaatggcagcctctcctcacagggaccctggcaatctaagacatgaccagctgagcaggttcagtggccttttgtatctgaa

SEQ ID NO: 54094 - DNA, 201 bp, Homo sapiens
gggtgaaggagcattttccagatcctctatgggctgctgtttgggccagtagctttggctcagctctgctcatgcccttttggctctgcgggaggaagaakataagaggaagagggaagatggggatggggaggcagttggtcagaccgaccatgaacaattcactcccaccctctggactcagtttccctatttgtcaaa

SEQ ID NO: 54095 - DNA, 201 bp, Homo sapiens
tctgtaatagaaatgtagaataagtaaataaaccaagataaatcacgtgttttaaataaagcttaagtcatgaaaaacaagtggctggggctgggcgcggyggctcctgcctgtaatcccagcactttgggaggctaaggtgggaggatcacttgaggccaggagtttgaggccagcctgggcaacatggtgaaaccccat

SEQ ID NO: 54096 - DNA, 201 bp, Homo sapiens
cccgcgcagagccaggtaccccgcgggccgaagtccgccctgggagggaagcggtgggctccgagcccgggcggggccccatctctctctgggagaaatcsgagggcggggatgtgcgctctgtgggattcctgagggtttactaaaagcgttttcctcttttagaacgcttgagaggtcgcaattcaggagcccaggcgg

SEQ ID NO: 54097 - DNA, 201 bp, Homo sapiens
atgagatctcgccactacactccagcctgggtgacagaaactccatctcaaaaaaataaaaaagaaagtgggatcagagaaacagagcctggcagtgaccyccactgtccaggagaaagtgagagaacctgagacgtggggacgacaagacagttgcccttgtgactgtagggtgaaggatgtggttcatcaggactctgt

SEQ ID NO: 54098 - DNA, 201 bp, Homo sapiens
ccgcgagccgagccaagccaggaccccgccctgccctcacatctcctttcttttctgaaggtagaggcctggaaaacccatgtctggcaggacgagaagcrgagacccaagagaagagagattccattgaaagtcttggtcaagtgagtggcagtggcagtggctagtagtgatgtgtgaactatatctctcccttctagt

SEQ ID NO: 54099 - DNA, 201 bp, Homo sapiens
tatgctggcattagcagccacactgtcggtaggaccggcccacctggtaacctgcggccacctgtgcttttacgtctactcttggttaaccacgagccacktttccagcttggactctaagcatctgctccacttcctctccttcctcattgaactctttcactaaaaggagagtgcaagagagacttaaactgtttgatt

SEQ ID NO: 54100 - DNA, 201 bp, Homo sapiens
cagatgccagatggcagcatcagaggggaccctgccaacgtggaattcactcaggtacccggcccagcctcagccgccggccattggggcggggagccccrtggtgagcgagtgacagagtggagcccagaggagacacgcagcccgggcttacagactcacagggcccgtcttgttccccagctgtgcatcgacctgggc

SEQ ID NO: 54101 - DNA, 201 bp, Homo sapiens
ttccccagctgtgcatcgacctgggctggaagcccaagtacggccgcttcgatgtggtccccctggtcctgcaggccaatggccgtgaccctgagctcttygaaatcccacctgaccttgtgcttgaggtggccatggaacatcccaagtaagtaggctgagggtgctgggggcaagggcgagtcaacacacagcccttct

SEQ ID NO: 54102 - DNA, 201 bp, Homo sapiens
gctggagggcggccgatgcttccaccacggccatcagaggggctcttctgtccccagggccgcgttaccccctgagcctggggtgtcagaatagactctcrgccttcacacatttgtcccatcagggcacctcttgggcccagtgctctgtgcccagtgctggggccactgggcatcctgtgtggagcaggagcagagagt

SEQ ID NO: 54103 - DNA, 201 bp, Homo sapiens
ggagcaagtgggaatttatagccaaggatcagggtggggtctgtggatggaaaattaccaagaaaaacttcaggcatagggggaattctgcctcacccaayctaacaggattcttgcttaggacaggctaaggtgatcagacatcgcctgggggaggatggaggatgaggaccctgatcagatggggaggacgacaagcta

SEQ ID NO: 54104 - DNA, 201 bp, Homo sapiens
atggagatgtcccgggactttccatttttaggttcctaaattgaatttcccaacacctagaagcaacacttagaagctgccctgtatcagatcaaggagcttttttttttttttttttttttttgagacggagtctcggtctgtcgtccaggctggagtgcagtggcgcgattcccgcttactgcaacctccgtctcctgg

SEQ ID NO: 54105 - DNA, 201 bp, Homo sapiens
tcagctcatccgctatgctggctaccagatgccagatggcagcatcagaggggaccctgccaacgtggaattcactcaggtacccggcccagcctcagccrccggccattggggcggggagccccgtggtgagcgagtgacagagtggagcccagaggagacacgcagcccgggcttacagactcacagggcccgtcttgt

SEQ ID NO: 54106 - DNA, 201 bp, Homo sapiens
tgtatgcgtgtgtgggtgttttgtagggaaagctcttctcagagtggggagctggtgggtgtcacagcctggacagatccccgacagagggacaccccagscagtccatggctcctctgaaatggctgccaggtgtgccagcagcagatggagcttcgtgctggtccaaagacctgtggtagggcagggggcgcaggcctg

SEQ ID NO: 54107 - DNA, 201 bp, Homo sapiens
cacactgtcggtaggaccggcccacctggtaacctgcggccacctgtgcttttacgtctactcttggttaaccacgagccacttttccagcttggactctragcatctgctccacttcctctccttcctcattgaactctttcactaaaaggagagtgcaagagagacttaaactgtttgattcattcttaagaactttca

SEQ ID NO: 54108 - DNA, 201 bp, Homo sapiens
caaatgaacaaggcacagtcccggccctctgaagcctcatgggcatagggagatgggggtggagtgacggggacagacaacgcaaacacagttacaatggrgtgctttgaactggcatggcacagatacgtacagactccgtggggtcatgggggagcgtccaacaatattccaggcggggaggactcccagaggagcgac

SEQ ID NO: 54109 - DNA, 201 bp, Homo sapiens
ggcccataaagaaggcactggggtcacactggtgtggctgcctgtagcagggacagcgatgacaggtgggtctcaagagtccagtgagcttggcccttttwcagaaggacctgggggaggtgctggtgcctggacagaagtgaagcagcctgcaggacgtgggaaatcaaataggagcttcttgtcctctccaccccctca

SEQ ID NO: 54110 - DNA, 201 bp, Homo sapiens
agcacacactgttccccatgactgggtcaccccataggcagatcaggcctgtgcttgacgggggaggggaagatggaacaggaagagccccccggtgtttsgggaagggctggctttgcaccacacatcctgactcctggggactcccagcaccagccctgatgctggcaggatgtggatacgtcccagaaaatctgtgag

SEQ ID NO: 54111 - DNA, 201 bp, Homo sapiens
ctcacgaccgcctcccacaggcccagctccccagccatcctgtgtgtgcgtgggcctggggtgtctgaggactggccccctcttctcctgtcctcttcagygccagcggcttccacctccccgaggatccctcccatccttgcatcctcatcgggcctggcacaggcatcgcgcccttccgcagtttctggcagcaacggc

SEQ ID NO: 54112 - DNA, 201 bp, Homo sapiens
tgggcatagggagatgggggtggagtgacggggacagacaacgcaaacacagttacaatggggtgctttgaactggcatggcacagatacgtacagactcygtggggtcatgggggagcgtccaacaatattccaggcggggaggactcccagaggagcgacatttaggcagagcatggaagggcaattaggcgtgtgctg

SEQ ID NO: 54113 - DNA, 201 bp, Homo sapiens
tccgattggctgagggaattctgcatccgcactttcagttctgtgactatggatgagtgatctgaatgcgctgggcctcagtttcctcatctgtaaagtgrggataatgctattaaatagctagtgggagtgaagtgagaattccagttgggcttggagccctggcgccctctggtggccaacatggtaacaacagcccgg

SEQ ID NO: 54114 - DNA, 201 bp, Homo sapiens
cttgtgggagttcagtgacaggggtggggcgcaggccagccttctctcccaggctcatgatgggtgtgaagggtcctctaccactccagcatccgcgagcygagccaagccaggaccccgccctgccctcacatctcctttcttttctgaaggtagaggcctggaaaacccatgtctggcaggacgagaagcggagaccca

SEQ ID NO: 54115 - DNA, 201 bp, Homo sapiens
tgtgtgtgcgtgggcctggggtgtctgaggactggccccctcttctcctgtcctcttcagtgccagcggcttccacctccccgaggatccctcccatcctygcatcctcatcgggcctggcacaggcatcgcgcccttccgcagtttctggcagcaacggctccatgactcccagcacaagggtaaggctggaggcttccc

SEQ ID NO: 54116 - DNA, 201 bp, Homo sapiens
tggcaggtagacccaggggaatcaggcccagaaaggttctggaccccaagagaatcttagcagtggctgagatctgagctgggtgggctgtcagatggccytactgcacatcctggaccagttggcagctttgagaagtcgggtgaatgtgttccatttttccatctgtagaatgggggcaggagagtctccctggcctct

SEQ ID NO: 54117 - DNA, 201 bp, Homo sapiens
ggaggagttggggggaggaggtgggtccacccagagtgcaacatccactcaggtgagggaggggtgatgttactggaagaggaagcagccgtgcaaagggratttcatcctgaaagcaatgagagccaatgaatatattttgattttaaaaagtaattttctaatctgttcaggtgtcatgaaaccaagagcctattctaa

SEQ ID NO: 54118 - DNA, 201 bp, Homo sapiens
agcaggaaacagcccagggaacgctggggagtgtaattttaaatagggtggccagggaaggcagagctggaaggtggcatctgagaataaacctgagatgrtgaggaggagccctgtggatactgaaggaaacactctgggctgttctggaggggcagcaggtacaaaggccccgggggtgggagttaagctggcgtgttt

SEQ ID NO: 54119 - DNA, 201 bp, Homo sapiens
ggcggaaaggatccagtcagatagaagaggggatgaagaaaaaaatatcacacatcaattcattcaactctcccaacgatccacaaggaaggaattttagytatcccattttaaagatgaggaccctgaagcccagaaagttaaagtaattttcaagatctcataattagcaaatgacagagctgggattcagatccaggc

SEQ ID NO: 54120 - DNA, 201 bp, Homo sapiens
agtatcttgggtgggggatgaacgctgggcaggaaatgggtatgctaagtaaagctttggagatggttagagggcccgcaccagagcaggtgctgagcagsgttagggtctaaaccagattcaagcacaatctaagtataacagttgggaagacagatggctcatgaaggtccatgtgatagggaagctgggcaaccccag

SEQ ID NO: 54121 - DNA, 201 bp, Homo sapiens
gcccccatctacacaagaccaccacatagccacacaaccccaccgccccagaggagcctttcccatggactacaaagggtagggcgccccctggatgtgtrcagcatgacggccctgagtgtatctgtcagaggcggcaaaaaatgccagtggctaagaggatgggcttggggatgagcaagtggctttgccactcagtag

SEQ ID NO: 54122 - DNA, 201 bp, Homo sapiens; identical to SEQ ID NO: 10267

SEQ ID NO: 54123 - DNA, 201 bp, Homo sapiens
cagttaatgaacaagtcaagggacaggcttgaggctcgctcaggtggaaagacaaagcaatctgcaataacgcaatagtgcaactgaaaccaaagcccccrtctacacaagaccaccacatagccacacaaccccaccgccccagaggagcctttcccatggactacaaagggtagggcgccccctggatgtgtgcagcat

SEQ ID NO: 54124 - DNA, 201 bp, Homo sapiens
cacataataaaagaggagcaagtaataatgctgagttagaacaacaactgcaaaatctttaaaagaaaggtagctacagcttgagtgctttccccagtaayagacctaaaactacagttgataatgagagctgctgggaagtgtctttcagggtcaggcaaaggcacccctgtttcaacgacctccgggctcttcctcacc

SEQ ID NO: 54125 - DNA, 201 bp, Homo sapiens
gcaaaaacaactctctggatggcatggggtgagtataaatacttcttggctgccagtgtgttcataactttgtagcgagtcgaaaactgaggctccggccscagagaactcagcctcattcctgctttaaaatctctcggccacctttgatgaggggactgggcagttctagacagtcccgaagttctcaaggcacaggtc

SEQ ID NO: 54126 - DNA, 201 bp, Homo sapiens
ggattaaccagagagctccctgctgaggaaaaaatctcccagatgctgaaagtgaggccatgtggcttggccaaataaaacctggctccgtggtgcctctrtcttagcagccaccctgctgatgaactgccaccttggacttgggaccagaaagaggtgggttgggtgaagaggcaccacacagagtgatgtaacagcaag

SEQ ID NO: 54127 - DNA, 201 bp, Homo sapiens
cctaatgtagttgttattttacttttatgatggaaaaatgcatatgtatgggaatactgtatttcaggcattataaggaatgaaattataggccgggcatkgtggctaacccttgtaatcctagcactttgagaggctgaagtgggcagatcacttgagcttcagagttcgagaccagcatggacaacatggtgaaaccca

SEQ ID NO: 54128 - DNA, 201 bp, Homo sapiens
aagccagtgctgcctggcaccctctggccgccccacctggctgaggggctgagcctgggcctgccggtgacagccatccctgtccttcctgctgagagggygggccaccaaagcttatgtgaaagcagctgtggaaacagtcccagcccataaggcatggccccctggccttagtttccctaatgataacatccccctcaa

SEQ ID NO: 54129 - DNA, 201 bp, Homo sapiens
tcccgtccctgcgggtgtctgctggcttcctgctttcccagctccccattctgaagcccaggttctactccatcagctcctcccgggatcacacgcccacrgagatccacctgactgtggccgtggtcacctaccacacccgaggtgagccaggggcagaggctctggaacagccccgctccgcccattattggacatctg

SEQ ID NO: 54130 - DNA, 201 bp, Homo sapiens
cccttcgcttttcattttgcaaggctagtggatacccccgaagtggcccttcacccccagcctgcccaccacaaacagaacctccgccctccctgagaaaycacttacataggtggggtgggggtacatcataggtgggttggcgggagtctgctgaaaagaaaccaggaaattcaatgggagagcgcatgtgtgcgcgag

SEQ ID NO: 54131 - DNA, 201 bp, Homo sapiens
ttgcaggtcttcgatgcccgcagctgttccactgcccgggaaatgtttgaacacatctgcagacacgtgcgttactccaccaacaatggcaacatcaggtyggtgcacgtttcccagggctgcagaggggcttgccttgcctgagaatcttagccaaaagatgcagcacttgggtctaggggaggcatctccagctccagg

SEQ ID NO: 54132 - DNA, 201 bp, Homo sapiens
catgagcctttggcccttggactcccccatccacctcccttttcatgttagccttcctggaacttcctgccgtgttcccggactccaccacggtcacctgyccctcaacccctctgcaggcagccccactaacgctaaacttccggcctgatttgcaccagcaggagaagagcttaagcctatgatcggtagtgacatcct

SEQ ID NO: 54133 - DNA, 201 bp, Homo sapiens
ctcctccatgtggctccacaccaggaacataagagcaatcagacctcttccagtgtgggcatgaggatacaacaagatcatgtcaatattggcattcatartggtcgggcacagtggagcatgcctgcaatccaagcactttaggaggctgaggtgggcagattgcttgagcccaggagcttgaaactagcctgagtaaca

SEQ ID NO: 54134 - DNA, 201 bp, Homo sapiens
ttttatttttatcaccttttgtcacgagaaaagtcaggcccagagagaagtggcttttccaagatcacatggtaggtcagcagtgaagctgtgcctcgaayctgggacctttcaggctaaaggaaaccagaacatgccacgcccagatatgccgatatggcatcctgattatctccagctgaaggcatttgagaaagagca

SEQ ID NO: 54135 - DNA, 201 bp, Homo sapiens
agccagctgtgggggagcccgctgaggtcacgaccacggtgctggtgaggagagatcaccatggagccaatttctcgtgccgcactgaactggacctgcgsccccaagggctggagctgtttgagaacacctcggccccctaccagctccagacctttggtgaggattgaagaagccagcagggagaaggtgggggtgggg

SEQ ID NO: 54136 - DNA, 201 bp, Homo sapiens
gccagctgtgggggagcccgctgaggtcacgaccacggtgctggtgaggagagatcaccatggagccaatttctcgtgccgcactgaactggacctgcggscccaagggctggagctgtttgagaacacctcggccccctaccagctccagacctttggtgaggattgaagaagccagcagggagaaggtgggggtggggt

SEQ ID NO: 54137 - DNA, 201 bp, Homo sapiens
gatcttgagggcacctacctctgtcgggccaggagcactcaaggggaggtcacccgcaaggtgaccgtgaatgtgctctgtgagtgagccggcgggcagarctgggtgggggcaggggccatggacctaatgcaatcctcaccgcctgttgtatcctccccacagccccccggtatgagattgtcatcatcactgtggtag

SEQ ID NO: 54138 - DNA, 201 bp, Homo sapiens
cagcccccggggtcatcgccctgccaccgccgcccgattgctttagcttggaaattccggagctgaagcggccagcgagggaggatgaccctctcggcccsggcaccctgtcagtccggaaataactgcagcatttgttccggaggggaaggcgcgaggtttccgggaaagcagcaccgccccttggcccccaggtggcta

SEQ ID NO: 54139 - DNA, 201 bp, Homo sapiens
cagcaccgccccttggcccccaggtggctagcgctataaaggatcacgcgccccagtcgacgctgagctcctctgctactcagagttgcaacctcagcctmgctatggctcccagcagcccccggcccgcgctgcccgcactcctggtcctgctcggggctctgttcccaggtgagtcggggtggggattgccgtcgggcc

SEQ ID NO: 54140 - DNA, 201 bp, Homo sapiens
ccctctcggcccgggcaccctgtcagtccggaaataactgcagcatttgttccggaggggaaggcgcgaggtttccgggaaagcagcaccgccccttggcycccaggtggctagcgctataaaggatcacgcgccccagtcgacgctgagctcctctgctactcagagttgcaacctcagcctcgctatggctcccagcag

SEQ ID NO: 54141 - DNA, 201 bp, Homo sapiens
tgtaatctcagctcactgcaacctctccctcccgggttcaagcaattctcctgcctcagcctcccaagtagctggaattacaggcgcccagcaccacgccyggctaatttttgtatttttagtagagacgggatttcatcatgttggccaggctggtcttgatctcctgaccttgtgatctgcccgcctcggcctcccaaa

SEQ ID NO: 54142 - DNA, 201 bp, Homo sapiens
cgaacattcccagcagcttctggaaaccccagggaaacctctttgaaggtcttttctgcatctctgcctgataggtctttttttttttttttttttttttytttttttgacacacagtcttgctctgtcgcccaggctggatcactgcaacctccatctcccgggttcaagcagttctcctgcctcatcctctccagtagc

SEQ ID NO: 54143 - DNA, 201 bp, Homo sapiens
aggcattctgggcaggaggaacagcctgggcaaaagttgggagcagggagaaatcttgatggaggcaggaggaggaggaggtaggttggtgtaggccaggygcagtggctcacacctgtaatcccagtgctttgggaggccaaagcaagaggattgtttgagcccaggagttcgagaccagcctgggcaacatagcgagac

SEQ ID NO: 54144 - DNA, 201 bp, Homo sapiens
cacaagtaaacctcagcctctcaagtagctgggactacaggcacacaacaccacgcctggctaatttttgtatttttaggtagagacggggtttcactatrttggccaggctggtcttgaactcctgacctcaggtgatccgcctgcctcggccccccaaagtgttgggattacaggcgtgagccaccacacgcagccttt

SEQ ID NO: 54145 - DNA, 201 bp, Homo sapiens
gtgcgtggtgacacgcacctgtagtcccagctatttgggaggctgaggcaggagaatcacttgaacctgggaggtggaggttgcagtgagccgagatcgcwccactgcactccagcctgggccacagagtgagactccatcttgaaaaaaaaaaaaaatacaaaagttagccaggggtgttggtgggtgcctgtaatccca

SEQ ID NO: 54146 - DNA, 201 bp, Homo sapiens
cctcaggtgatccgcctgcctcggccccccaaagtgttgggattacaggcgtgagccaccacacgcagcctttttgttattagactctgtcattactgactttttttttttttttaatagaaacagggtctttctttcccaggctaaagtacagtggcatgatcacagttcactatagccttaaactcctgggctcaagtg

SEQ ID NO: 54147 - DNA, 201 bp, Homo sapiens
gacacgcacctgtagtcccagctatttgggaggctgaggcaggagaatcacttgaacctgggaggtggaggttgcagtgagccgagatcgcaccactgcamtccagcctgggccacagagtgagactccatcttgaaaaaaaaaaaaaatacaaaagttagccaggggtgttggtgggtgcctgtaatcccagctatttgg

SEQ ID NO: 54148 - DNA, 201 bp, Homo sapiens
ctcaggtgatccgcctgcctcggccccccaaagtgttgggattacaggcgtgagccaccacacgcagcctttttgttattagactctgtcattactgactttttttttttttttaatagaaacagggtctttctttcccaggctaaagtacagtggcatgatcacagttcactatagccttaaactcctgggctcaagtga

SEQ ID NO: 54149 - DNA, 201 bp, Homo sapiens
catttgttccggaggggaaggcgcgaggtttccgggaaagcagcaccgccccttggcccccaggtggctagcgctataaaggatcacgcgccccagtcgaygctgagctcctctgctactcagagttgcaacctcagcctcgctatggctcccagcagcccccggcccgcgctgcccgcactcctggtcctgctcggggct

SEQ ID NO: 54150 - DNA, 201 bp, Homo sapiens
ggcttatctcgaactcctgacttcgtggatccaccctccttggcctcccaaagtgctgggattaaaggcgtgagccaccgcgccctgccaacctttttttratttttcttagagatgggggtctccctatgttgcccaggcttgtcttgaactcctggcctcaagtgaccctcttgccttggcctcacaaagtgctaggat

SEQ ID NO: 54151 - DNA, 201 bp, Homo sapiens
agggggttggagatggaggggaggggcgggcctcgttttgttgcccaggccggtcttgaactccgggggtctagccttacctcctgcctcagcctcccgastagctgggatgagaggtgtgaaccaccgccttgcttggctagattgcgtctcttacagtttctcagctgtaaaacgggaaacgttatagcggccacctgg

SEQ ID NO: 54152 - DNA, 201 bp, Homo sapiens; identical to SEQ ID NO: 10301

SEQ ID NO: 54153 - DNA, 201 bp, Homo sapiens
ggtctagccttacctcctgcctcagcctcccgagtagctgggatgagaggtgtgaaccaccgccttgcttggctagattgcgtctcttacagtttctcagytgtaaaacgggaaacgttatagcggccacctggcagggtatcttggcccagcgcagcacctggccccaggactcgatcatgatggtttgggaacttggct

SEQ ID NO: 54154 - DNA, 201 bp, Homo sapiens; identical to SEQ ID NO: 10306

SEQ ID NO: 54155 - DNA, 201 bp, Homo sapiens
tgttcctcatcctctctgcccctggggaagtccagggctgcttctacttgggggaattccagagctgacttatccgtggcccaaagctgagaagtgggacrccccagcacaccctcccccagctccagcccagctagggaagagggaaggggtcagagggtctttcatggtggtgtaagtttggggaaccaggagggtggg

SEQ ID NO: 54156 - DNA, 201 bp, Homo sapiens
accttttgggctcaagtgatcctcccacctcagcctcctgagtagctgggaccataggctcacaacaccacacctggcaaatttgattttttttttttttycagagacggggtctcgcaacattgcccagacttcctttgtgttagttaataaagctttctcaactgcctcagccttgtgtgagttgaggggaggtgtcac

SEQ ID NO: 54157 - DNA, 201 bp, Homo sapiens
ttaaggtcaggagtttgagaccagcctggccaacatggcaacatcccgtctctactaaaaatacaaaaattagctggcatggtggtgggcgcctgtgatcscagctgctcgggaggctgagggaggaaaatcccttaagcccacgaggctgaggttgcagtgaaccaagattgtgccactgcactccagcctgggagacat

SEQ ID NO: 54158 - DNA, 201 bp, Homo sapiens
cccgtctctactaaaaatacaaaaattagctggcatggtggtgggcgcctgtgatcccagctgctcgggaggctgagggaggaaaatcccttaagcccacsaggctgaggttgcagtgaaccaagattgtgccactgcactccagcctgggagacatagcgagattctgtctcaaaaaacaaagcgttctgatccggactc

SEQ ID NO: 54159 - DNA, 201 bp, Homo sapiens
tcacacccccatccaagatagaacaaatctgagacaggaatctttgagtgaggcagtgctgggctcagacattttttcccaccttcggaggcagcagaatytgagggacctgatccaaataagccccttctttctttcttttcttttcttttttttttttttttttttttgagacggagtctcactctgtcgcccaggctg

SEQ ID NO: 54160 - DNA, 201 bp, Homo sapiens
ctgttgggagcataaataagcccaaccctgtggcgggaaattgggcatcagttctcaaaatgtcatgggctgggcacggtggctcacgcctgtaatcccascactttgggaggctgagggaggcggatcacttgaggtcaggagttcgagaccagcctgaccaccatggagaaaccccgtctctattaaaaatacaaaaaa

SEQ ID NO: 54161 - DNA, 201 bp, Homo sapiens
aggtccacctggcactgggggaccagaggttgaaccccacagtcacctatggcaacgactccttctcggccaaggcctcagtcagtgtgaccgcagaggaygagggcacccagcggctgacgtgtgcagtaatactggggaaccagagccaggagacactgcagacagtgaccatctacagtaagaaggggcaggggcgga

SEQ ID NO: 54162 - DNA, 201 bp, Homo sapiens
agccgggaaggggtgatcagatggtccacagggaatatcacaaactcgaattctgacgatgttctggtagtcacccagccagatgagcgcatggagttggsggtggggggtgtcaaagcttggggcccggaagcggagtcaaaagcatcaccctcggtcccttgttctcgcgtggatgtcagggcccccacccaccgagca

SEQ ID NO: 54163 - DNA, 201 bp, Homo sapiens
catccctgtctgctcacacctttcttctctccctagtcctgccagcgactcccccacaacttgtcagcccccgggtcctagaggtggacacgcaggggacmgtggtctgttccctggacgggctgttcccagtctcggaggcccaggtccacctggcactgggggaccagaggttgaaccccacagtcacctatggcaacg

SEQ ID NO: 54164 - DNA, 201 bp, Homo sapiens
ctcaattgcagcaacagctgtccccagccgcagaattccagcctccgcaccccgctgcggcaaggcaagacgctcagagggccgggttgggtgtcttaccrgctgctcgacgtgagggcctggagctccctcgcgcactgcctcgtgacctgcgcaggaaaaacacgctgggccacctccaggatcaccgcctacagtgag

SEQ ID NO: 54165 - DNA, 201 bp, Homo sapiens
ctttcttctctccctagtcctgccagcgactcccccacaacttgtcagcccccgggtcctagaggtggacacgcaggggaccgtggtctgttccctggacrggctgttcccagtctcggaggcccaggtccacctggcactgggggaccagaggttgaaccccacagtcacctatggcaacgactccttctcggccaaggc

SEQ ID NO: 54166 - DNA, 201 bp, Homo sapiens
acctaagggtccgcattactgcccttcttcggaggaactggtttgtttttgttgttgttgttgtttttgcgatcactttctccaagttccttgtctccctragggcacctgaggtttcctcactcagggcccacctggggtcccgaagccccagactctgtgtatccccagcgggtgtcacagaaacctctccttctgctg

SEQ ID NO: 54167 - DNA, 201 bp, Homo sapiens
cgggcaggggcggggtggggttcatggtatggctttcctgattggcgccgccgccaccacgcggcagctctgattggatgttaagtttcctatcccagccscaccttcagaccctgtgctttcctggaggccaaacaactgtggagcgagaactcatctccaaaataacttaccacgctggagtgagaccacgaatggtgg

SEQ ID NO: 54168 - DNA, 201 bp, Homo sapiens
taggcaacatagcaaaaccccatttttatttaaaaaaaaaaaaaaagatatgagttaaaactagccctgggatggcatttttcacatattggtaacaaacraaagaattgatggccgggcgcagtggctcacgcctgtaatcccagcactttgggaggccgaggcgggcggatcacaaggtcaggagatcgagaccatcct

SEQ ID NO: 54169 - DNA, 201 bp, Homo sapiens
tgactcagaggcgctgttcccgctccacccagagccctggcaaccgggtccctcagctgttcccgcggttccttccatgagcccagccttgcgtcccggckccgtgttcttcaccgggtgtagggtccttcctgatccttgacccagcctcgtctctcctttgcccttgccgcaaacgcactctcctcgtatcccggcatt

SEQ ID NO: 54170 - DNA, 201 bp, Homo sapiens; identical to SEQ ID NO: 10293

SEQ ID NO: 54171 - DNA, 201 bp, Homo sapiens
gtaaggaaggaggcggggtctccgcggctccgaggtgggaccagaggaatgcgaaggcggggcgaagagtgggcgggacctcagtaccggaacaggcgtgkcccgagggggcggggcaggtgggggcggagacgtaatcgctggggaggaggagcctgtacagcctgagaggcggggcgccgtaccctagttcgttctcag

SEQ ID NO: 54172 - DNA, 201 bp, Homo sapiens
cactttcccactgcccatcggggaatcagtgactgtcactcgagatcttgagggcacctacctctgtcgggccaggagcactcaaggggaggtcacccgcraggtgaccgtgaatgtgctctgtgagtgagccggcgggcagagctgggtgggggcaggggccatggacctaatgcaatcctcaccgcctgttgtatcctc

SEQ ID NO: 54173 - DNA, 201 bp, Homo sapiens; identical to SEQ ID NO: 10295

SEQ ID NO: 54174 - DNA, 201 bp, Homo sapiens
acgtggcgaaaccccgtctctattaaaaatacaaaaattagctgggcgtggtggtgcttgcctgtaatcccagatactctggaggctgaggcaggagaatmacttgaacccgggaggcaaaggttgcagtgagctgagattgcgccactgcactccagtctgagtgacaaagcgagactccatctcaaaaaaaaaaaaaat

SEQ ID NO: 54175 - DNA, 201 bp, Homo sapiens
ttagcgcacgctcgcctcccgcccccccgccgcctctgccgccgccccctccttggaaaccaagttaccaacgttaaaccaatccccaagcgcaactctgyctcccccacaccccacccgccgcgccgcgcggagccgtcctctagcccagctcctcggctcgcgctctcctcgcctcctgtgctttccccgccgcggcga

SEQ ID NO: 54176 - DNA, 201 bp, Homo sapiens
ccttttgggctcaagtgatcctcccacctcagcctcctgagtagctgggaccataggctcacaacaccacacctggcaaatttgatttttttttttttttyagagacggggtctcgcaacattgcccagacttcctttgtgttagttaataaagctttctcaactgcctcagccttgtgtgagttgaggggaggtgtcaca

SEQ ID NO: 54177 - DNA, 201 bp, Homo sapiens
aggagctgggactttccttcttggggtgatagggagtcatggagggtttctgagcaggccagggattagatagctgaaggctggatttactggaagccaawgagcagttggctatggtccttgtccacgcggcccatgttgtgggcagtgaccgtattcaagaagggaaggacagacaagtatttgaatacttcagtgacc

SEQ ID NO: 54178 - DNA, 201 bp, Homo sapiens
tcttgaactcctggcctcaagtgaccctcttgccttggcctcacaaagtgctaggattacagcctgagccatcacacctggccaacaggtttttttttttkttttgttttgttttttaaagaatgtctaggccaggctcatttactttcacctgtaatcccagcactttgggaggccggggtgggcagatcacttgaggtc

SEQ ID NO: 54179 - DNA, 201 bp, Homo sapiens
gagctgtttgagaacacctcggccccctaccagctccagacctttggtgaggattgaagaagccagcagggagaaggtgggggtggggtatcctgcaatgyggtgcctgtggccacaggatcttttgagatgggtgtggccccggctaaggggtgcatgtgttctaggcgtatgtgacctaggctgctgagtggccctgga

SEQ ID NO: 54180 - DNA, 201 bp, Homo sapiens
gtgaggcccaccctagagccaaggtgacgctgaatggggttccagcccagccactgggcccgagggcccagctcctgctgaaggccaccccagaggacaaygggcgcagcttctcctgctctgcaaccctggaggtggccggccagcttatacacaagaaccagacccgggagcttcgtgtcctgtgtgagtggggctgct

SEQ ID NO: 54181 - DNA, 201 bp, Homo sapiens
actccaatgtgccaggcttgggggaacccattgcccgagctcaagtgtctaaaggatggcactttcccactgcccatcggggaatcagtgactgtcactcragatcttgagggcacctacctctgtcgggccaggagcactcaaggggaggtcacccgcaaggtgaccgtgaatgtgctctgtgagtgagccggcgggcag

SEQ ID NO: 54182 - DNA, 201 bp, Homo sapiens
cgccgcggcgatgccagggccttcgccagggctgcgccgggcgctactcggcctctgggctgctctgggcctggggctcttcggcctctcaggtaagagcyccgctctggttcggggtggacagggcgggggcggagtccctggacctgagaaacggcctcctgtccctcccagctctgccctcgcctcgctcccacgcct

SEQ ID NO: 54183 - DNA, 201 bp, Homo sapiens
ggtgttcttccgcacccaacccttcgccctggagacccagtgtctctcctgtccgctccccgggtacctccttacgctgtgctgtgcaccatggtccacgractggcatcttccccactcgcggtccgcgaagactccatctctccaactaccctgactcagaggcgctgttcccgctccacccagagccctggcaaccgg

SEQ ID NO: 54184 - DNA, 201 bp, Homo sapiens; identical to SEQ ID NO: 10317

SEQ ID NO: 54185 - DNA, 201 bp, Homo sapiens
ggctgacgtgtgcagtaatactggggaaccagagccaggagacactgcagacagtgaccatctacagtaagaaggggcaggggcggagtggggcttcttgrgggtgtgacctgaacccggggcggggctcactgtgtgcctattccaggctttccggcgcccaacgtgattctgacgaagccagaggtctcagaagggacc

SEQ ID NO: 54186 - DNA, 201 bp, Homo sapiens
acatagcgagaccctgtctctaagaaaaaataaaaaaattagggtacagtggcatatgcttgtattctcaactactctggaggctcaagtgggaggatcayttgaacccaggaatttttttgtttttgtttttgtttttttgagatggagtctcactctgtggcccaggctggagtgcagtggtgccatcttggctcactg

SEQ ID NO: 54187 - DNA, 201 bp, Homo sapiens
atcccttaagcccacgaggctgaggttgcagtgaaccaagattgtgccactgcactccagcctgggagacatagcgagattctgtctcaaaaaacaaagcrttctgatccggactcagacccagatcgcactgctttctagctgagtaaccatttctctctatgaaatgggaatggtcccagaatctcccttggagaatgt

SEQ ID NO: 54188 - DNA, 201 bp, Homo sapiens
ctcctgagtagctgggactacaggcgcccaccaccacgcctggctaattttttgtatttttagtagagacggggtttcaccgtgttagccaggatggtctygatctcctgacctcgtgatccgcccgccttggcctcccaaagtgctgggattacaggcgtgagccaccatgtctggcctggccaggctggtcttgaactc

SEQ ID NO: 54189 - DNA, 201 bp, Homo sapiens
gtcggtcggtgtttaggaggtttagaggtagatacatctgaatgctgaccccgacttcaaccctcgccggctgagctgtttccccctccgtgccttgaggrtgataatacgataagatagtgcatgtcaagtgcttaggacatattgagcgctcggagttagttcaaacttggttcttcgacccctagccctgtctccgga

SEQ ID NO: 54190 - DNA, 201 bp, Homo sapiens
tcggtcggtgtttaggaggtttagaggtagatacatctgaatgctgaccccgacttcaaccctcgccggctgagctgtttccccctccgtgccttgaggakgataatacgataagatagtgcatgtcaagtgcttaggacatattgagcgctcggagttagttcaaacttggttcttcgacccctagccctgtctccggat

SEQ ID NO: 54191 - DNA, 201 bp, Homo sapiens
tctcaagtagctgggactacaggcacacaacaccacgcctggctaatttttgtatttttaggtagagacggggtttcactatattggccaggctggtcttsaactcctgacctcaggtgatccgcctgcctcggccccccaaagtgttgggattacaggcgtgagccaccacacgcagcctttttgttattagactctgtc

SEQ ID NO: 54192 - DNA, 201 bp, Homo sapiens
tacaggcgtgagccaccacacgcagcctttttgttattagactctgtcattactgactttttttttttttttaatagaaacagggtctttctttcccaggstaaagtacagtggcatgatcacagttcactatagccttaaactcctgggctcaagtgatcctcctgcctcagcctcccaagtagcagggactacaggtgt

SEQ ID NO: 54193 - DNA, 201 bp, Homo sapiens
ccacgtcccagagacaccctcgaggtttagactctgggagtgcgcctttaaaccggaggcctgggcacgacgcgggacgcctgggttctttccctggctgsagcctctcctcctcctccccgccctctgagaacccttgactcgacataggggcgctaagatgtcagggagttggctccccaggctcagcccgcgtttccc

SEQ ID NO: 54194 - DNA, 201 bp, Homo sapiens
ctctcagccttgctgtgttcatccaagaacccacctttcctctcctctacgccctccccccatgctttcccgccgctccatcggcgctttggagaccatgsctctctgctaccacgtcccagagacaccctcgaggtttagactctgggagtgcgcctttaaaccggaggcctgggcacgacgcgggacgcctgggttctt

SEQ ID NO: 54195 - DNA, 201 bp, Homo sapiens
ctgagcgagaaaaagaggaatatgaaacaatctggggaaatggccatacatggtggctgacgcctgtaatcccagcactttgggaggccgaggcaggagartcgcttgagcccaggagttcgagaccagcctggacaacatagtgagaccccgtctatgcaaaaaatacacaaattagcctggtgtggtggcccgcacctg

SEQ ID NO: 54196 - DNA, 201 bp, Homo sapiens
actgtcctttccccatccagtgcctcccaaatctctcttagtccccaaatgtatccccgccctaaggggcgctggtgggaggagctaaatgtgggggcggrgctcggagtccagcttattatcatggcatctcagccagggctggggtaggggtttgggaagggcaacccagcatcccccgatcccagagtcgcggccggg

SEQ ID NO: 54197 - DNA, 201 bp, Homo sapiens
cagtttcccagcgacaggcagggatttcgagcgtccccctcccctccctcgtcaagatccaagctagctgcctcagtttccccgcggagcctgggacgccagcggaggggctcggcgcgtagggatcacgcagcttccttcctttttctgggagctgtaaagacgcctccgcggccaaggccgaaaggggaagcgaggagg

SEQ ID NO: 54198 - DNA, 201 bp, Homo sapiens
ctgcatgttggtcagtccagtccctgcagagggaattcccagcatgacctcattcacttgtgaagacagagcaatccttgtgttttatttttttaagatgkatctcactctgttgcccagactggagtgcagtggcatgatctcagccctctgccacctccaccttccgggttcaagagattctcatgcctcagcctcctg

SEQ ID NO: 54199 - DNA, 201 bp, Homo sapiens
ggaccagaatctgagtcctgatgtcaccctcgaaggggacgcattcgtggccactgccacagccacagctagcgcagagcaggagggtgccaggcagctgrtctgcaacgtcaccctggggggcgaaaaccgggagacccgggagaacgtgaccatctacagtaaggaaggaggcggggtctccgcggctccgaggtggga

SEQ ID NO: 54200 - DNA, 201 bp, Homo sapiens
attttatttatttttttgagacagagtctcactctgttgtccaggttggagtccagtggcgtgatttcggctcactgcaacctctacttcccaggttcgascaattctcctgcctcagcttcccgagtagctgggattacaggcccgcgtccccacacctagctaatttttgtatttttagtagagacagggtttcaccat

SEQ ID NO: 54201 - DNA, 201 bp, Homo sapiens; identical to SEQ ID NO: 10300

SEQ ID NO: 54202 - DNA, 201 bp, Homo sapiens; identical to SEQ ID NO: 10305

SEQ ID NO: 54203 - DNA, 201 bp, Homo sapiens
gagctgagatcgtgccactgcactctagccagggtgacagagtgaaactctgtctcaaaaaattaaaaaagaaattcagcaagtaatgagttaaggaattygaatattaaggcgagtgacaaggaacgcccaggatgtggcccaggatggagtaggggggacactcatttaggagaaagctcaggccacaagacaggagga

SEQ ID NO: 54204 - DNA, 201 bp, Homo sapiens
ctattaaaaatacaaaaattagctgggcgtggtggtgcttgcctgtaatcccagatactctggaggctgaggcaggagaatcacttgaacccgggaggcaraggttgcagtgagctgagattgcgccactgcactccagtctgagtgacaaagcgagactccatctcaaaaaaaaaaaaaataaaagaacacatctttagc

SEQ ID NO: 54205 - DNA, 201 bp, Homo sapiens; identical to SEQ ID NO: 10308

SEQ ID NO: 54206 - DNA, 201 bp, Homo sapiens
gggctcaagtgatcctcccacctcagcctcctgagtagctgggaccataggctcacaacaccacacctggcaaatttgatttttttttttttttcagagayggggtctcgcaacattgcccagacttcctttgtgttagttaataaagctttctcaactgcctcagccttgtgtgagttgaggggaggtgtcacatccagc

SEQ ID NO: 54207 - DNA, 201 bp, Homo sapiens; identical to SEQ ID NO: 10311

SEQ ID NO: 54208 - DNA, 201 bp, Homo sapiens; identical to SEQ ID NO: 10314

SEQ ID NO: 54209 - DNA, 201 bp, Homo sapiens; identical to SEQ ID NO: 10315

SEQ ID NO: 54210 - DNA, 201 bp, Homo sapiens
gtgatcctcccacctcagcctcctgagtagctgggaccataggctcacaacaccacacctggcaaatttgatttttttttttttttcagagacggggtctygcaacattgcccagacttcctttgtgttagttaataaagctttctcaactgcctcagccttgtgtgagttgaggggaggtgtcacatccagctggagtcc

SEQ ID NO: 54211 - DNA, 201 bp, Homo sapiens
gaggcaggagaatcacttaaacctgggaggcaggggttgcagtgagctgagatcgtgccactgcactctagccagggtgacagagtgaaactctgtctcawaaaattaaaaaagaaattcagcaagtaatgagttaaggaattcgaatattaaggcgagtgacaaggaacgcccaggatgtggcccaggatggagtagggg

SEQ ID NO: 54212 - DNA, 201 bp, Homo sapiens
tgaggcaggagaatcacttgaacccgggaggcaaaggttgcagtgagctgagattgcgccactgcactccagtctgagtgacaaagcgagactccatctcaaaaaaaaaaaaaataaaagaacacatctttagcatggccttcagtgctcacgggatcttcctgaattaatctccccctcttcatccttgctcactcagct

SEQ ID NO: 54213 - DNA, 201 bp, Homo sapiens
cattaccctgtcaccaaagcactgtctattctatcaccctgttttgtttttgtcaaagctcatattaacatcagttattaattatcttgtttgctcataatttttttttttttttttttggagacagagtctcgttctgttgctcaggctggagtgcagtggcacaatcttggctcactgtaacctccacctcccaggttc

SEQ ID NO: 54214 - DNA, 201 bp, Homo sapiens
accatggtccacggactggcatcttccccactcgcggtccgcgaagactccatctctccaactaccctgactcagaggcgctgttcccgctccacccagarccctggcaaccgggtccctcagctgttcccgcggttccttccatgagcccagccttgcgtcccggctccgtgttcttcaccgggtgtagggtccttcctg

SEQ ID NO: 54215 - DNA, 201 bp, Homo sapiens
ttttgcgatcactttctccaagttccttgtctccctgagggcacctgaggtttcctcactcagggcccacctggggtcccgaagccccagactctgtgtakccccagcgggtgtcacagaaacctctccttctgctggccttatcgagtgggatcagcgcgggccggggagagccacgggcaggggcggggtggggttcat

SEQ ID NO: 54216 - DNA, 201 bp, Homo sapiens
gcgcatggagttgggggtggggggtgtcaaagcttggggcccggaagcggagtcaaaagcatcaccctcggtcccttgttctcgcgtggatgtcagggccyccacccaccgagcagaaggcggactcaggggcgctccagggtggctcgagctcacacacgctgagtagacacgtgcccgctgcaccctgggtaaatacag

SEQ ID NO: 54217 - DNA, 201 bp, Homo sapiens
ccctacccgcttcgagatcctaggtgttcttccgcacccaacccttcgccctggagacccagtgtctctcctgtccgctccccgggtacctccttacgctstgctgtgcaccatggtccacggactggcatcttccccactcgcggtccgcgaagactccatctctccaactaccctgactcagaggcgctgttcccgctc

SEQ ID NO: 54218 - DNA, 201 bp, Homo sapiens
gagccgagcggattctaatttagacgcccgcgaacgctgcgcgcacgcacacgtgtcctcggctcgctggcactttcgtcccgccccctccgtcgcgtgcsggagctgacccggaggggtgcttagaggtatggctccgcggggtcaaaaggagaaggatcagtgagagaggcatccccacaccctcccctagaactgtcc

SEQ ID NO: 54219 - DNA, 201 bp, Homo sapiens
gtaagagccccgctctggttcggggtggacagggcgggggcggagtccctggacctgagaaacggcctcctgtccctcccagctctgccctcgcctcgctsccacgcctctgcccccacctcgagcctgagtcttctccccttccccctcctccccaacacacacccgagccccagcttcctgactcctcgatagccccta

SEQ ID NO: 54220 - DNA, 201 bp, Homo sapiens
tgagttgaggggaggtgtcacatccagctggagtcctttctaagcagccacagcctgatcctcccacttcctcccccaagaaaacattgtgggttgatggycataccctgaggttctggtccaaatcggactttctatgaccttctgggtctctagtgaaaactaaagactcctctccagaaaaaaacatttggtttctaa

SEQ ID NO: 54221 - DNA, 201 bp, Homo sapiens
cgtggatgtcagggcccccacccaccgagcagaaggcggactcaggggcgctccagggtggctcgagctcacacacgctgagtagacacgtgcccgctgcmccctgggtaaatacagacccggagccgagcggattctaatttagacgcccgcgaacgctgcgcgcacgcacacgtgtcctcggctcgctggcactttcgt

SEQ ID NO: 54222 - DNA, 201 bp, Homo sapiens
catcggcgctttggagaccatggctctctgctaccacgtcccagagacaccctcgaggtttagactctgggagtgcgcctttaaaccggaggcctgggcasgacgcgggacgcctgggttctttccctggctgcagcctctcctcctcctccccgccctctgagaacccttgactcgacataggggcgctaagatgtcagg

SEQ ID NO: 54223 - DNA, 201 bp, Homo sapiens
agcggtctcgcaggagcccttctgggcggacctgcagcctcgcgtggcgttcgtggagcgcgggggctcgctgtggctgaattgcagcaccaactgccctyggccggagcgcggtggcctggagacctcgctgcgccgaaacgggacccagaggggtttgcgttggttggcgcggcagctggtggacattcgcgagccgga

SEQ ID NO: 54224 - DNA, 201 bp, Homo sapiens
ggccacgcgcgtactccactactctccctccctcccaggccccgccccctgggtcccagggtcctccccttcaggccccaccttctgttccaagtcccggygttcaaagagctgcggactcttcccccttgcagagcgaccagatcgcgtagagctgatgccgctgcctccctggcagccggtgggcgagaacttcaccct

SEQ ID NO: 54225 - DNA, 201 bp, Homo sapiens
ccaaggcccaatctccctgaaggtcccataaggtcttgcctccaagtcctgcccccacccacctccatgtcatctcatcgtgtttttccagatggcccccractggacgagagggattgtccgggaaactggacgtggccagaaaattcccagcagactccaatgtgccaggcttgggggaacccattgcccgagctcaag

SEQ ID NO: 54226 - DNA, 201 bp, Homo sapiens
gggactacaggcgcccaccaccactcccggctaatttttgtatttttagtagagatggggtttcactgtgttagccaggatagtctcgatctcctgacctygtgatccgcctgcctcggcctcccaaagtgctgggattacttattttgttttttgtagagacaggttctcactgtgttgcccaggctggtcttgaactcc

SEQ ID NO: 54227 - DNA, 201 bp, Homo sapiens
ctggtcaatggcccctatcccccaaggcccaatctccctgaaggtcccataaggtcttgcctccaagtcctgcccccacccacctccatgtcatctcatcrtgtttttccagatggcccccgactggacgagagggattgtccgggaaactggacgtggccagaaaattcccagcagactccaatgtgccaggcttggggg

SEQ ID NO: 54228 - DNA, 201 bp, Homo sapiens
agtggcatgatctcagccctctgccacctccaccttccgggttcaagagattctcatgcctcagcctcctgagtagctgagattacaggcttgtgcctccrtgcccagctaatttttttatttttactagagatgaggtttcaccagtttgggcaggccggtctcaaactcctgacctcaagtgatccacccacctcggcc

SEQ ID NO: 54229 - DNA, 201 bp, Homo sapiens
agtaagaaggggcaggggcggagtggggcttcttgggggtgtgacctgaacccggggcggggctcactgtgtgcctattccaggctttccggcgcccaacrtgattctgacgaagccagaggtctcagaagggaccgaggtgacagtgaagtgtgaggcccaccctagagccaaggtgacgctgaatggggttccagccca

SEQ ID NO: 54230 - DNA, 201 bp, Homo sapiens
gagtagctgggattacaggcccgcgtccccacacctagctaatttttgtatttttagtagagacagggtttcaccatgttggccaggctggtctcgaactsctgacctcaggtgattctcctgccttggcctcccaaagtgctgagattacaggtgtgagccactgcacacggccttaaattttatttattatttatttat

SEQ ID NO: 54231 - DNA, 201 bp, Homo sapiens
aggcccgcgtccccacacctagctaatttttgtatttttagtagagacagggtttcaccatgttggccaggctggtctcgaactcctgacctcaggtgatyctcctgccttggcctcccaaagtgctgagattacaggtgtgagccactgcacacggccttaaattttatttattatttatttatttatttatttagagac

SEQ ID NO: 54232 - DNA, 201 bp, Homo sapiens
agtgctgagattacaggtgtgagccactgcacacggccttaaattttatttattatttatttatttatttatttagagacttagtctcactctgttgcccmggctggagtgcagtggcatggtctcggctcactgcactccacctcctgggttcacgccattctcctgcctcagcctcccgagtagctgggactacaggcg

SEQ ID NO: 54233 - DNA, 201 bp, Homo sapiens
gtgctgagattacaggtgtgagccactgcacacggccttaaattttatttattatttatttatttatttatttagagacttagtctcactctgttgcccasgctggagtgcagtggcatggtctcggctcactgcactccacctcctgggttcacgccattctcctgcctcagcctcccgagtagctgggactacaggcgc

SEQ ID NO: 54234 - DNA, 201 bp, Homo sapiens
ttcttctctccctagtcctgccagcgactcccccacaacttgtcagcccccgggtcctagaggtggacacgcaggggaccgtggtctgttccctggacggkctgttcccagtctcggaggcccaggtccacctggcactgggggaccagaggttgaaccccacagtcacctatggcaacgactccttctcggccaaggcct

SEQ ID NO: 54235 - DNA, 201 bp, Homo sapiens
agccactgcacacggccttaaattttatttattatttatttatttatttatttagagacttagtctcactctgttgcccaggctggagtgcagtggcatgrtctcggctcactgcactccacctcctgggttcacgccattctcctgcctcagcctcccgagtagctgggactacaggcgcccaccaccactcccggctaa

SEQ ID NO: 54236 - DNA, 201 bp, Homo sapiens; identical to SEQ ID NO: 10303

SEQ ID NO: 54237 - DNA, 201 bp, Homo sapiens
cgagggcccagctcctgctgaaggccaccccagaggacaacgggcgcagcttctcctgctctgcaaccctggaggtggccggccagcttatacacaagaaycagacccgggagcttcgtgtcctgtgtgagtggggctgctggtcaatggcccctatcccccaaggcccaatctccctgaaggtcccataaggtcttgcct

SEQ ID NO: 54238 - DNA, 201 bp, Homo sapiens
tgctgagattacaggcatgagccaccgtgcccggcctttttttttttttttttttttgagacagagtctcactctgtcgcccaggcaggagtgcagtggtkcgatctgggctcactgcaagctccgcctcccgggttcactccatcctcctgccttagcctcctgagtagctgggactacaggcgcccaccaccacgcctg

SEQ ID NO: 54239 - DNA, 201 bp, Homo sapiens
acctgggaagtagaggttgcagtgagccgagattgcaccactgcactccagcctgggcgacggagtgagacgacctcacaaaaatttacataaataaaatraaaagtaaaataaaaatacaaaagttggccgggtgcgtttgctcacgcctgtaatcccagcactttgggagggtgaggcaggcagataatgaggtaagaa

SEQ ID NO: 54240 - DNA, 201 bp, Homo sapiens
gaaagcagcaccgccccttggcccccaggtggctagcgctataaaggatcacgcgccccagtcgacgctgagctcctctgctactcagagttgcaacctcmgcctcgctatggctcccagcagcccccggcccgcgctgcccgcactcctggtcctgctcggggctctgttcccaggtgagtcggggtggggattgccgtc

SEQ ID NO: 54241 - DNA, 201 bp, Homo sapiens
acggtgaaaccctgtctctactaaaaatacaaaaaattagctgtgcgtggtgacacgcacctgtagtcccagctatttgggaggctgaggcaggagaatcmcttgaacctgggaggtggaggttgcagtgagccgagatcgcaccactgcactccagcctgggccacagagtgagactccatcttgaaaaaaaaaaaaaat

SEQ ID NO: 54242 - DNA, 201 bp, Homo sapiens
gctgtgcgtggtgacacgcacctgtagtcccagctatttgggaggctgaggcaggagaatcacttgaacctgggaggtggaggttgcagtgagccgagatsgcaccactgcactccagcctgggccacagagtgagactccatcttgaaaaaaaaaaaaaatacaaaagttagccaggggtgttggtgggtgcctgtaatc

SEQ ID NO: 54243 - DNA, 201 bp, Homo sapiens
ataaggacaggcattctgggcaggaggaacagcctgggcaaaagttgggagcagggagaaatcttgatggaggcaggaggaggaggaggtaggttggtgtrggccaggtgcagtggctcacacctgtaatcccagtgctttgggaggccaaagcaagaggattgtttgagcccaggagttcgagaccagcctgggcaacat

SEQ ID NO: 54244 - DNA, 201 bp, Homo sapiens
ttgattgatgggaggaagggtgaggttggcagagccttgaatgccaggtggaggagctgggactttccttcttggggtgatagggagtcatggagggtttstgagcaggccagggattagatagctgaaggctggatttactggaagccaatgagcagttggctatggtccttgtccacgcggcccatgttgtgggcagtg

SEQ ID NO: 54245 - DNA, 201 bp, Homo sapiens
aataccataagattcatcccttttaagcacataattcaatgacttctgtacaaacaaccatgactacaatctaattttaaaatatttcaatcactctaaamaagaaacctcctgcttatgtacagcgactctgtctacctcttaagtgaattctcctacctttaatagccctattttacagttcaggaaactgaggttcag

SEQ ID NO: 54246 - DNA, 201 bp, Homo sapiens
aatgtgctattcaaactgccctgatgggcagtcaacagctaaaaccttcctcaccgtgtactgtgagtaactgagcccggagggctggactaggcagaccsggtgggagagacgtgcaggggcacctgcagaggcctgggggaatctttgccacttgctcgtagggtcaaggaggggctccttgcagggcaggtggggaca

SEQ ID NO: 54247 - DNA, 201 bp, Homo sapiens
tggccaagtgaaagtcagggagaggagggaatggtgtttcaggaagatggaacagcatacacaaaggcccagaggtgagagggatgtggctgtgtgccatygaaagagttttagcttggtaagagtgtgacagtatttcaaagtagggagaggtggtgagaaaagagtatagagaccaggtgtggtgactcacacctgtga

SEQ ID NO: 54248 - DNA, 201 bp, Homo sapiens
cagttattaagggcccattttgtgttagtcactgttcttggctccgggcatgcaagagataacaagacagattcctatcctcaccaggcttagagtcagaygggcagtcatcagacaatgacaggacacagtgatatgtgtttccatgggggacatacaagtagggactcatttgctagccatgttggggtgactggggtc

SEQ ID NO: 54249 - DNA, 201 bp, Homo sapiens
tattttagtagagaccgggtttcaccgtgttagccaggatcgtgatccacccgcctcagcctcccagagtgctgggattacaggcatgagccactgcgccyggccagcaaacagttattaagggcccattttgtgttagtcactgttcttggctccgggcatgcaagagataacaagacagattcctatcctcaccaggct

SEQ ID NO: 54250 - DNA, 201 bp, Homo sapiens
ggctgcatgaggcaggagccctgttaacattggctgtttccttctccccgaaggtgttcggcatgaccccaacatgaaatatgagctacagctggcgaacmccaaagagttctaccacgaggtgcacaggccctctcacttcctcaactttgctctcctgcaggagggggaggtttactctgcggatcgggaggacctgta

SEQ ID NO: 54251 - DNA, 201 bp, Homo sapiens; identical to SEQ ID NO: 10337

SEQ ID NO: 54252 - DNA, 201 bp, Homo sapiens; identical to SEQ ID NO: 10339

SEQ ID NO: 54253 - DNA, 201 bp, Homo sapiens; identical to SEQ ID NO: 10340

SEQ ID NO: 54254 - DNA, 201 bp, Homo sapiens
aaggagaagggaggccgtagcccagtgacaacccttccttcctaccccatggggcctgcccctcctgataccaggagtcagggtttctcctgtgacgcacycccaggcctgaaggggcacctcttgaggaggcatggcccctggagccagtgagagggcaggggtgtcccctggtcctgctcccgtctttccaacctgggt

SEQ ID NO: 54255 - DNA, 201 bp, Homo sapiens; identical to SEQ ID NO: 10342

SEQ ID NO: 54256 - DNA, 201 bp, Homo sapiens
aacagacgaatagctaattataaaacaatgccagcagtggacaaataaagtgaacagtattaatggggagtggttagggaaggcttcccagcggaggtgcygtccaaaatgaggctatgtcgcgagctagaggagagagaacagcaggtgcagaaaccacaggcaattccatgtgactggagcatcggggaccaggcaggt

SEQ ID NO: 54257 - DNA, 201 bp, Homo sapiens
agagttctaccacgaggtgcacaggccctctcacttcctcaactttgctctcctgcaggagggggaggtttactctgcggatcgggaggacctgtatgccygaccgtttccctgcctcctgcttcagcctcccgaggccgaagcctcagcccctccagacaggccgctgacattcagcagtttggcctctttccctctgtc

SEQ ID NO: 54258 - DNA, 201 bp, Homo sapiens
agccctgccattgcctttctttccctttctttttttgagtgtcagtctttccagccaccccctccctctcagggaggtgcctcgtggcagcccgcccctcyggcctggtttcctcaggaaaagccctgagaggaagcagggagggggttgggagctgtgggggccagacgaacccgagcgctcccaccgagctgcctgcca

SEQ ID NO: 54259 - DNA, 201 bp, Homo sapiens
tctgtactcctctttacctataggagatggaacccttaggttggatccacactcagcccaatgagtccccgcagttatcaccccaggatgtcaccacccaygccaagatcatggctgacaacccatcttgggatggcgagaagaccattatcatcacatgcaggtgggcctgggctccttgggaggaagtatggtggggca

SEQ ID NO: 54260 - DNA, 201 bp, Homo sapiens
agagtgggaacaagggaaggcttcctggagggggtgtcatttgagacaggtgggccgggcgcagtgactcacgcctgtaatcccagcactttgggaggccraggtgagtggatcacctgaggtcaggagttcaagaccagcctggccaacatggtgaaaccccgtctctactaaaaatacaaaattagccgggtgtggtgg

SEQ ID NO: 54261 - DNA, 201 bp, Homo sapiens
gagacatggagcccaggagggcggcgcccggggtgcctggctgggggtctcgggaggccgcggggtcggcatcggccgcggagcttgtgtaccatctagcmggggccctgggcactgagctgcaggatctggcgcgccgtttcgggccggaggcggcggccgggctggtgccgctagtggtgcgggcgctggagctcttgg

SEQ ID NO: 54262 - DNA, 201 bp, Homo sapiens
aggaacagtgaagagcagagcagtctcctccacatgtgggggtagagcagagtgggaacaagggaaggcttcctggagggggtgtcatttgagacaggtgsgccgggcgcagtgactcacgcctgtaatcccagcactttgggaggccgaggtgagtggatcacctgaggtcaggagttcaagaccagcctggccaacatg

SEQ ID NO: 54263 - DNA, 201 bp, Homo sapiens; identical to SEQ ID NO: 10352

SEQ ID NO: 54264 - DNA, 201 bp, Homo sapiens
gcaggagccctgttaacattggctgtttccttctccccgaaggtgttcggcatgaccccaacatgaaatatgagctacagctggcgaaccccaaagagttstaccacgaggtgcacaggccctctcacttcctcaactttgctctcctgcaggagggggaggtttactctgcggatcgggaggacctgtatgcctgaccgt

SEQ ID NO: 54265 - DNA, 201 bp, Homo sapiens
gcgggccgttccgtaggtctgggcgctgatcttgtggttgaagaaaccagctctggggaagggtctcgggcgcgggcgggagggcacctgtcagggtcccygggagaggcagccctcggatctgcccctgcccacctcacgctgcgttccatgctggccccaggcgatgtcagtcctgctgcaggccaggactagttccac

SEQ ID NO: 54266 - DNA, 201 bp, Homo sapiens
ggcgagaagaccattatcatcacatgcaggtgggcctgggctccttgggaggaagtatggtggggcagggattgcaggccagggcccagaacagtggcctragctgttactctgtcctcgttcctcccccagcttcacgccaggctcctgtacactgacggcctacaagctgacccccagtggctacgaatggggccgcca

SEQ ID NO: 54267 - DNA, 201 bp, Homo sapiens
catccgtgagtagccaggacagaccctcagccaaggagaagggaggccgtagcccagtgacaacccttccttcctaccccatggggcctgcccctcctgawaccaggagtcagggtttctcctgtgacgcacccccaggcctgaaggggcacctcttgaggaggcatggcccctggagccagtgagagggcaggggtgtcc

SEQ ID NO: 54268 - DNA, 201 bp, Homo sapiens
cagcagtttggcctctttccctctgtctgtgcttgtgttgttgacctcctgatggcttgtcatcctgaataaaatataataataaattttgtataaatagragttcaggggctggtttgttttttttttcccccccaaactcaaattctggatttaggtctaacaggaggctggactggagcggttcacagcaagatgctg

SEQ ID NO: 54269 - DNA, 201 bp, Homo sapiens; identical to SEQ ID NO: 10345

SEQ ID NO: 54270 - DNA, 201 bp, Homo sapiens
tgtgtcccatggccgctgtccagcctgcgcccttctccctggatctcaccactccccttgccttgcctgccatccattctgcctgacaacactgcctctcyacattcattcttcaagttcctgtcttggctgggtctgtttattcttacgggggtgaaactgtagccgcggctgtgtcagggcctgctgtgtgtcaagcta

SEQ ID NO: 54271 - DNA, 201 bp, Homo sapiens
tgccccacctgtgttcaggggtcctgtgatactgtgacaggggactgtgtctgcagtgccggctactgggggcccaggtaaggatggggatcccgggggcrggagagtgccaggggcctaggtcagggctctgtgcagcatttcctgaacttccctggacagtgcccagaaatctccctgcccgtctcctgcctgcctccc

SEQ ID NO: 54272 - DNA, 201 bp, Homo sapiens
tcccccacccccggagtccaaaatacagagtttgtatgttggggaaaggggaaaggcaagagtgtggggagggaggaagggccctggctggtccttctcargatcccctttcccgcttctctgcccatcaccctgctgtgcttggctctaagcacaccgtcccctcctgcttctctggccctggcccccatcaccttcaca

SEQ ID NO: 54273 - DNA, 201 bp, Homo sapiens
gaaggctgcggggtgcagtagccagggaaaggcgggcccttcacatgggctccagggcaagttcctcaccagggagtctgggcccacttcagagatattcttttttttttttttttttcccttaagacgaggtcttgctctgtcacccaggccagagtgcagtggtgtgatgtcagctcactgcaacctccacctcccagg

SEQ ID NO: 54274 - DNA, 201 bp, Homo sapiens
ttccctcagctcccacaagctaccctgggtgacaggtcagtgggcgctgggggccggggtctgggattggacagggctttgcatcaggtcctgcaggcgcytgatctggagtctctacagtctcacatcacgacccggaggtccccttcaaccacagcttcatcgagccgccctctgccggctgggccactgatgactcct

SEQ ID NO: 54275 - DNA, 201 bp, Homo sapiens
gagagagaaacgtgagctgaggctcagctaggatgataataacaaagacctgccaggtcctgcaaaaagctcagatagatgatagatagatggatagatakatagatagatagatagatagatagatagatagatagataggatctgttttacagatgcggaaactgaggcctagggaggtgaagtgtgaaccagagttgt

SEQ ID NO: 54276 - DNA, 201 bp, Homo sapiens
aactcagagcaaagacaggatgtgtaggagacaggaaggcctgaatatcccccgtttctggctcccccaggctctggcagtcgggacactgccctcatcgygggcagccttgtgcctctgctgctgctcttcctgggtcttgcctgctgtgcctgctgctgctgggccccccgatcagacctcaaggacaggtgaacgcca

SEQ ID NO: 54277 - DNA, 201 bp, Homo sapiens
agagtttgtatgttggggaaaggggaaaggcaagagtgtggggagggaggaagggccctggctggtccttctcaggatcccctttcccgcttctctgcccrtcaccctgctgtgcttggctctaagcacaccgtcccctcctgcttctctggccctggcccccatcaccttcacactccctcaggctgccctttcttcccc

SEQ ID NO: 54278 - DNA, 201 bp, Homo sapiens
ggattggacagggctttgcatcaggtcctgcaggcgcctgatctggagtctctacagtctcacatcacgacccggaggtccccttcaaccacagcttcatygagccgccctctgccggctgggccactgatgactccttctcatccgatcctgagtctggagaggcagatgaggttcctgcctactgtgtgccaccccaag

SEQ ID NO: 54279 - DNA, 201 bp, Homo sapiens
ggcccgccccggactcggtgagtcatggccctcccttcgccacccacggggccggcagggccgaagcctgagacccgggtctccccagctgcaggtgtcgrcgcagccggcggagcaggagctgcggcggctgcgggaggagaacgagcgcctccgcagggagctgcgcgcggggccacagggtaagcgcagccccggcca

SEQ ID NO: 54280 - DNA, 201 bp, Homo sapiens
ctgcggctggcatctccactgctggcatccccatggctggcatcaccagggctttctccctccctgccccttttctttagggagctgctcacagaccaccrggtccccggccttctgctcgaggccatgaaggtggctgtccggaagcagcggaagaagatcaaggccaagatgttagggacaccagaggaagcagagagc

SEQ ID NO: 54281 - DNA, 201 bp, Homo sapiens
ctgtccggaagcagcggaagaagatcaaggccaagatgttagggacaccagaggaagcagagagcaggtaggtccctgcctgcattcccacggagccaggmctccctccctcattctgctgagcctgatgacccagcctggtcaccctctgagcccattgtctcagactgaggctgtcaccccaacccggtcaccccttga

SEQ ID NO: 54282 - DNA, 201 bp, Homo sapiens
tctaagcacaccgtcccctcctgcttctctggccctggcccccatcaccttcacactccctcaggctgccctttcttccccctctccccttttctcaccaycccctgccctcacccatatccttgacctctctggcttcctggctcaaagtgcctctggctgtctctctccagctttggcctatggtatcggggtaaagct

SEQ ID NO: 54283 - DNA, 201 bp, Homo sapiens
atgcgggctggggaatggaggcgcgggggtccgaggccatggaaacgggcgagttgccgggggaacgcccgagatgggggtcgcgcggctggctcgcgccrccggtttgaaccggctcctcgtctcccacgctgggttcgcgtggccgcagcgcctagcgacctagacggcggccaatggcgcggcagttcctgcgccgtc

SEQ ID NO: 54284 - DNA, 201 bp, Homo sapiens
tgtaccgagcctctggggccagatataagagtgcctctctgagtctcagtttccccatccatgaaatgagagctgactgcctagctcccagggctttgtgmagacggcctgagctcatgtaataaagaactgcccgtaatacacagaaactgttcctcgcctgtctgtccatgtctgtgccacctcccaaccctgccagga

SEQ ID NO: 54285 - DNA, 201 bp, Homo sapiens
ttctccccgaaggtgttcggcatgaccccaacatgaaatatgagctacagctggcgaaccccaaagagttctaccacgaggtgcacaggccctctcacttmctcaactttgctctcctgcaggagggggaggtttactctgcggatcgggaggacctgtatgcctgaccgtttccctgcctcctgcttcagcctcccgagg

SEQ ID NO: 54286 - DNA, 201 bp, Homo sapiens; identical to SEQ ID NO: 10336

SEQ ID NO: 54287 - DNA, 201 bp, Homo sapiens
agagagagagagagaaacgtgagctgaggctcagctaggatgataataacaaagacctgccaggtcctgcaaaaagctcagatagatgatagatagatggdtagatagatagatagatagatagatagatagatagatagatagataggatctgttttacagatgcggaaactgaggcctagggaggtgaagtgtgaacca

SEQ ID NO: 54288 - DNA, 201 bp, Homo sapiens
agagagaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgtt

SEQ ID NO: 54289 - DNA, 201 bp, Homo sapiens; identical to SEQ ID NO: 10338

SEQ ID NO: 54290 - DNA, 201 bp, Homo sapiens
gagagaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgtta

SEQ ID NO: 54291 - DNA, 201 bp, Homo sapiens
agagaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgttac

SEQ ID NO: 54292 - DNA, 201 bp, Homo sapiens
gagaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgttact

SEQ ID NO: 54293 - DNA, 201 bp, Homo sapiens
agaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgttactc

SEQ ID NO: 54294 - DNA, 201 bp, Homo sapiens
cattggctgtttccttctccccgaaggtgttcggcatgaccccaacatgaaatatgagctacagctggcgaaccccaaagagttctaccacgaggtgcacrggccctctcacttcctcaactttgctctcctgcaggagggggaggtttactctgcggatcgggaggacctgtatgcctgaccgtttccctgcctcctgct

SEQ ID NO: 54295 - DNA, 201 bp, Homo sapiens
ccttcaaccacagcttcatcgagccgccctctgccggctgggccactgatgactccttctcatccgatcctgagtctggagaggcagatgaggttcctgcytactgtgtgccaccccaagaaggtagccccccaacagcccacatagcccctgagcagccctgcccaccacgaccccctctttagtcctccagcaaagtta

SEQ ID NO: 54296 - DNA, 201 bp, Homo sapiens
acttgcttttttacttaacgacatatcctggatatagttcaatgtccataaatgtaaagctaactctctttatttaaaaaatgactacatgagattccatstagcacaattatttaaatcattcccccgccaatggaaggttgggttgttctgatctgttttgatacaataagcaatgacatagtatacaactttgtccat

SEQ ID NO: 54297 - DNA, 201 bp, Homo sapiens
aggggatcgcggccggggcgagggcgcgggggcagaagcggccgccgaaggggcgtagggagaaaacgtgggaacaagaggagagagatggagcgatgagrggccgccagggaagagatgacgaacagatgcgggctggggaatggaggcgcgggggtccgaggccatggaaacgggcgagttgccgggggaacgcccgag

SEQ ID NO: 54298 - DNA, 201 bp, Homo sapiens
ttcaagtgattcccctgcctcagcctcccaaatagctgggattacaggcgtgcaccaccacacacggctaatttttatattttagtagagaccgggtttcwccgtgttagccaggatcgtgatccacccgcctcagcctcccagagtgctgggattacaggcatgagccactgcgcccggccagcaaacagttattaaggg

SEQ ID NO: 54299 - DNA, 201 bp, Homo sapiens
tagatagatagatagatagatagatagatagataggatctgttttacagatgcggaaactgaggcctagggaggtgaagtgtgaaccagagttgttactcrgctgtctgactctagagccactctttgttctgtggcaggcctgaattgtgggctcaatcatttggattttattctgtagtcaatagagagccactgaagc

SEQ ID NO: 54300 - DNA, 201 bp, Homo sapiens; identical to SEQ ID NO: 10343

SEQ ID NO: 54301 - DNA, 201 bp, Homo sapiens
aagaaagagatttttcagatggcagttgaaaccttgggagtgggaagggttccacagggtgaggaaccgggtaggctaccagctggagccgccccccagcrggctgacagctccaagcgttgtctgggggaggttgccctcgccaggtggcccgggcggattctagacagtagggggcacactcggactggggcaggtgga

SEQ ID NO: 54302 - DNA, 201 bp, Homo sapiens
aacattggctgtttccttctccccgaaggtgttcggcatgaccccaacatgaaatatgagctacagctggcgaaccccaaagagttctaccacgaggtgcmcaggccctctcacttcctcaactttgctctcctgcaggagggggaggtttactctgcggatcgggaggacctgtatgcctgaccgtttccctgcctcctg

SEQ ID NO: 54303 - DNA, 201 bp, Homo sapiens
tcctgttttacaaataatagtttctgaaggattttggcagaagtcacatttacatttcccttagtgccctgggatgagatgggggctggatttgaggaacygaaatctgaaggtggctcaacaacagtagttgcgggcctaagggcacagatggaccgattaggtaaatatgtaggagatacagctgtatcagtttgatgg

SEQ ID NO: 54304 - DNA, 201 bp, Homo sapiens; identical to SEQ ID NO: 10344

SEQ ID NO: 54305 - DNA, 201 bp, Homo sapiens
tgaggccatcgccctttgcacttggggcctggctggcttggaggtggcgcaggctgcatgaggcaggagccctgttaacattggctgtttccttctccccraaggtgttcggcatgaccccaacatgaaatatgagctacagctggcgaaccccaaagagttctaccacgaggtgcacaggccctctcacttcctcaactt

SEQ ID NO: 54306 - DNA, 201 bp, Homo sapiens
ggaaccgggtaggctaccagctggagccgccccccagcaggctgacagctccaagcgttgtctgggggaggttgccctcgccaggtggcccgggcggattstagacagtagggggcacactcggactggggcaggtggagcaagaggcgtttggggctcccacagccctggggtggtggtggggttttatttttggttttt

SEQ ID NO: 54307 - DNA, 201 bp, Homo sapiens
ctctgctcaccgcaacctctgcctccccagctcaagcaattctcctgcctcagcctcccaggtagctgggattacaggcgtgtgccacatcacccagatcttttttttttttttttcttttcagacaaagtttcgctcttgttgcccaggctggagtgcagtggcacgatctcggctcacttcaacttccgcctcccaggt

SEQ ID NO: 54308 - DNA, 201 bp, Homo sapiens
cttcatggtccctgcccagtcctcgtggaactacaacttcatgggtaagtgggaggagcctggggatgtggggatagcagtagggataaggtgaggccatygccctttgcacttggggcctggctggcttggaggtggcgcaggctgcatgaggcaggagccctgttaacattggctgtttccttctccccgaaggtgttc

SEQ ID NO: 54309 - DNA, 201 bp, Homo sapiens
tctaccacgaggtgcacaggccctctcacttcctcaactttgctctcctgcaggagggggaggtttactctgcggatcgggaggacctgtatgcctgaccrtttccctgcctcctgcttcagcctcccgaggccgaagcctcagcccctccagacaggccgctgacattcagcagtttggcctctttccctctgtctgtgc

SEQ ID NO: 54310 - DNA, 201 bp, Homo sapiens
gtctcgggcgcgggcgggagggcacctgtcagggtccctgggagaggcagccctcggatctgcccctgcccacctcacgctgcgttccatgctggccccakgcgatgtcagtcctgctgcaggccaggactagttccacggccctgagcatgcgttagccccttcttgcctccatgcctcagtttacctcggagtgagctg

SEQ ID NO: 54311 - DNA, 201 bp, Homo sapiens
tcgcctgtctgtccatgtctgtgccacctcccaaccctgccaggagcagaggcaggctgaggggtcctcgctggtctccttgctcagtcactgggtggggkggcttcttgcagctcaggccttgctttgggagtgtggcctgatggaaagccgtggctcccagcctcagtccacccccttccctggccccggcacccaggg

SEQ ID NO: 54312 - DNA, 201 bp, Homo sapiens
tattctgtagtcaatagagagccactgaagccactgaagtagaggcagtcaccctgtcacaccctgccaaggtgacccaggtcaccgtgggtctcatgtaytgaccagtgtccctaccctcctccctcaggccagcgagagatggagctaccgtgtccaggatgaagctgcaggtctgggggacactgaccagcttgggct

SEQ ID NO: 54313 - DNA, 201 bp, Homo sapiens
ccccttcaaccacagcttcatcgagccgccctctgccggctgggccactgatgactccttctcatccgatcctgagtctggagaggcagatgaggttcctrcctactgtgtgccaccccaagaaggtagccccccaacagcccacatagcccctgagcagccctgcccaccacgaccccctctttagtcctccagcaaagt

SEQ ID NO: 54314 - DNA, 201 bp, Homo sapiens; identical to SEQ ID NO: 10349

SEQ ID NO: 54315 - DNA, 201 bp, Homo sapiens
ggcatctccactgctggcatccccatggctggcatcaccagggctttctccctccctgccccttttctttagggagctgctcacagaccaccgggtccccrgccttctgctcgaggccatgaaggtggctgtccggaagcagcggaagaagatcaaggccaagatgttagggacaccagaggaagcagagagcaggtaggt

SEQ ID NO: 54316 - DNA, 201 bp, Homo sapiens; identical to SEQ ID NO: 10350

SEQ ID NO: 54317 - DNA, 201 bp, Homo sapiens
tggcatctccactgctggcatccccatggctggcatcaccagggctttctccctccctgccccttttctttagggagctgctcacagaccaccgggtcccyggccttctgctcgaggccatgaaggtggctgtccggaagcagcggaagaagatcaaggccaagatgttagggacaccagaggaagcagagagcaggtagg

SEQ ID NO: 54318 - DNA, 201 bp, Homo sapiens
cgaagttttgctctgttgcccaggctggagtgcagtggtgcaatctcagctcactgcaacctctgcctcccgggttcaagcgattctcctgcctcagcctsctgagtagctgcaattacaggtgtgtgccaccacacccagctaatttttgtattagtagagatggggtttcaccatgttggccaggctgttctcgaactc

SEQ ID NO: 54319 - DNA, 201 bp, Homo sapiens
cttgatcaatggccctcacttctcctctctcctctgtctcagtgaggatgaggctggcccatggatcctgctctccgatgacaagggagaccatcccccayccccggagtccaaaatacagagtttgtatgttggggaaaggggaaaggcaagagtgtggggagggaggaagggccctggctggtccttctcaggatcccc

SEQ ID NO: 54320 - DNA, 201 bp, Homo sapiens
gtccatgtctgtgccacctcccaaccctgccaggagcagaggcaggctgaggggtcctcgctggtctccttgctcagtcactgggtggggtggcttcttgyagctcaggccttgctttgggagtgtggcctgatggaaagccgtggctcccagcctcagtccacccccttccctggccccggcacccagggacctgcaact

SEQ ID NO: 54321 - DNA, 201 bp, Homo sapiens
cacggacaggagcccgaatgggcgaccgccggcgcaggcgccccagggaaccctgaggacccggtgagtgccgtatgagggcaaggacccagcccaggackcagcgtccagccctcggtgggcactcaagcaaggtttgcatgctgcacagcaggtcggccaggaagcggggaggtggcagacagatctgcgcccccggcc

SEQ ID NO: 54322 - DNA, 201 bp, Homo sapiens
cagttcagctccagccaagctcttctgtctcctctgccagggatggtccctgtggcccaggcagggtcgtcagaggccagcctggctgcaggtgctttccygccccctgaggacgcctccacgccattcgccatcccgcgcacctccagcctagctcgggccaagcggccatcggtctccttcgcggaaggtaccaagttt

SEQ ID NO: 54323 - DNA, 201 bp, Homo sapiens
gaaacgtgagctgaggctcagctaggatgataataacaaagacctgccaggtcctgcaaaaagctcagatagatgatagatagatggatagatagatagatagatagatagatagatagatagatagatagataggatctgttttacagatgcggaaactgaggcctagggaggtgaagtgtgaaccagagttgttactca

SEQ ID NO: 54324 - DNA, 201 bp, Homo sapiens
ggtgctttctttcagatgtttttctgtgtacatgtcaacaaatattttaaacaaaaaattttagcatactaagcatactgttcctcagcttcttttttttyttttttttttctttttgagacgaagttttgctctgttgcccaggctggagtgcagtggtgcaatctcagctcactgcaacctctgcctcccgggttcaag

SEQ ID NO: 54325 - DNA, 201 bp, Homo sapiens
ctgaggcaggaggatcacctaagcccaggaggtcgaggctgcagtgagctatgatcatgccaccacactccagcagtctgggtgcctgagatcctgtctcaaaaaaaaaaaaaaaagaaaaagaaaaagaaaaaagacagggttcttggtatctaacttcagtagacagtagtagtatggttatctgagagaaaatgtgga

SEQ ID NO: 54326 - DNA, 201 bp, Homo sapiens
tgaggcaggaggatcacctaagcccaggaggtcgaggctgcagtgagctatgatcatgccaccacactccagcagtctgggtgcctgagatcctgtctcaaaaaaaaaaaaaaaagaaaaagaaaaagaaaaaagacagggttcttggtatctaacttcagtagacagtagtagtatggttatctgagagaaaatgtggag

SEQ ID NO: 54327 - DNA, 201 bp, Homo sapiens
acctaagcccaggaggtcgaggctgcagtgagctatgatcatgccaccacactccagcagtctgggtgcctgagatcctgtctcaaaaaaaaaaaaaaaaraaaaagaaaaagaaaaaagacagggttcttggtatctaacttcagtagacagtagtagtatggttatctgagagaaaatgtggaggacagttctggggga

SEQ ID NO: 54328 - DNA, 201 bp, Homo sapiens
caattacaggtgtgtgccaccacacccagctaatttttgtattagtagagatggggtttcaccatgttggccaggctgttctcgaactcctgacccgcctyggtctcccgaagtgctgggattacaagcgtgagccaccgcggccagcctcaacttgcttttttacttaacgacatatcctggatatagttcaatgtccat

SEQ ID NO: 54329 - DNA, 201 bp, Homo sapiens
attggctgtttccttctccccgaaggtgttcggcatgaccccaacatgaaatatgagctacagctggcgaaccccaaagagttctaccacgaggtgcacargccctctcacttcctcaactttgctctcctgcaggagggggaggtttactctgcggatcgggaggacctgtatgcctgaccgtttccctgcctcctgctt

SEQ ID NO: 54330 - DNA, 201 bp, Homo sapiens
tgatcttgtggttgaagaaaccagctctggggaagggtctcgggcgcgggcgggagggcacctgtcagggtccctgggagaggcagccctcggatctgccsctgcccacctcacgctgcgttccatgctggccccaggcgatgtcagtcctgctgcaggccaggactagttccacggccctgagcatgcgttagccccttc

SEQ ID NO: 54331 - DNA, 201 bp, Homo sapiens
agcctcctgagtagctgcaattacaggtgtgtgccaccacacccagctaatttttgtattagtagagatggggtttcaccatgttggccaggctgttctcsaactcctgacccgcctcggtctcccgaagtgctgggattacaagcgtgagccaccgcggccagcctcaacttgcttttttacttaacgacatatcctgga

SEQ ID NO: 54332 - DNA, 201 bp, Homo sapiens
gtgccgctagtggtgcgggcgctggagctcttggaacaggctgccgtggggcccgccccggactcggtgagtcatggccctcccttcgccacccacggggycggcagggccgaagcctgagacccgggtctccccagctgcaggtgtcggcgcagccggcggagcaggagctgcggcggctgcgggaggagaacgagcgcc

SEQ ID NO: 54333 - DNA, 201 bp, Homo sapiens
tgtcagtctttccagccaccccctccctctcagggaggtgcctcgtggcagcccgcccctccggcctggtttcctcaggaaaagccctgagaggaagcagkgagggggttgggagctgtgggggccagacgaacccgagcgctcccaccgagctgcctgccatggggctggggctgctgctcccgctgctgctgctctgga

SEQ ID NO: 54334 - DNA, 201 bp, Homo sapiens
tagtcaatagagagccactgaagccactgaagtagaggcagtcaccctgtcacaccctgccaaggtgacccaggtcaccgtgggtctcatgtactgaccartgtccctaccctcctccctcaggccagcgagagatggagctaccgtgtccaggatgaagctgcaggtctgggggacactgaccagcttgggctccacgct

SEQ ID NO: 54335 - DNA, 201 bp, Homo sapiens
ctgccctgccgttccctcagctcccacaagctaccctgggtgacaggtcagtgggcgctgggggccggggtctgggattggacagggctttgcatcaggtyctgcaggcgcctgatctggagtctctacagtctcacatcacgacccggaggtccccttcaaccacagcttcatcgagccgccctctgccggctgggccac

SEQ ID NO: 54336 - DNA, 201 bp, Homo sapiens
aaacaatgccagcagtggacaaataaagtgaacagtattaatggggagtggttagggaaggcttcccagcggaggtgctgtccaaaatgaggctatgtcgygagctagaggagagagaacagcaggtgcagaaaccacaggcaattccatgtgactggagcatcggggaccaggcaggtcagatgtccttcagagggaggg

SEQ ID NO: 54337 - DNA, 201 bp, Homo sapiens
gctcccgccttcacagccctcgccaggggtctgccccaatcctggcctgcatcagggcaggacggggtctcagcccgcctccctctctacgtctctgtacygagcctctggggccagatataagagtgcctctctgagtctcagtttccccatccatgaaatgagagctgactgcctagctcccagggctttgtgcagacg

SEQ ID NO: 54338 - DNA, 201 bp, Homo sapiens
gaatagctaattataaaacaatgccagcagtggacaaataaagtgaacagtattaatggggagtggttagggaaggcttcccagcggaggtgctgtccaamatgaggctatgtcgcgagctagaggagagagaacagcaggtgcagaaaccacaggcaattccatgtgactggagcatcggggaccaggcaggtcagatgt

SEQ ID NO: 54339 - DNA, 201 bp, Homo sapiens
ggcctgaatatcccccgtttctggctcccccaggctctggcagtcgggacactgccctcatcgtgggcagccttgtgcctctgctgctgctcttcctgggycttgcctgctgtgcctgctgctgctgggccccccgatcagacctcaaggacaggtgaacgccagcccgtcccttccccacacagctcaggccacagggtg

SEQ ID NO: 54340 - DNA, 201 bp, Homo sapiens
tttttaagatggagtctcagtctgtcacccaggccggagtgcagtggtatgatctcggctcactgccacctctgtctccccggttcaagcgattctcctgyctcagcctcctgagtggctgggattacaagcgcccgccaccatgcccggctaatttttgtattttttggtggagacagggtttcaccatgttggccaggc

SEQ ID NO: 54341 - DNA, 201 bp, Homo sapiens
aaaaagtactaacattacagacatgtataaagtaaaacggagatttcctttctccccagaggcgtctgtgggtcaagagagaggtagaatctacttttccytggcagctttttggtcttgtttgaattctttgctcacatattacctagtcagaaaagaaaaggggcaaccctccccccgagctttattttttttttttta

SEQ ID NO: 54342 - DNA, 201 bp, Homo sapiens; identical to SEQ ID NO: 10353

SEQ ID NO: 54343 - DNA, 201 bp, Homo sapiens; identical to SEQ ID NO: 10354

SEQ ID NO: 54344 - DNA, 201 bp, Homo sapiens
acaagaaatgcctcaacctcacatccagtcactggaagagccagaactagaaagctcccgagtcttttccccacattcaagagggttgctgggtgcatccwtacccagctatccttacagtgtttgggaatggggaatggctctgtcttactgtgggcatggtgggcatttttggcagtgggagagaaggaaaatctgttg

SEQ ID NO: 54345 - DNA, 201 bp, Homo sapiens
tgtacctccagaggtcagcatgtccaggaggcatgggatggccacagaatagctcactgggatcagtagaccctcaggtttcaggtcagtcttcacgaggmgatcaagaaggggagtagagggaagaggtgccctctgtttgtgaaggactgaacagaatttgctcatatcccctattcctctctcaaggaatcctgaacc

SEQ ID NO: 54346 - DNA, 201 bp, Homo sapiens
cctattcctctctcaaggaatcctgaacctaattaccctacaattgggaatagcatcaccagggccttgagtataaaactgtgggcacaaagcattggagrtgtttaagttttctgatggcacacagatctcaaccaggaatcagggatgtcaccaactcatttctctggaaagcatactattagatgaagatgttcatgc

SEQ ID NO: 54347 - DNA, 201 bp, Homo sapiens
ccactcagagcaatcactggccctcactctgagtacaaaaaacctctctgcctctcctatagcctagcagactttagccctaaacatcaatcaggatgtayctccagaggtcagcatgtccaggaggcatgggatggccacagaatagctcactgggatcagtagaccctcaggtttcaggtcagtcttcacgaggcgatc

SEQ ID NO: 54348 - DNA, 201 bp, Homo sapiens
caggcttttatacccccatctgaaccagccctggctgcaggatgctcctggaagaggacacaactctgggcaaggcagctgtttttagctgacggcgggcmtcatagaggaaattccgctgagaagcattggctgccaacacttctagcagctggggaagaagcactttagacctgggagggaaaaacttgggcagcacac

SEQ ID NO: 54349 - DNA, 201 bp, Homo sapiens
cccaaaatttttacctttgtctttccaggcccctgcccaatgatgcagaccattcaacactatctatctacgagtccatatatatatatatatattttttwtttttttattatactttaagttttagcgtacatgtgcacattgtgcaggttagttacatatgtatacatgtgccgtgctggtgcgctgcacccactaact

SEQ ID NO: 54350 - DNA, 201 bp, Homo sapiens
cctttcccccaaaatttttacctttgtctttccaggcccctgcccaatgatgcagaccattcaacactatctatctacgagtccatatatatatatatatwttttttatttttttattatactttaagttttagcgtacatgtgcacattgtgcaggttagttacatatgtatacatgtgccgtgctggtgcgctgcaccc

SEQ ID NO: 54351 - DNA, 201 bp, Homo sapiens
gtagaaccaatgacatggaaactttctaaatgccaaagctgcaattaaaggttagcttcttagacccagaaaattaatttctctctgtcactgtttactcrcaccttaactttactagcttgagagctttcaatcaaatggacaggacctcatcttcctgtataagcaacttaaatcaggattccctttcagcatacaaaa

SEQ ID NO: 54352 - DNA, 201 bp, Homo sapiens
cagcatacaaaatcagcttgcgtttccattggtcacattacctatgtacctgaacgcagagaccaactatgtccccaagggtagaaaagggtcacaggtgmcctgctggtataactctgcatggtctaaggccattgatctggagggccaatggcctactgtgtcatgcatgcccagcagggtcgctgcatgcaaagctcc

SEQ ID NO: 54353 - DNA, 201 bp, Homo sapiens
ctttgccaccattcctttcctccccacctcatacttgcctctcctgggacctattttaacagccctgtggtatctccctctacccgaccctgctcctcggwcttccaacccagactaggcagacatgacagacactggaaatcagaggaaggctaggtgacctttgaccagaggtttaggtgcaggttttacaggtgtggt

SEQ ID NO: 54354 - DNA, 201 bp, Homo sapiens
tccaattcattaattttcacaagtgagtgttcactcccagctccctgcctgggagattgctgtagtcatatcaatttcttcaagtcaagagcaaagatggytttactgggcctttaagagcagcaactaacccaagagtctcatccttcctcctctccgtagcaaccctttgtccaggggcagatggtccttaaatattta

SEQ ID NO: 54355 - DNA, 201 bp, Homo sapiens
ccttcatcgtgacccccgcatgggcaaaggcttccctggaatctcccacactgtctgctccctataaaaggcaggcagatgggccagaggagcagagaggytgagaccaacccagaaaccaccacctctcacgccaaagctcacaccttcagcctccaacatgaaggtctccgcagcacttctgtggctgctgctcatagc

SEQ ID NO: 54356 - DNA, 201 bp, Homo sapiens
gtctccaaaatcctcaagaccaccatgtgaacacaggaatcaaggaaggttcttagatcgactcatcccccaggcctttggtttccttgctcctttccccractacaggtgtttcatttcaactcatcccctagggccttggttttcttgctctcttcccccactacagatgtttaacttcatttcataaccacatattcc

SEQ ID NO: 54357 - DNA, 201 bp, Homo sapiens
ttcttggaaaccatccctgcggtagcatatctttacttggaagcagtgggaaaacttggaagaatatttggagaaatatccagactctgaggtctttccarcattcccaatctgcccttcttttttttttttttttgagacacagtctcactctgttgcccaggttggagtgcagtggcatgatctctgcccattgcaacc

SEQ ID NO: 54358 - DNA, 201 bp, Homo sapiens
aactatccagttctgatgtcctatcatgctaaaatttcagggactaagattctgtgatcattacattgaaacacagcagcaaagctgtggtgtgttgtccytcctggttcagagatgcaactatgtgcagggctgctgagctctctctgcatctgggtgggagcctaatggaagttttggggctccttcctggtctccaaa

SEQ ID NO: 54359 - DNA, 201 bp, Homo sapiens
gaacagaaaaccaaacactgcatgctctcactcataagtgggagttgaacaatgagtacacatggaaacagggaggggaacatcacacactggggcctgtyggtggatggcaggcaaggggagggagagcattaggacaaatacctaatgtagatgacgagttgatgggtgcagcaaaccaccatggcacatgtataccta

SEQ ID NO: 54360 - DNA, 201 bp, Homo sapiens
tttacactgttggtgggaggagtataaattagttcaaccgttgtggaagacagtgtggtgattcctcaaggatctagaatcagaaataccatttgacccarcaatcccattaccgggtatataaggattataaatcattctattgtaaagaaacatgtacacgttatgtttactgcagcactatttgcaatagcaaagact

SEQ ID NO: 54361 - DNA, 201 bp, Homo sapiens
cttcatccctgggatgcaagtctctttcaacatatgcaaatcaataaacataatccatcacataaacagaaccaatgacaaaaaaaccacatgattatctsaatagatgcagaaaaggccttcaataaaattcaacacctcttcatgttaaaaacactcaataaactaggtattgatgcaacatatctcaaaattgtaaga

SEQ ID NO: 54362 - DNA, 201 bp, Homo sapiens
atctgggtgggagcctaatggaagttttggggctccttcctggtctccaaaatcctcaagaccaccatgtgaacacaggaatcaaggaaggttcttagatygactcatcccccaggcctttggtttccttgctcctttccccaactacaggtgtttcatttcaactcatcccctagggccttggttttcttgctctcttcc

SEQ ID NO: 54363 - DNA, 201 bp, Homo sapiens
cgccagtgaacaaacacttgtaagctctcagataatggtgctgtctaaggtactggagacagaaatggcaaactcatacctggaaagtgtttctactccarttaagatgagtcattgctcttttcagagtagaataggtgcaatgtaatcaaacatgtactttccaccaaacggctggttagtctccctgatggatggatg

SEQ ID NO: 54364 - DNA, 201 bp, Homo sapiens
tatgaattttacctattgggaatacagcttcacttattatttgatttaaggtctatattgaatcctagaggatagtatttcttccttgtaggatactcttyccaagctggtgccttaactgtgccttcagcaggccattccattactgtatcagcctggaaacctgtggataacacaggtatatagtgggatcagtggatc

SEQ ID NO: 54365 - DNA, 201 bp, Homo sapiens
ggtgtgttgtccttcctggttcagagatgcaactatgtgcagggctgctgagctctctctgcatctgggtgggagcctaatggaagttttggggctccttmctggtctccaaaatcctcaagaccaccatgtgaacacaggaatcaaggaaggttcttagatcgactcatcccccaggcctttggtttccttgctcctttc

SEQ ID NO: 54366 - DNA, 201 bp, Homo sapiens
tgagttcatgtccgttgcagggacgtggatgaagctggaagccatcactctcagcaaactaacacaggaacagaaaaccaaacactgcatgctctcactcrtaagtgggagttgaacaatgagtacacatggaaacagggaggggaacatcacacactggggcctgtcggtggatggcaggcaaggggagggagagcatta

SEQ ID NO: 54367 - DNA, 201 bp, Homo sapiens; identical to SEQ ID NO: 10360

SEQ ID NO: 54368 - DNA, 201 bp, Homo sapiens
actggccctcactctgagtacaaaaaacctctctgcctctcctatagcctagcagactttagccctaaacatcaatcaggatgtacctccagaggtcagcmtgtccaggaggcatgggatggccacagaatagctcactgggatcagtagaccctcaggtttcaggtcagtcttcacgaggcgatcaagaaggggagtaga

SEQ ID NO: 54369 - DNA, 201 bp, Homo sapiens; identical to SEQ ID NO: 10355

SEQ ID NO: 54370 - DNA, 201 bp, Homo sapiens
gggagggagagcattaggacaaatacctaatgtagatgacgagttgatgggtgcagcaaaccaccatggcacatgtatacctatgtaacaaacctgcacgytctgcacatgtatctcagaacttaaagaataataataaaaataaaagataccttttccaattaaaaaaaagaaaaaaaactctttagaagtcaatatttt

SEQ ID NO: 54371 - DNA, 201 bp, Homo sapiens
gaaccaatgacaaaaaaaccacatgattatctcaatagatgcagaaaaggccttcaataaaattcaacacctcttcatgttaaaaacactcaataaactargtattgatgcaacatatctcaaaattgtaagagctatttatgacaaactcacagccaatatcatactgaatgggcaaaagctggaagcattccctttgaa

SEQ ID NO: 54372 - DNA, 201 bp, Homo sapiens
tagtttgacctctatggtccaattcattaattttcacaagtgagtgttcactcccagctccctgcctgggagattgctgtagtcatatcaatttcttcaartcaagagcaaagatggttttactgggcctttaagagcagcaactaacccaagagtctcatccttcctcctctccgtagcaaccctttgtccaggggcaga

SEQ ID NO: 54373 - DNA, 201 bp, Homo sapiens
atccttccaattgcatcctgtatctcccacagcttcaagaccaaactggccaaggatatctgtgccgaccccaagaagaagtgggtgcaggattccatgamgtatctggaccaaaaatctccaactccaaagccataaataatcaccatttttgaaaccaaaccagagcctgagtgttgcctaatttgttttcccttctta

SEQ ID NO: 54374 - DNA, 201 bp, Homo sapiens
tctcacgccaaagctcacaccttcagcctccaacatgaaggtctccgcagcacttctgtggctgctgctcatagcagctgccttcagcccccaggggctcrctgggccaggtaagccccccaactccttacaggaaaggtaaggtaaccacctccagagctactaggtcagcaagaatctttacagactcactgcaaattc

SEQ ID NO: 54375 - DNA, 201 bp, Homo sapiens
catcctgtatctcccacagcttcaagaccaaactggccaaggatatctgtgccgaccccaagaagaagtgggtgcaggattccatgaagtatctggaccaraaatctccaactccaaagccataaataatcaccatttttgaaaccaaaccagagcctgagtgttgcctaatttgttttcccttcttacaatgcattctga

SEQ ID NO: 54376 - DNA, 201 bp, Homo sapiens
ggttaagtaagttgtccatggtatcacagctagtcagtcacagagccatcatccaaatgcagatatcctgaattcaggttctacattagactaacccaccrggaatggagcaggaaagaacagggaagactccacatttttggcctctatttggtaattatagttaactttttaggtaattatagaccaattatcctagat

SEQ ID NO: 54377 - DNA, 201 bp, Homo sapiens
tagaataggtgcaatgtaatcaaacatgtactttccaccaaacggctggttagtctccctgatggatggatgatgccatagccggggatcaacaatgggcyatgttactggcaggttggacattcagctacagggccacgtgtcatctgaactcctgctaccataatgactttgttcatattcttactgtcccattactgt

SEQ ID NO: 54378 - DNA, 201 bp, Homo sapiens
tcattgctcttttcagagtagaataggtgcaatgtaatcaaacatgtactttccaccaaacggctggttagtctccctgatggatggatgatgccatagcyggggatcaacaatgggctatgttactggcaggttggacattcagctacagggccacgtgtcatctgaactcctgctaccataatgactttgttcatattc

SEQ ID NO: 54379 - DNA, 201 bp, Homo sapiens
ggaatgatcatgctgcatttacccagttgggtgggagcccatcaaaagatgtcagtgttggagtatgtgtgaaatggtggggaaatttggaaagaagtttragaccaggctgtctaggtggggagtttgtgctccatgtaaggtgaacatatggttcttcccagcccagttaggatgcttttgagagcagaaaagtggtat

SEQ ID NO: 54380 - DNA, 201 bp, Homo sapiens
agaggatagtatttcttccttgtaggatactctttccaagctggtgccttaactgtgccttcagcaggccattccattactgtatcagcctggaaacctgyggataacacaggtatatagtgggatcagtggatccgatgaccatacacccagtgctgcacctcatttgctgtagtgtgtcttccagtctatagtgatgtt

SEQ ID NO: 54381 - DNA, 201 bp, Homo sapiens
gagaaggggtgttgcttgggcaaaatccaagaagtaggaatgatcatgctgcatttacccagttgggtgggagcccatcaaaagatgtcagtgttggagtrtgtgtgaaatggtggggaaatttggaaagaagtttgagaccaggctgtctaggtggggagtttgtgctccatgtaaggtgaacatatggttcttcccagc

SEQ ID NO: 54382 - DNA, 201 bp, Homo sapiens
tatatacaaagttctggaaaactcatccagaaatctgttgagcctcattttttaaggaaacttgcaagaggaaggttggtggagtgaacagtagccacctmcaacagctgcaactggtcttgaggttataaatgatgcttatcaccccactcctagaacactcattctagattttcctcaacctcagcccatgcctctgct

SEQ ID NO: 54383 - DNA, 201 bp, Homo sapiens
tcaccaactcatttctctggaaagcatactattagatgaagatgttcatgcagggttcactgagagtatggggaagctgaactaaggagagggagaattgrtattgtggtgcaattgcagcccaggtctcagcaatcccatagggagctttagaactgggatagcacaaatgaggtcgaggggccaggcttttataccccc

SEQ ID NO: 54384 - DNA, 201 bp, Homo sapiens
ccccatccataataggggtatattaatatcttttaagggatctgaccaatgacccaccaagatctcctgttctgagagcactacctcttggaaagcatcaytacctccacccattgagggagggaatgttgtcagagggttccacactcacaagcccaagtcggacaggggccaggataactggcacacttactctatttc

SEQ ID NO: 54385 - DNA, 201 bp, Homo sapiens
agagggagaattgatattgtggtgcaattgcagcccaggtctcagcaatcccatagggagctttagaactgggatagcacaaatgaggtcgaggggccagrcttttatacccccatctgaaccagccctggctgcaggatgctcctggaagaggacacaactctgggcaaggcagctgtttttagctgacggcgggcctca

SEQ ID NO: 54386 - DNA, 201 bp, Homo sapiens
cgaaattattcagtaacttcaagctgtgtctataaagtgtattataattcccaactctctcttttattttcctctctctcatttgtttacccatcaatccyacaagcatttactaagctctaagtataagcagaagcacattcgatgctgggatgtcttacaatacacaaagaaaaagatatccctgctattaatgagatt

SEQ ID NO: 54387 - DNA, 201 bp, Homo sapiens
aaatttaaagattcgctttgaacctatttgatcagaaagtattaaatatcactaccacatgagttaaaacaaaaaatggaataaaaaacaaaagtggtgtctatgtaatcagtgaattacttgataggacattttaactattttacagttcttcttagcaccagaataaactggttccaaggttaaaaaaaaaaaagaaag

SEQ ID NO: 54388 - DNA, 201 bp, Homo sapiens
aataatcaccattctgactggcatgagatggtatctcattgtggttttgattttcaaatgatcagtgatgttgagcttttttcatatgactgtctttttcyttttttttttcttttttttttttttttcattttgagggagtctcactctggtgcccaggctggagtgcagtggcagcttacttcatagctcacggcagcc

SEQ ID NO: 54389 - DNA, 201 bp, Homo sapiens
gcactacagcagccaacacacactcgtctcaccaaactcacaggggcatctgcccagcaagaaactattcctacctaatctaaccctcatgctattaacckagaagctctgtttaagaatcaggagcctagattatgcccctactgctttgtccataacaagtattcataaaattgcaataaaaactagaaataatcttag

SEQ ID NO: 54390 - DNA, 201 bp, Homo sapiens
gagctaggatccaaaaccaaggaactctaaggtctgtgttctccgctgcctgctcgccagcgtgcatatttaacgtggaggggtaggagggtggcaggcakggcagtgaggggggcactaaggcacccacccaggaaacaggtggctagatctcgaccacagggtgccagctgcaggctgcaggagaggacatgtgagaaa

SEQ ID NO: 54391 - DNA, 201 bp, Homo sapiens
acactgattagttttggcatgactagaagcctagctgttcttcatgagaaataatggactgagatcatcagaattctctaagagctataacaagaacatcyataaaatttaacctcagaaaacttttgaataacttcctgacactggagtattttttatattacatttccctctgctatctttaataaaattaaattggta

SEQ ID NO: 54392 - DNA, 201 bp, Homo sapiens
tttgaataacttcctgacactggagtattttttatattacatttccctctgctatctttaataaaattaaattggtatcccaataaacaaagtaacaagamaaaatgagaggttctaagtttctccctggttctcctttttaataatcaattcatcttaatttatgctaataacaattcagtcagaacacatctgttgagg

SEQ ID NO: 54393 - DNA, 201 bp, Homo sapiens
atattcttaaatatcatagagtaaaagaattctatgctgccaattcataacaaaatcaggcataatcaattgagtgaaggttaaggttggcactgtcttgmaaaattaagcagcttaaaaaggacaaacgtaacaaagaaaagggacctattctatgttcctttgaacaagaaaaaaaataaatgttgaaaccccaaatgt

SEQ ID NO: 54394 - DNA, 201 bp, Homo sapiens
ttatgaattgcatctgggtggataatataatagtataagatagatgtaatatagattacatctatattaagggtatggaaatgaagttcaacatctaataragaagacagacatttacacagatgtcatgcattcattcaacaaacatacttaagcactatgcgcccagctgttaacaagatagacacagttcctgccttt

SEQ ID NO: 54395 - DNA, 201 bp, Homo sapiens
gttcaacatctaatagagaagacagacatttacacagatgtcatgcattcattcaacaaacatacttaagcactatgcgcccagctgttaacaagatagayacagttcctgcctttatgaggcttacatgagacatgatgtgttaaaaatagaaggctgcagaaggtgctatagtctttgcctccactgggaaggagggct

SEQ ID NO: 54396 - DNA, 201 bp, Homo sapiens
acttgcggatgaggagactaaaacacagagattaggtagcttaatcacgcttacagatgtggtgagtggtaggcctgggatccagagctgctctggaactragcacgaatttgccagatggacacacacaaaaaaggaatggtaagagcactccgggcacagggaagtacaagtacagagacataaaaatggtcagaaaca

SEQ ID NO: 54397 - DNA, 201 bp, Homo sapiens
ttctccgctgcctgctcgccagcgtgcatatttaacgtggaggggtaggagggtggcaggcagggcagtgaggggggcactaaggcacccacccaggaaayaggtggctagatctcgaccacagggtgccagctgcaggctgcaggagaggacatgtgagaaacacgcatacagaggtagcaccggagacgaagtgggatc

SEQ ID NO: 54398 - DNA, 201 bp, Homo sapiens; identical to SEQ ID NO: 10379

SEQ ID NO: 54399 - DNA, 201 bp, Homo sapiens
cctagagaatgtgaaggaggaaggcggtacgcaagggcgagcaggcgccagtttgcacaaagctagtaacactcattccaagtccagccttcacttgaccrtttaaatgccacaccggaatgatttcatttaatttgcctgccctttccccggcatcccggggaagattctcgcttcccaaaccccctcccctagggggca

SEQ ID NO: 54400 - DNA, 201 bp, Homo sapiens
atgaatttgtattgctttgcacaggcaaaactataaacagtagagccaaaaagtcagaaataactgtgctgttttccctatttcttactttcaagtccacractctaattcttgggtttcccaaagacctcaacttttataatcactgaacttatgatcaacgtaaggatgcagaccactttgctagagaacataaagcct

SEQ ID NO: 54401 - DNA, 201 bp, Homo sapiens
tatcacactactcagaacagttaacaatgtaaaacttacgaattgtttatttctggcattttccatttaatattttcggactgtggttgactgggtaaccraagctatggaaagggaaagcaagcttaagggaggactactgtataccaagcaagctactgagagaagacatatatgagaggaggcaggacttgggggctc

SEQ ID NO: 54402 - DNA, 201 bp, Homo sapiens
ctgtttggagaaggtgttcagaaaatgcttttctgaccattttcatctcagctgaaacttgaagaatgagaggaatcagccatgtgatagcatcttgaagscttgggcaaattataggtacttctcttcaacacaagattttagatatctgattatttgggaaagagagatccctgcaaataccaagttatattttggcca

SEQ ID NO: 54403 - DNA, 201 bp, Homo sapiens
gtagagtggctttttatcccgggcatttaagagagggattctctatttcagtgcagatgactccatcacccctctcagaaactgggctattctgtaagggkgtgtgtgtgtgtgtgtgtgtgtgtgtgtgtatgtgtgtgtccaaccaaagacactattccaaataattaaagaatttggcattttaggtaagcccacatt

SEQ ID NO: 54404 - DNA, 201 bp, Homo sapiens
aagcattattagatcattatttttcatttttacaaacagacatattcacaatctgaatttttagtcatttagtcatttgcactaatgcaatttattgccawcactgtatgggactggatggttataataatgactaagaggtgagactaaccttagggaaatacaatccagagaaatatgtgactaaatcctgacagtaca

SEQ ID NO: 54405 - DNA, 201 bp, Homo sapiens
tttaaacagacatgcttcctagatacaatgcaagacagtatctgtctattggtttctctctgaaaaccatgcatcagtgttcctgacttacatgggagaamacaaatatgtgtacatatatttaaccataaataggaactcaattatattgggtgaaggaatgactgaataagtgagaagagaagggagggaaaaagaaac

SEQ ID NO: 54406 - DNA, 201 bp, Homo sapiens
actcaggctatacatttaataaagaacttttggacatgacccagttgctacagaaatcaaaggtctgtctactcaggggtgttctttatttttctaatagrccaattaatccatctttctatgataagggtaattttgtattaaagttgtttcatttgagagaagatgttcaatcctgtctggaataaagagagttgatcc

SEQ ID NO: 54407 - DNA, 201 bp, Homo sapiens
ctttgagtggtcctacttggttctaagaatttgagcaaagtacagctagccacttgtagtaggcaataatgtatatataaagcataaaccagcaatgtttycacattttttgaaacagcgagattaaatccagaaacatccaacctatttctcttactacaacaaggaaaccagaaggaatgtcaaaggaagacactgaag

SEQ ID NO: 54408 - DNA, 201 bp, Homo sapiens
tagattttcatagacaaaaataaataaatatataaataaataaaatgaacagcatcagttgttaattgtggctatctctagatggtgacgttattggacawtttttagtttatttgcctctctgtgtgtttcttcaattaataagtataatattataatcagaaaaatgtggcataaaaaataaagctagatttattatac

SEQ ID NO: 54409 - DNA, 201 bp, Homo sapiens
ctcatctaagccgagttctgccgtattggaatacacatatcatctcagggcagtttttttgttctttaaattggatgcttttggaaaatatatataagaargggtacagtatagcttctagaggcctcatgggtctcatcataacagctactcattagtggagtccccacattccacagtctaggcatcaacttgtaagtt

SEQ ID NO: 54410 - DNA, 201 bp, Homo sapiens
catttgtgacaatcagcatcagttttagcccttccatcttatatttatattttaatagctcatttttaaatgaactatttcatttactgacttgcacaatrtcttaatttccttcctccaacccggttagtttgaattgttatgggactcttccattgctcttatgattacagtcccatttcaaatcatcacgttatttct

SEQ ID NO: 54411 - DNA, 201 bp, Homo sapiens
acacacaagtgctgagaatctgtcaaaagacttcacacttatcaagatgattaaattagaaagaatggcaggattgtcatctttttccttaagcatttctrtatagttttgtcacagttttgttttgttctgtttttatcttgagacagagtcttgctctgttgcccaggctggagtgcagtggtgcaatcatggctcact

SEQ ID NO: 54412 - DNA, 201 bp, Homo sapiens
cttttaaaatatttttcatctcaaagagccgaagaaagaatttataattacaagggttttatgaacttttaagttcaggggtacctgtgcaggtttgtcaygtaggtaaacttgtgtcatggcacaagtttgttgtacagattatttcatcacccaggtattaagcatagtacccattatttatttttcctgatcgtctaa

SEQ ID NO: 54413 - DNA, 201 bp, Homo sapiens
gtagaggccttggcctcccaaagtgctgggattacaggcgtgagccacttcacccggcctgtcacaaatatttttattccaaagtgtttcagatgatccakaatgcagctgttataactgcatcatgggtcaaagacagcttcttggatgaggcggccaactttcaaagttagcaaggatctgacacattttcacctcggt

SEQ ID NO: 54414 - DNA, 201 bp, Homo sapiens
tacctctatttcatctcttactgtatattgcctcatcttttattctccagctgcaataaatttcccatcattctcatgtcatttcactcccacactttcaktttttaatcttctgcttgaaaagccttctcatcctcttgcctagctgccttctacttttctactttcctatgattttggcatcacctcttccaggaagcc

SEQ ID NO: 54415 - DNA, 201 bp, Homo sapiens
acccctccatatctctatattttcacatattcgattataatcattagtttattcccctactaggtcacaaattttcagagtgcaaggaatggaaagcaaarcagaaaatgtacttcatcttgagtacaaactatgtaatagaaaatgcctatccaggtacacctgcatataaaaattaatttctggagtctgactctgcaa

SEQ ID NO: 54416 - DNA, 201 bp, Homo sapiens
actgtgacttttgtttcttatgtcttttaaaattagaaattactgccatattctctagaaaagtactatccagaagaaatagaactatgaagatatgaaaytggttttactaggaaacacacatatacacagacacatacacacaagacatagtgtttgtacacccaggctcagtgattcagaatcttttttgtgttgcag

SEQ ID NO: 54417 - DNA, 201 bp, Homo sapiens
taacaaggcaagtctgggactcaaagccaggtcttgtgacttcaagtgcattactgtttacactgtgcaccatttacattcctcagctgctctctcccctraggcctgagttgattgcacagcccctcaggcagtacaggatagctctgcagagtggctgacagaccctaggacaggaagcaggcagagaagggaggaacc

SEQ ID NO: 54418 - DNA, 201 bp, Homo sapiens
ctgtgttgtccaatagagtagccactagtcatatatattgccatttcatttttattttatcaacttaaatttaacattcaactgctctgtcacaccagccrcattttcagtggtcagtacacacatggctggtggctagtacattgggcagtagatatggaacccttccgtcacagaacgttccaatggacattgctgctc

SEQ ID NO: 54419 - DNA, 201 bp, Homo sapiens
accaacacacacagtcctcagcaccagaactagggcacactgggccaggtattaggccttaagttgtgggttgaggagaattctgagaattcctcgaaaarggcaaatagaagaatgagtaagggctgggggacttccagggctctgagcagaggttattaagtacagaaggactttgaattttaacaaccgacatggcca

SEQ ID NO: 54420 - DNA, 201 bp, Homo sapiens
catttagtcatttgcactaatgcaatttattgccatcactgtatgggactggatggttataataatgactaagaggtgagactaaccttagggaaatacartccagagaaatatgtgactaaatcctgacagtacagtgtgagaggtgctccagaagaggagccaaaacacaaattttgacataagccattaacaaaagaa

SEQ ID NO: 54421 - DNA, 201 bp, Homo sapiens
gtttattgaagtgtcattaaaaagataaaacattgtacctaggtatttgcatttatttcaaatcttttctaagtggcatattagtttgattataaatctaygagggattgttttgctttgtattgtaatgaatttttagaaatttaaattgcgtactcttacaaaagataggagagcatattgtcagcaacgaagatgtac

SEQ ID NO: 54422 - DNA, 201 bp, Homo sapiens
tctatattcaaaaaaaagcaattaactgccataattagggaaaactgtttaaagcatactgcatttacttggccacagcgccatctcatggtaattttttwaagtgctaccgtagccaaattgaactaagtcactgtactgctttcagcaaagggtgctcctcccatttgtgcatcaatgagacatatttataaagtgcta

SEQ ID NO: 54423 - DNA, 201 bp, Homo sapiens
taaactgacagatttcttgtgtcacagttccggaggtcagaattctgggaatcaaggtattggcaggattggttccttctgacctgtgaaggagaggctgytccatggcctcttcttagctctggggggacattagtcaatttggtgttccctgacttatagttccgtctcccaatctctgccttcatcttcacataatgt

SEQ ID NO: 54424 - DNA, 201 bp, Homo sapiens
cataagccattaacaaaagaaatgttttgccaggcgtaagggggaagaaagagaacccccaaatagagaccatccaagcttaccgtgccacactcacatamctccagacactagaaattttcaaaccctgcattcatcagccagtgctagcttatcatagttaagtacagttgccagtgggcttttttcaaatactaaaaa

SEQ ID NO: 54425 - DNA, 201 bp, Homo sapiens
attgctgtttggaccatatcagtaggtaagtggcaacatatttcagagtctcatttgaaatgacagttcgtgctttctgaaaagacttgttccattttgtkgtactgaaacctgacatcctcaatctactgttttgggtggtgcaagatatgttacaacatcataattatcagattcgcttcaggaaagaaaaatctgttt

SEQ ID NO: 54426 - DNA, 201 bp, Homo sapiens
agagagggattctctatttcagtgcagatgactccatcacccctctcagaaactgggctattctgtaagggtgtgtgtgtgtgtgtgtgtgtgtgtgtgtrtatgtgtgtgtccaaccaaagacactattccaaataattaaagaatttggcattttaggtaagcccacattctggttaattgagaattgccacttatgta

SEQ ID NO: 54427 - DNA, 201 bp, Homo sapiens
gaaacttgaattagtccaagtctcctttggtttctctatcttttcactttctctcctagggggaagaagtgaaattgcctccatttgttgtatctttattkttgttcctgccatacttcatttccctccccagaggtccagagagagatccaggcactgccccagcctgcagctgagtggcttggcatccaggaacagaga

SEQ ID NO: 54428 - DNA, 201 bp, Homo sapiens
aaactccaaagttattttgcataataattactaattgagatgcaaagtattaaactaatgttttcatatatcctttttgcacatacgcttgttaatattarcacttccatttgtaatatacagagtggtcaaataaaccatgcaatacagcatgctagattttataacctctcaaggacaggggctatgtcttatttgtct

SEQ ID NO: 54429 - DNA, 201 bp, Homo sapiens
gactattcaggcaaccaggacagaaagggctttgggttacctgtcctcacttccacttctgggagatcatatggtaagttagcatctaccagaatacaaayggaaacttgaattagtccaagtctcctttggtttctctatcttttcactttctctcctagggggaagaagtgaaattgcctccatttgttgtatctttat

SEQ ID NO: 54430 - DNA, 201 bp, Homo sapiens
ggaatgctaacacaatagaattgtcttatttcttctccttttcttgcctctgagcttttctcctcattcccctctgaatctagctgctttccgtttatgayttcagttcaatttcctaccagctattatgagataactaggaccttttaaagaataaatttgtattttcccacttagtcagctttccattcctgcctacaa

SEQ ID NO: 54431 - DNA, 201 bp, Homo sapiens
ctggaggacattcccagccccacagcctgaaacaaactatctgaggaatccacttgagattgtctctcctgggaccctccaggtttatgcccaactccttyatacggctattagtcagcctaagaagtacatgtcagagactattcaggcaaccaggacagaaagggctttgggttacctgtcctcacttccacttctggg

SEQ ID NO: 54432 - DNA, 201 bp, Homo sapiens
ttttattgcatttaatcgtcacaactcagagaggaaacttgttttgttagctaagaatcaaatcctagacttgacactaagtccactgtgctggtcccccygctatttgataatattccaaagcaaaatacccatgctaccgatgactaggaccccccagctcagtcgcttgggctagtttttcctgtagtctttcaggat

SEQ ID NO: 54433 - DNA, 201 bp, Homo sapiens
ttctccagccagtggggtggcttcaggagagggctgggactggggatctcaaccttagcagcacattagaatcatctggggaggtttaaaacagcctgatrcacttggcctcacctggaatgcacaaaatcagaatctctatggattcaattcactatcagtatttaaggctgccaggtgattccagtgtgctgccaacaa

SEQ ID NO: 54434 - DNA, 201 bp, Homo sapiens
taaccttcattttcttacttgcacctccacccaatcactaaatcctgctgatgctccctgccactgtcttaggagtcccccacttttgtccccagtggcamtgtttctcatttcccaccttgcttactgcagcagcctctttactggtctagtttccctctaatccacccaccaaacagccaggctgtcatctgaatattt

SEQ ID NO: 54435 - DNA, 201 bp, Homo sapiens
gttcgtgctttctgaaaagacttgttccattttgttgtactgaaacctgacatcctcaatctactgttttgggtggtgcaagatatgttacaacatcatarttatcagattcgcttcaggaaagaaaaatctgtttatgtcactggctgacaacatgaatttgtattgctttgcacaggcaaaactataaacagtagagcc

SEQ ID NO: 54436 - DNA, 201 bp, Homo sapiens
ttgccttcatatacttaattccttaataatcatgtttcattttctgttcaactccaggtatatccatgccaataccagtctttgggctacaggacgattcraaggtctttaaggaggggagttgcttactcgccgatgataactttgtcctgatcggctcttttgtgtcatttttcattcccttaaccatcatggtgatca

SEQ ID NO: 54437 - DNA, 201 bp, Homo sapiens; identical to SEQ ID NO: 10375

SEQ ID NO: 54438 - DNA, 201 bp, Homo sapiens
attgccgtaaagaaatacctgaggctgggtaatttataaagaaaagcggtttaatcggctcacggttctgcaggctgtacaggaagcatggtggcttctgsggaggcctcgggaaactttcaatcatggcagaaggggaagcaggcacaaattacatggcccagagcaggaggaaggtgagggaggtgctacacacttgca

SEQ ID NO: 54439 - DNA, 201 bp, Homo sapiens
gatccccaccatgtgtccacgtgttctcacgattcagctcccacatattagtgagaacatgcagtgttaaacacttctacattttgtacatttttctcctyttatttcttgagatagctttactgacttttcttcttctgttactagtcctctcatcagctacttctaatctgcctaagacccatctcttgttttcttaat

SEQ ID NO: 54440 - DNA, 201 bp, Homo sapiens
atgtaatactgtcttacattcctggaatattgagtttgtatgacaaagttggttggtttatgattcttacaagttttctttttctagctttattaaatgayagagaagtttccactttccctaagtcttgaagtctttaagtagaaattacatgtttttgagaggttatgtagaacttggttccaaatctcttcatcctgg

SEQ ID NO: 54441 - DNA, 201 bp, Homo sapiens
gccttcctaaatcaattgtgtatattttgttttccctataagatcttagacatcatgattatattgaacttgggtgatgtgtacatagggttcacagtacyattttctgtagtttcgtgtgtttaaaattttccataataaaaagcttaaaaaaaaaagatcttagacatcatgaaatgtctcaaaggtcttttgctttac

SEQ ID NO: 54442 - DNA, 201 bp, Homo sapiens
actactaaaaacatagaacaacctttatgggacaattggaaatttgaacactaactctacatttaatattaaggaaatattaaacttctatttaggagtgrgaatggtattgtgaaaatattaggtttgtctaagagtgcatggcttttagatctacgtaataaatattttcagattgaatgacatgatgtctaggatttg

SEQ ID NO: 54443 - DNA, 201 bp, Homo sapiens
tctcactctggtgcccaggctggagtgcagtggcagcttacttcatagctcacggcagccttgaactcctgggctcaagcaatcctcctgcctcagccccytaagtagctgggactacaggcacactccaccacgctcagctaatttttgtactttttgtagagatgaggcgctgctatgttgcccagagtggtcttgaac

SEQ ID NO: 54444 - DNA, 201 bp, Homo sapiens
gcaaaggacatgatctcatttttatgactgcatagtattctatggtatatatgtaccacattttctttatccagtctatcagtgatggatatttatgttgwttccatgtctttgctattgtgaatagtgctgcaatgaatatatgtgtgcatgtgtctttataacagaataatttatattcctttgggtatatattcagta

SEQ ID NO: 54445 - DNA, 201 bp, Homo sapiens
agtgcaattatacaacatttattctctttctgtctggcttatttcacttagcatactgttttcagggtctgtagtatagtacatatcagaacttcattttytatggctgaataatatttcattatatatatatgtacctcattttattcattcatctgttgatggatatgtggatttctgcttttgactattctgaataat

SEQ ID NO: 54446 - DNA, 201 bp, Homo sapiens
ggcgtcacccgcttggggagcaagggcgccccctggcggccgccgctctgagagcagcccgttccctccggagccccgcccctccctaggctgctcctccmgcctcccccagcccacggggcgtggggcatggggcttctcccacaaggaaatgccccctccttatcccgcatcagaaacacggactgaggcctgggccgc

SEQ ID NO: 54447 - DNA, 201 bp, Homo sapiens
catcatagattagtcaagttttcctgcactcagtactcctgaaatgtactgctgctttccccttgctcaccattatcagtgtggtcacttcactgcttgcsaaggattccatctaattctgaggaaaaggaacataattgcaaatcattgtgttttctgtgtgggagcttctgagtaaagcagcaatgacaggagattgaa

SEQ ID NO: 54448 - DNA, 201 bp, Homo sapiens
ccacttagtcagctttccattcctgcctacaacaaaaacatctggtgagtctaattttaagtaatcaaccttttcagtttggtgattaagagatatatatstgaatttgcatttcatttgtggaaattctgcctgggagccattcatttttcatcaagctccctgtgcttttcattactccctccctctcattttccctgt

SEQ ID NO: 54449 - DNA, 201 bp, Homo sapiens
gacggggtttcaccatgttagtcaggctagtctcgatctcctgacctcaggagatccgcctgcctcggcctcccaaagtgcagggattataggtgtgagcyaccatgcccggtcagaagtgcttcattttttgttagtctgttgatttggcctggcttatggactatgaatttctttattcttttgctaaatattctttct

SEQ ID NO: 54450 - DNA, 201 bp, Homo sapiens
tgcccggtcagaagtgcttcattttttgttagtctgttgatttggcctggcttatggactatgaatttctttattcttttgctaaatattctttctaagargaagagaagggacagggtacttgtgttgcttctggctatttaaagcagaggaataacatctgcatgctgccccttcatgcccaccctctgcccttgggct

SEQ ID NO: 54451 - DNA, 201 bp, Homo sapiens
tcctaaaacccaaatatgatcaggtttctcgcctgtctaaaatattatattagctctatctcattccttaggcataaaacatgacaggcaaaacccatcamgaattattccctgccttccatccacagccctctgtactacctgcaattcctcatggcatgtaagtctcatcatcattccccagcttccaagcatttcctg

SEQ ID NO: 54452 - DNA, 201 bp, Homo sapiens
aattggggtgaacatctgtgttagctaattagtgtcttataaagggaaaaacaaacttctcatatcttaatgacaagaagtagttttgcaagttggaggargaggatcctcggaagtttaggctcctaccttcttaccgaagccgcaagatagaagtgttgtctcctttacgtcagagagatggctccttggtcctagaaa

SEQ ID NO: 54453 - DNA, 201 bp, Homo sapiens
gcaaatgtaactacataaaatctaagcacttaggttgaaaaaatagcatgctcatttaggtccaagaggaatgacagcaaaatatattttcctatgatacygtatcttctggaaaaaaaatgcttgaaaaaataaatcaactgagtaaaccagactcaaaaccagatggtgttctgtcagcctttacactggaggacattc

SEQ ID NO: 54454 - DNA, 201 bp, Homo sapiens
cctttacgtcagagagatggctccttggtcctagaaaatgacactcctggcttgtaagacctgcgagggccttttaaaatatttttcatctcaaagagccraagaaagaatttataattacaagggttttatgaacttttaagttcaggggtacctgtgcaggtttgtcacgtaggtaaacttgtgtcatggcacaagttt

SEQ ID NO: 54455 - DNA, 201 bp, Homo sapiens
tggtcctagaaaatgacactcctggcttgtaagacctgcgagggccttttaaaatatttttcatctcaaagagccgaagaaagaatttataattacaaggrttttatgaacttttaagttcaggggtacctgtgcaggtttgtcacgtaggtaaacttgtgtcatggcacaagtttgttgtacagattatttcatcaccca

SEQ ID NO: 54456 - DNA, 201 bp, Homo sapiens
aagatgagaagtccataagagatggaaataaagaagaacccaaaagaaatttgtaaagctctaaacctgtgccaagctaattgaataatgaaaaatgtgtytagcccacagatctgttttgtttggcttgcacaatgtgttttgtttcttattatattgaacttgattgccctcaggcactatccagtttaccaagcaaca

SEQ ID NO: 54457 - DNA, 201 bp, Homo sapiens; identical to SEQ ID NO: 10364

SEQ ID NO: 54458 - DNA, 201 bp, Homo sapiens
taaaacttttcttctttgtccaggacatttatcttcccgaacgctcaaaaaaaaccctgcaacctctatgctaaaagttcattctgcttttttgtcctcgstttggtgagaaaataataaaaccaaacagtggactctcctaaaattgtgaatgaagaaaacttacagccaccacagttcagttctttaactatcattgta

SEQ ID NO: 54459 - DNA, 201 bp, Homo sapiens
ccaaatgttcccatcactgccaacaacatctaggaccacttcaactctagtatctgtacatcttccaatcagtgataaatgctgatcagtatcctacacargagatttctctccaaatagcgcaagccttgtaatatttaagtaaatgaccccaaaaatcatcttcccttgaatcatatagttctgtgttgtccaatagag

SEQ ID NO: 54460 - DNA, 201 bp, Homo sapiens
tattgcagtaatccatggctgagttctcagacctcttcccttctttatctccactcactctcttagatgatttcacctagtagcataccttaaataccaayatgccattggctatttgatgtctcttccctaaactctgtactcatccatgctactgccaactatttcttgaatgaatgaaggcaggaactatgctcatct

SEQ ID NO: 54461 - DNA, 201 bp, Homo sapiens; identical to SEQ ID NO: 10367

SEQ ID NO: 54462 - DNA, 201 bp, Homo sapiens
catgcacctctgcgccatctcgctggaccgctacgtcgccatccagaatcccatccaccacagccgcttcaactccagaactaaggcatttctgaaaatcrttgctgtttggaccatatcagtaggtaagtggcaacatatttcagagtctcatttgaaatgacagttcgtgctttctgaaaagacttgttccattttgtt

SEQ ID NO: 54463 - DNA, 201 bp, Homo sapiens
ttgattattttgctttgggtttagttttttgtttgctttgtgtgtggtttcttttaatttagatccttagtctagctggaattttaaaatatgatctaacytgtttgcttctactagtaactaaagctttttttagactcaattgatattttctcttcaagctattgatatgttcactctcttggtaaatttctaaatgta

SEQ ID NO: 54464 - DNA, 201 bp, Homo sapiens
gtcctttttacagcctttgattgccactgtctaaggcagataatcatgtcccattcttccccaagaaaagaccatcatgcacaattgtttttttctactcscatcttccaattgtacccctgatcttctgtacttcctgtctctacctcctgtccttcccaagaatttgatttctctccatctctctccaacttatgttaa

SEQ ID NO: 54465 - DNA, 201 bp, Homo sapiens
actgccaagcaaagctccctcagatttcagcccttggagaatgccccttaattcccatccatgtgtatatccttttatcctgcatttcatgcagtttcctyaaaaccctgctgacatttgctgcagtttcttatatttgtttttgtcctttcttcaagttctgtttccctctaaaccagatcccatctgctgtcttccaga

SEQ ID NO: 54466 - DNA, 201 bp, Homo sapiens
gagtgactcaggcagggtgaggaaggctgactggggagagggcatttacatggacaccaaataagaagaagccagccatggtaatatcagtagagagtggygtgttcctggcagtgggaacagcaagtcccaaggccctgatgaagtaaccagcttacggggttgaaggagcagaaagcagccagtccagctcaagtgtag

SEQ ID NO: 54467 - DNA, 201 bp, Homo sapiens
atatatatatatgtatacatacacacacaaatacacacacaagtgctgagaatctgtcaaaagacttcacacttatcaagatgattaaattagaaagaatrgcaggattgtcatctttttccttaagcatttctatatagttttgtcacagttttgttttgttctgtttttatcttgagacagagtcttgctctgttgccc

SEQ ID NO: 54468 - DNA, 201 bp, Homo sapiens
ataatttctaaataacctagtggcagaatagatctttaaaagcaagtcaaaaaatgcagatgccataaagaagaatatatacataaacagttatataagtytgatacggctaaaatcagtgtaagcaaagttaaacgaaaaatatttgcaatgtatatgattggcagaccaagggttaataaccttaaaatacaaatagca

SEQ ID NO: 54469 - DNA, 201 bp, Homo sapiens
agtgagctgagattgcgccactgcactccagcctgtgcgacagagcaagactctgtctcaaaaaaaaaaaaaaaaaaaaaaatatatatatatatatatatgaatcaaaatacaagcacacagcaaatgccttacaattgaatgaagaaactgctaattctgagaaagcagaatctgccattataataaaaatgcagagaa

SEQ ID NO: 54470 - DNA, 201 bp, Homo sapiens
agaggcacccccgctcactgccccaattacagcagctacaaatcatgccgtaggtcaagtgaagtgggtgcctgccatatttctttcaactagcctttcartattttgggaaattcccaagaatcgaaactcaaattcccacccttctttgtagctaggacattggcttatagcctcagttccaccaaagagcagcatgct

SEQ ID NO: 54471 - DNA, 201 bp, Homo sapiens
cagtgagctgagattgcgccactgcactccagcctgtgcgacagagcaagactctgtctcaaaaaaaaaaaaaaaaaaaaaaatatatatatatatatatatgaatcaaaatacaagcacacagcaaatgccttacaattgaatgaagaaactgctaattctgagaaagcagaatctgccattataataaaaatgcagaga

SEQ ID NO: 54472 - DNA, 201 bp, Homo sapiens
gagcttaacaaacccaaatcttcataatgagcaggaaacaaacctgacctttgctccagatggagacactatctccatcttgaaagattattcactattcraaaatccttcaagagatgttctggagaaattagcaactcagattcccatgcagaattggctaacagttttatatattacatacacatatgcaccaagcta

SEQ ID NO: 54473 - DNA, 201 bp, Homo sapiens
gggaggcggagcttgcagtgagctgagattgcgccactgcactccagcctgtgcgacagagcaagactctgtctcaaaaaaaaaaaaaaaaaaaaaaatawatatatatatatatatgaatcaaaatacaagcacacagcaaatgccttacaattgaatgaagaaactgctaattctgagaaagcagaatctgccattata

SEQ ID NO: 54474 - DNA, 201 bp, Homo sapiens
ccgggaggcggagcttgcagtgagctgagattgcgccactgcactccagcctgtgcgacagagcaagactctgtctcaaaaaaaaaaaaaaaaaaaaaaatatatatatatatatatatgaatcaaaatacaagcacacagcaaatgccttacaattgaatgaagaaactgctaattctgagaaagcagaatctgccatta

SEQ ID NO: 54475 - DNA, 201 bp, Homo sapiens
acccgggaggcggagcttgcagtgagctgagattgcgccactgcactccagcctgtgcgacagagcaagactctgtctcaaaaaaaaaaaaaaaaaaaaawatatatatatatatatatatgaatcaaaatacaagcacacagcaaatgccttacaattgaatgaagaaactgctaattctgagaaagcagaatctgccat

SEQ ID NO: 54476 - DNA, 201 bp, Homo sapiens
gctgggactacaggcacactccaccacgctcagctaatttttgtactttttgtagagatgaggcgctgctatgttgcccagagtggtcttgaactcctggrctcaagcaatccttccacctcagccttccaaagtgctgaaatttataggtatgagccaccacaccgggccaattacaagttgacaaaggaaaatgctcta

SEQ ID NO: 54477 - DNA, 201 bp, Homo sapiens
actttcaccttatttgactaattttgactaattgttgagaaaataagtctgaattaaagagtcaaaattgcagtttatttcagagaaatttttattctccratgcacatggtaactagtgttataccagaaagaatggtaactagtgttataccagaaagaatatcagcgagtggagctccttgaggtatcttgaggatta

SEQ ID NO: 54478 - DNA, 201 bp, Homo sapiens
gatctcatttttatgactgcatagtattctatggtatatatgtaccacattttctttatccagtctatcagtgatggatatttatgttgattccatgtctytgctattgtgaatagtgctgcaatgaatatatgtgtgcatgtgtctttataacagaataatttatattcctttgggtatatattcagtaatgggattgct

SEQ ID NO: 54479 - DNA, 201 bp, Homo sapiens
tctgtgcttccactttctcatcagcaaacagtgataataatagcacaaactcatagggtgactgtgaggagtaagtgagctcatctgtataaagcacttargatagtgcctggagcacagtaagcaccatgtaagtatttgattgtgttattttttatcattattatttactaccaccaccatgacatagtcctccctgat

SEQ ID NO: 54480 - DNA, 201 bp, Homo sapiens
tgaaacccaaactaagaaagatcctgcctaatcttaggatttaggacccaaaacaaaaagttgtttgggcctcgtggtacaaatagtgtcagctgatcagracgagaacagtgaccacaagagcaaggccaagatgagaagtccataagagatggaaataaagaagaacccaaaagaaatttgtaaagctctaaacctgtg

SEQ ID NO: 54481 - DNA, 201 bp, Homo sapiens
atcatctcactgctttttcaccaaagccttgcatgaaaattagaggaggcctctttatattatctccaccttacagatggaagcttgaaagttaagcagcytaaggtcacccagctagtgattaacagagtctggaggcaaacctgtgtcttgtgattccaaattctgtgattttcccactatattcatgctccagtttgc

SEQ ID NO: 54482 - DNA, 201 bp, Homo sapiens
cagtggcccccaattctggaataaaccggtgttcttggctggtgtgagaccatgtattagactctaaagacggtcagaagcagtaaccacaacactctttrttctacaattctgagtgtgctgataatatgggcaggagttagaagggaactatttttctgactttttctcccaggctgtccctgcaatatctaccatttc

SEQ ID NO: 54483 - DNA, 201 bp, Homo sapiens; identical to SEQ ID NO: 10372

SEQ ID NO: 54484 - DNA, 201 bp, Homo sapiens
ctttttattttttaagcatcagagctatcaaactgcattctcttatttttaaaagtgagagttaagccttttatttttcatgtataattgcccttatagtmttcataagaaattaagagttttgtataaccatttatactttcaccttatttgactaattttgactaattgttgagaaaataagtctgaattaaagagtca

SEQ ID NO: 54485 - DNA, 201 bp, Homo sapiens
ttacatttatttggggccattcccctcaagctgtgacaccttacatagaatcctaaccttcctggacctaacctcttgccttcatgcagctcaaatagctrccttcctagacagtgcagatgtttcaggaagctttgaaggacagagaaaatgataaaatctcattgtagttttgtgttgatttagtatatgggggtttta

SEQ ID NO: 54486 - DNA, 201 bp, Homo sapiens
tctgctcgggttttagggacatagtttaagagcacgtgaaatatatctaaaatcaatatgaggttaggttgggtaaatttaaagacaaaatcatcttccarcctaaaaaaaacctctttacaaatatagtagagaaagaaagcagctttattattgaataaacgctaaactagaatatgatacacatagagggaatccact

SEQ ID NO: 54487 - DNA, 201 bp, Homo sapiens
cacttagcacagcatagatgatccatggccactggaaactggtgagaataattaagaaacgatcaggtcataagaaagaaagaggtgccttctttttttttcttttttatttgagacagagtctccctctgtcacccaggctggagtgcagtggcaccattttggctcaccgcaacctctgcctcccaggatcaagtgatt

SEQ ID NO: 54488 - DNA, 201 bp, Homo sapiens
tcaaaaccctgctgcattttctacctcttgaatttcataaacttgcagtgtatgaagaaacactttacatttttctccccacttgctttgttcagaaaaayaaaagtaattaggtttattgaagtgtcattaaaaagataaaacattgtacctaggtatttgcatttatttcaaatcttttctaagtggcatattagtttg

SEQ ID NO: 54489 - DNA, 201 bp, Homo sapiens
ctggagtgcagtggtgcaatcatggctcactgcgagctccgcctcccaggttcacgccattctcctggctcagcctcctgagtatctgggactacaggtaygcaccaccactcccagctaattttttgtatttttagtagagatgggttttcaccgtgttagccaggatggtcttgatctcctgacctcgtgatccgccca

SEQ ID NO: 54490 - DNA, 201 bp, Homo sapiens; identical to SEQ ID NO: 10370

SEQ ID NO: 54491 - DNA, 201 bp, Homo sapiens
aatcaaaggaaaaatgttaggcatcaaggagacaagtgagaagaaaatttggggacaagaaatgttttcttggtatccctgaaatgaccaacaacaacaamaaaaaaacaagtatcttcaaacacttcataacttatataaagttttataacttaatattgaatttaatccacaataataatgatgattttgaaagaaaca

SEQ ID NO: 54492 - DNA, 201 bp, Homo sapiens; identical to SEQ ID NO: 10371

SEQ ID NO: 54493 - DNA, 201 bp, Homo sapiens
ccaaattttttcgccttcacaaacaaattctgtaaccattaagcaataactccccactccttccaacccaactccctggtaacctctaatctgctgtctcytaattcatctgttccagatattttatacaagtgcaattatacaacatttattctctttctgtctggcttatttcacttagcatactgttttcagggtctg

SEQ ID NO: 54494 - DNA, 201 bp, Homo sapiens
tttgactctccccaggctattttctcaccttttcatttttaatatgtttttgtagctttgctttatgtgcattttcacaagtaacatatggatagatttayttaacaaaatctgttagtctttgcctttttaatattgaaatttgacctgcccacatttgtgacaatcagcatcagttttagcccttccatcttatattta

SEQ ID NO: 54495 - DNA, 201 bp, Homo sapiens
ctgcaactcatgtctctgtgtgcctacctggagagtttactaacactttgtaattatttgaaattgggttggttcttggtgtaataaactaagtcatagaycctattgaaagagtaatgctaaataatgtattttctgaattgcttgtttattttctttttccactatggatgagtatagggtagaaaactgattagttag

SEQ ID NO: 54496 - DNA, 201 bp, Homo sapiens
ctcgaaatattttcttatcttggctcctagaacaccacattcttcacttttcctccttcctcaccaaccccacggtctcctctgccacgtctttcttatcycccttacctctaactgttgaagaagctccagattcagtctttaaactgcttcttcctctactcggatatttagggaatcacattctacctcacagctttc

SEQ ID NO: 54497 - DNA, 201 bp, Homo sapiens
ttctgtttttcttatcctaagcatctttattttgctttcatttcaaacacatttttgttcagtatagaattctaggttgacagtcatctttttttttttttcagcacttcataggtggcaaatccaacattccaggcttatattttttgtttgtaagaatccagctgtcagtcttatttttattccttcagaaacatcacc

SEQ ID NO: 54498 - DNA, 201 bp, Homo sapiens
ggaaacagtttttgctcctagaaaatgcttgtagtttctgggactgtgcaagttggactcattctactaagagcaagaaagtgaagggccagtaaccactmaatcccaattacacataaaatgcccctgggaacattctgatttaattgcctagggtgaggccaggtgattctaaggggcagtcagagttgaagaccactg

SEQ ID NO: 54499 - DNA, 201 bp, Homo sapiens
gttctgtttttcttatcctaagcatctttattttgctttcatttcaaacacatttttgttcagtatagaattctaggttgacagtcatctttttttttttttcagcacttcataggtggcaaatccaacattccaggcttatattttttgtttgtaagaatccagctgtcagtcttatttttattccttcagaaacatcac

SEQ ID NO: 54500 - DNA, 201 bp, Homo sapiens
tggtcagcgtgataagtaggagaatcaagattaatgcagagggagcaaatgaagctatttatttttaccctgatacactgtccatagttttaccccaatayactgtgccattggtgagacaaatgctgggaaggtcaaccatcttttcctcagccacactgactcccccatctcattcaggcttcatgataacaccagtag

SEQ ID NO: 54501 - DNA, 201 bp, Homo sapiens
cctccgcctcccgcattcaagctattctcctgcctcagcctcctgagtagctgggattacaggcatgtgccaccacgcccggctaattttgcatttttagyagagacaaggtttctccatgttggtcaggctagtctcgaactcccgacctcaggtgatccccctaccttggcctcccaaagtgctgggattacagtcatg

SEQ ID NO: 54502 - DNA, 201 bp, Homo sapiens
ttgagatttctttggaaagcgtgcaagaatcgttctcatctaagccgagttctgccgtattggaatacacatatcatctcagggcagtttttttgttcttyaaattggatgcttttggaaaatatatataagaaggggtacagtatagcttctagaggcctcatgggtctcatcataacagctactcattagtggagtccc

SEQ ID NO: 54503 - DNA, 201 bp, Homo sapiens
gtagctgggattacaggcatgtgccaccacgcccggctaattttgcatttttagtagagacaaggtttctccatgttggtcaggctagtctcgaactcccracctcaggtgatccccctaccttggcctcccaaagtgctgggattacagtcatgagccactgcccccacatttgaccagtcttgtaatgtgcatctacta

SEQ ID NO: 54504 - DNA, 201 bp, Homo sapiens
tcaccccaagtaagctcccactgaagccttgactatttctgttaaggacgatgccccattcttctagttgctcagatctaaaaccttcagagtgacgcagstctcttctttctctcacgtcccatatcctatcattatctgtcatcaagttctgttggctctacctttaaaacatacgcagaatctgaccatttctcacaa

SEQ ID NO: 54505 - DNA, 201 bp, Homo sapiens
ccccatagacttcatataccacctttgccatctactgcattccatgtgtatttaggtgtttattgactgtttctactgatctgtctagtcgttcaccacarcatacttttaattaaggatttttttattgtctctgatttagtactttctcttttttttttttaacttccctgaccattttcacttgcttgtgagtttcaa

SEQ ID NO: 54506 - DNA, 201 bp, Homo sapiens
ggaaacaaaagaataaaaaaaagttacatagaatctatactagaagtctgaggtgtgtgccctgaggagggggcaagcggaaaatgtaaaaaggaaaaagrcagatctaatgaaggacctacagagactcagcacaaatattctcttgagttttcttctagtgtttctgttttgattattttgctttgggtttagtttttt

SEQ ID NO: 54507 - DNA, 201 bp, Homo sapiens
ttcttaattttaattcctacacttttagttctagattttttcatttaattctttataaattccaggtttttagaataattctccatgttttcatctatttycttaaatattaatcacaagttatctggatctctcttttctgggttgtgggattacctagggatttctcttttctgagttttggggttgtttttctcttca

SEQ ID NO: 54508 - DNA, 201 bp, Homo sapiens
gttatctggatctctcttttctgggttgtgggattacctagggatttctcttttctgagttttggggttgtttttctcttcattctgtctgttgatatgtytggtaatttttttaattgagtactgtgtatgcctgataattttttttttttttttttgagacagagtctcactctgtcgcccccgctggagtgcagtggc

SEQ ID NO: 54509 - DNA, 201 bp, Homo sapiens
ttggaattgcatgtaacttcatgtatctactttctagaccttttgactggcatactttttgcactttttttggtcttattttttacttctttttttatgarcaacctcaaattctatatggaatgaagtgaatgtatacaagcaaatgtaactacataaaatctaagcacttaggttgaaaaaatagcatgctcatttagg

SEQ ID NO: 54510 - DNA, 201 bp, Homo sapiens
atgagcaggaaacaaacctgacctttgctccagatggagacactatctccatcttgaaagattattcactattcgaaaatccttcaagagatgttctggaraaattagcaactcagattcccatgcagaattggctaacagttttatatattacatacacatatgcaccaagctatctcataatattgctacaaattcata

SEQ ID NO: 54511 - DNA, 201 bp, Homo sapiens
ggaattgcatgtaacttcatgtatctactttctagaccttttgactggcatactttttgcactttttttggtcttattttttacttctttttttatgagcracctcaaattctatatggaatgaagtgaatgtatacaagcaaatgtaactacataaaatctaagcacttaggttgaaaaaatagcatgctcatttaggtc

SEQ ID NO: 54512 - DNA, 201 bp, Homo sapiens
catttctgactgtttacatttctcataaaagtgaaagcaattatgggaacagtgttaatagggaattttcctcaggggaatgaacttcttttagattctgrttatggccttcagaactcctcccctctagccctttcctcactgaactgccttagccagcacttgctcacctgcctatttttgcggacatttgaatgaaag

SEQ ID NO: 54513 - DNA, 201 bp, Homo sapiens
aaagtcactatttgaagtcctggctataaaaattagttccagcagctttcacctaaagctggcccaagtctgaaatgaaccaaattgcatgagctctattrtgtgcccctcttgtaatataaaaatctaataaaagtaaatagcaaagtctaatagataatcctaacagaggagcaagcactaaggtgtggtagctgagga

SEQ ID NO: 54514 - DNA, 201 bp, Homo sapiens
tagctctgcagagtggctgacagaccctaggacaggaagcaggcagagaagggaggaaccacgaggccaggctgaggctgaagggcgagtcagctttctcsgtaagcctatcaggaagctgattgcttaatctaactgagtctgtgtgggcctgcctcctgggctaatagcacagatgcattgctccgaaccctataaaca

SEQ ID NO: 54515 - DNA, 201 bp, Homo sapiens
agctaagaatcaaatcctagacttgacactaagtccactgtgctggtccccccgctatttgataatattccaaagcaaaatacccatgctaccgatgactrggaccccccagctcagtcgcttgggctagtttttcctgtagtctttcaggattggaagtagagtggagttgtcaggtcctgttacaaaagtagactaact

SEQ ID NO: 54516 - DNA, 201 bp, Homo sapiens
gacttgacactaagtccactgtgctggtccccccgctatttgataatattccaaagcaaaatacccatgctaccgatgactaggaccccccagctcagtcrcttgggctagtttttcctgtagtctttcaggattggaagtagagtggagttgtcaggtcctgttacaaaagtagactaactggaactgtagacttttttc

SEQ ID NO: 54517 - DNA, 201 bp, Homo sapiens
ttattatttactaccaccaccatgacatagtcctccctgatgcactgttagcatgtaaagatggatgattattattaactaggatattagagaaagggctstgtctagggaaagtcctcaaattaactagctttaccttcaacttctataaagccctactttgtcagaattgttagcccccaaatgatctatatttgggca

SEQ ID NO: 54518 - DNA, 201 bp, Homo sapiens
gctgagagtcgtagatgctgccttggaagagtgtccacgctaccctggacaggggcctgcctgcccacccagtgaccatggcagggcagagaaaaagcaaygtcagcccagtatcttctccagccagtggggtggcttcaggagagggctgggactggggatctcaaccttagcagcacattagaatcatctggggaggtt

SEQ ID NO: 54519 - DNA, 201 bp, Homo sapiens
ccagtccagctcaagtgtagtaagaaaggaagggagtgagaagagagggggaaggagaggtcagcagagccacatctctgagggcctgcagccaaagtaargagtttggatggtattctcagtgcagtgcggggtctctgagggtcttaggctcagaggtacacaggtaaggatgggagccccttgagggcagtggggaag

SEQ ID NO: 54520 - DNA, 201 bp, Homo sapiens
aaccttagcagcacattagaatcatctggggaggtttaaaacagcctgatgcacttggcctcacctggaatgcacaaaatcagaatctctatggattcaaytcactatcagtatttaaggctgccaggtgattccagtgtgctgccaacaaccactgagagcacacagcaagggaagagagcaacctgctggcttctgagc

SEQ ID NO: 54521 - DNA, 201 bp, Homo sapiens
ctgtgatcactggagagttttgtgcttcaaaacgcgtacatcctgtgtaaaaatgatcattggagagttttgtgcttcaaaacatgtacatttaatgtagraatttttataaattaccccatacagtcataaaccaataacttacccatcattctgaatctacttgatttttgcttctttatattcccaaccaatattcca

SEQ ID NO: 54522 - DNA, 201 bp, Homo sapiens
ggaagggagtgagaagagagggggaaggagaggtcagcagagccacatctctgagggcctgcagccaaagtaaggagtttggatggtattctcagtgcagwgcggggtctctgagggtcttaggctcagaggtacacaggtaaggatgggagccccttgagggcagtggggaaggtcttgtggtaattcaggcaggagtcc

SEQ ID NO: 54523 - DNA, 201 bp, Homo sapiens
gttgccagtgggcttttttcaaatactaaaaatatattgtgttgccctttgccaccacctgtgcctgtcccagagctggaaattgtcataggatagggatmcatgtgctccaggaggcacagggttgctcactgacaccaaccttctgcctcatagggtaccggtggcctctgccgagcaagctttgtgcagtctggattt

SEQ ID NO: 54524 - DNA, 201 bp, Homo sapiens
ttaaggctgccaggtgattccagtgtgctgccaacaaccactgagagcacacagcaagggaagagagcaacctgctggcttctgagctctttctcctcccmgcccaagggttaggggattgggagtcagagaagtggcccaggcagatgagtatggaggtgtccagcaagatgtggacagatggaggatctgggagcccac

SEQ ID NO: 54525 - DNA, 201 bp, Homo sapiens; identical to SEQ ID NO: 10365

SEQ ID NO: 54526 - DNA, 201 bp, Homo sapiens
ggtaaaattaggatagattattaggtagacttattagaatgctggtgagtcttttgcaaaggcaggataatggaaagagactcctaagtttttaagctgtrtatctggatagatggtaggaccatttactgggataaggaaaggtggggggtgagcgagtgcaacccagagtcctagtgtgacggtgtaaggttagggatg

SEQ ID NO: 54527 - DNA, 201 bp, Homo sapiens
agatgtggacagatggaggatctgggagcccacatttcaatgctagaggccatctgccctaaggtccaccttccccttcttcctaatcaagatcaccaggwggcgcacaggctgtaaccccttctcctggtgtacgatattaatcacggcatcttatatcccctgaaggggatataaagtcacaagaaaaaatttctaggc

SEQ ID NO: 54528 - DNA, 201 bp, Homo sapiens
tcggagacatccaaattgagaggccaaggaggcagctaaatgtctcagttgttcattacttattatgacaatgcttagcccttggggtggaggttttgttrttttcagtttcctatctcctgtttctattcctgcttcccacgtataagtaatatcagatagcagtaatttccatatgcatctcaaagttctttacgagta

SEQ ID NO: 54529 - DNA, 201 bp, Homo sapiens
aaagaaaataagcattgtaagaaatagcagagaaaattgtaatttcaaaaaatgttgatcttggcattgtgcattaaagacttgcagtaaaacataactgstccttagcattaagttcttaaaagatggtttctatagccagtcttcccatagatagcatgtaaatggctctaaatgagaaacgtatagcccctgcaacac

SEQ ID NO: 54530 - DNA, 201 bp, Homo sapiens
tatttactatataagggtagcaattctcatttatatttctcatgatcatctcttgaagggtacactgttaatccccattttatgggagaaaaaaaactccrattaaatgacttgcttaaaaccagaggggatccaaatttgggttttctcattgcaaactaatggctttttttctcctgtatcagtggctttccaaacata

SEQ ID NO: 54531 - DNA, 201 bp, Homo sapiens
ctatagccagtcttcccatagatagcatgtaaatggctctaaatgagaaacgtatagcccctgcaacacaagcacagataaaaggaggcctgtccccacaraaagatttcataggtaggacactgcatgaattccaggctccggatctaagagccagccttgagcagcaatgaagcagcaactcttcaagcagcaactttt

SEQ ID NO: 54532 - DNA, 201 bp, Homo sapiens
gttttccagaggatacatgctatgtaacttcacaacagactgaagcagaagcagatatatttccctgtaagatcctagttttctgcttatatctctgtatmctctgcctccctagtctttttttcttttttttttttttttttggagtgatgaattaatgaatggtagtgaaggtgttagattgtaaagtaactgattata

SEQ ID NO: 54533 - DNA, 201 bp, Homo sapiens
ggagtgcagtggcaccattttggctcaccgcaacctctgcctcccaggatcaagtgattctcctgcctcagcctcctgagtagctgggattacaggtgccygccaccacacccagctaatttttctatttttattggagacggggtttcaccatgttagtcaggctagtctcgatctcctgacctcaggagatccgcctgc

SEQ ID NO: 54534 - DNA, 201 bp, Homo sapiens
caccaggtccctgtcccgacatgtggggattatgaggattacaattcaagatgagatttgggtggagacacagaatgaaaccatatcaattggtgtaattkagtgcttattagtcatattaggggctagaatttttctgcccatctaaggaaagatctatctccaaggaaatatacatatatacaaatttttcagatttta

SEQ ID NO: 54535 - DNA, 201 bp, Homo sapiens
ctgcatgctgccccttcatgcccaccctctgcccttgggctgcgtcaggatcctgtatgctcttgaggcttccactctctccagatcagtcttttctgggytaagagataggaatcgtcaccatgcaaggagctaaggtggatcttctgatcagtttattgtcaccagcatcctctgtgtcctagtatcctactccttcat

SEQ ID NO: 54536 - DNA, 201 bp, Homo sapiens
attagccacaataagtgtccttatgaacagctctgatgtcatttatctccaccttccaagaatcctggatgggcttgcataggcaagtgacaaatattgtyaattaagtctttgaagataatggcaaatgtcactaagaaagatttgtgttgaatattacatcaactcagcgttctttcctggccacgatggccaatgtga

SEQ ID NO: 54537 - DNA, 201 bp, Homo sapiens
aagcagaagcagatatatttccctgtaagatcctagttttctgcttatatctctgtatactctgcctccctagtctttttttcttttttttttttttttttggagtgatgaattaatgaatggtagtgaaggtgttagattgtaaagtaactgattatagactcaaccaccttcccctcaaattcctcaagtacctagctc

SEQ ID NO: 54538 - DNA, 201 bp, Homo sapiens
tttttcatcaagctccctgtgcttttcattactccctccctctcattttccctgtggtcagcctgcctgagtaagcagctctgtttcactggtctcaagcyctgcaatgtaaaaccattagcaaatcttaataatagtaacccatcaaatttcattatttcagtaatggaatctgtcaaggtcagccactgatggctgtta

SEQ ID NO: 54539 - DNA, 201 bp, Homo sapiens
tggagtaaatgaaatctcagagagtagaggctttcatatcactcactgaaagacagtaaaaccaaaaggtcttcatcttgggctttcctgagctggatgggaagtttggaggtctcagccaaccagactgttgagtgataaaaagtgaaactgtgaagaagcttctagaatcctagaagctctaggaaacagtgggtaaga

SEQ ID NO: 54540 - DNA, 201 bp, Homo sapiens
gttcttcttagcaccagaataaactggttccaaggttaaaaaaaaaaaagaaagtaaaatagatgcaaaaataatcactcataactgaagatcatttcacytttgaatgagaatttgtctctgaaggctaacttttctaggcaaagtcaggaaacaatggcagtggccgggtgcggtggctcacgcccagctactgaggca

SEQ ID NO: 54541 - DNA, 201 bp, Homo sapiens
gaaatacatattctcagggcccattcccagagaatctgagtaggaactaatgggaagtccaaaaattgggacactctgagaagcactgcctacactatcartttaggattggagcagacttttaacatctactcatgaattatactgcatgtacacttttttaaatttcagggcttttgtatatagagatgcaaggtatta

SEQ ID NO: 54542 - DNA, 201 bp, Homo sapiens
ggcactcttctgaaatagttcagaaaatcatgtcttatgcaggatatgtctagaattaaattacattttgataattctttccagctctataattccatttyctactgttgggtttcaacacctaaaattgtcagcaagcctctgaacaaagatgcttttgttctgttggcagagattctacttctaagtttccacatgacc

SEQ ID NO: 54543 - DNA, 201 bp, Homo sapiens
tcatgtcttatgcaggatatgtctagaattaaattacattttgataattctttccagctctataattccatttcctactgttgggtttcaacacctaaaaktgtcagcaagcctctgaacaaagatgcttttgttctgttggcagagattctacttctaagtttccacatgacccgcagagccatactcagccagttaggt

SEQ ID NO: 54544 - DNA, 201 bp, Homo sapiens
aggagaggagcactgccaagcaaagctccctcagatttcagcccttggagaatgccccttaattcccatccatgtgtatatccttttatcctgcatttcaygcagtttccttaaaaccctgctgacatttgctgcagtttcttatatttgtttttgtcctttcttcaagttctgtttccctctaaaccagatcccatctgc

SEQ ID NO: 54545 - DNA, 201 bp, Homo sapiens; identical to SEQ ID NO: 10373

SEQ ID NO: 54546 - DNA, 201 bp, Homo sapiens
gagctgtcaagtgtcaagtggccatctatgcttgtcactaccctgaaacaaaggatccgcagggccaccacttggcccaccccttctcttgtccctgagtrcagtgacccttcccctcctctgcccacagatgcaagagaatttagggacatctccttgcctggccagttgtctcatacttagaagcacaatacggtaaaa

SEQ ID NO: 54547 - DNA, 201 bp, Homo sapiens
gtcaggtttccagggcttgcatgactgaattccctggacagaaatgacactagtgacactgtggcaggtccttctgttgtcttgggtgagaaactgattcygtattaacatagacctctgtgcaaagaactgattccttgtcaacacaacacctgtgaaaaaagtcccagatttcatatgaccacccttcttcccacagag

SEQ ID NO: 54548 - DNA, 201 bp, Homo sapiens
gagtaagtgagctcatctgtataaagcacttaggatagtgcctggagcacagtaagcaccatgtaagtatttgattgtgttattttttatcattattattyactaccaccaccatgacatagtcctccctgatgcactgttagcatgtaaagatggatgattattattaactaggatattagagaaagggctctgtctagg

SEQ ID NO: 54549 - DNA, 201 bp, Homo sapiens; identical to SEQ ID NO: 10361

SEQ ID NO: 54550 - DNA, 201 bp, Homo sapiens
ctagtaccatcggcataaccaacaaaatgagatatagttaaacaagagtcccagtagttataaaacttttcttctttgtccaggacatttatcttcccgarcgctcaaaaaaaaccctgcaacctctatgctaaaagttcattctgcttttttgtcctcggtttggtgagaaaataataaaaccaaacagtggactctcct

SEQ ID NO: 54551 - DNA, 201 bp, Homo sapiens
ttgtctgctaatctttacttaagacttttttgttttccttttattagctaagcaacattataggagctgaaattcctgacagcagctgtggcaattcagcytaagaatggctgagaactgtaacccaaagtacatccaattactatgggattaacactggatgtatttttaattgactttcttaatgtagaatgtgtacat

SEQ ID NO: 54552 - DNA, 201 bp, Homo sapiens
ttggggacaagaaatgttttcttggtatccctgaaatgaccaacaacaacaacaaaaaaacaagtatcttcaaacacttcataacttatataaagttttakaacttaatattgaatttaatccacaataataatgatgattttgaaagaaacattcaagactttgaagatttcattctaaactaagaacattaatgatgca

SEQ ID NO: 54553 - DNA, 201 bp, Homo sapiens
aaggagaagaatcggaactcaagcatgactatataaatgataagcttttactgtttctaatttccactgtgctaaagatcagaaaatattttctataaggrgccaaatagtacatgttttaggttctgttgtggtgtgaaaacagccatagacaataagcaaatgagtgaatgtgactatgttccaataaaactttattta

SEQ ID NO: 54554 - DNA, 201 bp, Homo sapiens
taccatccaacaacagcaacaataattaccacaaacacaacaaccacaacaacatatactactacactactactaccatcacatctatttatttgagcccktagtaaatgtcaagtattatgttagatattttaatatatccttacaataccagcactatacagtggatattatcatcatctccatgttctatataaggaa

SEQ ID NO: 54555 - DNA, 201 bp, Homo sapiens
tattatgctggtggaagatcaagaagaggggactctacaccagtttaattactgtgagagatgcagcgagtcacagaataacaaatgtatctcatgtgtgraccctgaagacaaatgtaagttctcatgccgctatattttattgctgtgtaattttctttccggtttgaaatcatgcttggccaacatgtaatcatttca

SEQ ID NO: 54556 - DNA, 201 bp, Homo sapiens
  misc_feature (1)...(201): n = A,T,C or G, or insertion/deletion polymorphism (see Tables 1-2)
agttatcaccacagacgtgcctagccaccctgagcctatgtggccaatgtcagtaattccactctggacacaaacactgttggctttggatggaagtgccngacactcacagcactccgaggacatactgttttctagccttatttatgttctctcttcacccttcagcctaaaaaattaccacagtgccacttacctacc

SEQ ID NO: 54557 - DNA, 201 bp, Homo sapiens
cagctagagatttaggtctggaactgagagaaataatcagctatgaaggtacagacttggccacaaacatattgaaggcatgagagtggttgaatttgtcyagggagaatgtgaagaacagaaggtgatagaactgtagcaaaacccaactattgaggaaaatattttcatgcctgcaaaaagagagagatcgaactgcct

SEQ ID NO: 54558 - DNA, 201 bp, Homo sapiens
acacctaaaattgtcagcaagcctctgaacaaagatgcttttgttctgttggcagagattctacttctaagtttccacatgacccgcagagccatactcakccagttaggtgtcaaaaatgcagggaaagatactgaaacctcttactggcctgaccaatgcatgcagcgttatctgcaactcatgtctctgtgtgcctac

SEQ ID NO: 54559 - DNA, 201 bp, Homo sapiens
tttagtggcataaattacattcacaatcttgtgctaccatcaccactatctatttccaaattttttcgccttcacaaacaaattctgtaaccattaagcartaactccccactccttccaacccaactccctggtaacctctaatctgctgtctcttaattcatctgttccagatattttatacaagtgcaattatacaac

SEQ ID NO: 54560 - DNA, 201 bp, Homo sapiens
ctgttccagatattttatacaagtgcaattatacaacatttattctctttctgtctggcttatttcacttagcatactgttttcagggtctgtagtatagyacatatcagaacttcattttttatggctgaataatatttcattatatatatatgtacctcattttattcattcatctgttgatggatatgtggatttctg

SEQ ID NO: 54561 - DNA, 201 bp, Homo sapiens
tcactattcgaaaatccttcaagagatgttctggagaaattagcaactcagattcccatgcagaattggctaacagttttatatattacatacacatatgyaccaagctatctcataatattgctacaaattcatagtaaacagtggaacaagacagattcaaattgaaaatgatccctttcctgagatgcttttaacttg

SEQ ID NO: 54562 - DNA, 201 bp, Homo sapiens
tcgaaaatccttcaagagatgttctggagaaattagcaactcagattcccatgcagaattggctaacagttttatatattacatacacatatgcaccaagstatctcataatattgctacaaattcatagtaaacagtggaacaagacagattcaaattgaaaatgatccctttcctgagatgcttttaacttgtcaagtt

SEQ ID NO: 54563 - DNA, 201 bp, Homo sapiens
gctatctcataatattgctacaaattcatagtaaacagtggaacaagacagattcaaattgaaaatgatccctttcctgagatgcttttaacttgtcaagktatttggataaccttcattttccatgatgaaggaaatcagtcagcgtcagcctttaaatgtaagtaagtatttggcacctagcacatagtaggcatttta

SEQ ID NO: 54564 - DNA, 201 bp, Homo sapiens
gttttggattacttttggagagccactttggagtcctggatgaacagggagctatgtttttaatcggaaacattttcaaaacctttcttctgaagagtcayttctaggaagatttctgtaggtgaacattttcatccattttatgatgatcctccttggctctcatttcataaggcagcatttttctgacctttcctcaca

SEQ ID NO: 54565 - DNA, 201 bp, Homo sapiens
gaacttgaaaataatgaaatatgtgaaaaatacagcaagaagtctcatgagatggctggagagaacccagaaaagcttacctcgtctcaagcacccaaatsttcccatcactgccaacaacatctaggaccacttcaactctagtatctgtacatcttccaatcagtgataaatgctgatcagtatcctacacaggagatt

SEQ ID NO: 54566 - DNA, 201 bp, Homo sapiens
tgggcaaaccgaccctcattagacactgaatctgctggtgctttcatcttggacattccagccttgagatctgtgggcaatgattttttttttttttttttaagatggagtcttgctctgtcaccaggctggagtgcagtggtatgatctcagctcactgaaacctccgcctctcaggttcaagtgattcttctgcctagc

SEQ ID NO: 54567 - DNA, 201 bp, Homo sapiens
tcctcccattacttttatggttttgttttataaatttaagtctttgggccatttagaaattaacacgtgatctaattttatctttttctgcatggcaaccyattgtcccagcatcatttgtttccccatagacttcatataccacctttgccatctactgcattccatgtgtatttaggtgtttattgactgtttctactg

SEQ ID NO: 54568 - DNA, 201 bp, Homo sapiens
agctcagcctctttcctccctatcacttgcagtctttctcagctagctgacacatgacttttaagacaatctacttgctgttatcacattatttgagataycataaaattaatcctctaatttaaattaaagctgcagaccattatcagtgataataccaggaagtgagtgaggaagggtggcaaaacatgttctagggtg

SEQ ID NO: 54569 - DNA, 201 bp, Homo sapiens
ttacaaatatagtagagaaagaaagcagctttattattgaataaacgctaaactagaatatgatacacatagagggaatccactgagggattgcaaagacraatctcactcttttatacagccaaacagatgcatcctattacataggcattctctagataaactagctagtcctcacataaggacttgacagcaccatgt

SEQ ID NO: 54570 - DNA, 201 bp, Homo sapiens
ttcataagaaattaagagttttgtataaccatttatactttcaccttatttgactaattttgactaattgttgagaaaataagtctgaattaaagagtcamaattgcagtttatttcagagaaatttttattctccaatgcacatggtaactagtgttataccagaaagaatggtaactagtgttataccagaaagaatat

SEQ ID NO: 54571 - DNA, 201 bp, Homo sapiens
tatatatatatatatgaatcaaaatacaagcacacagcaaatgccttacaattgaatgaagaaactgctaattctgagaaagcagaatctgccattataawaaaaatgcagagaactctggcaaaaattggggatcagagatggttgtgtcaagagggagatgcttgagttgaaccttgaaggatgggcagaatttcaaca

SEQ ID NO: 54572 - DNA, 201 bp, Homo sapiens
atgtctatgcttatctgaacactagagagtccagacaaggccttgttgaaccaaggcactgcttcaggtgccaaggataatctggaatgcagaaccctcaygttttcttaaattctctagatggatttcaaataaatgacaactttatcttttatatgggatgagataaatcaaattgctaagtatctaagaagtttctaa

SEQ ID NO: 54573 - DNA, 201 bp, Homo sapiens
ttggcatgcggcttgctaaaacaaaatttttaaaaattttttccttaatggtttacacaccagtcttaactctttctttttttttttttttcttttgaggkggagtcctgctgtatcacccaggctggagtgcaatggtgtgatctcagctcactgtgacctccgcctcccagggttcaagcaattctcctgcctcagcct

SEQ ID NO: 54574 - DNA, 201 bp, Homo sapiens
ctaatgtattttgccttcacttgtaactctgcacatttcattatatattagggaaaagattacagattctacccccatatactcaatcttgatcagaatgwacattaatgttgcctgatagatgtcttttgactacctatatattacaaatgtgtatgtgtttttttcttccataagtatctattcaagtgtatactgtat

SEQ ID NO: 54575 - DNA, 201 bp, Homo sapiens
gacactctgagaagcactgcctacactatcagtttaggattggagcagacttttaacatctactcatgaattatactgcatgtacacttttttaaatttcrgggcttttgtatatagagatgcaaggtattaaactaacagagacacaaggtattaaaccaatgttttcatgtgtcctttttgcacgtacacttgttaatg

SEQ ID NO: 54576 - DNA, 201 bp, Homo sapiens
tgcctagccaccctgagcctatgtggccaatgtcagtaattccactctggacacaaacactgttggctttggatggaagtgccagacactcacagcactcygaggacatactgttttctagccttatttatgttctctcttcacccttcagcctaaaaaattaccacagtgccacttacctaccttaatgggaatctgcac

SEQ ID NO: 54577 - DNA, 201 bp, Homo sapiens; identical to SEQ ID NO: 10377

SEQ ID NO: 54578 - DNA, 201 bp, Homo sapiens
cagcctaaaaaattaccacagtgccacttacctaccttaatgggaatctgcacaaaaggccatttctccagtttctctcaaaagcaaaggaaaacttcccratattaatatgtagcaaaaagagggagaagaaaaagcctgtttggtccgccctcctggctgttgctaccttgcagcttatgacatacacatagagggagg

SEQ ID NO: 54579 - DNA, 201 bp, Homo sapiens
cacaactgcttacagagatccctggagtggttgttgttttcatgtttatgtagtgcctgggcatttatattttttaaagtactaacatcagaacccccgaraatgaggctcaggcaatgtaacttttaaaactccctcagtgattctaatgtgcagctacagttgagaataacttccctagtatttgaaagaaactaaatg

SEQ ID NO: 54580 - DNA, 201 bp, Homo sapiens
taatgaagaactctgggcattaaggatggctgtagaacattcttctctataattgccagctgttagacaatactatatttactatatagtatttactttakatttactatataagggtagcaattctcatttatatttctcatgatcatctcttgaagggtacactgttaatccccattttatgggagaaaaaaaactccg

SEQ ID NO: 54581 - DNA, 201 bp, Homo sapiens
catgccgtaggtcaagtgaagtgggtgcctgccatatttctttcaactagcctttcagtattttgggaaattcccaagaatcgaaactcaaattcccaccyttctttgtagctaggacattggcttatagcctcagttccaccaaagagcagcatgctggcaaaactgcaatttggaaaagagcaaaatgaacaaacagga

SEQ ID NO: 54582 - DNA, 201 bp, Homo sapiens
aataatgactaagaggtgagactaaccttagggaaatacaatccagagaaatatgtgactaaatcctgacagtacagtgtgagaggtgctccagaagaggrgccaaaacacaaattttgacataagccattaacaaaagaaatgttttgccaggcgtaagggggaagaaagagaacccccaaatagagaccatccaagctt

SEQ ID NO: 54583 - DNA, 201 bp, Homo sapiens
cagaccaacttttacctaacaattcagaataatgcactatattaaggagaaaaagaaaaatcagataagaattaccaggaactttataggaaaaaaaaaaraccctagaactattataggacagacaagacctaagtagataaaaatataacatgttcaagttattgagataacttacctttgttaactgtagaactaagg

SEQ ID NO: 54584 - DNA, 201 bp, Homo sapiens
tcagctttccattcctgcctacaacaaaaacatctggtgagtctaattttaagtaatcaaccttttcagtttggtgattaagagatatatatctgaatttscatttcatttgtggaaattctgcctgggagccattcatttttcatcaagctccctgtgcttttcattactccctccctctcattttccctgtggtcagcc

SEQ ID NO: 54585 - DNA, 201 bp, Homo sapiens
cagagaaaatgataaaatctcattgtagttttgtgttgatttagtatatgggggttttagcatcgcttcatgttatgtttttattttctataattggctgyccatggtttttgctgtaggacttggtgaatataagcaaaatgtctggagccacactatctggatttgaatactggctctgtcccttctaagctgtgtgac

SEQ ID NO: 54586 - DNA, 201 bp, Homo sapiens
aataatattcattttaagcaaataaaatatgttctgattaagaattcattctgcccagttggagtccaattaagccagcttctggatggagtctcacccargatctctccacttaaggaatatattcgcagttgaagtttgacttttttcaataaagctcttctctctccttgaaagagatgaaactttgtcttcaatcca

SEQ ID NO: 54587 - DNA, 201 bp, Homo sapiens
tcaaggtcagccactgatggctgttaatggccactttgttgataaatcgggggtaactgcaataatattcattttaagcaaataaaatatgttctgattamgaattcattctgcccagttggagtccaattaagccagcttctggatggagtctcacccaggatctctccacttaaggaatatattcgcagttgaagtttg

SEQ ID NO: 54588 - DNA, 201 bp, Homo sapiens
taatactatatcttgtgtattttagttcccattgttttctttgctgctagcaatgggaactattatgcaatttgaagagtaagtagctccatcttatagaygaggaaaaactgggattcaaaaagcaaaatgagctgtgcaaagccccacagccagtaagtagcacaacaaggattttattgaattctgatgggaacatct

SEQ ID NO: 54589 - DNA, 201 bp, Homo sapiens
ggacacagatccaaaccctatcaaccctgaaggaccttataatcatagtgggaagagagtaatatgtaaataaaaatatacttttaagctgatgaaatggyatggatgacaggacgtagagccatgatagtaataacaggacctgtttggagaaggtgttcagaaaatgcttttctgaccattttcatctcagctgaaact

SEQ ID NO: 54590 - DNA, 201 bp, Homo sapiens
tcctgtgaggatgcagtgagcaggtgccatttatgaaatgggcaaaccgaccctcattagacactgaatctgctggtgctttcatcttggacattccagcyttgagatctgtgggcaatgattttttttttttttttttaagatggagtcttgctctgtcaccaggctggagtgcagtggtatgatctcagctcactgaaa

SEQ ID NO: 54591 - DNA, 201 bp, Homo sapiens
atgtataatatgctgctagtaccaaggctgcatttgaactgaactactccttatgatataccatactaactgatgaaaatataaatgttaaaatgtctccrctctaatgtattttgccttcacttgtaactctgcacatttcattatatattagggaaaagattacagattctacccccatatactcaatcttgatcagaa

SEQ ID NO: 54592 - DNA, 201 bp, Homo sapiens
ctgtgggcaatgattttttttttttttttttaagatggagtcttgctctgtcaccaggctggagtgcagtggtatgatctcagctcactgaaacctccgcytctcaggttcaagtgattcttctgcctagcctcctgagtagctgggactgcaggggagcacaatcacccccagctaatttttgtgtttttagtagagaca

SEQ ID NO: 54593 - DNA, 201 bp, Homo sapiens
atgtcctcatagatatgttgaaagatggttcactgtttcaaagatagaatgtataatatgctgctagtaccaaggctgcatttgaactgaactactccttrtgatataccatactaactgatgaaaatataaatgttaaaatgtctccactctaatgtattttgccttcacttgtaactctgcacatttcattatatatta

SEQ ID NO: 54594 - DNA, 201 bp, Homo sapiens
taataatcaccattctgactggcatgagatggtatctcattgtggttttgattttcaaatgatcagtgatgttgagcttttttcatatgactgtctttttytttttttttttcttttttttttttttttcattttgagggagtctcactctggtgcccaggctggagtgcagtggcagcttacttcatagctcacggcagc

SEQ ID NO: 54595 - DNA, 201 bp, Homo sapiens
cacctcagcctcccaaagtgctgagattacagtcgtgagccaccgcgcccagccagcaatgaatttctattgtttacaagccacctaggctgtggcagttsgttctagcagcctgaatggatgaagatgctagggctccccccagcaccttgcactgccctcatcctcacatggaattatagatgcctcctactcaactga

SEQ ID NO: 54596 - DNA, 201 bp, Homo sapiens
ttggaaatgcataaaattctcattatgtcctcatagatatgttgaaagatggttcactgtttcaaagatagaatgtataatatgctgctagtaccaaggcygcatttgaactgaactactccttatgatataccatactaactgatgaaaatataaatgttaaaatgtctccactctaatgtattttgccttcacttgtaa

SEQ ID NO: 54597 - DNA, 201 bp, Homo sapiens
tttatttcaaatcttttctaagtggcatattagtttgattataaatctatgagggattgttttgctttgtattgtaatgaatttttagaaatttaaattgygtactcttacaaaagataggagagcatattgtcagcaacgaagatgtacttgaatcttctccacccactgtccagagcactcttcgttttctaagatcaa

SEQ ID NO: 54598 - DNA, 201 bp, Homo sapiens
agatttgaaaactaaagaatgtgggaagtgtcattgtgtaatttggaaatgcataaaattctcattatgtcctcatagatatgttgaaagatggttcactrtttcaaagatagaatgtataatatgctgctagtaccaaggctgcatttgaactgaactactccttatgatataccatactaactgatgaaaatataaatg

SEQ ID NO: 54599 - DNA, 201 bp, Homo sapiens
aaaacttcccaatattaatatgtagcaaaaagagggagaagaaaaagcctgtttggtccgccctcctggctgttgctaccttgcagcttatgacatacacrtagagggaggtctgatgaaatgaacgagacagtcagagagctactccattcccgtggaaaccaggagtcccttggtgcagacagctcttcctactttccc

SEQ ID NO: 54600 - DNA, 201 bp, Homo sapiens
tataaatctatgagggattgttttgctttgtattgtaatgaatttttagaaatttaaattgcgtactcttacaaaagataggagagcatattgtcagcaasgaagatgtacttgaatcttctccacccactgtccagagcactcttcgttttctaagatcaacatataaccagggatgaagcagggtaagggattgcttta

SEQ ID NO: 54601 - DNA, 201 bp, Homo sapiens
gttaaattgcatgttgttattagaatcaatgttatatatatgattacaatgctgaagcatttctattgaatgagaaatagtgtttgccctaaacctttggraaaaaaatacagatttgaaaactaaagaatgtgggaagtgtcattgtgtaatttggaaatgcataaaattctcattatgtcctcatagatatgttgaaag

SEQ ID NO: 54602 - DNA, 201 bp, Homo sapiens
agttgtctgctaatctttacttaagacttttttgttttccttttattagctaagcaacattataggagctgaaattcctgacagcagctgtggcaattcarcctaagaatggctgagaactgtaacccaaagtacatccaattactatgggattaacactggatgtatttttaattgactttcttaatgtagaatgtgtac

SEQ ID NO: 54603 - DNA, 201 bp, Homo sapiens
gggattgttttgctttgtattgtaatgaatttttagaaatttaaattgcgtactcttacaaaagataggagagcatattgtcagcaacgaagatgtacttsaatcttctccacccactgtccagagcactcttcgttttctaagatcaacatataaccagggatgaagcagggtaagggattgctttattctacctgttct

SEQ ID NO: 54604 - DNA, 201 bp, Homo sapiens
taatatttcattgaaatggttactaaagagaaaaagagattaacaacagttaatccaccttgatattataacactcaaggttaaattgcatgttgttattrgaatcaatgttatatatatgattacaatgctgaagcatttctattgaatgagaaatagtgtttgccctaaacctttgggaaaaaaatacagatttgaaaa

SEQ ID NO: 54605 - DNA, 201 bp, Homo sapiens
gcacgtacacttgttaatgttagcacttccattagtagtatacagagtggtcaaataaacagacataacaaatcataactaattgtagtccaatttagacrtaacaaatctatataataaaatagtatataattgatacaactctagaataaagagaagctagcctgaaactccaaagttattttgcataataattactaa

SEQ ID NO: 54606 - DNA, 201 bp, Homo sapiens; identical to SEQ ID NO: 10376

SEQ ID NO: 54607 - DNA, 201 bp, Homo sapiens
tcagataagaattaccaggaactttataggaaaaaaaaaaaaccctagaactattataggacagacaagacctaagtagataaaaatataacatgttcaarttattgagataacttacctttgttaactgtagaactaaggtgttcgttttccaccagattatctacagtttcaacagttttaatccaaaagttaaaattt

SEQ ID NO: 54608 - DNA, 201 bp, Homo sapiens
tagggtgggctgagtagctggtaattgctcgagtgttagggacactataggctcttgtgtaatatgatggaaaaggtgctttaggatgctgcatacaagcraggctggaggaaagagaactgactgttgtgggtctagattatgtgcgcacctgccgcaatctagctttccagacaccatggctgtttctccccacacctt

SEQ ID NO: 54609 - DNA, 201 bp, Homo sapiens
gatgtatttttaattgactttcttaatgtagaatgtgtacatccccactgtttctgattgcatgctattttaataatactgttgctaaactagtaccatcrgcataaccaacaaaatgagatatagttaaacaagagtcccagtagttataaaacttttcttctttgtccaggacatttatcttcccgaacgctcaaaaaa

SEQ ID NO: 54610 - DNA, 201 bp, Homo sapiens
tgctggttaatcctatatgtgcctcccttaaaagagtgtacgaattatgtagtatacaaattttgtatcatacaaatgtccattttcttttttccaccctrtgtggctaattggcagcctcattactgtgttttcccaacaaaaatgaagggaagcattacgaaattattcagtaacttcaagctgtgtctataaagtgta

SEQ ID NO: 54611 - DNA, 201 bp, Homo sapiens
agaactattataggacagacaagacctaagtagataaaaatataacatgttcaagttattgagataacttacctttgttaactgtagaactaaggtgttcrttttccaccagattatctacagtttcaacagttttaatccaaaagttaaaattttttgaggagcatgactaagtgattttaaaatgtttatgggaaaaca

SEQ ID NO: 54612 - DNA, 201 bp, Homo sapiens
ttctatgtattatatagcaacagaaagtagattctgggtttggattagaagtctaggcaggtatgaccttcaaaacatttaccaacctgtacagcacagayaccaaccaacacacacagtcctcagcaccagaactagggcacactgggccaggtattaggccttaagttgtgggttgaggagaattctgagaattcctcg

SEQ ID NO: 54613 - DNA, 201 bp, Homo sapiens
agctagtgattaacagagtctggaggcaaacctgtgtcttgtgattccaaattctgtgattttcccactatattcatgctccagtttgctgatacatactwgtttaatttacctgaaagacactttgtgaaaaataacgggcctagatccaggatatgagtcagaacagacaggaataaacgcaagtctcctgattctcac

SEQ ID NO: 54614 - DNA, 201 bp, Homo sapiens
ccctggaccagcagcatcagcatcacccgggagcttgctaattcagatgcaaattctacagcctgctccctactaactgcatcagaacctctggacggagktccagcagtgtgtgttttaagaggtgtggcagagtctgatgctcactaaagtttgagaaatgcctccctaaaacaaagctcagagcaaggacaccttcct

SEQ ID NO: 54615 - DNA, 201 bp, Homo sapiens
aggtccagcagtgtgtgttttaagaggtgtggcagagtctgatgctcactaaagtttgagaaatgcctccctaaaacaaagctcagagcaaggacaccttyctttatttttcttcacccttgtcttcagctctccctacacataccccaaatttgagtttggcacccaaagcattattagatcattatttttcatttttac

SEQ ID NO: 54616 - DNA, 201 bp, Homo sapiens
ctcctgactgaaactcttgagtgtctctcttgccccataaagtacggatccttaaatgaaaggcataaagtccccataaatatggacctggtccatacctytatttcatctcttactgtatattgcctcatcttttattctccagctgcaataaatttcccatcattctcatgtcatttcactcccacactttcatttttt

SEQ ID NO: 54617 - DNA, 201 bp, Homo sapiens
actgcttaataatccacatcccagcatgaagtgcttcccagggcttcaacccccggcatccaagtaccctgtggctgcttatagccagaagtcccccacayttctcaggtgaaaagctctactcattgtctacctgtttctcctgaaggctgtcttagcatctgccatcaacatctactcagcccattagactcacagaat

SEQ ID NO: 54618 - DNA, 201 bp, Homo sapiens
actgcatagtattctatggtatatatgtaccacattttctttatccagtctatcagtgatggatatttatgttgattccatgtctttgctattgtgaatastgctgcaatgaatatatgtgtgcatgtgtctttataacagaataatttatattcctttgggtatatattcagtaatgggattgctgggtcaaatgatatt

SEQ ID NO: 54619 - DNA, 201 bp, Homo sapiens
cccaaggacaaataatggaaatgctgcatacaggataaaatagaaactcagttgaacatagggaatttcatatatacccccgtgagtaggttctttcaaakaactatatttaatagtaaaaatgatatatctgtaagagtgctaattccctaattttgaagaaaaaaaatttagcaatgatattttggggaaatattagac

SEQ ID NO: 54620 - DNA, 201 bp, Homo sapiens
tagcaaagtctaatagataatcctaacagaggagcaagcactaaggtgtggtagctgaggaacacctaagcttgtgctatttgtaatgctgcttattagakacatcgctgatcctcctgtcaactccagttaatgtttctgtcccattcaagttgaaaatgttcaaattcagctaatgtctatggcatctcctgaaagccc

SEQ ID NO: 54621 - DNA, 201 bp, Homo sapiens
gtgtaggctcaattactacttgattgatggatgaaggaacaaaactgattgctatcatagatagaggacctgctcaatgcttctggtaagtgataagcaaygtgtgcacttgctcctgagttcacagttgcataccagacaacagactgcctcagccccagcaagtccaggctcacctgggcccagggtggagagatcact

SEQ ID NO: 54622 - DNA, 201 bp, Homo sapiens
cttaacttcttaacatcctggctaccttggtaccctctcaccaattgctttttctctccctgaccccaaggacaggtttgggaccttgaattctgctttaygtggtactaatattactctatcttttttgtttgactctccccaggctattttctcaccttttcatttttaatatgtttttgtagctttgctttatgtgca

SEQ ID NO: 54623 - DNA, 201 bp, Homo sapiens
cagaaaatatatttgactacatcctgtgaaactgccccttctgaaggtcatagtggttacatatcagccttttcacatgtttcaaccgaaaaactgaaggrgttcccttgagtttgagcaatctatagtatcacttctcctggaaggcagagtgagagaaaagggggtgtactggtttcctagggctactgtaacaaagaa

SEQ ID NO: 54624 - DNA, 201 bp, Homo sapiens
ctaatttcaccccacctgtctacagccgtgaactgcattttaacagcacataaagaaatatactgcatgcaatgccgctcctcatatcatagaacaattaycttaatcataggaaagcttagaagttaacacatcagtctgaatggcatcatagctcatcgtttgtccctttgacaaagaacttttgtagcgaatgccact

SEQ ID NO: 54625 - DNA, 201 bp, Homo sapiens
ttacagttttggaagtgaaaagtccaaagttggtctcaccaggccaaaaccaaggtgtcagtagggctgcgttctttctggaggcactagggaaaaaataygtcactggcccctccagcttctagaaaccacctacactccttggcccacggtccttttcctgttatcttccaaggtagccagtacagattgaatcctgct

SEQ ID NO: 54626 - DNA, 201 bp, Homo sapiens
tgtcattactggtgggggaaaaaaattggtactgcgaaaccaacttatttcctaccacatgtgaggttttgaataatatctgggtggcatatttctgctgmagaaaataagccagttcaatggtgtatctattaaataaaaatagtgctaatagtttatcagagttatcaccacagacgtgcctagccaccctgagcctat

SEQ ID NO: 54627 - DNA, 201 bp, Homo sapiens
ttgttagcccccaaatgatctatatttgggcaatttcttgcccttgccaagataactaaggtaataaggaagtctactaggtagtcataattgttctctcytcttctttttatgttgtatgtgttcccaaaggcctctgcatttgcttcttcatttattccagaaatctttatttcatgcttaatatttaaatactatgtg

SEQ ID NO: 54628 - DNA, 201 bp, Homo sapiens
aaaatgttgatcttggcattgtgcattaaagacttgcagtaaaacataactggtccttagcattaagttcttaaaagatggtttctatagccagtcttccyatagatagcatgtaaatggctctaaatgagaaacgtatagcccctgcaacacaagcacagataaaaggaggcctgtccccacaaaaagatttcataggta

SEQ ID NO: 54629 - DNA, 201 bp, Homo sapiens
aattgagatgcaaagtattaaactaatgttttcatatatcctttttgcacatacgcttgttaatattaacacttccatttgtaatatacagagtggtcaaataaaccatgcaatacagcatgctagattttataacctctcaaggacaggggctatgtcttatttgtctttgagttcctcaccactagcaaaacaggtgct

SEQ ID NO: 54630 - DNA, 201 bp, Homo sapiens
cttccaagcatttcctgccacaccccctcccactactcttcatccttcaaggcagctcagtactccttcctggaatcccttgccctgagagctgcctgagwgaggggtcgtcagattcaggtacctgttttccaagcagctctgcttggctatactttatgtatatccaaatcagtatgtctaaaactgaatcgtcccctt

SEQ ID NO: 54631 - DNA, 201 bp, Homo sapiens
ccctgcttttctcagacctgtaccttgccattccacctctgagatgggtagtgcccatctcaccaaatggtccaccatcagccaagccagaactctgaatmtcattcttgccatcttcctcacctcccacatttagtccatggctatagctgtcatttctgccacctcggtatccctaaaattcattccttcttcctcacc

SEQ ID NO: 54632 - DNA, 201 bp, Homo sapiens
aaataatcactcataactgaagatcatttcacttttgaatgagaatttgtctctgaaggctaacttttctaggcaaagtcaggaaacaatggcagtggccrggtgcggtggctcacgcccagctactgaggcagaagaatcacttgaaccgggaggcggaggtttcagtgagctgagatcacgccattgcactccagcctg

SEQ ID NO: 54633 - DNA, 201 bp, Homo sapiens
atattttggccatttttaacatgttgagtatctgtttctttcaaaagataaagtagttttgcaaacagaactgatttccaagccttaatattgacaaaaakggcaaagtgatgccaaattcttcactgcagatgaaagtaattaaaattgctgttccttgcagggatcaagaattcgaacgtcttagtgactcatgatttt

SEQ ID NO: 54634 - DNA, 201 bp, Homo sapiens
ttatggaagtttctatgtattatatagcaacagaaagtagattctgggtttggattagaagtctaggcaggtatgaccttcaaaacatttaccaacctgtrcagcacagacaccaaccaacacacacagtcctcagcaccagaactagggcacactgggccaggtattaggccttaagttgtgggttgaggagaattctga

SEQ ID NO: 54635 - DNA, 201 bp, Homo sapiens
acgctttgacatttgatgtccacctcagcccaccctccaaacatgatttaattgggctgggtttggcatgggcatcaggaccttctctaaagctctccagytgatactgatgtgcagccaggggtgagagccactaccctaaagcagctattcacaaagcgtggtccctggaccagcagcatcagcatcacccgggagctt

SEQ ID NO: 54636 - DNA, 201 bp, Homo sapiens
ctatgtcattattatggaagtttctatgtattatatagcaacagaaagtagattctgggtttggattagaagtctaggcaggtatgaccttcaaaacattyaccaacctgtacagcacagacaccaaccaacacacacagtcctcagcaccagaactagggcacactgggccaggtattaggccttaagttgtgggttgag

SEQ ID NO: 54637 - DNA, 201 bp, Homo sapiens
tgacaagaagtagttttgcaagttggaggaagaggatcctcggaagtttaggctcctaccttcttaccgaagccgcaagatagaagtgttgtctcctttaygtcagagagatggctccttggtcctagaaaatgacactcctggcttgtaagacctgcgagggccttttaaaatatttttcatctcaaagagccgaagaaa

SEQ ID NO: 54638 - DNA, 201 bp, Homo sapiens
gaaatttttattctccaatgcacatggtaactagtgttataccagaaagaatggtaactagtgttataccagaaagaatatcagcgagtggagctccttgrggtatcttgaggattaaattgaaatgttttacaattagtgatttaagtcatttacacagaaatgactgtcaagtgcctgaagagtctaagcattttaatt

SEQ ID NO: 54639 - DNA, 201 bp, Homo sapiens
ataattgcaaatcattgtgttttctgtgtgggagcttctgagtaaagcagcaatgacaggagattgaagcattggattaagaataatcctgcggggtggaragagagtgatcctagtattctctatggatttcattttccctttataaacctacttcccatgatcagcagtaactgtgacttcaccgcaacgtataaaatg

SEQ ID NO: 54640 - DNA, 201 bp, Homo sapiens
ggagatttctctccaaatagcgcaagccttgtaatatttaagtaaatgaccccaaaaatcatcttcccttgaatcatatagttctgtgttgtccaatagaktagccactagtcatatatattgccatttcatttttattttatcaacttaaatttaacattcaactgctctgtcacaccagccgcattttcagtggtcagt

SEQ ID NO: 54641 - DNA, 201 bp, Homo sapiens
tggcctcccaaagttctgggattactggcatgagccaccgtacctggcctacttattaccttctgatgtgttatgtaaagcatttattatgtttattttcmgttcctcttgctgaaaatgtaaattccatgagggtagaagtttttagtctagttcactgatgactccccagttcctaacacagtacctaactcaatattt

SEQ ID NO: 54642 - DNA, 201 bp, Homo sapiens
ctatccctgttgtcttttgggtttttccctatttactaaatgtcttttttaaacccataagacatcattatagccattctattcactatttctcacatatyaacccctgttgctgtttattgctttcttcattttcatgattttgcctgggttcctcattcctgaagaatttcctctagaatatcatgtcgtttgttctgt

SEQ ID NO: 54643 - DNA, 201 bp, Homo sapiens
ctgggactgtgcaagttggactcattctactaagagcaagaaagtgaagggccagtaaccactcaatcccaattacacataaaatgcccctgggaacattmtgatttaattgcctagggtgaggccaggtgattctaaggggcagtcagagttgaagaccactgagacaggttttcagggtggtcagcgtgataagtagga

SEQ ID NO: 54644 - DNA, 201 bp, Homo sapiens
aatttgagtttggcacccaaagcattattagatcattatttttcatttttacaaacagacatattcacaatctgaatttttagtcatttagtcatttgcastaatgcaatttattgccatcactgtatgggactggatggttataataatgactaagaggtgagactaaccttagggaaatacaatccagagaaatatgtg

SEQ ID NO: 54645 - DNA, 201 bp, Homo sapiens
catgagccaccgtacctggcctacttattaccttctgatgtgttatgtaaagcatttattatgtttattttcagttcctcttgctgaaaatgtaaattccrtgagggtagaagtttttagtctagttcactgatgactccccagttcctaacacagtacctaactcaatatttgttaaatgaatgggaatgagaaaagtaa

SEQ ID NO: 54646 - DNA, 201 bp, Homo sapiens
cataaccaacaaaatgagatatagttaaacaagagtcccagtagttataaaacttttcttctttgtccaggacatttatcttcccgaacgctcaaaaaaarccctgcaacctctatgctaaaagttcattctgcttttttgtcctcggtttggtgagaaaataataaaaccaaacagtggactctcctaaaattgtgaatg

SEQ ID NO: 54647 - DNA, 201 bp, Homo sapiens
aacaccgcatattctcactcataggtgggaattgaacaatgagaacacatggacacaggaaggggaacatcacactctggggactgttgtggggtaggggkagggggtaggggaatagcattaggggatacaccctaatgtaaatgacgagttaatgggtgcagcacaccaacatggcacatgtatacatatgtaactaac

SEQ ID NO: 54648 - DNA, 201 bp, Homo sapiens
agcatccattagttattcttcctgatgctctccctcccacctccccccaccaacaggccccagtgtgtgttgatccccaccatgtgtccacgtgttctcaygattcagctcccacatattagtgagaacatgcagtgttaaacacttctacattttgtacatttttctcctcttatttcttgagatagctttactgacttt

SEQ ID NO: 54649 - DNA, 201 bp, Homo sapiens
cgtacaagggttctgatttctccaagtcctcaacaatattttccttgtgtttgttatagccatcatagtatgtgagaagtggttatctcattgtgattctkatttgcatttccctaatgactactgacgttgatcatttcatatgtttattggtcatttgtaatgtcttctttgaagaaatccctattcaaattctttgcc

SEQ ID NO: 54650 - DNA, 201 bp, Homo sapiens
ttaggggtgaggcagtgtaaacttgtgctcagatactatcttgatccacaaaaacagaatcatatgtgtatacatacacatatatgcacatactcatctastgttactctttaatgcaattgtttgattctgtggactgatttcttcacatctgtcttcttcctcagctccttcccactccctagatcttcttcctctgtg

SEQ ID NO: 54651 - DNA, 201 bp, Homo sapiens
ttaaaaaacactaataaaatgacattttcttttcagtaattctgatttttttcttctaattcttttgtatcattaaatagaattttaggggtgaggcagtrtaaacttgtgctcagatactatcttgatccacaaaaacagaatcatatgtgtatacatacacatatatgcacatactcatctactgttactctttaatgc

SEQ ID NO: 54652 - DNA, 201 bp, Homo sapiens; identical to SEQ ID NO: 10378

SEQ ID NO: 54653 - DNA, 201 bp, Homo sapiens
agccatcaggcaagagggccagccctttatatcctcacaatggaccagtctttgcatgctggctgccacagagaaggggcatgaccactggcaagctggcytccttggctgaggggagtgttcacagaaagagtggagagccagccaccaatccttccagcagcagggagcccgagtctcagccctgaagcagaagctggg

SEQ ID NO: 54654 - DNA, 201 bp, Homo sapiens
ataaaacttttcttctttgtccaggacatttatcttcccgaacgctcaaaaaaaaccctgcaacctctatgctaaaagttcattctgcttttttgtcctckgtttggtgagaaaataataaaaccaaacagtggactctcctaaaattgtgaatgaagaaaacttacagccaccacagttcagttctttaactatcattgt

SEQ ID NO: 54655 - DNA, 201 bp, Homo sapiens
tgagtatctgggactacaggtatgcaccaccactcccagctaattttttgtatttttagtagagatgggttttcaccgtgttagccaggatggtcttgatstcctgacctcgtgatccgcccaccttggatttgtttagatatctcacttttctctaaattgcagaatattttgaagatcttaaaaatattaagttgagac

SEQ ID NO: 54656 - DNA, 201 bp, Homo sapiens
accccaaatgtccaggccatttcagtttctcagactacaatccattaaataatcatttaatcacagtgacatggatgaacacacagatacactgttgagtraaagaagcgtgacatagaagactgcagaagatgctacagtctttgcctccactaggaaggagggccacatgtgtccatttaagttaaagtcaaaaaagga

SEQ ID NO: 54657 - DNA, 201 bp, Homo sapiens
ctaaactagtaccatcggcataaccaacaaaatgagatatagttaaacaagagtcccagtagttataaaacttttcttctttgtccaggacatttatcttyccgaacgctcaaaaaaaaccctgcaacctctatgctaaaagttcattctgcttttttgtcctcggtttggtgagaaaataataaaaccaaacagtggact

SEQ ID NO: 54658 - DNA, 201 bp, Homo sapiens
ggcctaggagggctcagaaatcactacaaacccgttgtcaagccaggctccggtccactctgctgccctttctttttgtttttttttttttttttcgtgaractggttctcactctgcctgggcaggagtgcagtagcgccatctctgctcactgcaacctctgcctcctgggctcaggcgatcctcccatttcagcccaa

SEQ ID NO: 54659 - DNA, 201 bp, Homo sapiens
ggccagacgctgacacagcggggacccccacaggcctcccacggcccatctgtctctcacctgccagggccccggagatgggccttccaggtgtctgagcyccccggcatgtaggaccccagcaggctgtgtggcagtgagcccgatgccaggggacagatggcagaggtggtggcctggctgtgagggacaggtgggcct

SEQ ID NO: 54660 - DNA, 201 bp, Homo sapiens
tgcctcccaggttcaagcaattctcctgcctcagcctcccaagtagctgggattacaggcgtgtgccaccacacccagctaattttttgtatttgtagtaragacagtgtttcaccatgttggccaggctggtttcgaactcttgacctcaggtgttccacctgcctcagcctcccaaagccctgggattgcaggcatgag

SEQ ID NO: 54661 - DNA, 201 bp, Homo sapiens
catggccaggcctctctgggactgtggggggcacccacaggcagttcagtgcttcctgctcaggcagacgctgtagggagtttggtccaggaagggggacrgcagccaggagcgtctggatctgccaggtgggggcaggtgcgggcaggtaggaaagagaaaaaagccttggtgcaaggagagggaggttgagggcagagt

SEQ ID NO: 54662 - DNA, 201 bp, Homo sapiens
tactccttggtgctggcttgggcccaccccatttcagtcctgctgagctttgccttggttctttattcattcagcaaacatctcctgggcatttgccccartggaaagtactgttctgggcgctgtgggcttttggccatgagcaggaagttgactccggaggctgcagggacctgcttaggcatcctcattaccgcctgg

SEQ ID NO: 54663 - DNA, 201 bp, Homo sapiens
ccagctttggctggaccgctaccctctgatgagccacaaggctggtctcgagaaagcccacgggggtgggcgaggcgtggatggccaggcagggctcgaaygggcttcacaggactgggctgcagcccttcctccctcctggctgtgggaggagacagccgagcttgttagggcatcagcgagctcctggtgtcgttcacc

SEQ ID NO: 54664 - DNA, 201 bp, Homo sapiens
ccctgtctctactaaaaatacaaaaattagccaggagtggtggcgggcacctgtaatcccagctactcgggaggctgaggcaggagaactgcttgaagccrggaggcagaggttgtagtgagccaagatcctgtcactacactccagcctgggagacagagcgagacactctgtctcaaaaaattaaaaataaaaataata

SEQ ID NO: 54665 - DNA, 201 bp, Homo sapiens
agtgtgcaggaacggcagcttcactgcccatcccctggggtactccctgcagccttgggccctgctcctgcaacggtggccgaacggtgcaaaggaggggrcggcccagtccctgcaggctgccctcagcctgggtttgctcatctgtgagatgggatcacatgtataatcctggctacttcacagagcccaggcgaggat

SEQ ID NO: 54666 - DNA, 201 bp, Homo sapiens
gaggttgtagtgagccaagatcctgtcactacactccagcctgggagacagagcgagacactctgtctcaaaaaattaaaaataaaaataataaaaatttwaaaaatctgctgaattcactctggccgtcactgatgaaaccttgcagggaagcggctccgttgcctcagcctgtgccgctcgcagctcacgtttgctggc

SEQ ID NO: 54667 - DNA, 201 bp, Homo sapiens
gttgcctcagcctgtgccgctcgcagctcacgtttgctggcttaaaagcagccagagcagggaggcaagctgcccacgctgttggccgcgcactctgcctyccgaacacgttcctgtactgcttgccgtgcacggagggccacgttcatgcctttggggccacgacagctctctctagagtaggacatgggaggggggctg

SEQ ID NO: 54668 - DNA, 201 bp, Homo sapiens
acgtgcctcccgtctgctgggctgaaaagctgtggcagccccagacccgcctgaaaagcactgcttttgcccaagaggatggacagattgtcacagctatrgttatcataagtggcctgtggctttgtgaggtattagcctcagggagctgagtggagacacacaggcctgccctgtgctgtttttgcaactttcctgaaa

SEQ ID NO: 54669 - DNA, 201 bp, Homo sapiens
aggctaggccagccccagggtggacagggaggctccccagggtcggacgaaggcaggcgcctgtgagcagaggcctgggggctggatgggtggcaggtggmcaggccactcttcctagcccagctgatgccatcccgttatcttgtaattttcttcccggggccttatcagccttattagcaaatgtcagaaacaatgaga

SEQ ID NO: 54670 - DNA, 201 bp, Homo sapiens
taattaatgtgtatatagtcaaaataataataatatctgtattattaaatattttatcaccaacaatagatttactcgatgcagtctagaatctttctggktcttttgtcctcaggctgtgcggcaggagggaggattagtcaaaatactgtatttcaaaatcacttgaaacttcttatctgtgtttttaccaggtttatt

SEQ ID NO: 54671 - DNA, 201 bp, Homo sapiens
gtgtcactcagaagtttaagggcacttctgtcactgagctttcattctagggagggagattgtaggcctggaaagccagagagttctctgaaggagctaayaccagttagtgttttgaagagtagctgatgggaaggcgggattgaaatcccaagagagcctgttgccgtatctgcgagggagggacctgggatctgagag

SEQ ID NO: 54672 - DNA, 201 bp, Homo sapiens
ggatgctcggcctgggatccgggccatgggtgggaggtgccagaaagtctcagcctgagcactgctcatgttcctaggcagttccctgctccccacctccrctccccatcagtcccagcccccactggggggctttatttttaggtaccacttactcagcacccagctgtgtgtgcagccggaggaagcctggttccctgg

SEQ ID NO: 54673 - DNA, 201 bp, Homo sapiens
aaagtgtacaacaaggtgtctcgaactgggtcagctcacagcctgtgccaggatggctgggagtgacatggacaggaacaaaagggaggggagagggagcrcactcccacctggagcctggcaggcaggatccccactgagccgatctcttccactgagccggcccatccctccctgtaggttcctcatactccagagatg

SEQ ID NO: 54674 - DNA, 201 bp, Homo sapiens
cttgcattctcccttctatcaaagcttcctcttagatgctccatttacctttttcatcacccactcttcatgaagcctgtaaggcacatctctgccccaarcagcttctaatccagttctttcgctcccttcattccttactcacatgtgcatttattcactcactgatccagccagtattgattcagggccggctgaggg

SEQ ID NO: 54675 - DNA, 201 bp, Homo sapiens
ctgctggcactggcctggtggggagcctctgctatcaggctagggctaactttagaattgtggtgcctgagcaacgtggtgacaaagtgtacaacaaggtrtctcgaactgggtcagctcacagcctgtgccaggatggctgggagtgacatggacaggaacaaaagggaggggagagggagcgcactcccacctggagcc

SEQ ID NO: 54676 - DNA, 201 bp, Homo sapiens
agtggacgtgggcttttagctggcaacagccctgctgcccctggggcactgcctgcctctgaatggcagctgagctgggcagcagcattactctgtgtgcygctggcactggcctggtggggagcctctgctatcaggctagggctaactttagaattgtggtgcctgagcaacgtggtgacaaagtgtacaacaaggtgt

SEQ ID NO: 54677 - DNA, 201 bp, Homo sapiens
gggctggagcacaatttcatgtgaggggtcattctgggacagtggcaccacaagcagacccgggtggccgctggtaagggcctgtgtgtgtggttgcctaygctctttccatctcttgtcggcttctcacagcctccacagaagacagggatagttacagggaggacagggaaagtccgaagtgtgcaggcgccctgcatc

SEQ ID NO: 54678 - DNA, 201 bp, Homo sapiens
catgtccatgagtgtgaccttaaccaccagatctcaattatatagaaaggagagaaacatttttttctttctttttttttggagacagggtctcactctcrtcacttaggctggagtacagtggcacaatcacagctccctgaagtctctctctcctgggctcaagtgatcctgccgctttagtttcccgagtagctggga

SEQ ID NO: 54679 - DNA, 201 bp, Homo sapiens
cagaggtgtgccctggtcctcactctctcccccactgttcttcccctccaggcccctgcctgcaccctatcctgccatgtccctggtgacccatccttccygcccacacctgccagtgtgaggcacacaggtggcaggtgctggagccggaccgggctgttgggccaggctctgacaggaccctcgggaccagctcctgca

SEQ ID NO: 54680 - DNA, 201 bp, Homo sapiens
agaaatctggctcccagggcatggccgcatatccagtgggctccaagccagtgtttctggaccagaaagcgtcgtcctctgccagggcctcttgcacttgygggaaagctgagctgagctgggcttactggcggagcctgtggcacaagaagggtttttctttgagcagagccagctggctcatcaggcctgactgagacc

SEQ ID NO: 54681 - DNA, 201 bp, Homo sapiens
actggccctgtctctccctctagaacctttccttgtggccagggcaggctcaggacaggctgccgtcagccaggcccactccagggctcccaggtcagagyggccatggtagcttacaatgcggcctgcaggacccagcaggcagccggcccctctcccctcccctctcccgcctgcgctctgaaggctccaagtcagtgt

SEQ ID NO: 54682 - DNA, 201 bp, Homo sapiens
cagtcatctcccgccccccagtccctggcagcactcgtctgctttctgtccccatgagtgtgcctgttctggacctttggggtgtggcatcgttctccatrggagatggcaagctttgtggggtccaggctgtgctcaaaagcctctgcacccagcaggagtcggttggtgggcagagaacacaggcacgtgcttgagcca

SEQ ID NO: 54683 - DNA, 201 bp, Homo sapiens
cacacttgaggacaccaaggctgtggtctgtgcagtgaatcggggcagtggggggacttcatggttagaaacacaagctggaggccggatgcggtggctcmtgcctgtaatccctgcactttgggatgcctgaggtcaggagttcaagaccagcctggccaacatggtgaaaccctgtctctactacaaatacgaaaatta

SEQ ID NO: 54684 - DNA, 201 bp, Homo sapiens
gccggaccgggctgttgggccaggctctgacaggaccctcgggaccagctcctgcatcccccacacccccacaccctttcccatgcatgcctcgcttcagyggctgtctagaggtgggtattcttttttgtgcagtaaaatagacataacataaactgttatgaaccattttaagctttacaattcagtgacatttagcag

SEQ ID NO: 54685 - DNA, 201 bp, Homo sapiens
ccaggagcccgtggtgagctgaggatatggagaaggctcatctggggtgacctgagcaagcaccctctatcccaagccagtccccagaggccacgtaggcmcctgtttctggattaactgagcgggagctcaatcaggcaaaccaggttgcttggcacggtgtttgccttaaagaagaacaaggtgggccaggcgtagtgg

SEQ ID NO: 54686 - DNA, 201 bp, Homo sapiens
agccggaccgggctgttgggccaggctctgacaggaccctcgggaccagctcctgcatcccccacacccccacaccctttcccatgcatgcctcgcttcartggctgtctagaggtgggtattcttttttgtgcagtaaaatagacataacataaactgttatgaaccattttaagctttacaattcagtgacatttagca

SEQ ID NO: 54687 - DNA, 201 bp, Homo sapiens
atcaggcaaaccaggttgcttggcacggtgtttgccttaaagaagaacaaggtgggccaggcgtagtggctcacgcctgtaatcccagcactttggaggcyaaggcaggcggatcacctgaggtcaggagtttgagaccagcctggccaacatggtgaaatcccgtctctactaaaaatacaaaaattagctgggtgtggt

SEQ ID NO: 54688 - DNA, 201 bp, Homo sapiens
ccccagaagcctcaacaaacctgtgctcaccgctgctttaggccctgcagcagtcccaggtctgggcagatgtttcaagttcagtgtgtgggctctggctygctggagctgggcccagggaactggcgccttgggatgaggcccgccatgtccgagcctgcccatgccccgctgctgctgcggccggtggtcttggggctg

SEQ ID NO: 54689 - DNA, 201 bp, Homo sapiens
taggaatgtgtagagctggaggagctgaaagagctggggctcgggatcaggtggttcagctgactcgggaaactttgaggcaccaccgcacatgtccgtgygtgagggagacatcttccttgcagggctctgggaggatggggtgcttctgtaatgcccagtcttgggcctggcgcctacctcatatgggtgctctatata

SEQ ID NO: 54690 - DNA, 201 bp, Homo sapiens
ctaccatcgtggggcctgcaggtcactgagggctgggagggctgggacccaggcccctgactggccccctgttgcagcgttggagagaccacctcagacascaaggacggtcatgccatgggtcccggcagcagctgtcccttcctgaggagggcgtttgccagctgaccactccctggtgatttctgccctgatcttccc

SEQ ID NO: 54691 - DNA, 201 bp, Homo sapiens
ggggcctgcaggtcactgagggctgggagggctgggacccaggcccctgactggccccctgttgcagcgttggagagaccacctcagacaccaaggacggkcatgccatgggtcccggcagcagctgtcccttcctgaggagggcgtttgccagctgaccactccctggtgatttctgccctgatcttccctggaggtggc

SEQ ID NO: 54692 - DNA, 201 bp, Homo sapiens
ccagcctagccaacatgttgaaacccctatctctactaaaaatacaaaaattagccgggtgtcgtggcatgcacctgtaatcccagctacttgggaggctraggcaggagaattgctagaacttgggagacggaggttgcagtgagccgagatcgcaccactgcactccagcctgggcaacagagcaagactctgtctcaa

SEQ ID NO: 54693 - DNA, 201 bp, Homo sapiens
gccaatattttctgccagtctatggctgatcctttcattctatcaagaatgtcttttgaagagaagaagctttaaaagtttggtgaatttcaagttatcasgttttcttttatgaatcatgcttttcatattgtgcctaagaaatcatcatataatccaagatcataaagattctctctagtctattttcttctaaaagtt

SEQ ID NO: 54694 - DNA, 201 bp, Homo sapiens
agatttaggtttatatttctatttatagtccatcttgaattcatttttatattttttctgagttatggattgaagttcttttttttttttttttttttttkgcatatgatagccaattgttccagtggcatctgtggaaaggctgtcctttctccactgaattgccttagcactttgtcagacatctcaaaatctggttgt

SEQ ID NO: 54695 - DNA, 201 bp, Homo sapiens
aaagccagactcaggaaggggcagtgctgcctgggctcggtcggcccaagtggcccagcgtcggccggagggcctgggtcacggcaggaagggccagcctrggcaggtgggccgtggccctgagagaccctggctccagccaggcctgacctgcctctgtcctttcaggcacgccagccccacgggcctgctcctgacggt

SEQ ID NO: 54696 - DNA, 201 bp, Homo sapiens
ggacagccaggcctaaaggggctgggcaggggctctagagaattaaagctgcccaggccacagccccgccctgtgagggcctcacaagccctgtgcaggcygagtgctagagactcccctcttccaggagccagtgccctcctggggaggcgggcagactgtgccccactcctgggtgaggtgggtggggctgtgctggag

SEQ ID NO: 54697 - DNA, 201 bp, Homo sapiens
cacagcccctggcccaggcctgcccatgcgccctctgtgcccgccagacagctcctttcctccctctccttcctctcttcctccctccctccctcctcccyggcagcagcccagcacctgcgggagctgtgggatcagaggtaactatagaaatagattgggggacagcttgacggcagctatttctggaaacccaaagca

SEQ ID NO: 54698 - DNA, 201 bp, Homo sapiens
tgcagctcctcccctctgaggcccctctctcccacagtgcaccctgcccaagacctctcgctccattgggccgggggtggctcctgcacatgtgctccagrgaggaaaggcatttgacaggtcagctgcagacaggtgttctgacactcactgtcaaccagaccaaagccccagcccttggccctgcagaggatacctata

SEQ ID NO: 54699 - DNA, 201 bp, Homo sapiens
tgggcctttctgggtgatctggcttctcttgtgcaaggctgcccacagacctttgttaccgcagcttggagtggtccttgtcaggtgtcccctccctcatrcctcctcaccctgccctctctgactcagggttgctgacttttggggccatccctggcactacaggtgtccagcaatgtccccggcctctgcccactagat

SEQ ID NO: 54700 - DNA, 201 bp, Homo sapiens
gaaagggcagggaagaagcatgggtcctggcgtggagacagaggccggagctgccacctcaggccagacgggcaccacgggcatgtgcatgggcagaggcygttcccatctgagtgggacccagaaggaaatcagacacagtccctgctctgagccacggatagggggagagacgggcgctctcacatgtcctgggccaca

SEQ ID NO: 54701 - DNA, 201 bp, Homo sapiens
tccggcttctctcactcggcactgtgtctttgaggttcagctgcgtagtgccatgcctcagcactcgtcatttttactgctgaacagtgttccactgtgtrgatggagatgctgtgtttatccatcaggcaatggacacttgggttgctctcaccttcgggctgttgtgaagaatgctgctgtaaacacttgtggacagtt

SEQ ID NO: 54702 - DNA, 201 bp, Homo sapiens
cccacacctgccagtgtgaggcacacaggtggcaggtgctggagccggaccgggctgttgggccaggctctgacaggaccctcgggaccagctcctgcatmccccacacccccacaccctttcccatgcatgcctcgcttcagtggctgtctagaggtgggtattcttttttgtgcagtaaaatagacataacataaactg

SEQ ID NO: 54703 - DNA, 201 bp, Homo sapiens
ttgaacccaggaggcggaggttgcagtgagccgaggttgcaccagtgcactccagcctggggcaacagagcgagactccgtctcacatttttttttttttwaaaagaaagcttctttgcccatctctggacttgggacaggcaccttcctgctgtcaaatgaaaaggtcagagaagaagaactggaactagatgatgaggc

SEQ ID NO: 54704 - DNA, 201 bp, Homo sapiens
ttgttctctgctcacggtttaggttgcacgatgggaacacaagacccgcaagctgagcagggccttcggatccccctacctggcctgctactctctaagcvtcaccatcctgctcctgaacttcctgcgctcgcactggtaagcacagctctctcactggggagccacaacccctgggctagcgggagggccgctactggt

SEQ ID NO: 54705 - DNA, 201 bp, Homo sapiens
ctccaggtggcaggaacaccgtgaggagcatgcaacgtgctggagaccatggggcatgtgacctccgggcacaccctggacagacctgggtgagaggtggkctgggacgccaggacggtgaggggcttcaaggtgtgtttgtcctttgtccttatacaggtgacctgcatgggcgggtgaggtccatcagaatgctctaga

SEQ ID NO: 54706 - DNA, 201 bp, Homo sapiens
gctggtgagcctgggctggctgtggggacccttcgcttacaggcaaggtgtgccctgggcagtgggcagagatctcaagagaagctgaaatgggggcagarcagcctgactcaaaggtcctgggggaagggggatggagaatctggttgcctgatgggaagtagccaattaggagggtcctgaggatggacgcagagggtg

SEQ ID NO: 54707 - DNA, 201 bp, Homo sapiens
ggctgcagagggttgagactcagcccagggctggcacgctgagctgttccaccactcctgctccctagagcatgccgggaccaccatcagggccggcacamagcaggagaagtgggctgcagcccacagcgcacacagatccaggagcagctagaccaggccaggtgactgcccagaaacaccggccagcgccacaaggca

SEQ ID NO: 54708 - DNA, 201 bp, Homo sapiens
tctgctggggcccttttagagtctgtgggatgcactcagcagctcccaggtagggcctgaggtcagaccccatgtgtctccccagggacagatcttctccrccagacgtctctttctgcctcttggtgggttcatggctgtgtctggttgaagagttgtttccagaaggaccttgttgtccgtccagatgaactgagcaag

SEQ ID NO: 54709 - DNA, 201 bp, Homo sapiens
aagggaggcacactatcggacgtcccccgtggggctggcatgcagattgaataggatacatggctgcactcaccccagcgcctggtgtgcagcaggccctrtgccagtgtcggctgacgtcactgtgctgtgggtgtcatcagagcctgcatgccacagtcagtgcagtggcacagggcctgcatgccacagttaaggaga

SEQ ID NO: 54710 - DNA, 201 bp, Homo sapiens
cctgaacttcctgcgctcgcactggtaagcacagctctctcactggggagccacaacccctgggctagcgggagggccgctactggtggtacctcatcccycaccacgcgggagccttgtgtctgagcactcaggggttagctctcaaagccacctgccacagcaagccaccctacccctcccagccgtttagactctggc

SEQ ID NO: 54711 - DNA, 201 bp, Homo sapiens
ctgttctttccctatcactccagatgccagggcagtggtccaaggaccagcatggactccctcttctcacctgcccccggatctgtaccctcgcggactcyacctggcttcatgccatcacccccgccagatcaccagcagcagctgcttgcagccagtctccccactgctcctctctagccacccttgagggccatgctc

SEQ ID NO: 54712 - DNA, 201 bp, Homo sapiens
ggagagacattccctggactctgagctgggagccattgcagaggtggcatgatctgagtcagagtttcaaggtcactgcaccaaggacagaggagaagagrcaaaggtggagctgagaggccagcaggccccagatggcagcttgaccacagtgggactggcggaggtgggagcagtgatcagggagagctgagagaggtg

SEQ ID NO: 54713 - DNA, 201 bp, Homo sapiens
tgaatcttcacagcaaatgctgttaatatcccctttggagactgaagcttgaagaggttcattcatacattcttcaaatgtttattgagcatctactgtgygctgggcaccatcccggcccctggccctcacgcagcagcttcagtggtgaatgaatgtatagcactgccggtgacacagcaggcaaggggagggacagac

SEQ ID NO: 54714 - DNA, 201 bp, Homo sapiens
aggcctgcccatgcgccctctgtgcccgccagacagctcctttcctccctctccttcctctcttcctccctccctccctcctccctggcagcagcccagcrcctgcgggagctgtgggatcagaggtaactatagaaatagattgggggacagcttgacggcagctatttctggaaacccaaagcagctgcgcccgggctc

SEQ ID NO: 54715 - DNA, 201 bp, Homo sapiens
acaggcagagattgtgctgttctgtcctgtccctccctttgggtgacagagaaccacgaacgtctgtgtcctcagagggtcacgggacacgttccagaggkgggtggtggggagcacagtgagcacagaacatggtattttcaatccaggctgtactggcgaggagagagagtctctgtgcccagccctgctgatcccccc

SEQ ID NO: 54716 - DNA, 201 bp, Homo sapiens
catcccctggggtactccctgcagccttgggccctgctcctgcaacggtggccgaacggtgcaaaggagggggcggcccagtccctgcaggctgccctcarcctgggtttgctcatctgtgagatgggatcacatgtataatcctggctacttcacagagcccaggcgaggatctcatggacttgtgcatgtggaaaagcc

SEQ ID NO: 54717 - DNA, 201 bp, Homo sapiens
aggatcacaggtgtgcaccaccatgcctggctaatttttgtatttttagtagagacggggtttcaccatgctggccaggctggtctcgaactcctgacctygtgatctgcccgccttggcctcccaaagtgctgggattccaggcgtgagccaccatgcccagcctggcccaggctggagtgcagtggcgcgatctcggct

SEQ ID NO: 54718 - DNA, 201 bp, Homo sapiens
ctccttgcctgttcaattatttccgattgaattaattatcctgcagtaacagcggagctgctaatagggaacattgggtgccccccaggcggagcatgtgsctcgagagcacgcctggagctggagaccagtgggcagcccagctcttcgggggcgcaggccccctggagctcttctgacgatgggcagcttcatcctgca

SEQ ID NO: 54719 - DNA, 201 bp, Homo sapiens
gttcccaaggctgccatgtgctgtggtcaggtccagccactggatggcgctgctcaggtcagctgcgtcctcccgattttccacctgcgtttttttttttctttctttctttctttctttctttctttctttctttctttctttctttctttctttctttctttctttctttttctttctttctttctttccttccttctt

SEQ ID NO: 54720 - DNA, 201 bp, Homo sapiens
atgtccttgagcccactggagtctgtcccccttgccatcctcgggagcccggtgcggttgtgcccccctcatatctctgggcctctcagcacacaggtctrtcctgcctttgatagcaagacggacctgggcaaggttcctggcttctccgagccttggtattctcatctgtgacccaggcacagctgcctggctcactgt

SEQ ID NO: 54721 - DNA, 201 bp, Homo sapiens
tcctcccgattttccacctgcgtttttttttttctttctttctttctttctttctttctttctttctttctttctttctttctttctttctttctttctttctttttctttctttctttctttccttccttctttttctttttctttctttctttttctctttctttttctttctttctttctcattagattttttttaat

SEQ ID NO: 54722 - DNA, 201 bp, Homo sapiens
gactccaatgggccggaacgccagccttgctggcaggaagaggccctccaagcgcctctcgtggatccggcccagatccggtcctgaggcccctcccaccrgagcctggggtgccctcacatgccctgcgccaacttcgcaacagcccagcttcccggctgctgtgtgccctgcctgtgtcaatattatgactggacttcc

SEQ ID NO: 54723 - DNA, 201 bp, Homo sapiens
cctcccgattttccacctgcgtttttttttttctttctttctttctttctttctttctttctttctttctttctttctttctttctttctttctttctttctttttctttctttctttctttccttccttctttttctttttctttctttctttttctctttctttttctttctttctttctcattagattttttttaatg

SEQ ID NO: 54724 - DNA, 201 bp, Homo sapiens
gttgggcctgagtgacccgtgggaggcaaggccgttggctgccctggggcaaccgtgggaggagaggcttgtggaggaagagctcggttttgcctgtgtcmgacacggatgtccttgggctccagacagtgtgagaaggccaggcatggtggctcacgcctataatcccaagcactttgggaggccaaggcaggcggatcg

SEQ ID NO: 54725 - DNA, 201 bp, Homo sapiens
ggctgttcccaaggctgccatgtgctgtggtcaggtccagccactggatggcgctgctcaggtcagctgcgtcctcccgattttccacctgcgtttttttytttctttctttctttctttctttctttctttctttctttctttctttctttctttctttctttctttctttctttttctttctttctttctttccttcct

SEQ ID NO: 54726 - DNA, 201 bp, Homo sapiens
ccactgcctgtgtggagtttgtgtgctctcacgactccgtgggctttctctgtactctgctttctttcacatctccgagatgtgcacattcagtgaactgsacatctaagtggtcccagtctgaccaggtgtgggtgcgagtgtgtcctgtgatggaacggcgtcctgtccaggctttgtgccctgggagaggctctagcc

SEQ ID NO: 54727 - DNA, 201 bp, Homo sapiens
attggttccagttccccgtggataccaaaatcggcagatgctcaggtccctgatgggaaacaatgttgtattcgagtataacgtatgcccaccctcccatrtactttacatcatctctagattacttatcatacccaagacagtgtacatgctgggtagttacactgtattattttttatgttattactttttgtttttat

SEQ ID NO: 54728 - DNA, 201 bp, Homo sapiens
ggggagagtatccggacggcatctggaatgggatgacgaggcccagctctgtgatgccagaagcccagtgggtggatcagttgagccaaggagttggagaycatcctggggaacatggcaaaaccctgccactacaaaaaatacaaaaattagccgtgtgtggtggtgtgcacctgtagtcccagctactgggttggctga

SEQ ID NO: 54729 - DNA, 201 bp, Homo sapiens
ggagtgagctcttcaaagtggtttcaaaaggagaaaagttaagaaacatgttgcagttccgtgggctgctgccggggagagtatccggacggcatctggartgggatgacgaggcccagctctgtgatgccagaagcccagtgggtggatcagttgagccaaggagttggagaccatcctggggaacatggcaaaaccctg

SEQ ID NO: 54730 - DNA, 201 bp, Homo sapiens
ggagctctgaggacaggggccagaggactcactagggagccaccttctgggagtcagtggccttgaggaaatcatcgctaatcactctcctgccgcaactrctgggaaaggcaggtccacttgggaagtggagcaggcagcagtcatcgctggggctggggtggaggtaggtggctgggagcaggcctctgaggctcttcc

SEQ ID NO: 54731 - DNA, 201 bp, Homo sapiens
gccctctgctgtctgcgtgcctgttgggtccctctgactctgcccattgttgaactctctgaagtctcctggagggcagggccctgtctcacctgcaggtytcgccacagcccgctctggggcctccctcagtgatggtgtggccagggctgatgaatagccgagggaccctgccttgcctcatccacaggtgattacttc

SEQ ID NO: 54732 - DNA, 201 bp, Homo sapiens
tgcagtaagatttggccgggcgcggtggcccacgcctgtaatcccagcactttgggaggctgaggtgggtggatcacctgaggtcaggagttcgagaccarcctggccaacatagtgaaacctcatctctactaaaaatacaaaaatttagccggatgtgatggtgtacgcctgtagtcccagctactcgggaggctgggg

SEQ ID NO: 54733 - DNA, 201 bp, Homo sapiens
ccccagagcctctggtggaagcacagcccagtcggcaccttgattttggcccagtggtaactgattggggattgctgttgttttcagcccctaagttggcrgtcatttgttacagcagccacaggaagcgaggccagggtatttaaaaagccaaagacccctgctggaagacgttgtgggcctaacctttggagtgttggg

SEQ ID NO: 54734 - DNA, 201 bp, Homo sapiens
ctcccgattttccacctgcgtttttttttttctttctttctttctttctttctttctttctttctttctttctttctttctttctttctttctttctttctttttctttctttctttctttccttccttctttttctttttctttctttctttttctctttctttttctttctttctttctcattagattttttttaatgg

SEQ ID NO: 54735 - DNA, 201 bp, Homo sapiens
tcagggtgacccttgttgactaacattctgcttttcttctgctgtccttgttggtgcagttaagcttcctgttgccaagggatttttcttaaagaaagaargaaagaaacatacaacatacaacattacatatttgcttatgtggtagctctactccctcctcaatcaaaatctccggttttaaaatatgtcagtccctgg

SEQ ID NO: 54736 - DNA, 201 bp, Homo sapiens
tcccgattttccacctgcgtttttttttttctttctttctttctttctttctttctttctttctttctttctttctttctttctttctttctttctttctttttctttctttctttctttccttccttctttttctttttctttctttctttttctctttctttttctttctttctttctcattagattttttttaatggg

SEQ ID NO: 54737 - DNA, 201 bp, Homo sapiens
tgacctcgtgatccgcccgcctcggcctcccaaagtgctgggattacaggcatgagccaccgcgcccggccgacctagtgcttttaactgctgtagtttarctgctgtaggaatgggccgtgggttttttttttttttcttcatttctttggttgctggacacctaagttgtttgtcattgttcctgacgttttcatgcaa

SEQ ID NO: 54738 - DNA, 201 bp, Homo sapiens
gattacttatcatacccaagacagtgtacatgctgggtagttacactgtattattttttatgttattactttttgtttttatttttttcctgaatttttctttttttttttttttgagacagcatctcactctgtttcccaggctggagtgcagtggcatgatcttggcttactgcaacctctgcctctcaggttcaagcg

SEQ ID NO: 54739 - DNA, 201 bp, Homo sapiens
ctatcactccagatgccagggcagtggtccaaggaccagcatggactccctcttctcacctgcccccggatctgtaccctcgcggactccacctggcttcrtgccatcacccccgccagatcaccagcagcagctgcttgcagccagtctccccactgctcctctctagccacccttgagggccatgctcagaggtcccca

SEQ ID NO: 54740 - DNA, 201 bp, Homo sapiens
agtgtagacaaaaggtggactacaggtgggcctggggcttgtgagggaggaccccaagtgcatacctgcaatctggactgtctgctcaaggatggtggcakgtgtgtgtgtgtgtatgtgtgtgagtgtgtgcatgtgtgtgagtgtgtgtgtgtcagaagttaggatgggggcatgagccaaactgtctgagacccttgc

SEQ ID NO: 54741 - DNA, 201 bp, Homo sapiens
gacaaaggtggagctgagaggccagcaggccccagatggcagcttgaccacagtgggactggcggaggtgggagcagtgatcagggagagctgagagaggyggcttggccagcccatggttgggcctgagtgacccgtgggaggcaaggccgttggctgccctggggcaaccgtgggaggagaggcttgtggaggaagagc

SEQ ID NO: 54742 - DNA, 201 bp, Homo sapiens
ggactacaggtgggcctggggcttgtgagggaggaccccaagtgcatacctgcaatctggactgtctgctcaaggatggtggcatgtgtgtgtgtgtgtakgtgtgtgagtgtgtgcatgtgtgtgagtgtgtgtgtgtcagaagttaggatgggggcatgagccaaactgtctgagacccttgcttccatctggctcaga

SEQ ID NO: 54743 - DNA, 201 bp, Homo sapiens
tttcagtgctcagtttccgtccttcatcttggctcccacagaaggtgaaaaaagcatatttcttgctcactttcccagtttccttgggtttcaagacccaraagcactcacttttatccttgtcccatttttatggggctttctgtctggtagggctggccttgctcaggctggctctgctcctcactgcctggggtctgg

SEQ ID NO: 54744 - DNA, 201 bp, Homo sapiens
gcctctgccctctctggcctctgtgcccttattatgtgtaattctgttctgcaccgccctgctgtgtaaacttggcaagttctggtcccctctcctgcttrtagtttcctgggctaaaatcaaaggaggtaaattatctcccaaggtcctttccattctggatcctctgttaatccaagggagatggggaagagggcttgg

SEQ ID NO: 54745 - DNA, 201 bp, Homo sapiens
tggcctaggctgtggacaactgggttcaggtaacttcactcccgtgccctcttcccagcaagtagtaggtccttggggaaggggcttcttccaaagctcakggcagatgggagtggggagggaactcgtgatcagggcacacatctccagatgacctctcccctgccccagttcccaccctggctaccctcttgttcctgg

SEQ ID NO: 54746 - DNA, 201 bp, Homo sapiens
cctgcttgtagtttcctgggctaaaatcaaaggaggtaaattatctcccaaggtcctttccattctggatcctctgttaatccaagggagatggggaagagggcttggaaacagctggatttggggatgaagattccactgggggcagaggggaggcagccccccacccaagccccatactccatctccattcctcactcc

SEQ ID NO: 54747 - DNA, 201 bp, Homo sapiens
caggctggagtgcagtggtgcgatctccactcactgcaagctctgcctcccaggttcaagaaattctcccacctcagcctcccaagtagctgggactaccrgtgtgtgccaccatgcccggctaatttttgcaattttagtagagacaaggtttcaccatgttggccaggctggtctcaaactcctgacctcaagtgatct

SEQ ID NO: 54748 - DNA, 201 bp, Homo sapiens
atcagggactgggctgggctgctgtggaggcctgcaagcccgcgccagcttctccaccctgctgggcctcagaggcgcctgtcagctccagctcaccaccrtgtgtggccctctgccccttgcctctgggacaggtttagtctgcagttattatgttcaaaattttaaaattttaagcagttaacactgatgcgtgatgaa

SEQ ID NO: 54749 - DNA, 201 bp, Homo sapiens
cccgctccctggccccggatctgcccttcatcaggaatctgcttccaagcagatctgatttgcctactgagccatgcccccagggaagctgggccctgaaygagctgggcttttgggccacaccagagggaggaagttccctttcatctgctgcctgcttgtgtgatgcagatgaattctggcagaggaaccctgagcatg

SEQ ID NO: 54750 - DNA, 201 bp, Homo sapiens
ggaccgtctggccacatctgactgccaagtgctgccggggagaacctgctgaaggtgctggacgtggctgtcctgcgagaaggccacgcgtgggagctgawctgagcagggggtgctgggtcaggttagtgctggccattgggtggacgcgggcccatcgtgggcttgtgagccactgtgggcttaaaaagtgcagagttg

SEQ ID NO: 54751 - DNA, 201 bp, Homo sapiens
aaggcctacccagggtcacctcccttttgattaactcaaggccagctgattaggacctgaattctatttgtgaaatcccttcaccagagtgatttcctcgmggcaggtgcctggggtagccactgggcggggtccatgagggcagctggagagtaaggggtgggggggcacttaggacagggaagctggcataggctttcc

SEQ ID NO: 54752 - DNA, 201 bp, Homo sapiens
gttccttaggtgcccgtcctgtctccaggcctttgtacataccattcgtcttgccttgtttgccctgccctcacacttggcacatctggcacctcccctgmacattctaagacagcatccttccgtaccatttgacccaccccgttttttccaccacagtactcatccatattataaccctttattcacattttgtctttt

SEQ ID NO: 54753 - DNA, 201 bp, Homo sapiens
ttgtcctttgtccttatacaggtgacctgcatgggcgggtgaggtccatcagaatgctctagaacaggacaactgaggtcccggctgccccgctcaacacrccatgattcctagactgccctgagaggtcaggttttaaatagggtgtggcccggcaaggaccctgagggatgtgaggccagacagctccttggtggccgc

SEQ ID NO: 54754 - DNA, 201 bp, Homo sapiens
cctgagcctcactttcctccatagtatgagttgctcattggacaggatgagagtttgcaagctggtggccttcgggctgaatccagcctgctcacatgcakggtctaaagtggctttcatgaattgtctatttctaaaaattaggatatttcacatacgagtcaggatttctggcttctcttgaaaaaatttaaaaatctg

SEQ ID NO: 54755 - DNA, 201 bp, Homo sapiens
gagaatgaatgaaggaaaaaatgagtggaggaggggtctttggccgagctaaagagcctgggcgccgcgggggcgggaagctctaggcagtgctcgtcgcrcaccgcccccagagtaaagcgaatttcagaagagggcgtggggccctgggcgtgtggggccctgggcgtgtgtgacccgggccaagtccaagtccgcagg

SEQ ID NO: 54756 - DNA, 201 bp, Homo sapiens
tataggtccggttccgggggcgcgtggctgcagcggggcccgcgtggtgcctcctgaggcggcccccggatgaagagatctgggaacccgggagccgaggyaacgaacagctcggtggcagggcctgactgctgcggaggcctcggcaatattgattttagacaggtactgaccgcaccggaccgccgcggaaactgggag

SEQ ID NO: 54757 - DNA, 201 bp, Homo sapiens
caccagagcgggtgagtgatgatgtctccagcttggtgttggtgtcaagaagaatggggacagtgagggggttatggtgaagaccagaatgagatgagggstgtaaagctttatgaagtatcgagtgcagcccacctaagggtggtcctcaagaaggcaaagcccttgtattcagaaggctgagagacctggggcagggga

SEQ ID NO: 54758 - DNA, 201 bp, Homo sapiens
ctggccttgctcaggctggctctgctcctcactgcctggggtctggaggctttgctcttttatctggaaagtaggctaacaacaaggctttacttttaggrtggctgagagtatggccagagataggtctgcgctcactgacaggtcctgtgttttcttagatcccctagagtgagggcctccttagtggagctcagctaa

SEQ ID NO: 54759 - DNA, 201 bp, Homo sapiens
gctggaagacgttgtgggcctaacctttggagtgttgggtgtgccacgctcttggctgtccacagtccttctctgagggagatgttgggctcttacagccrgaggaggtccctgccctctggcttcctgcaggcctgacgttgaccagcagtcattgaggtacatatgggtctcccagcactgggagcttggctggctgaa

SEQ ID NO: 54760 - DNA, 201 bp, Homo sapiens
tgcactggggttcgctggaactttcctaggtaagaccctgagggctggggtgaccctgagcaggaccgctggagccccagggaggtgcagggccaggtggytgctgccctgctatccgtgacatcggtgggagtgctaggggccccctccatcggggcgtctttgctcctccaggcctggcttgtctgtggttagaacagg

SEQ ID NO: 54761 - DNA, 201 bp, Homo sapiens
cagagccaggcagtggacgtgggcttttagctggcaacagccctgctgcccctggggcactgcctgcctctgaatggcagctgagctgggcagcagcattrctctgtgtgctgctggcactggcctggtggggagcctctgctatcaggctagggctaactttagaattgtggtgcctgagcaacgtggtgacaaagtgta

SEQ ID NO: 54762 - DNA, 201 bp, Homo sapiens
cttagccaagagggctccttcccaagactcaggaggaagaacataggggacagccaggcctaaaggggctgggcaggggctctagagaattaaagctgccsaggccacagccccgccctgtgagggcctcacaagccctgtgcaggccgagtgctagagactcccctcttccaggagccagtgccctcctggggaggcggg

SEQ ID NO: 54763 - DNA, 201 bp, Homo sapiens
ttgtcagtgtactctggaccccctggatggccatctctcatgcagtcctgccatttgggattggctggattgtttccttggggagaaatggtgcatttccrtaggtggggggccacttatgatgcagcagttccaccctgggtctccccacagacacaagtgcctgggagcaccaactaacacccatccccactgcatcct

SEQ ID NO: 54764 - DNA, 201 bp, Homo sapiens
gggagtctccagtctccaaagggagcccctgccaagacctccccaatgttctgttctttccctatcactccagatgccagggcagtggtccaaggaccagsatggactccctcttctcacctgcccccggatctgtaccctcgcggactccacctggcttcatgccatcacccccgccagatcaccagcagcagctgcttg

SEQ ID NO: 54765 - DNA, 201 bp, Homo sapiens
gccctgctgggcactggggtggacacttgcccatcagtccttcagtgagtgcgaaggagccgtgtctcacttcaaagagggatttaaaaattctaccctcrccgggcacagtggctcactcctgtaatcccagcactttgagaggccgaggcgggcggatcacctgaggtcgggagtttgagaccagcctaaccaacatgg

SEQ ID NO: 54766 - DNA, 201 bp, Homo sapiens
gctcatggactaaacatggaccacgtggttctccaaaaaatgagaaactagctgcaccagagaatccccatttttgacttgtcgagacagaccagaagttstgtgtgtgcctggccacaccccacgtggagcgctcactggggccgaggcacagctgccccctttggatggggcgcgtgtagcctggctctccccattgcc

SEQ ID NO: 54767 - DNA, 201 bp, Homo sapiens
ctcagacctggccatgtgcgttcttagaaaggcgtttggtctttcctctaagatgagcatagcgtcccttcctcagggttggctgaggagcttggtgtggrcagccgggctccaggcacacagcggccccagtacacctgtcgctttgcctgccacccgcttacggtagcagcatggttgtaataaagcaataaagccagc

SEQ ID NO: 54768 - DNA, 201 bp, Homo sapiens
tcaggccaaaactgccccttcttcctaaggggcaccctgtgcttcttgctgcagaatcctggggcttcccccttcgcatttccgtggaactcagagatggyacctccctgcgaggtggggctgagagggggcccctgcggatgcggttattggaagggctgaggggtcagaggccaggtttggccccaccaatggctggca

SEQ ID NO: 54769 - DNA, 201 bp, Homo sapiens
tctctaacccctccccggggccggtgtggtgaagacagcacagcttctgggccccaggcagcccctgttgctccttagctatgtggctttggataggttasctgcctacccttttctggataggtacctctgtctccttttccgataacctctgccacagcctctgctgtggcatttggtgatgaaatgagaccatgtgtg

SEQ ID NO: 54770 - DNA, 201 bp, Homo sapiens
ggaggaggtgatggtgggccataggcagggcagcacttggcccacgtgggctttttggaggagtcataggggcagggtgggcaggagttgaggccaaggaragggatatgagtgtagacaaaaggtggactacaggtgggcctggggcttgtgagggaggaccccaagtgcatacctgcaatctggactgtctgctcaagg

SEQ ID NO: 54771 - DNA, 201 bp, Homo sapiens
gtacttggcacactggaggcctccctgtctgccttcacccgatgcctgccttgaccatgtgatggtcaaggagtgcacagtgtacagcacatggggtgctktgcaaaggacatgccccagccaggtcaccggggatctttctggccaggtcaggccgtggcttcgctgtgactgtcttggagactgggtcttggcgggcct

SEQ ID NO: 54772 - DNA, 201 bp, Homo sapiens
acaacaaagtgcacctatatgaagcatacaatttgagttgccttttttagagatggggtcttgctctgtcgcccaggctggagtgcattcgtgctgcagcrttgaactcctgggctcaagtgatcctcccacctcagcttccagagtagctgggactacaggcatgtgccactgcactggctaatgtttttatttttgtag

SEQ ID NO: 54773 - DNA, 201 bp, Homo sapiens
cagcacatggggtgctgtgcaaaggacatgccccagccaggtcaccggggatctttctggccaggtcaggccgtggcttcgctgtgactgtcttggagacygggtcttggcgggcctggtggaggccttaggtggggtagagtagccggtaggcctcagaggctttgtccacctctgacttcccagcactcaggtggggcc

SEQ ID NO: 54774 - DNA, 201 bp, Homo sapiens
gatctgcccgcctcggcctcccaaagtgcaaggattacaggcatgagccaatgcgcccagccttcagtggaactttaaatgcctgaagtttttttgtatcrtctctttaaaaaattaaccgtccgtctcagtctcaggtaggttccctgccctcctccatccaaccgtgtcatggtgacgaggggtcgctgaccagcagct

SEQ ID NO: 54775 - DNA, 201 bp, Homo sapiens
cccgcagaagcctccagaccctcctgcccagaggagccccccaccccacccctggctgggtgtgctctgggtgggagggctgtgactgccgggcagcgggsagggagggcgagtggttcccccaagtgcggctcctctcctgtcgtggcagggacatggcagctttcaggacaggcagaggacatagtagggaactgagga

SEQ ID NO: 54776 - DNA, 201 bp, Homo sapiens
tgcccgcctcggcctcccaaagtgcaaggattacaggcatgagccaatgcgcccagccttcagtggaactttaaatgcctgaagtttttttgtatcgtctytttaaaaaattaaccgtccgtctcagtctcaggtaggttccctgccctcctccatccaaccgtgtcatggtgacgaggggtcgctgaccagcagctcacc

SEQ ID NO: 54777 - DNA, 201 bp, Homo sapiens
ctggcatttgcttgcagttggggctggtttgcaaatatttctctctgcctcagcaggtgagaaatagcacctcggagctccttgcctgttcaattatttcygattgaattaattatcctgcagtaacagcggagctgctaatagggaacattgggtgccccccaggcggagcatgtggctcgagagcacgcctggagctgg

SEQ ID NO: 54778 - DNA, 201 bp, Homo sapiens
cctgggttttaggaatgtgtagagctggaggagctgaaagagctggggctcgggatcaggtggttcagctgactcgggaaactttgaggcaccaccgcacmtgtccgtgcgtgagggagacatcttccttgcagggctctgggaggatggggtgcttctgtaatgcccagtcttgggcctggcgcctacctcatatgggtg

SEQ ID NO: 54779 - DNA, 201 bp, Homo sapiens
aggcggagcacaattctgctaacgtcagcaacaatcctgtctgttggaataaacatgcagatgcatctgtgaccccagaatcccagtggtggctctgtccycgtctcagccgagcactcatcggccagggtggctggactcagcacggggctggcactgaaactggcagtcactgctgtcagtgcccacagaaagcaagaa

SEQ ID NO: 54780 - DNA, 201 bp, Homo sapiens
tcggcctcccaaagtgctgggattataggcgtgagccaccgcgcccagccccgatcattttttttaattgtcagtgtactctggaccccctggatggccayctctcatgcagtcctgccatttgggattggctggattgtttccttggggagaaatggtgcatttccataggtggggggccacttatgatgcagcagttcc

SEQ ID NO: 54781 - DNA, 201 bp, Homo sapiens
gagaccctggctccagccaggcctgacctgcctctgtcctttcaggcacgccagccccacgggcctgctcctgacggtgctggtggccctcacctacatartggctctcctatacgaagagtgagtaggggctgcggcgggtgggggcgtggctgcccgactggccctgtctctccctctagaacctttccttgtggccag

SEQ ID NO: 54782 - DNA, 201 bp, Homo sapiens
ccaggagtggtggcgggcacctgtaatcccagctactcgggaggctgaggcaggagaactgcttgaagccgggaggcagaggttgtagtgagccaagatcytgtcactacactccagcctgggagacagagcgagacactctgtctcaaaaaattaaaaataaaaataataaaaattttaaaaatctgctgaattcactct

SEQ ID NO: 54783 - DNA, 201 bp, Homo sapiens
cggagcacaattctgctaacgtcagcaacaatcctgtctgttggaataaacatgcagatgcatctgtgaccccagaatcccagtggtggctctgtcctcgyctcagccgagcactcatcggccagggtggctggactcagcacggggctggcactgaaactggcagtcactgctgtcagtgcccacagaaagcaagaagag

SEQ ID NO: 54784 - DNA, 201 bp, Homo sapiens
gttaaatgggcatagtgggagtacctgcttgtaggatcatcgtgagaatccagtgagttggtccctctgcagggtttagagctgtgcccattagtgctcaygcatgtgtgtgtggtcactctggtgcccatccgcatccccagtggaggccgtgcatggccttgaatgagtagctatgtgctccctttcacttctgtgctg

SEQ ID NO: 54785 - DNA, 201 bp, Homo sapiens
gcctcttccttacccatgctttggggtgttaacagctgaggctattcgtcggtgacctgtgggactcgagctattcctgcagctcagcagacctcctggcygtggtgggtagctcctttcctttagtcagattccgaggcctctgcaacctggagccttggagtgggggttccattagaattactgggtagcagaaagccg

SEQ ID NO: 54786 - DNA, 201 bp, Homo sapiens
aacgtcagcaacaatcctgtctgttggaataaacatgcagatgcatctgtgaccccagaatcccagtggtggctctgtcctcgtctcagccgagcactcakcggccagggtggctggactcagcacggggctggcactgaaactggcagtcactgctgtcagtgcccacagaaagcaagaagagaatagacaaataccagg

SEQ ID NO: 54787 - DNA, 201 bp, Homo sapiens
ctctgtcctcgtctcagccgagcactcatcggccagggtggctggactcagcacggggctggcactgaaactggcagtcactgctgtcagtgcccacagamagcaagaagagaatagacaaataccaggcagtggagacactccctgcccactgcagatttataatcagcgaacatttactgagtacctgttgtatgcctt

SEQ ID NO: 54788 - DNA, 201 bp, Homo sapiens
cgttgcggagacaccccaggatgatcaaagtcagggaagtgtttctggtcggctgcagatagaaacgggacaggcctgtcccaggtggggccgtgtgcctstggcctggtgtgtggcccaggactgctggctggggacagggcggggacactgagggcagtgatgccccctccccacctccaccccagggtttccgggatt

SEQ ID NO: 54789 - DNA, 201 bp, Homo sapiens
agaggtggccacgtgcagagcatgactaatcagcagctgagtggcacacacacaggggatctcgcctgaggcctgggccagcatggggaaggcccctgcargctgctgggcacggggatggctcagggtcctgggctgggctgggctaggcttgggggagcccggtgtgttgggctggagctggcctctgctgtcgctgga

SEQ ID NO: 54790 - DNA, 201 bp, Homo sapiens
tgggcctgggccatcggggccggcctaggggatgcccagtagccttggcagcctcagccatccttgtcaactccagtgggactgggggatcctgaatcccrcctcctgatgccagtggagccctgagtttctgttcagaaggccaatggagggctgggctccaccgcctctgaggtccctgacctctcataggttctgggg

SEQ ID NO: 54791 - DNA, 201 bp, Homo sapiens
gagccctgggccaggtggtgggggggtcctggctgtggaatccagatgggacctaccactgcagctgggtattaggcagatttagccagggaaggacaagktgagagaggaggagcttctgagagtccatcaagggctggccgcagaggggagaggcctggcagccggcgagcccagtgtggcacaggtctgtctgcctgt

SEQ ID NO: 54792 - DNA, 201 bp, Homo sapiens
gctcccagtgaggacacggtggtgctgccaggcagggaaggaagttctgggagtcctgctggctgctggtttatcgattgcctcggaataacagccccatygaataccagttcgctgggaggcaaggcgtggtttcctctttttctttcccacatgggttagtcttgcttgatgcttttctgttgtcgttagattgttctg

SEQ ID NO: 54793 - DNA, 201 bp, Homo sapiens
gtgagactccatgtctacaaaataaaaaaaaattagccaggtttgggccgggtgcggtggctcacgcctgtaatccctcggcactttgggaggccgaggcrggcggatcatgaggtcaggagatcgagaccatcctggctaacacggtgaaaccctgtctctactaaaaatacaaaaaaatagctgggcatggtggcgggc

SEQ ID NO: 54794 - DNA, 201 bp, Homo sapiens
agagttgtttccagaaggaccttgttgtccgtccagatgaactgagcaagtgtgaaaatccctgtggaacttgctctagggcagataatgtgcagctgggrtgcatgtggttgttgctcccgtgtaattcttcttctttggaaatgggggctttggagcctgggaagcagagagaggcatgtgctccccacccccaccctg

SEQ ID NO: 54795 - DNA, 201 bp, Homo sapiens
ttgtgaaatcccttcaccagagtgatttcctcgcggcaggtgcctggggtagccactgggcggggtccatgagggcagctggagagtaaggggtggggggrcacttaggacagggaagctggcataggctttcctgggcacaagggcccccagctgctgggaaggaaggagggagaggggctgcagttcggcaagagtggg

SEQ ID NO: 54796 - DNA, 201 bp, Homo sapiens
cgagggccggctttcccttgacctcccgttactttcgctcagggctgcaaagccacggcctgaatggatatttacaaagcgccctcaatccaggatcttcrtgctcacaccgccaagatggggtcccgggccgcattcctgagccttccaggcaagcctggccctctccttggagggctggaggcgggtgcaaggagactc

SEQ ID NO: 54797 - DNA, 201 bp, Homo sapiens
aacatggggaccctggtcctggcacaaaagccagactcaggaaggggcagtgctgcctgggctcggtcggcccaagtggcccagcgtcggccggagggccwgggtcacggcaggaagggccagcctgggcaggtgggccgtggccctgagagaccctggctccagccaggcctgacctgcctctgtcctttcaggcacgcc

SEQ ID NO: 54798 - DNA, 201 bp, Homo sapiens
agacgcgttcttctccgtacttcagtgcctttgcactttctgcttcctccccttcgccagctttcccgccttcacctggctgccttggctcttccagcctrgcttccctgagccctggctctgtgcagacatggctgggccctcctccctgtgccttcctgaaccctgcggcagtgctgagccctagccccgggaactgag

SEQ ID NO: 54799 - DNA, 201 bp, Homo sapiens
tcttgtgccctggagtgagagtcacccttgggctcggggcagccaggccagggctctgggggacgcataagccacctccagaggacatcagccatgcagcrtgctgagagatggcatcaatggtccaggagctcattagagatgagccattatctggccagacgctgacacagcggggacccccacaggcctcccacggcc

SEQ ID NO: 54800 - DNA, 201 bp, Homo sapiens
ctccctctccatcccctgcccacagcttcacgcaggccatgctgagccagcccaggatggagagcctggacacccccgcggcctacagcctgggcctcgcrctcctgggactgggcgtcgtgctcgtgctctccagcttctttgcactggggttcgctggaactttcctaggtaagaccctgagggctggggtgaccctga

SEQ ID NO: 54801 - DNA, 201 bp, Homo sapiens
cccagtggcttagtgtccccagcagtgtcttgtgccctggagtgagagtcacccttgggctcggggcagccaggccagggctctgggggacgcataagccrcctccagaggacatcagccatgcagcgtgctgagagatggcatcaatggtccaggagctcattagagatgagccattatctggccagacgctgacacagc

SEQ ID NO: 54802 - DNA, 201 bp, Homo sapiens
gtgggtctggctgggacccaccctacccccaccccacgtccaggccaggcagtccccagggacacgtcctacctgccttctagcctggtccctctgcctgmtaaggcccagactatgtgcccccaggctcaccggccatggagcacccccactggggccacaggatgagcccaaactcaaaacaatcccccccacccaggt

SEQ ID NO: 54803 - DNA, 201 bp, Homo sapiens
gcccgctcccctgtgatgaggcctgggtacatcagcacatgcctagcccctgtgccctccctgcaccagcccctcagttctccggagccaactggagaacytgagcctctagacccactgctgtcatagtcacccccttttggtcacgccactgccttttctttttttcttttttcttttgatactaagtctcgctctatt

SEQ ID NO: 54804 - DNA, 201 bp, Homo sapiens
tggatcccagctttgtggctgccgtcatcaccatcaccttcaatccgctctactggaatgtggtaagtgatgtgcctgacactgtccagacgggagtatcycactgcttggtgagccccacatgcaggggatcgcggtggttgctgctggctggccagacagacagacagctctgctcttccctcccgtgtctgtcgctgg

SEQ ID NO: 54805 - DNA, 201 bp, Homo sapiens
agggaagcggctccgttgcctcagcctgtgccgctcgcagctcacgtttgctggcttaaaagcagccagagcagggaggcaagctgcccacgctgttggcygcgcactctgccttccgaacacgttcctgtactgcttgccgtgcacggagggccacgttcatgcctttggggccacgacagctctctctagagtaggaca

SEQ ID NO: 54806 - DNA, 201 bp, Homo sapiens
tggcagccctgggctggctactctctaagggtccctggggagagggcgagaagatgaggtcggcctcctcccgggctgtgacatcctccctggccatgacrtcctccctctccatcccctgcccacagcttcacgcaggccatgctgagccagcccaggatggagagcctggacacccccgcggcctacagcctgggcctc

SEQ ID NO: 54807 - DNA, 201 bp, Homo sapiens
ccagccagcagggccatgacttttggttgaactggccacccctggattttggggaggagagaaaggatgtcctgggctgcttttctcctctcaccttttgygttcagaggcagaggtgtgccctggtcctcactctctcccccactgttcttcccctccaggcccctgcctgcaccctatcctgccatgtccctggtgacc

SEQ ID NO: 54808 - DNA, 201 bp, Homo sapiens
agttccagccgtagacagcagcaaagcactgtctggtttgttcttggatcccggggcctgggagtcctcctggggtagctggaggaagtcagcttcttachgatggtggctcccagctttccctcctctcatatcagcgttggcctcacctggcatctgcccagccagcagggccatgacttttggttgaactggccaccc

SEQ ID NO: 54809 - DNA, 201 bp, Homo sapiens
ctgccatgtcataccaaacagtgctgctctgggtaccatgccctccaccagctcttttctgggcctgcttcagcaggtacagaatcttgcttttgtttttwaaaaaaaaaaaaaaaaaatcagctgttggggctgggcacggtggctcacgcctgtaatcccagcactctgggaggccaaagcaggtggatcacctgaggt

SEQ ID NO: 54810 - DNA, 201 bp, Homo sapiens
ttgcccgtggccccatctccgtcggaccagcctggcttgcaggcactgggtgcacacaggaaggggcctgtgaatgctccatgccagcacgtgcggagccrgggcaggccttgctggtggtcaggcccctcacacactcaccgagggtggcctaggccttccccctccgtggccaggcacccttgctgccttctcgtcatt

SEQ ID NO: 54811 - DNA, 201 bp, Homo sapiens
cagagggactgacaggcttttccctctgtcatctgagtctcagtctgtggcctggactcctcagggcttcaggaccttgggtccaggcactgtggccctaygtgggagtctccagtctccaaagggagcccctgccaagacctccccaatgttctgttctttccctatcactccagatgccagggcagtggtccaaggacc

SEQ ID NO: 54812 - DNA, 201 bp, Homo sapiens
aacctagaaggatttctaggcagagttgcctgtgtctgacttcccttcctcactgggaccccgtaaacctgaaggggagctgtaaggaatcctgccaagayggcagatgcacacggggtcacgccggtttcctccagccttgggagggtgcttcctggtgcctttgtttgtccccttccaagccctgcgtggccaccctgc

SEQ ID NO: 54813 - DNA, 201 bp, Homo sapiens
tctgagacccttgcttccatctggctcagaaatctggctcccagggcatggccgcatatccagtgggctccaagccagtgtttctggaccagaaagcgtcrtcctctgccagggcctcttgcacttgtgggaaagctgagctgagctgggcttactggcggagcctgtggcacaagaagggtttttctttgagcagagcca

SEQ ID NO: 54814 - DNA, 201 bp, Homo sapiens
taaaactccctgccaggccccaggcctgcactgtcaggaactgagatgcagcccagcggggctgtgttatttgctttaccccattcctgggtcttctttgraggctgaatgaaattccatggacaatttccaaggcatgagtttttgtgtcatttcactgctaacctacttggtgacccaaaacaaaacccttcccttgag

SEQ ID NO: 54815 - DNA, 201 bp, Homo sapiens
gatggggcgcgtgtagcctggctctccccattgcccgtggccccatctccgtcggaccagcctggcttgcaggcactgggtgcacacaggaaggggcctgygaatgctccatgccagcacgtgcggagccggggcaggccttgctggtggtcaggcccctcacacactcaccgagggtggcctaggccttccccctccgtg

SEQ ID NO: 54816 - DNA, 201 bp, Homo sapiens
atgagtttttgtgtcatttcactgctaacctacttggtgacccaaaacaaaacccttcccttgagtctggaggagcagcctctgccccactttgctcagasgtgcaacaaggccttcaggagggaatgggtgtaaaagggtttgggctccaaggagaagcagctgcgggagctgcctggctgctccatctccagaagagct

SEQ ID NO: 54817 - DNA, 201 bp, Homo sapiens
tcgagaccaccctggccaacatgatgaaactccgtctctactaaaaatacaaaaattagccgggcatggtggtgcatgcgcctgtaatcccagctactcgrgaggctgaggcaggagaattgcttgaacccaggaggcggaggttgcagtgagccgaggttgcaccagtgcactccagcctggggcaacagagcgagactc

SEQ ID NO: 54818 - DNA, 201 bp, Homo sapiens
agcttctgttccaggggagtttcccttgtttgtgttactgctggaccttgagatgattccattattttattcaaaaaaggggacactggcctgatgcagasgtgtggtctctctcctgcaggtgttggtggctggtgagcctgggctggctgtggggacccttcgcttacaggcaaggtgtgccctgggcagtgggcagag

SEQ ID NO: 54819 - DNA, 201 bp, Homo sapiens
gaggggtggaggcaccttatcccttctccatttccctctgcctgtggctgaggtgctttcaggctgtgagcccagtgctggcctggctagacgcccaccartgaccctgatgatggcagcaacttccagctccttggaatctgggaaagaaaagcagccatgggaaaggcagtaggggtcggggtgggaggggagatgggg

SEQ ID NO: 54820 - DNA, 201 bp, Homo sapiens
gacccaaggcagggaccccacccggtgtgtgcagtgcaggggtgtgtgttcctggaggcctttctcccaaggccctccctggccagggcacccctaccagsctgagtcccacctgtccagctgacgtcacagcctcttgcttgaattggcatgggcggtgggtgtgagcccctctggtgaggacagcgttggcagctgcta

SEQ ID NO: 54821 - DNA, 201 bp, Homo sapiens
ctggtgaggacagcgttggcagctgctaggcactgtcccccttgggcagctgtgggagcagagggaagagagactgggggtacccgccttcccagatggarcgggctgctcatgggacttagctggagtttccaaggagactgaggtttgggggtttctgtgagctggccggatgttgctgaagtgcctctgccctctctg

SEQ ID NO: 54822 - DNA, 201 bp, Homo sapiens
ttctctccgagggcctcaggggctcttagtctgccggctcctcaggctggggcttcctgcacccctagcgcccaccctccaactctcccctgctgctgagrcagatcttggagcctcggccaggctgtcctagtcacaaggtaagtgtccaaggcaggcgtcagagtcaccagcagccacttgaggcctccttccctttga

SEQ ID NO: 54823 - DNA, 201 bp, Homo sapiens
gattaaaggcacccgccatcatgcccggctaatttttgtattttcgtagagacggggtttcaccatgttggtcaagctggtcttgaactcctgacctcagstgatccgcccgcctcggccacctaaagtgctgggattacaggtgtgagccactgtgcctgccctgttcttactcttaattatgcaaaacatttacatggt

SEQ ID NO: 54824 - DNA, 201 bp, Homo sapiens
tccctgctgccccggggacgtctcactcagacatttgtatgtcacctacaggtaccctgggggccttagggcccctcctctcttcatggagcccagctagyggccccctcccttcctggctccctgcaaggcgagggaaagaggagaggagagaaggcctcggagcgctgatgtatccatcattccacacagacccgtgct

SEQ ID NO: 54825 - DNA, 201 bp, Homo sapiens
gtggaatgtgggcaggtaagagtcccagaggggtaagagccattggtgggaagcaactgtgggaccagtgccgccaccacggcccaaggacctggtgttcratgccgcatccttccggtggcgtctgtggctcttctccttccccctgacccacccatgcctccgccctggggctggtgggattgctctcaaaaccacctt

SEQ ID NO: 54826 - DNA, 201 bp, Homo sapiens
tagtggaaaatgatatttggagaccacagtttgaatgctagggtgctcactgttccaggcctctctaggaaaaatgatttttttttttttttttttgagayggagtctcactctgtcgcccaggctggaatgcagtggcaccatctcggctcactgcaacctccgcctcctgggttcaagcaattctcctgcctcagcctc

SEQ ID NO: 54827 - DNA, 201 bp, Homo sapiens
gggattgcaggcacctgccgttacgcccggccaattttttgtaatggaaaaatgaattttttagaaatagaaataaatcatgaattcataccaatatttcyacttcaaaagtttttgttcaacctttcaatttcatttttgtaccacttttataggaagcttggatcctaaatacagtaacataattaatgtgtatatagt

SEQ ID NO: 54828 - DNA, 201 bp, Homo sapiens
gtggctcacacctgtaatcctagcactttgggaggccgaggcgggtggatcacctgaggttaggagttcgagaccaccctggccaacatgatgaaactccrtctctactaaaaatacaaaaattagccgggcatggtggtgcatgcgcctgtaatcccagctactcgagaggctgaggcaggagaattgcttgaacccagg

SEQ ID NO: 54829 - DNA, 201 bp, Homo sapiens
tggtgttacagaagcagcagctgaaggcccgagaagtcacttgacttgtcagggcctcggccgtgtgtgcagagctggtcccgccctgtgcttcatgcccyctatgcctctcactgcctggtacatggatgcatcatggcaggaaagtggaaaaacagccccgagctgcagcacggccgactccaatgggccggaacgcca

SEQ ID NO: 54830 - DNA, 201 bp, Homo sapiens
tgtgaatggggggcaagggacaatgcctgggtggtccccaggtcacatcccagcctctgccacgtagccaaggctgttttaggagtctcctccaggaagcrtccagtcagaaggtggatgctggctcgggagccctcaggggtcaggcctgaccatctctccaggttaggtttgaatcagcgtcagaaagcttctttgagg

SEQ ID NO: 54831 - DNA, 201 bp, Homo sapiens
ctctgggccctgccccacggtgcccagtgaatgtttgatgactgtggtgtgtgtgggtcctgcccatcatgtgagactccctggaacctgaggcaaatagratttgagtgtggggtctggaggaagggaggagagaggggagaggaaggcgcggccggggtccttgctatcttcagtcacactgcacacattgctgactcc

SEQ ID NO: 54832 - DNA, 201 bp, Homo sapiens
ggggttttctttgctttgctttgcgcctgtgatggacactttgtgaggcccccagcggaaatttgggcctgtgctctgaaggccgcgtgctcctgcagccwtgggctcctctggcagttctgctggggcccttttagagtctgtgggatgcactcagcagctcccaggtagggcctgaggtcagaccccatgtgtctcccc

SEQ ID NO: 54833 - DNA, 201 bp, Homo sapiens
cctggttgggtgggctgaccttggagtggtgcttcctgctaggtggtgggggcaggctctgggaggggtgtcggctggaagggaccttgttatagtgtacrtggagcacctgaggcctaggagggctcagaaatcactacaaacccgttgtcaagccaggctccggtccactctgctgccctttctttttgtttttttttt

SEQ ID NO: 54834 - DNA, 201 bp, Homo sapiens
gaggttgagcatgagcactgaggctgggggaggcgagtgtcccccgctgtgccatggcccctcgggtgtgaagctgggtcatgttgctttgctggggcctygggtgcaggttgtctggaagtgggcagctggtgctgggacctgctctctggcactagtgtgctcactgcagggcgagagcttgggtgcaccttggacagg

SEQ ID NO: 54835 - DNA, 201 bp, Homo sapiens
ttttagggatgctcagttgagcaggacctggccctgttctctggagctcatggtctgggggacaccccctcacctgcctctggactctctggcgtccatcyagccacttcagtgcgacgtgtgactgctgcttgtgcccttccccaggagtggctgtgttccgctcatcatggaggcctggtgcccggcacagtgcgcagc

SEQ ID NO: 54836 - DNA, 201 bp, Homo sapiens
ggcagttctggaaagttcctcctcaccttgcaggggaaactgttgaggtggagggcacttgtccagggcagcacactgtgacaggtgggagccgaggctckggaggtgggccgggctgagctgtgacaggtgctggtgagcatctcctccgcttccccgtgctctggccgtagcagaaagtgtcccactgctgtctccagg

SEQ ID NO: 54837 - DNA, 201 bp, Homo sapiens
cagcacactgtgacaggtgggagccgaggctcgggaggtgggccgggctgagctgtgacaggtgctggtgagcatctcctccgcttccccgtgctctggcygtagcagaaagtgtcccactgctgtctccaggcagctctggctcttccctaattcggccccatccctccgtgtcgcccttcttcttgggggtgggtacag

SEQ ID NO: 54838 - DNA, 201 bp, Homo sapiens
agaggggacaccctccccctctcctcctggcatccatgccgccacttcctgttttcatcccagttctgctgctggtggcagggtcacccctcagcccccargactccaggccccctgactggggcaggtcgaggacttctatgcttggtgggctttggggtgattctccccggggtgctagaggccctcagcccttcagct

SEQ ID NO: 54839 - DNA, 201 bp, Homo sapiens
gggctgtgaacatctggggcagcatcttctcttcatggattgtcaggaactgcacccttgtttaccgagggacagaggccagcctcccactgccttgtggytgaggggagggggccgggtctctaacgctgtcttctttgtactgaaaaccaaacaccttctctgcacaaggtatgtctgtgagagaaacagacaagagga

SEQ ID NO: 54840 - DNA, 201 bp, Homo sapiens
gtcaggaactgcacccttgtttaccgagggacagaggccagcctcccactgccttgtggctgaggggagggggccgggtctctaacgctgtcttctttgtwctgaaaaccaaacaccttctctgcacaaggtatgtctgtgagagaaacagacaagaggacagaacggagcaggtgctgaaagggttgctgttggctgcag

SEQ ID NO: 54841 - DNA, 201 bp, Homo sapiens
tctagcctgggcgacagagcaagactccgtctcaaaaaacaaacaaacaaaaaatctctgccctggtgaagttccccttataggggataggggatggacarggaatgacactatacaaaataaataagtgcactaaatacatttgttaaatgatatggccaatggagagaaataaagttgggagaggcccatggcgagcat

SEQ ID NO: 54842 - DNA, 201 bp, Homo sapiens
gaagcctccagaccctcctgcccagaggagccccccaccccacccctggctgggtgtgctctgggtgggagggctgtgactgccgggcagcggggagggarggcgagtggttcccccaagtgcggctcctctcctgtcgtggcagggacatggcagctttcaggacaggcagaggacatagtagggaactgaggagagttg

SEQ ID NO: 54843 - DNA, 201 bp, Homo sapiens
tctttccatctcttgtcggcttctcacagcctccacagaagacagggatagttacagggaggacagggaaagtccgaagtgtgcaggcgccctgcatcccygcagccaagttctgggcggacactgccctgagccaggacggtgaggtgggacgccttccccacccagctgccagatcacccctcctggagggtggggtgg

SEQ ID NO: 54844 - DNA, 201 bp, Homo sapiens
ggagatgccgtctacagactgggtgtgaaaggcgctgccctgcgtgaggtagcagatctccatgtctcttctgtgttgtgattattgtgagcatgggaagwgcacatttggtcacacatgtccgtgctcccacacacagcctttcctgtgagtgtgcctctcatctagcacccagggcccccttcccaccagcgcccgctc

SEQ ID NO: 54845 - DNA, 201 bp, Homo sapiens
tgtttttaccaggtttattgattgagtttttggatttctagtagttcctttgttctctctctttttttttggagacggagtctctctgtcacccaggctgragtgcaatggtgccatctcagctcactgcaacctccgcctccggggttcaagggattctcccacctcagcttcccaagtagctgggattaaaggcacccg

SEQ ID NO: 54846 - DNA, 201 bp, Homo sapiens
cctctgcacacacggcctttgaggacatattgctgatggatgggctgagccgggcagcaaagctccgtgcatcctgacccttggttcctggggcagagccrggagccttgggctgaactggcttctgctggaagggtctgctctgtcgggtacagagctcatcactgatgaggaatctaccagagttaaaatctcagcttg

SEQ ID NO: 54847 - DNA, 201 bp, Homo sapiens
atggctgggtcatgtggtggtaggtgtgtgcataacacttcaagagactgccaaactgggctggatgcagtggctcatgtctgtaatcccttgcgaggccraggtgagtggatcacctgaggtcaggagttcaagaccagcctagccaacatgttgaaacccctatctctactaaaaatacaaaaattagccgggtgtcgt

SEQ ID NO: 54848 - DNA, 200 bp, Homo sapiens
gggagcctgtcagagggaacgcaaagccagctctatttgcccctttcctcctcttcaggaggtggcgtaccagggccacacaggatagaagcgtgcctcarggcctcctctgtccaaggcgctggtagagatgggctctggccgcacgggccagcacggcaatgcccaggcccgagggtgctctgggttcctgtcacctg

SEQ ID NO: 54849 - DNA, 201 bp, Homo sapiens
gagagcttgggtgcaccttggacagggattgattcactggactagctggtggagtgggcaggtctgttgatctgttggagacaatgactgttggagccctygagcaggctgtgtcacgtggaagggcagttgagccatgtgctgtgggacgctttggatgctgccctgagctgccactggtcctatgtcctggagaggccc

SEQ ID NO: 54850 - DNA, 201 bp, Homo sapiens
cgcgatctcggctcactgcaacctccgcctcctaggttcaagcaattcttctgcctcagcctcccgagtagctgaactacagatgcacaccaccactcccrgctaatttttgtatttttaatagagacagggtttcaccgtgttagccaggatggtctggatctcttgacctcatgatccacctgcctcggcctcccaaag

SEQ ID NO: 54851 - DNA, 201 bp, Homo sapiens
ttagaggtgtaagccaccatgcccagtgtcccccacccctgaaggctataatttttgaaaagggaaaataactggtgttggggaggatgtggagaaactaraatcttcatgcattgctggtggggctggaaaatggggcagccactgtggcaaacagtttcacagctcttcaataaatagatttaccatgtgacccagcaa

SEQ ID NO: 54852 - DNA, 201 bp, Homo sapiens
agacagggatagttacagggaggacagggaaagtccgaagtgtgcaggcgccctgcatccccgcagccaagttctgggcggacactgccctgagccaggayggtgaggtgggacgccttccccacccagctgccagatcacccctcctggagggtggggtggggccctgacaccttgttctttgtccctgccccaaacttt

SEQ ID NO: 54853 - DNA, 201 bp, Homo sapiens
gtattcccaggctgggctaggaggcacctggaggggcagggtggtctctggaaggtggtctgggtgggtggggtgcaggcggagccctggctgaagaagcsttacgaccaaggcctggaggagtgagccggctcttcagatggctgggcagggcccatgagtcccaggagagggcggcccccactcacaggctgggcagca

SEQ ID NO: 54854 - DNA, 201 bp, Homo sapiens
ggcaccttcacacctaaatggaaacctgcatgctggtttccatgaagaaaaggttgcgattggggtttctgggaggccagtgaggggttgggactctacaraggagagtggactcacggggcgctgggccgccctccagccaaggctcctggcctgggggaaagggggcaagggatgagggatgcagggagcagtgtgttc

SEQ ID NO: 54855 - DNA, 201 bp, Homo sapiens
ctctgtcctggtgactacatgtcctggtcactgctgcatcccacccagtgcctggccggacctgctcaaggatgtggtcaggacaggccgggggttgagcrgctgcatgaaggagggagggcatggagctgatgggacagtttgcttccgatggagcaatggagggctgggcgtgtgcagcgttccatggcagaaaaaagc

SEQ ID NO: 54856 - DNA, 201 bp, Homo sapiens
ggcctgggggaaagggggcaagggatgagggatgcagggagcagtgtgttcagaaaaggttgttccctgagcacagatttgacacctcttcactgtcagckctgagacacgcccctgccctggggagctcagaaagtcaggtgcgggatccagtggcctaattttagatcttgggtctccatgtcgaaacgacagcagagt

SEQ ID NO: 54857 - DNA, 201 bp, Homo sapiens
tgctgcttatggtgcctggtgcctgtcccgtgcccctcctgttttgctgctgcttatctgctgttcggggcatcctgtgacaggccagttggaatcctacrtagagtgaaagcatctcagccccagacaggcccgaccactcccacgccagcttgtcttctcatcagggactgggctgggctgctgtggaggcctgcaagc

SEQ ID NO: 54858 - DNA, 201 bp, Homo sapiens
ctcccttttgattaactcaaggccagctgattaggacctgaattctatttgtgaaatcccttcaccagagtgatttcctcgcggcaggtgcctggggtagycactgggcggggtccatgagggcagctggagagtaaggggtgggggggcacttaggacagggaagctggcataggctttcctgggcacaagggcccccag

SEQ ID NO: 54859 - DNA, 201 bp, Homo sapiens
caccaccgtgtgtggccctctgccccttgcctctgggacaggtttagtctgcagttattatgttcaaaattttaaaattttaagcagttaacactgatgcrtgatgaaaattccaacagcacaaaaaggcagatagtgacaatgtgccccttgaatccctttcccctgaacccctttccggtgtcttgggtcccttcctga

SEQ ID NO: 54860 - DNA, 201 bp, Homo sapiens
ccccttgccatcctcgggagcccggtgcggttgtgcccccctcatatctctgggcctctcagcacacaggtctgtcctgcctttgatagcaagacggaccygggcaaggttcctggcttctccgagccttggtattctcatctgtgacccaggcacagctgcctggctcactgttgcaagggccgggatggtgcctggagt

SEQ ID NO: 54861 - DNA, 201 bp, Homo sapiens
gtgatgcagatgaattctggcagaggaaccctgagcatggggtatggacccaggcctggctcgggtctccgcaggagggggtaagagcgacagagtctccstccagagtgaccctccagcgtctcgggcctggcctctgcgcccaccccctattgcagcacctggatgggtctccctggttctgcattttccacagcaggc

SEQ ID NO: 54862 - DNA, 201 bp, Homo sapiens
caggtgctgcgggccacggtccacgatgctccctgcttcctgtttggtgggcagcctgggttttaggaatgtgtagagctggaggagctgaaagagctggrgctcgggatcaggtggttcagctgactcgggaaactttgaggcaccaccgcacatgtccgtgcgtgagggagacatcttccttgcagggctctgggagga

SEQ ID NO: 54863 - DNA, 201 bp, Homo sapiens
acggtgaaaccctgtctctactaaaaatacaaaaaaatagctgggcatggtggcgggcgcctgtagtcccagctacttaggaggctgaggcaggagaatgrcgtgaacccgggaggtggagcttgcagtgagcagagatcgcgccactgtactccagcctgggtgatagagtgagactccatctcaaaaaaaaaggaaaga

SEQ ID NO: 54864 - DNA, 201 bp, Homo sapiens
ctctgcgcccaccccctattgcagcacctggatgggtctccctggttctgcattttccacagcaggcagagtgcattccaaaccctgccgggccgaggccwgcaccttccctgctccatgccctgccccagactctaaggcacacctccctgctatttcctctttctggaatgctctcccctgttcgcccctcccaacccc

SEQ ID NO: 54865 - DNA, 201 bp, Homo sapiens
atcctcctggaaggctgagtggcgggaaggaaagacacctgccttctacgccatgctgggccctgcagcaggcactgtccatgtctcaaatctccctcccygggaaatctaggcacaggtcatactgctggaaggcttgtctgtctctcccagtctcagggccagagcttccaggagcaaagagtggtccgggcctttcct

SEQ ID NO: 54866 - DNA, 201 bp, Homo sapiens
tactgcttctctccagtcgatgaatatgcactaaacatccattctgtggcctgggccaagtgctggggggatacgcagggaaggaggagcaacttctgttycccaagagctcccagtcaagctggaggaaggagttccagggaggcataaagacatgtctgtatgtccttagctcagcataaggagtttcacaacaatctg

SEQ ID NO: 54867 - DNA, 201 bp, Homo sapiens
ccacacagacccgtgcttgttgagtgcctcctcgggtggtagccccacgtgggattcagcatagtgcaggcagaggtggacacagtgtgaactgttaggcsacagccacatcttgccggagccgcaaggcaggagttcaggagtgagaaggcactggctgcggctcctggggctggaaagggggccagtcaggcaggcaga

SEQ ID NO: 54868 - DNA, 201 bp, Homo sapiens
cccacagccagatcctcccagggcgtggccatggggttgcacctgtggccaggggctggggactcagggtggaccaaactggctttgggggaccctggacycatttctagaaaacagcctttgttcctcagagcatggtttctgggagacgggagcactttgccccagaatctcctcctgtgcgggaatgaacagccctag

SEQ ID NO: 54869 - DNA, 201 bp, Homo sapiens
gagaaggcactggctgcggctcctggggctggaaagggggccagtcaggcaggcagaggggtgggtccagctgtagaagcgagatgggggcggttcgggargcaaaagcaggaaggcagaaggaagcttggagctcatgagcccctctgtgctggcgcacggcccacgtcctctaaacaaaagggatgggctccttcagtg

SEQ ID NO: 54870 - DNA, 201 bp, Homo sapiens
gtccctggtgacccatccttcccgcccacacctgccagtgtgaggcacacaggtggcaggtgctggagccggaccgggctgttgggccaggctctgacagraccctcgggaccagctcctgcatcccccacacccccacaccctttcccatgcatgcctcgcttcagtggctgtctagaggtgggtattcttttttgtgca

SEQ ID NO: 54871 - DNA, 201 bp, Homo sapiens
ctgggcacaggagggagaggggggagggggtggatacgttccagctttgaccagttcagccctaattgggagactcaggtggatgtcagctgctgctgggytcccccagtgttagttgcttaatctttcagtgctcagtttccgtccttcatcttggctcccacagaaggtgaaaaaagcatatttcttgctcactttccc

SEQ ID NO: 54872 - DNA, 201 bp, Homo sapiens
gatcatcccattgcattctggcttgggcgacagagcgagactccgtctaaaaaaaaaaaaaagtgagagagagagagcaggaaggaaggaaggaaggctcycatgcagaaggctccggccttggctgagcatccagtttgctgggtacctgggccaggcccttctctcttgggcaatgagactcccaatgacagctgcctc

SEQ ID NO: 54873 - DNA, 201 bp, Homo sapiens
agggcttctctgtctcttttctgcatcctgtgcttggctgaagatgagaaccttgctttcccactgagaggcagtgggccacagcactgcgggagccacgrcatctgcagacgcatttgatttccccattaatagcaaagctcccactccaaggatcttccagcagacaaagggcattttaaccttcctctcagtcccagt

SEQ ID NO: 54874 - DNA, 201 bp, Homo sapiens; identical to SEQ ID NO: 10392

SEQ ID NO: 54875 - DNA, 201 bp, Homo sapiens
tttatgaatcatgcttttcatattgtgcctaagaaatcatcatataatccaagatcataaagattctctctagtctattttcttctaaaagttttagaagrctttatatatttagattgatatatttatatatagatttaggtttatatttctatttatagtccatcttgaattcatttttatattttttctgagttatgg

SEQ ID NO: 54876 - DNA, 201 bp, Homo sapiens
ttctttccacattcatttgttttggcagccttgttggaaatcacttgccatgtatgtggaagtttatttctgggctctgtatgctattccattggtctatrtctatccctatgtcagtgccacactgtcttgattactgttgcattgtggtaagtttgaaatcaggaagtgagtcctccaactttggttttttgttttttt

SEQ ID NO: 54877 - DNA, 201 bp, Homo sapiens
ccattgccactgggactcctgaggtggacagaggggacaccctccccctctcctcctggcatccatgccgccacttcctgttttcatcccagttctgctgstggtggcagggtcacccctcagcccccaggactccaggccccctgactggggcaggtcgaggacttctatgcttggtgggctttggggtgattctccccg

SEQ ID NO: 54878 - DNA, 201 bp, Homo sapiens
tgattcagactagtatcctaaaaacttaagagaaaatggagcagtgtgaatagtatgaaccagaaaatgatcagtgacaaccatcacacaggaaattttgraagggacacatggcagtgtgacctgttttcgctagggtggtcaagtgggcctctctgaggaggtggcatttgagccaagacccaacttcaagaagaagca

SEQ ID NO: 54879 - DNA, 201 bp, Homo sapiens
tgtgaatagtatgaaccagaaaatgatcagtgacaaccatcacacaggaaattttggaagggacacatggcagtgtgacctgttttcgctagggtggtcargtgggcctctctgaggaggtggcatttgagccaagacccaacttcaagaagaagcaggagggaggaagagcctccgggcatcgggagtggcaatgcaaag

SEQ ID NO: 54880 - DNA, 201 bp, Homo sapiens
ctctgtgtgcacaaacacatgcatgtatgcactcacacactgttccctcgcctagaaccctcccacttatgccccttgtcagtccttccaaacccaacgtsaagtgttccctcctgcacgaatccctccctaaccccccaaccttcggtgcctccccagtggcttagtgtccccagcagtgtcttgtgccctggagtgaga

SEQ ID NO: 54881 - DNA, 201 bp, Homo sapiens
caggaggcggaggttgtagtgagccaagatcacaccactgcactccagcctgggtgacagagcgagaccaaggaaaggcatggtgtggcactgggccagayggacactgcacacactgaccctgcggcccctcatgtgtaaaatggccatcatagtcatgactgccttgtgtataaagcaggtgctcaggcagtgcctccc

SEQ ID NO: 54882 - DNA, 201 bp, Homo sapiens
tgccactgcactccagcctggcgacagagcgagactccatctcaacaaaaaaaaaaaaaaaaaaaagaaaaaaagaaaagcagtattgttctgtgattcaractagtatcctaaaaacttaagagaaaatggagcagtgtgaatagtatgaaccagaaaatgatcagtgacaaccatcacacaggaaattttggaagggac

SEQ ID NO: 54883 - DNA, 201 bp, Homo sapiens
gctgggtcatgtggtggtaggtgtgtgcataacacttcaagagactgccaaactgggctggatgcagtggctcatgtctgtaatcccttgcgaggccgagrtgagtggatcacctgaggtcaggagttcaagaccagcctagccaacatgttgaaacccctatctctactaaaaatacaaaaattagccgggtgtcgtggc

SEQ ID NO: 54884 - DNA, 201 bp, Homo sapiens
gaacatttcttcccaaggcctcctcctgctcttccttgttcagaccatgggaggctttcccggccttctctttctgggtctttgggggagttcacactgcrgaccctcactcttcctggagaccggccttcctgtgcgccacgatgcttttctggctctcttcctgctgttcttgtgaattctgcttcctccacctgatgt

SEQ ID NO: 54885 - DNA, 201 bp, Homo sapiens
tttccttgtctgtaaaaatgggggggagcgtaagaagctgcgacggggtgaagtgagcagagacgaggtctgatttggattttgtgaaggtttctgcaacsatggcagggatgcagagagagcagggttgggatgggatgcattttggaaatggtgaaggacttgctgatggaaacctttccaatcagacttgctaagaat

SEQ ID NO: 54886 - DNA, 201 bp, Homo sapiens
ccttgcggggctgctgagttcttgatagaggtaacaagcaaccctggggctcccgtgtgcaggaggaaggttggggactgcctggttgtgcttcggacccrgaggcagacagaggaggcctttgaacttggcctgagcttgttgggtgaagccaaggacagaggctggggtctgagtgaggggagatggtcccgtgaagtc

SEQ ID NO: 54887 - DNA, 201 bp, Homo sapiens
ccaggcccaggagcaggtggggcctcctcacaggagcagggcaggattcgaggagctctgggctcccacctccgagctggactctgagcatgctggctccytccttctttccagggcagcagcagccccacattcaggacagagccatctgtgtaagcagggctcagagaccctcagacagacagggaaaaggagcaaaat

SEQ ID NO: 54888 - DNA, 201 bp, Homo sapiens
tgggaacctgcagggacagcatctgccctctggccggtggggggttcttagtagcagggcaaggggaaggcaaagggggccaggcccaggagcaggtgggkcctcctcacaggagcagggcaggattcgaggagctctgggctcccacctccgagctggactctgagcatgctggctccttccttctttccagggcagcag

SEQ ID NO: 54889 - DNA, 201 bp, Homo sapiens
cctgagagattcaggcgccagtgcatgggtggggcacaggggctgcggcagacagagggtggtgatacaggggtggagtcccacaggccggatgccttgayacttctcagctgcagggctgtgcccggggctctgtgcccctgaatgagggcaatggttcccctgcacagtgaccttgtgagctgattcaggccccatgat

SEQ ID NO: 54890 - DNA, 201 bp, Homo sapiens
ctgtgggaccagtgccgccaccacggcccaaggacctggtgttcgatgccgcatccttccggtggcgtctgtggctcttctccttccccctgacccacccrtgcctccgccctggggctggtgggattgctctcaaaaccaccttagccaagagggctccttcccaagactcaggaggaagaacataggggacagccaggc

SEQ ID NO: 54891 - DNA, 201 bp, Homo sapiens
aggccctggaacaggcagagattgtgctgttctgtcctgtccctccctttgggtgacagagaaccacgaacgtctgtgtcctcagagggtcacgggacacrttccagaggggggtggtggggagcacagtgagcacagaacatggtattttcaatccaggctgtactggcgaggagagagagtctctgtgcccagccctgc

SEQ ID NO: 54892 - DNA, 201 bp, Homo sapiens
ggggtcttgctctgtcgcccaggctggagtgcattcgtgctgcagcgttgaactcctgggctcaagtgatcctcccacctcagcttccagagtagctgggrctacaggcatgtgccactgcactggctaatgtttttatttttgtagagatgggggtctcaccatctggcccaatcttgtctcaaactcctgggttcaagc

SEQ ID NO: 54893 - DNA, 201 bp, Homo sapiens
gcccaccagaagctggaagaagcaaaaaatggagtctcccccagagcctctggtggaagcacagcccagtcggcaccttgattttggcccagtggtaactrattggggattgctgttgttttcagcccctaagttggcagtcatttgttacagcagccacaggaagcgaggccagggtatttaaaaagccaaagacccctg

SEQ ID NO: 54894 - DNA, 201 bp, Homo sapiens
accatggaggcagaggctggagtgaccaagccactagccaaggaaggccaggcccaccagaagctggaagaagcaaaaaatggagtctcccccagagcctmtggtggaagcacagcccagtcggcaccttgattttggcccagtggtaactgattggggattgctgttgttttcagcccctaagttggcagtcatttgtta

SEQ ID NO: 54895 - DNA, 201 bp, Homo sapiens
tgcctggccatcctggcgtttcctcccactgcctggcctgcatgcttcctctctcctttcacctttgcacacacccagcatgccagagatatgaggtggtkaagggtgaggagggtgtttggaggctgaaaaatggtcctgcaaagacgtccacatcctgtgaaggtctcttatatggcacacacacaaggatctttgcag

SEQ ID NO: 54896 - DNA, 201 bp, Homo sapiens
aagccttggctgggctggggagcacctgtactctcagccacaccgtccccagctggccccagcctcctgacatgggcctctggagccagggctgcagccgmagtgcctggccatcctggcgtttcctcccactgcctggcctgcatgcttcctctctcctttcacctttgcacacacccagcatgccagagatatgaggtg

SEQ ID NO: 54897 - DNA, 201 bp, Homo sapiens
tcgtggattgtcaggaggattctgtaataatccacaggatgtgttctgcatgcactaggtgctcaactttcctgacccccgtccagtgcccccctcaccgrccacgtctgccctctaagctgccagtcctataggaggcattaagacgtctagcaaggctgtgttctcagatgcctcgaaatgggacctcagccttggagt

SEQ ID NO: 54898 - DNA, 201 bp, Homo sapiens
gacttgtggggacggcggccacaagaggaggatcttcagcatggcctgacagcacctgtaatgtaggcaggcaatgggctcctccaggtggcaggaacacygtgaggagcatgcaacgtgctggagaccatggggcatgtgacctccgggcacaccctggacagacctgggtgagaggtgggctgggacgccaggacggtg

SEQ ID NO: 54899 - DNA, 201 bp, Homo sapiens
aggatgggaggcagaaaaacaggtggcttccgccccagagggcgagcatttgcttctgtgtgatcggagggcagcacaggggctggctgggccctgggatsatcgtgacaggctttagtggtctgggtggatgggccgtggtcagagccgatgtgaccaaattggctttcaggggagcccaggccaccttctgagtggaac

SEQ ID NO: 54900 - DNA, 201 bp, Homo sapiens
agaatcacgtgaacccgggaggcggaggttgcagtgagccaagattgtgccactgcactccagcctgggcgacagagtgagactccgtctcaaaaataaayaaataaataaataaaaattttgttaaaaagggcatggtggcacatgcctgtagtcccagctatttgggagtctgaggtgggaggatcatctgagcccagg

SEQ ID NO: 54901 - DNA, 201 bp, Homo sapiens
tttcactagagtgttttaaagcaaatccagacatcaaatttcatcagtaaatatctcacatgcatatgaaatgcagaatgtatctctaacaagtaaggactttttttttttttttcttgagacggagtctcagtctgtcgcccaggctggagtgcagtggcgcgatctcagctcactgtaacctcgtctcctgggttcaag

SEQ ID NO: 54902 - DNA, 201 bp, Homo sapiens
ttcactagagtgttttaaagcaaatccagacatcaaatttcatcagtaaatatctcacatgcatatgaaatgcagaatgtatctctaacaagtaaggactttttttttttttttcttgagacggagtctcagtctgtcgcccaggctggagtgcagtggcgcgatctcagctcactgtaacctcgtctcctgggttcaagc

SEQ ID NO: 54903 - DNA, 201 bp, Homo sapiens
ggagcttggaagtcactcggcttcagtggcctcagtagcctcctgggaccaacggtgtcctgaggagctcccgggcctgcctgccatccccatcctcagawgccggctacagctccttgggcccagcccccagggcaccgtgggctgtcacagggcactccaagttctcaaggagcttgtgcctgccagtaggggtccccc

SEQ ID NO: 54904 - DNA, 201 bp, Homo sapiens
ttagattgatatatttatatatagatttaggtttatatttctatttatagtccatcttgaattcatttttatattttttctgagttatggattgaagttcyttttttttttttttttttttttgcatatgatagccaattgttccagtggcatctgtggaaaggctgtcctttctccactgaattgccttagcactttgtc

SEQ ID NO: 54905 - DNA, 201 bp, Homo sapiens
tagattgatatatttatatatagatttaggtttatatttctatttatagtccatcttgaattcatttttatattttttctgagttatggattgaagttctttttttttttttttttttttttgcatatgatagccaattgttccagtggcatctgtggaaaggctgtcctttctccactgaattgccttagcactttgtca

SEQ ID NO: 54906 - DNA, 201 bp, Homo sapiens
agattgatatatttatatatagatttaggtttatatttctatttatagtccatcttgaattcatttttatattttttctgagttatggattgaagttctttttttttttttttttttttttgcatatgatagccaattgttccagtggcatctgtggaaaggctgtcctttctccactgaattgccttagcactttgtcag

SEQ ID NO: 54907 - DNA, 201 bp, Homo sapiens
tttgtggtttccatctgatttttgacatagatgattattgttgtctgtgaataaagacaaatcctactgagacagactgagaccatgtctcataaaaaagaaaaaaaaaaccatttcagaataatgcgttagtgtcctagcaacctcagcatgtctgcctttagccagctggggacccttcaagtgtttcttagtgttctt

SEQ ID NO: 54908 - DNA, 201 bp, Homo sapiens
ttcccacagagggggccccgtgccatgagggaagcctagaactgctgtcggcctcagccaggtacgggtactgacaaggtatggagatgtgctcccccggsgggtcagaggacctgcggtcaaggatggcacagcgggcgctgccctcggcttcatacccagcccccaccccagcagttctagtttagccattttcttcca

SEQ ID NO: 54909 - DNA, 201 bp, Homo sapiens
agcaaggctggctccagcctttctgtcttgaaatctcagagctgaggggtgggcacctctctccaggcctcccagtaaggtacttaggaggcgtcaggggytcacctggccatggccatggtttcatctccaggagacttggtgtcttgtgtcacctgctcccacccctgccccagcacacccaagacagcccctctgctg

SEQ ID NO: 54910 - DNA, 201 bp, Homo sapiens
gtgggccagtaccttccacatgagtcaattacctcatctggaaagtcagaataacattccctacctcacagggctcttgtgaggcttaaagaaaatgtgtkcttcaagtgctgagctcagggcctgcagccagcaagagctcagacagattagctattgtttccatgtttaggttttttttttgtttttttgtttgttttg

SEQ ID NO: 54911 - DNA, 201 bp, Homo sapiens
aagaggtggggaacctctcatcactggcggcacgtaagcagaaccaacttttccatttgcccaagatgccacagaaggaatgtttcagtgagggaggttgrcctggataatttctctacaagctctcagacttgggaacttttgaaaggctcaggcaagtacttgtgccccaaagtatctttggcagggttttttattttt

SEQ ID NO: 54912 - DNA, 201 bp, Homo sapiens
gccatgtagaagggggggcagaatgcaagggggcagtgtccctttgcagacccatctaggggcctgccccagggcctgccagtgggcaggggagactaacygggtgtgtgaggggtgggcttctctgctctttctcctttctccccagggctgtgcagctggagagagctggggctggggttcgggtcagggtgacccttg

SEQ ID NO: 54913 - DNA, 201 bp, Homo sapiens
caccatctcggctcactgcaacctccgcctcctgggttcaagcaattctcctgcctcagcctcccgagtagctgggattgcaggcacctgccgttacgccmggccaattttttgtaatggaaaaatgaattttttagaaatagaaataaatcatgaattcataccaatatttccacttcaaaagtttttgttcaacctttc

SEQ ID NO: 54914 - DNA, 201 bp, Homo sapiens
aatcagctgttggggctgggcacggtggctcacgcctgtaatcccagcactctgggaggccaaagcaggtggatcacctgaggtcgggagtttgagaccakcctgaccaacatggagaaatcccatctctactaaaaatataaaaagttagccaggcgtggcggcacatgcctgtaatcccagctactcgggaggctgagg

SEQ ID NO: 54915 - DNA, 201 bp, Homo sapiens
atcttctttctttatctggtttcatttgatttaattaatttatttattttaagacagagtctcgctctgttgctcaggcatgtactcaggaatgcagtggygtgataccagctcattgcaacctccgcctcccgagttcaagcaattcccccacctcaggctcccgagtagctgggattacaggtgcacctaccaccacac

SEQ ID NO: 54916 - DNA, 201 bp, Homo sapiens
agccaaacacaggcctcccggacacccctttctcctgagaagccttggctgggctggggagcacctgtactctcagccacaccgtccccagctggccccarcctcctgacatgggcctctggagccagggctgcagccgaagtgcctggccatcctggcgtttcctcccactgcctggcctgcatgcttcctctctccttt

SEQ ID NO: 54917 - DNA, 201 bp, Homo sapiens
agctttgtggctgccgtcatcaccatcaccttcaatccgctctactggaatgtggtaagtgatgtgcctgacactgtccagacgggagtatcccactgctyggtgagccccacatgcaggggatcgcggtggttgctgctggctggccagacagacagacagctctgctcttccctcccgtgtctgtcgctggctggtgtg

SEQ ID NO: 54918 - DNA, 201 bp, Homo sapiens
catctggcatccaggcacatttctgcggccgccctcccaggacatgacacagctcattaggtttcagctttttatcttcccttttatgagactacactgtrgtaacctttgccggacttggatgttcccaggcctcccagtgtgttcccagagggtaactttttctccgactcctgggggctcacaggccctgctgtgtct

SEQ ID NO: 54919 - DNA, 201 bp, Homo sapiens
cacggggcgctgggccgccctccagccaaggctcctggcctgggggaaagggggcaagggatgagggatgcagggagcagtgtgttcagaaaaggttgttycctgagcacagatttgacacctcttcactgtcagcgctgagacacgcccctgccctggggagctcagaaagtcaggtgcgggatccagtggcctaatttt

SEQ ID NO: 54920 - DNA, 201 bp, Homo sapiens
cacctggctctcctcctccaagactttctgcgtgcaccagcatcttccattttgtgtttcctgtctgtttaccatgtgtaattttgtcagcatgtcacgtycctttcataatgaagcaagggacaaagaaacaagggccagtggagcccagtacagggtggccagaggtgtcggctctatgtaggtctgctgctctggtgt

SEQ ID NO: 54921 - DNA, 201 bp, Homo sapiens
ggccatgagcaggaagttgactccggaggctgcagggacctgcttaggcatcctcattaccgcctgggtcccagagcgagccaggagcctctgaggcagcrggggcttctcaaccacacacctggctctcctcctccaagactttctgcgtgcaccagcatcttccattttgtgtttcctgtctgtttaccatgtgtaatt

SEQ ID NO: 54922 - DNA, 201 bp, Homo sapiens
aatgcaatagaacaaaacacaccattatgggaaagatcacagctctgatggactttacacttattttttttattttttgtttttaattttttaaaaaaatktttattattatactttaagttctggggtacatgtgcagaacatggaggtttgtacataggtatacatttgccatggtggtttgctgcatccatcaaccca

SEQ ID NO: 54923 - DNA, 201 bp, Homo sapiens
atgtcaccatgttggccaggctgctctcgaactcctgacctcaggtgatctgatcgcctcggcctcccaaagtgctgggattataggcgtgagccaccgcrcccagccccgatcattttttttaattgtcagtgtactctggaccccctggatggccatctctcatgcagtcctgccatttgggattggctggattgtttc

SEQ ID NO: 54924 - DNA, 201 bp, Homo sapiens
tgaggagcatgcaacgtgctggagaccatggggcatgtgacctccgggcacaccctggacagacctgggtgagaggtgggctgggacgccaggacggtgargggcttcaaggtgtgtttgtcctttgtccttatacaggtgacctgcatgggcgggtgaggtccatcagaatgctctagaacaggacaactgaggtcccgg

SEQ ID NO: 54925 - DNA, 201 bp, Homo sapiens
acagtggacacacacgtcgtggcttagtcacgcaatggtctcccctgcagcaaggaaaggaatgagtggccggtacctgtggaaggatgtcgtggacctaygatgcattgaaaccagacacaaaaggcaaaacggatctacggtggtagaagccagtgtagtcggcagaggcttagccaggtgagggcgcgagggagcttt

SEQ ID NO: 54926 - DNA, 201 bp, Homo sapiens
tgagtggccggtacctgtggaaggatgtcgtggacctacgatgcattgaaaccagacacaaaaggcaaaacggatctacggtggtagaagccagtgtagtyggcagaggcttagccaggtgagggcgcgagggagcttttcagaactggaggtgtcctgtgcttggatgtggtgctgccacaggtgtgcacagaggggaac

SEQ ID NO: 54927 - DNA, 201 bp, Homo sapiens
caccgtgaggagcatgcaacgtgctggagaccatggggcatgtgacctccgggcacaccctggacagacctgggtgagaggtgggctgggacgccaggacrgtgaggggcttcaaggtgtgtttgtcctttgtccttatacaggtgacctgcatgggcgggtgaggtccatcagaatgctctagaacaggacaactgaggt

SEQ ID NO: 54928 - DNA, 201 bp, Homo sapiens
tttctttctttctttctttctttctttctttctttctttctttctttctttctttctttctttctttttctttctttctttctttccttccttctttttcyttttctttctttctttttctctttctttttctttctttctttctcattagattttttttaatgggtctcaaaaatctgtgacaatttttttttttttttt

SEQ ID NO: 54929 - DNA, 201 bp, Homo sapiens
ttcctgggttgaagcgattctcctgcttcagcctctccagtagctgggattacaggtgcctgccaccacgtctggctatttttgtatttttagtagagacsgagtgtcaccatgttgtccaggctggtctcgaactcctgaccatcaggtgatctgcctgctttggcctcccagaatgctgggattacaggcgtgagccac

SEQ ID NO: 54930 - DNA, 201 bp, Homo sapiens
cccaggctggagtgcagtggcacgatctcgactcactgcaacctccacctcccaggttcaagtggttctcctgcctcagcctcctgagtagctgggattayaggcatgcaccactgtgcctgactaatttttgtatttttagtagagacagggtttcaccatgttggcaaggctggtgtcgaactcctgacctcaggtgat

SEQ ID NO: 54931 - DNA, 201 bp, Homo sapiens
agtatttcaatgaatcttcacagcaaatgctgttaatatcccctttggagactgaagcttgaagaggttcattcatacattcttcaaatgtttattgagcwtctactgtgcgctgggcaccatcccggcccctggccctcacgcagcagcttcagtggtgaatgaatgtatagcactgccggtgacacagcaggcaagggg

SEQ ID NO: 54932 - DNA, 201 bp, Homo sapiens
aggacttctatgcttggtgggctttggggtgattctccccggggtgctagaggccctcagcccttcagctttggtcaacattatccctcagggtctctctstgagccccgaaggccagtcaggggctcccggaggccgtgtggggattagggttctgcggggagaggcctccacctgttccagcccctctcctcttccacc

SEQ ID NO: 54933 - DNA, 201 bp, Homo sapiens
ttgggtggcagagtgagaccctgtatcagaaaaaaaaaaaaacccaaaacaaaacagactgtgtgtgagtctggactcctggggagctgggggcactggaraggggccttggccccaggcccactgtgtgcctttctgggctgtggctctagggagtgttttcccagcattgggctggggtgctgcccgcttctgctcatc

SEQ ID NO: 54934 - DNA, 201 bp, Homo sapiens
ggatccagccccgtgtccgtcagcatgagggtggagaggtgtgggcatgttgtccttggccaccccagtctagctgggcagatgacactgtcattcctaartgaatggccttgtgctgaccagcagctggacacatgctgggcaccctatgtgtctgtatgggggtgaggggtgggccctgcaagggtaagcctcatctgg

SEQ ID NO: 54935 - DNA, 201 bp, Homo sapiens
acttatcatacccaagacagtgtacatgctgggtagttacactgtattattttttatgttattactttttgtttttatttttttcctgaatttttcttttyttttttttttgagacagcatctcactctgtttcccaggctggagtgcagtggcatgatcttggcttactgcaacctctgcctctcaggttcaagcgattc

SEQ ID NO: 54936 - DNA, 201 bp, Homo sapiens
aggccaggcccagggttcagggatcccagggcccaggggatggttggttaaaggcagtcttgggagcgggaaggacaagcggaagctcaggcagcgtgtakgtgagggtggggtgaggtggaggtggggaggagtgtcgaggggaggctggacaccctgcccctgtggctagggcagcagggagcctgtgtagacatgcag

SEQ ID NO: 54937 - DNA, 201 bp, Homo sapiens
aggcccagggttcagggatcccagggcccaggggatggttggttaaaggcagtcttgggagcgggaaggacaagcggaagctcaggcagcgtgtaggtgarggtggggtgaggtggaggtggggaggagtgtcgaggggaggctggacaccctgcccctgtggctagggcagcagggagcctgtgtagacatgcagctggt

SEQ ID NO: 54938 - DNA, 201 bp, Homo sapiens
aacaggctgcctggcttccagtcctgttctgcctgcctcgagcaggtcagttagcctctgtgagcctcagtttcctcttctgtgaaatgggtacagtggtsttgatctcattggcaaggcttgcatgggaagtcctaacgtagtgttccttcagaccccactgcctccagccctccccagggtccccttttctgaagtcct

SEQ ID NO: 54939 - DNA, 201 bp, Homo sapiens
ctggcttccagtcctgttctgcctgcctcgagcaggtcagttagcctctgtgagcctcagtttcctcttctgtgaaatgggtacagtggtgttgatctcaytggcaaggcttgcatgggaagtcctaacgtagtgttccttcagaccccactgcctccagccctccccagggtccccttttctgaagtcctatgtcttgga

SEQ ID NO: 54940 - DNA, 201 bp, Homo sapiens
ttccaatcagacttgctaagaattctttcgtgcttctcttaggaccctggttgggtgggctgaccttggagtggtgcttcctgctaggtggtgggggcagkctctgggaggggtgtcggctggaagggaccttgttatagtgtacatggagcacctgaggcctaggagggctcagaaatcactacaaacccgttgtcaagc

SEQ ID NO: 54941 - DNA, 201 bp, Homo sapiens
atttccaacctctcttgcattctcccttctatcaaagcttcctcttagatgctccatttacctttttcatcacccactcttcatgaagcctgtaaggcacrtctctgccccaagcagcttctaatccagttctttcgctcccttcattccttactcacatgtgcatttattcactcactgatccagccagtattgattcag

SEQ ID NO: 54942 - DNA, 201 bp, Homo sapiens
gtttgtgaggtcagtagagaagtccccccttttatttctgatattgatattttgtgtcttttctctttttttcttggtcaggctggctggaggtttctcarttttattgggaaaataaattttccccaaagaaccagctttgggtgtaatttttttttctctattgttttcctgttttcaatttgattgatttttgcttat

SEQ ID NO: 54943 - DNA, 201 bp, Homo sapiens
tagcaaattgtatgcatggtcaagctcagaggttctattttgggtcaaaaaaggcatgagctggctgggcgccgtggctcacgcccgtaatcccaacactytgggaggctgaggcaagcaggtcacctgaggtcagcagttcaagaccagcctggccaacatggtgaaaccctgtccctgctgaaaatacaaaaattagct

SEQ ID NO: 54944 - DNA, 201 bp, Homo sapiens
gatcgcgccactgtactccagcctgggtgatagagtgagactccatctcaaaaaaaaaggaaagaaaaaagaaaatggggtgaagctcacaaccagcagargagtgagaagaggcagcccagcgtggaggcgagcagggccttgagaagcaccgtcttacccgtgggccccacacccacccctgctggagcacgtgagctg

SEQ ID NO: 54945 - DNA, 201 bp, Homo sapiens
gcatgggctgtggcttctccagtgggcccataggaatggccctggggctgggacttgtggggacggcggccacaagaggaggatcttcagcatggcctgamagcacctgtaatgtaggcaggcaatgggctcctccaggtggcaggaacaccgtgaggagcatgcaacgtgctggagaccatggggcatgtgacctccggg

SEQ ID NO: 54946 - DNA, 201 bp, Homo sapiens
ggtctgcatcttgctgtccacaggccggggcacctccaggattcagaagatgactccagtagggcctaggggtgcgggcacccaggctggcagagcacacygaggtcctcagagcaagggcacatgcccaggtctcaggtcccttttccatagcgaatcacctgctcaccagagcgggtgagtgatgatgtctccagcttg

SEQ ID NO: 54947 - DNA, 201 bp, Homo sapiens
tgtaggtgagggtggggtgaggtggaggtggggaggagtgtcgaggggaggctggacaccctgcccctgtggctagggcagcagggagcctgtgtagacaygcagctggtgtggacgcgaagggtggcttggttgggacctgtcacccggtcaccatgctgctccttggctaggcagggctattcctcaagggccagtttg

SEQ ID NO: 54948 - DNA, 201 bp, Homo sapiens
ggctcactgttgcaagggccgggatggtgcctggagtgggtggtgcctggagccagctcagcgtcagtgaccctcgtctgttccctcttcctacctccagycttaccgtccgcttccccctcgggcagccaccccagggcatctgttgtggaactgctctgtgggttttgtccttgatacctttccaggcttcttcaggtt

SEQ ID NO: 54949 - DNA, 201 bp, Homo sapiens
ttgctcctcagctgggcagctgcctgaaggcagtggggtggcagatggatgagagcagggtctgcatcttgctgtccacaggccggggcacctccaggatycagaagatgactccagtagggcctaggggtgcgggcacccaggctggcagagcacactgaggtcctcagagcaagggcacatgcccaggtctcaggtccc

SEQ ID NO: 54950 - DNA, 201 bp, Homo sapiens
ggccctgctgtgtctgggtggtgctgatgctagctctgtccctgcaggcagacttctgcgttatgacccggctgctgggctacgtggaccccctggatccyagctttgtggctgccgtcatcaccatcaccttcaatccgctctactggaatgtggtaagtgatgtgcctgacactgtccagacgggagtatcccactgct

SEQ ID NO: 54951 - DNA, 201 bp, Homo sapiens
gtcaggattctggagccttgctcctcagctgggcagctgcctgaaggcagtggggtggcagatggatgagagcagggtctgcatcttgctgtccacaggcmggggcacctccaggattcagaagatgactccagtagggcctaggggtgcgggcacccaggctggcagagcacactgaggtcctcagagcaagggcacatg

SEQ ID NO: 54952 - DNA, 201 bp, Homo sapiens
gaaaggcgtttggtctttcctctaagatgagcatagcgtcccttcctcagggttggctgaggagcttggtgtggacagccgggctccaggcacacagcggycccagtacacctgtcgctttgcctgccacccgcttacggtagcagcatggttgtaataaagcaataaagccagcgtggatgggcgatgttgctattgcta

SEQ ID NO: 54953 - DNA, 201 bp, Homo sapiens
cgtctgtggctcttctccttccccctgacccacccatgcctccgccctggggctggtgggattgctctcaaaaccaccttagccaagagggctccttcccaagactcaggaggaagaacataggggacagccaggcctaaaggggctgggcaggggctctagagaattaaagctgcccaggccacagccccgccctgtgag

SEQ ID NO: 54954 - DNA, 201 bp, Homo sapiens
attcctcactccctgccaggagtggaatgtgggcaggtaagagtcccagaggggtaagagccattggtgggaagcaactgtgggaccagtgccgccaccayggcccaaggacctggtgttcgatgccgcatccttccggtggcgtctgtggctcttctccttccccctgacccacccatgcctccgccctggggctggtgg

SEQ ID NO: 54955 - DNA, 201 bp, Homo sapiens
ggtttttcaggcagagcggtacttttttaaattgacaaattttaagcatacagaaaagtagagaggacgaacctccaaacatcagcccttagattccagtmcatcctgccttggtagctgacgtcacgaacgctgtgacctgtccctctgcactccatcatagcatctctaaaacggaggacatttcctacctcagcacaa

SEQ ID NO: 54956 - DNA, 201 bp, Homo sapiens
atctcagggatttaattgatagaagccactagagaggaaaagggcttggactgtctagtgtaattaagctttaaaaccttaattctgagctcctttggggracaagggaaactagaagcagggttataataggaccactctcaaactccatgagttttattggaaaatgagacaggaatgaggctccaataaacagcaata

SEQ ID NO: 54957 - DNA, 201 bp, Homo sapiens
agggcttggactgtctagtgtaattaagctttaaaaccttaattctgagctcctttgggggacaagggaaactagaagcagggttataataggaccactcycaaactccatgagttttattggaaaatgagacaggaatgaggctccaataaacagcaataacaagcacacaaaacaacagccaaacaacagtgtgtttat

SEQ ID NO: 54958 - DNA, 201 bp, Homo sapiens
cttttgggttcaagtgattcttgtgcctcagccttccgagtagctgggattacaggtgccttccaccatgcccagctaattttttttttttttgtattttyagtaaagatggggtttcaccatgttggccaggctggtctcgaactcctgatctcaggtgatccgcctgcctcagcctcccaaagtgctgggattataggc

SEQ ID NO: 54959 - DNA, 201 bp, Homo sapiens
ctcagccttccgagtagctgggattacaggtgccttccaccatgcccagctaattttttttttttttgtatttttagtaaagatggggtttcaccatgttrgccaggctggtctcgaactcctgatctcaggtgatccgcctgcctcagcctcccaaagtgctgggattataggcgtaagcctccgtgcctggcctgagtg

SEQ ID NO: 54960 - DNA, 201 bp, Homo sapiens
ggctcttcgttggggagcacgatggacaaaagccttcttggggctaggcaggtcacttcaaacttggagccgccaaatattttgggaaatagcgggaatgytggcgaactgggcaagtgcgttttctgattaagagcaaccagattcagctttttaaactacaattatactggccaaacaaaatacccttatacaaaaacc

SEQ ID NO: 54961 - DNA, 201 bp, Homo sapiens
caccatgcccagctaattttttttttttttgtatttttagtaaagatggggtttcaccatgttggccaggctggtctcgaactcctgatctcaggtgatcygcctgcctcagcctcccaaagtgctgggattataggcgtaagcctccgtgcctggcctgagtgatattttagtgctctttttgggtggagctgtggtccc

SEQ ID NO: 54962 - DNA, 201 bp, Homo sapiens
ggggtttcaccatgttggccaggctggtctcgaactcctgatctcaggtgatccgcctgcctcagcctcccaaagtgctgggattataggcgtaagcctcygtgcctggcctgagtgatattttagtgctctttttgggtggagctgtggtcccagcctaacttccaggacttcagccggctccaggacacactgtatttc

SEQ ID NO: 54963 - DNA, 201 bp, Homo sapiens
ttctcacttataagtgggagctgaacaatgtgaacacatagacacagggaagggaacaacacacactggggcctactgtgggttggggagaaggagagcaycaggaaaaatagctaatgcatgctgggcttaatacctaggagatggattaataggtgcagcaaatcaccatggcacatgtttacctgtgtaacaaacctg

SEQ ID NO: 54964 - DNA, 201 bp, Homo sapiens
gctgggcttaatacctaggagatggattaataggtgcagcaaatcaccatggcacatgtttacctgtgtaacaaacctgagcattctgcacatgtatcccrgaacttaaaagaaaaaaagaaggtcagtgggaagtcatagatacatcctgtggtttttgaagattagtttgtatcttatagacacacattcactttgaat

SEQ ID NO: 54965 - DNA, 201 bp, Homo sapiens
agggcaacgacagatgatttttaatattctttgtactttgtaaattttctcagtgagtatgtattcttttaaccagcaaacataattaatgttgttataaktctgcttgcatcacatttcctattcctgcagttcttattgtggaaaaattcttaatcaggcaggatgaatagcctcttctccctgattctgtctttgttt

SEQ ID NO: 54966 - DNA, 201 bp, Homo sapiens
gaattcgtttacattttcaagtaatgtgtttggccaaataagatattttgggacctgaattgtctagtttgtttgtcaagttgtagtacatcacctggaayggatagagcttcatttcttttggtactttgtagtagtctgaaagcagcaagatgatagtgagctgtaccaagttaaatcaccattcaataactatggcct

SEQ ID NO: 54967 - DNA, 201 bp, Homo sapiens
ggattccgagttttaattggactagagataattaagattcacttgtgaacaatagaccattgctcttctgacatggaaaatttttggtttttatctcaatwcgtgtgtatgcagaagtgatgtgaaatctgtcattttcttagctaggaaaagtaatttgtggcagaatattttatcttaagaagtatattcctatggctt

SEQ ID NO: 54968 - DNA, 201 bp, Homo sapiens
atggtgatagaagggatcgatggatttctatgaactcatcctaacttgtctctcaaagtctagattttggtccctttactctgccaaatctatgatgccargtattgcatcgagatatgttgacatattttcaaatgtataagcttattagcatttcataaactacacttgcaaataaagatttcaaagaccatggcagtt

SEQ ID NO: 54969 - DNA, 201 bp, Homo sapiens
ccaagtattgcatcgagatatgttgacatattttcaaatgtataagcttattagcatttcataaactacacttgcaaataaagatttcaaagaccatggcrgttttgtcatttccaaagtgattcatgttttagggcaaatccgcagaatgacgtctagattgtctctgatgctctgcattacctcttgttggtggcctgc

SEQ ID NO: 54970 - DNA, 201 bp, Homo sapiens
gaggcagttggaatgccttaaatgtagtgcaattcaggtgctatgcaaagattactgtcctctaggagattatgttgtaaactggtgcacacttcttcacygaaagtccttgaggaagaaagaagctaataataatgaaatgatatatcgaaaggagaaaataacaaaacctgatgatggagtaattcactagtatatgca

SEQ ID NO: 54971 - DNA, 201 bp, Homo sapiens
acatagaaaacagactctttgaactttttatcctctatgttcaactggacttttaaatctgtgtgtataaatagagaattacttccctaggaccaccagaraaacaaaatttactccaagcataattgtgcttgtctctcaatggttaagttaacttttattttgcaaaccaatttgttacttattttgcaaaccagtttc

SEQ ID NO: 54972 - DNA, 201 bp, Homo sapiens
gttaacttttattttgcaaaccaatttgttacttattttgcaaaccagtttcttacttgtcttcttctctcttgaggccgtagtgggccatccgcacagcktgtggcccggtttgattctccttgcactcttctgatgggaggccccaagtgatgactgcttccttatcatctctttgctaatcactcttagtggaaagcc

SEQ ID NO: 54973 - DNA, 201 bp, Homo sapiens
caacctttgcagaatgtttcttaatgtgtatctggtgctttctatgtccaagatctttactagctgtgttggggcctactccaagtgccttacatgcagtmactcctttaattcttgtaagaaccctatgaagaaggtactattataattttttttgtgtttcatagataagttacttgtaagttggtaaagatcacacag

SEQ ID NO: 54974 - DNA, 201 bp, Homo sapiens
atacatggtcattagtaactctcaggtcaaaaaattttgtttatttccctacttggtttcttatgtgatccttttgcaaactctgcacagatcaaaatatygactatcagtttaaaagaagacttttgttttcctcaaatagaaatatttttttttctctgtagagaatgatctgttttctttccatcaaagactgctctt

SEQ ID NO: 54975 - DNA, 201 bp, Homo sapiens
ggctgcgttggaagttatttctaagaacagaataaccaaagtctgaatcttttccttactcttgactctaattaaagaaaaattaaatcataatatgcgckgttatctctttcttatagccaagctgtctcagtgacaaacccatacccttgtgaagaatggagaagtgtggaggacttccagggaggaaataaaattgaa

SEQ ID NO: 54976 - DNA, 201 bp, Homo sapiens
tctagatattttctgcaaaattttctattatgcatgtatgtctccatgtatctcttctctatatctatatctatatctcaaagaaatatagaaaatactayctttttttttagtcagtgtgtcactctgtcacccagggtggaatgctgtggtgcaatcatagctcactgcagcctcagcctcctggcatcaagcaatcct

SEQ ID NO: 54977 - DNA, 201 bp, Homo sapiens
tttttgtgaacctaaggcacttctaagtgctgtgtgggagggaatgtggtagactgatttcattgagactctgccaaattctggtcttgcggccatcaaaracgcatcatttcctccaagacttctaaagggggctattaccacgggcctgcaggttctggtttgcattcagaggagacactatcttcttaaatgagacat

SEQ ID NO: 54978 - DNA, 201 bp, Homo sapiens
caagatctttactagctgtgttggggcctactccaagtgccttacatgcagtaactcctttaattcttgtaagaaccctatgaagaaggtactattataawtttttttgtgtttcatagataagttacttgtaagttggtaaagatcacacagatcataagcggtagatctgggaataaaatccagagtctgtgcacttag

SEQ ID NO: 54979 - DNA, 201 bp, Homo sapiens
gctgtggggaggggggggtttcagttcactaccccggattaggttttcctatcaatgcacattcctttgtcctcttcaacaaaaggacgaaaagcaaaaamccacaacccacagctttctagttgctgacttaacccaattttcctgtacccccagcatgtctttctttctacctttgactcagatatttatcagcagatg

SEQ ID NO: 54980 - DNA, 201 bp, Homo sapiens
cttacatgcagtaactcctttaattcttgtaagaaccctatgaagaaggtactattataattttttttgtgtttcatagataagttacttgtaagttggtwaagatcacacagatcataagcggtagatctgggaataaaatccagagtctgtgcacttagctactactctgctgtggcatctgaatagcatctatggaac

SEQ ID NO: 54981 - DNA, 201 bp, Homo sapiens
aatatatttcatggaggtttaattggcactagaattaaattattgtaaaactttctctgaattaagaaatgtcatgctactatgatacagtttgttacttrtgtaacagatgtccagagaagagtaaacttccctaaaacttgaaagcttaagggtagttacccccaaaatggaatcatatcaggagattgcactgaaaag

SEQ ID NO: 54982 - DNA, 201 bp, Homo sapiens
cctttaattcttgtaagaaccctatgaagaaggtactattataattttttttgtgtttcatagataagttacttgtaagttggtaaagatcacacagatcrtaagcggtagatctgggaataaaatccagagtctgtgcacttagctactactctgctgtggcatctgaatagcatctatggaacactcaacacatttggg

SEQ ID NO: 54983 - DNA, 201 bp, Homo sapiens
atatatttcatggaggtttaattggcactagaattaaattattgtaaaactttctctgaattaagaaatgtcatgctactatgatacagtttgttacttgwgtaacagatgtccagagaagagtaaacttccctaaaacttgaaagcttaagggtagttacccccaaaatggaatcatatcaggagattgcactgaaaagc

SEQ ID NO: 54984 - DNA, 201 bp, Homo sapiens
cctgaaattgatgtcctccttgtctgctttttagtagtttcaattatctccatggtttactacattttaaaggttgtaaacttttaaagactcattttgtrttcaaggagtttgtttgttcctttgcttttttatagaccaaaggggcacgattccgtcaagggaaagactacgttggagcaatccctgtggatctgaaac

SEQ ID NO: 54985 - DNA, 201 bp, Homo sapiens
ttgtaaacttttaaagactcattttgtgttcaaggagtttgtttgttcctttgcttttttatagaccaaaggggcacgattccgtcaagggaaagactacrttggagcaatccctgtggatctgaaacggcgcttggacagcatcaccagtagccagagctcagccagctctggatttgtggaggagaagtccctcagtga

SEQ ID NO: 54986 - DNA, 201 bp, Homo sapiens
ttctttctttcttttctatcttttttttttttaacagactttgccattttttttgtgaacctaaggcacttctaagtgctgtgtgggagggaatgtggtaractgatttcattgagactctgccaaattctggtcttgcggccatcaaagacgcatcatttcctccaagacttctaaagggggctattaccacgggcctgc

SEQ ID NO: 54987 - DNA, 201 bp, Homo sapiens
gagtgcaatggtgcgatctcggctcactgaaaccttcgccttttgggttcaagtgattcttgtgcctcagccttccgagtagctgggattacaggtgcctkccaccatgcccagctaattttttttttttttgtatttttagtaaagatggggtttcaccatgttggccaggctggtctcgaactcctgatctcaggtgat

SEQ ID NO: 54988 - DNA, 201 bp, Homo sapiens
gtatgtgtggaagacacctgatgaaaggccttggtaacaagtactttaaggaagaaaattaaacatctattgaatccttattaccaccatcaccattttayactttatagagcacttccatgagatgatctcatctgagtctcgtaacagtccttaaggtaggtaagaattattattttcattgacaaatgatgaagctgc

SEQ ID NO: 54989 - DNA, 201 bp, Homo sapiens
tagagttcttgatatgaaactattgtttatccctctgggtacatgacaaaaaacagtgtaagtggcaaatttggaaatgtcctctttatttcccagattayctaggtcagtgttaccttattctacctcctggatttactggttcaatttggctaaaatggaaaaaccagtattgttcctaagggggtatgatgaaggcta

SEQ ID NO: 54990 - DNA, 201 bp, Homo sapiens
tcggctcactgaaaccttcgccttttgggttcaagtgattcttgtgcctcagccttccgagtagctgggattacaggtgccttccaccatgcccagctaattttttttttttttgtatttttagtaaagatggggtttcaccatgttggccaggctggtctcgaactcctgatctcaggtgatccgcctgcctcagcctcc

SEQ ID NO: 54991 - DNA, 201 bp, Homo sapiens
ttcagaggagagtgccatacagatttgaggtgtgggaaggtcagcaatgcctggcttacatgatcacttctccaatgatttaagaattctccttttggccrggtgtgttggctcatgcctgtaattccagcactttgggaggccaaggtgtgtggatcacctgaggtcaggagtttgagaccagcctggccaccatggtga

SEQ ID NO: 54992 - DNA, 201 bp, Homo sapiens
tttccttactcttgactctaattaaagaaaaattaaatcataatatgcgctgttatctctttcttatagccaagctgtctcagtgacaaacccataccctygtgaagaatggagaagtgtggaggacttccagggaggaaataaaattgaagttaataaaaatcaatttgctctaattgaaggaaaaaacaaagtgagttt

SEQ ID NO: 54993 - DNA, 201 bp, Homo sapiens
attcttgaacacttattatccctttccaaaaactttgctttataagaaatttattactataattacttaggcagtaatatttaatagcaatttaatatttrgtgggtaatattactgagcgcatgatctacataaataatggacttcgggccctgccttgatattctggaatgcatctttccccacttgctagcaagaagt

SEQ ID NO: 54994 - DNA, 201 bp, Homo sapiens
ttcttttgtgatgggattaccagctagtatcactaatatgaatgttaaaagccattaatctgtttgcagtgtcctgactgacttgtttcatttaactttayccagtgaccagtgtattttcccagaagttaatatatcaacaagttcctttttactaaatttaaactgtttaaaactttgctgataccagaaccatttcaa

SEQ ID NO: 54995 - DNA, 201 bp, Homo sapiens
ctagtaggcacggcggtgattgccatgttcttctggctacttcttgtcatcatcctacggaccgttaagcgggtaaaaaaataatttcccttctgcccatrcacattggttttcatgattaatgaaaactgactggggttctttgagttgtttcttcccattgttattggctcaatgggcacatttttatttcaatacaat

SEQ ID NO: 54996 - DNA, 201 bp, Homo sapiens
gtagcccacgctgctgccacagcattgcctttaagaattccaagccctgcagctgcaatagctggaatgccacagtttgctaatttccagaataaagagaygagttttacaaagacatctgcatttaaattatccccgtgtatgcttttattaatgtgaattaaatggcttaggagagattcagaaaggaagagttctgtg

SEQ ID NO: 54997 - DNA, 201 bp, Homo sapiens
actttcctactgcctgaactgtctcatggctaccatgccatcctctcagccattgaataatctactgtattcttctacatctgagtaataatgcttttctraaagctgtaattacccttttagacagataggattctaatttataacccgggagcagaccactctgatttctacctacttatctttttgttatattttcaa

SEQ ID NO: 54998 - DNA, 201 bp, Homo sapiens
agatgttgctttaaatgttttctatacacattgagcctctggagtatgggactctgtgtcttacacagttttgtatccttatttagcatctcacctcgtcrgctctttacaaatgtgtactcatttaagtgcttattttcagcattcaggaagaaagaggcatttaatgaaatcagtgttttgcttctctaggtaccagac

SEQ ID NO: 54999 - DNA, 201 bp, Homo sapiens
agaaaagtaggccaaacaaaggctgagatggggacgtgacaagttacaactattccaaaggttgtaaacaccaagcggggagcaaggctggtggcagtgaytcccctggaaaggataaaaggtgtaattttatattaggtaacaatacttcaaattaaggatcaggaagaactatcagttgacagaatgtattcatgcagc

SEQ ID NO: 55000 - DNA, 201 bp, Homo sapiens
acatctattttagactgcagtataaagaataccctagccccttaccaatacccagcccttgggaaaaaacacagtagcaggtgctgtttctctagctttayttgtttaagacacatttcccattagattttccttttaccgaccctcgataacaaggttatttgaaatccccaaggatcccatgctccctttttaaaactc

SEQ ID NO: 55001 - DNA, 201 bp, Homo sapiens
ctgcagtataaagaataccctagccccttaccaatacccagcccttgggaaaaaacacagtagcaggtgctgtttctctagctttacttgtttaagacacrtttcccattagattttccttttaccgaccctcgataacaaggttatttgaaatccccaaggatcccatgctccctttttaaaactctgcataaacatttc

SEQ ID NO: 55002 - DNA, 201 bp, Homo sapiens
ctgcgtatcactttggttgtatagtaatccaagtctgttttcttgttgctgttgttgttgactctaggtaagcctcttggccgtggtgcctttggccaagwgattgaagcagatgcctttggaattgacaagacagcaacttgcaggacagtagcagtcaaaatgttgaaaggtaaaagcaaaattatgtggtgatctatc

SEQ ID NO: 55003 - DNA, 201 bp, Homo sapiens
gtccctcagtgatgtagaagaagaggaaggtactggctagtgcttcctgcatgctatggcatgctcttgtcagagcagacagggtgatagggtgttacaargaatttgatcatgggaaaagtccaatactacctcataatttgaaagagacctgaatttctataatagactgcctccattctgtctccccaaaagtgaagt

SEQ ID NO: 55004 - DNA, 201 bp, Homo sapiens
atatgaaactattgtttatccctctgggtacatgacaaaaaacagtgtaagtggcaaatttggaaatgtcctctttatttcccagattatctaggtcagtrttaccttattctacctcctggatttactggttcaatttggctaaaatggaaaaaccagtattgttcctaagggggtatgatgaaggctaatgatactggg

SEQ ID NO: 55005 - DNA, 201 bp, Homo sapiens
gagcgtgtcctgagatgccgacacaccctcaggctcttgggaggctggggtgggaaggcgcctggggttggcaggcaggaggtgcctccgcaggcgagaamaggcggtgaaaagttgtctggctgcgcgcaacatcctagtccgggcccggggaagaaaaccttgccggaatctcaggccgggtctcccggatcggacggt

SEQ ID NO: 55006 - DNA, 201 bp, Homo sapiens
ccccttctcatagcattaaaggcctcaggctctttgatgtttctgctaggtagctcttatgttctctctcccaaggggaaggaggagaactgggaccttayagggttttcccaaagagaaaggccctttacacttcttggagattatgacttattattaccatttttttatggccggaattcgccacttagtcagggttcc

SEQ ID NO: 55007 - DNA, 201 bp, Homo sapiens
cttgcacctccttccttcctaacctcacttcttactcccctttgctcactcttacctggctgctctggtttcctggctgttcccttaatactccagatatrcacctgctccagggcctttccatgtgctgtttttgctcctgtaatactgctcttcatgatgttcctatggctagctttatcaagaccacctcctgcaaaa

SEQ ID NO: 55008 - DNA, 201 bp, Homo sapiens
gttcagaggagagtgccatacagatttgaggtgtgggaaggtcagcaatgcctggcttacatgatcacttctccaatgatttaagaattctccttttggcygggtgtgttggctcatgcctgtaattccagcactttgggaggccaaggtgtgtggatcacctgaggtcaggagtttgagaccagcctggccaccatggtg

SEQ ID NO: 55009 - DNA, 201 bp, Homo sapiens
gccgagtagtaggaagttagctgaagtttggaggatacagagaaaggagaaactgagaagctaaaaggaagagaaagaagtcaagatgaatctcattgtaytattaatgcactagaaaatcaacctgacttgtgataggctgaaattgccttaatagacctttataataacccagcactttgaaatcaggggaagccacat

SEQ ID NO: 55010 - DNA, 201 bp, Homo sapiens
agtgagctgcttaaaatcacatccttgagatgaatccagttcctctgacccctaagtccatgttgtttcctcccatgccaaggagggccctcagagagaawcagtaatgagatgagactacaattccactcctgtgtttacacatttccagttcaagttgagctggccttttagtgtgacagttgttcccacacaccatta

SEQ ID NO: 55011 - DNA, 201 bp, Homo sapiens
tacaattccactcctgtgtttacacatttccagttcaagttgagctggccttttagtgtgacagttgttcccacacaccattattgcctccccctttatcrgaaagccatttgatcatgaactacattccatgtgttttctgtgaccaagtagagtgatgatccgagtcggcagcctcctggctcaccgggtgctttgcat

SEQ ID NO: 55012 - DNA, 201 bp, Homo sapiens
tttctatgccttggtttcctcatctgaagagttgggatagtaatactcacccctagagaggtaccgtggtgaacacatcatgagatgctgcttagacagcwtctggcacagtgtcaggcttgcggcagattatcagtgagggcttcctgaacaagtgaatgcaggaatgattgactacggtaccagtagtgtttgacaact

SEQ ID NO: 55013 - DNA, 201 bp, Homo sapiens
tttttttcagcatcagcataagaaacttgtaaaccgagacctaaaaacccagtctgggagtgagatgaagaaatttttgagcaccttaactatagatggtrtaacccggagtgaccaaggattgtacacctgtgcagcatccagtgggctgatgaccaagaagaacagcacatttgtcagggtccatggtaagctatggtc

SEQ ID NO: 55014 - DNA, 201 bp, Homo sapiens
tggatgtagagatgggtgacaggctggctccccttgaggcataagtctagaagaatagtggaagaaacccactctgtttcccttgacatgaggctacagaragaatttgcatttaactccttttccttagaagctgagaaggtagtgtgaggctgggacttggtctagaagcacatggggaggtggtctaggcttcattta

SEQ ID NO: 55015 - DNA, 201 bp, Homo sapiens
tagactgatttcattgagactctgccaaattctggtcttgcggccatcaaagacgcatcatttcctccaagacttctaaagggggctattaccacgggccwgcaggttctggtttgcattcagaggagacactatcttcttaaatgagacatggaagaggaagtgtcatgaactgtaaataaggctgatagggaattgttt

SEQ ID NO: 55016 - DNA, 201 bp, Homo sapiens
caccacacctggctcatttttgtatttttagtagagacagggttttaccatgttgcccagcctggtctcgaactcctggcctcaggtgatccatccgcctyggcctcccaaagtgctgggattataggcatgagccaccatgcctggccggtagaagactgactgtgtctgttgaagagtttatttaagtttcaaaaccaa

SEQ ID NO: 55017 - DNA, 201 bp, Homo sapiens
gaccagctgatttctacactcctgtcccaatgaaaggttgtagccttcttctaaggtgtttttgggttcatcactatattaaacgcttagtgaggaatatragtgaaaacccattttccttcctggacatgctgcctgcagggccactcatggtgattgtggaattctgcaaatttggaaacctgtccacttacctgagga

SEQ ID NO: 55018 - DNA, 201 bp, Homo sapiens
tagacgaggaaggctttactaagaacttgacatttgagcaatgacctggaaaggggaggggctgagccttacagatatcttggcatgagaatcatttttartttattttacattcatcaacatccatcaaaaagtatttgttaggagtataattagaaacgaggaaggacaggcttcagatgagagcgattaaaagagcta

SEQ ID NO: 55019 - DNA, 201 bp, Homo sapiens
gcttgcgacccggcatacttggctgagtatccgcttctcccttgtggctccaaactgctgcagattctcggccacttcagacgcgcgcgatggcgaagagrgtcctgcactttgacgcgcctggtgagggagcgctgctcttcgcagcgctcctggtgatgctccccaaatttcggggaccggcaagcgattaaatcttgg

SEQ ID NO: 55020 - DNA, 201 bp, Homo sapiens
caatataaggggattgggaccagctgatttctacactcctgtcccaatgaaaggttgtagccttcttctaaggtgtttttgggttcatcactatattaaaygcttagtgaggaatatgagtgaaaacccattttccttcctggacatgctgcctgcagggccactcatggtgattgtggaattctgcaaatttggaaacct

SEQ ID NO: 55021 - DNA, 201 bp, Homo sapiens
ttcaaaaaatgtttattcggcaagtatcatgtgcagagcaccatgccattgcttgagacacctacattagttttgttggggttgaattgaaagaaaaaatkgtatttctcattatttgaagtaacttttaaactatgtataaacacgagttactaaaattcccttttgcagttttaacatgaagaagttggggaaaacacc

SEQ ID NO: 55022 - DNA, 201 bp, Homo sapiens
gaagaagaggaaggtactggctagtgcttcctgcatgctatggcatgctcttgtcagagcagacagggtgatagggtgttacaaggaatttgatcatgggraaagtccaatactacctcataatttgaaagagacctgaatttctataatagactgcctccattctgtctccccaaaagtgaagtgtggaagccctagact

SEQ ID NO: 55023 - DNA, 201 bp, Homo sapiens
tctttttgtccttccatccagactccaaagaggaagacaaaagttgtcttttcctctcctgtacttcatgtctatcaggcaaaacttctcggaagctttgaaaaaaaaaatagatacataggtgatgaggatgtgcaagattcaggctcagggttttctataagagaaaatcaaatcaaagaatgtctcctccctgtttta

SEQ ID NO: 55024 - DNA, 201 bp, Homo sapiens
gttttagatcaacacagcctgcatttctaggctttgacatgattaccgtctgtcaggattccatgccattgaaaacattttctagttgctgctgagtgacwggggttctcagtccttccaaggaatgtggttttgatgagtaaaaagcagcgtttgatatgtctggcttgactgcacacatgcttcaagttattaaagttt

SEQ ID NO: 55025 - DNA, 201 bp, Homo sapiens
acacatgccccgtaattcccaaattgccacaataggaaaagcacaagtgaaatttaagaacatcccaatttccttgaatatcatgcaagtggccctttggygcctgtcactgtatacaaatttgtcaatctgcgaggccataaacatgttccatcagttggggcctttgcataactcgagagaactgcctttcatctcatt

SEQ ID NO: 55026 - DNA, 201 bp, Homo sapiens
attctttgttcccccttctggtacggcatattaaaacttcaggatattttcccatgacattaaggtgcttccctacgtgtcctgatactcttctgtaggcygctgaacttggctttattattttttttcagggaatattttaaagataggctgggtgccgtggtttgcatctgtaatcccagcactttgggaggccgaggc

SEQ ID NO: 55027 - DNA, 201 bp, Homo sapiens
taaatccttgcaaaggcccttgcattaggtgctgttatcaccatgttacaagtgaagatgggcagttaaggcttgaagcctcagtatgaaaggtcacatakaccagcattgaatccagtctactgaagacatgggggacatgttcttacttgagataaaagccaggatgagatctctcttgatggcaggcagtgagctgac

SEQ ID NO: 55028 - DNA, 201 bp, Homo sapiens
tactttattccttttttttttttttggtagagatggggtctcaccatgtggcccaggctggtcttgatctcctgggcttaagcgatccacctaccttggcstcccaaaatactgagattacaggcataagcccccatgcctggctagttgttatttttatgagtatcactagaactcaggtctcttgtttccacatctagg

SEQ ID NO: 55029 - DNA, 201 bp, Homo sapiens
aatcctttgggtatatacccagtaatgggatggctgggtcaaatggtatttctagtttagatccttgaggaattgccacactgtcttccacaatggttgarctagtttacagtcccaccaacagtgtgaaagtgttcctatttctccacatgctctctagcacctgttgtttcctgactttttaatgattgccattctaac

SEQ ID NO: 55030 - DNA, 201 bp, Homo sapiens
catgatccagcgtagcccaaggtcaatgggacgatcacttcagtgagcagatagctctgtaaattcctccatagaggcactgtctaccccttgtctaacckcatgccttgtgcaaaagctgggcagccatggctttgtctgtgggaaaatcaggcaaatttggggagcgtctctttgtgccacttctctccattttctcct

SEQ ID NO: 55031 - DNA, 201 bp, Homo sapiens
cccaccaacagtgtgaaagtgttcctatttctccacatgctctctagcacctgttgtttcctgactttttaatgattgccattctaactggtgtgagatgstatctcattgtggttttgatttgcatttctctgatgaccagtgatgatgagcattttctcatgtgtctgttggctgcataaatgtcttcttttgagaagt

SEQ ID NO: 55032 - DNA, 201 bp, Homo sapiens
gactgacttgtttcatttaactttacccagtgaccagtgtattttcccagaagttaatatatcaacaagttcctttttactaaatttaaactgtttaaaastttgctgataccagaaccatttcaaaagttataattccatgttctgtgattttctttttgtgtgtctagagcgtgtggcacccacgatcacaggaaacct

SEQ ID NO: 55033 - DNA, 201 bp, Homo sapiens
cccactttttgatgcgattgtttgtttttttcttgtaaatttgtttgagttctttgcagattctggatattagccctttgtcagatgagtagattgcaaamattttctcccattctgtaggttgtctgttcactctgatggtagtttcttttgctgtgcagaagctctttagtttaatgagatcccatttgtcaattttgg

SEQ ID NO: 55034 - DNA, 201 bp, Homo sapiens
cacgtctctttaccagttataaaagacaataggctcaaagaagaattgagtacaacaaagggcttgctctaaaggctgtttgccaagaggaatacacacarttcttctctcctgaggctttctctgagaaataagactcattgattctggagcttgggccgtgttacctcttttttgcccagttagtttgggtctgatctt

SEQ ID NO: 55035 - DNA, 201 bp, Homo sapiens
tccaggacacactgtatttctgcctccttcagaaggagcagagatagcgttgtggatgtagagatgggtgacaggctggctccccttgaggcataagtctrgaagaatagtggaagaaacccactctgtttcccttgacatgaggctacagagagaatttgcatttaactccttttccttagaagctgagaaggtagtgtg

SEQ ID NO: 55036 - DNA, 201 bp, Homo sapiens
tgtcagatgagtagattgcaaaaattttctcccattctgtaggttgtctgttcactctgatggtagtttcttttgctgtgcagaagctctttagtttaatkagatcccatttgtcaattttggcttttgttgccattgcttttggtgttttagtcatgaagtccttgcccatgcctatgtcctgaatggtattgcctaggt

SEQ ID NO: 55037 - DNA, 201 bp, Homo sapiens
gaggcctgcagggaaaaacaatgtggcatgttttaaagttgcattactttaaaaaataaatctgtgcaaagttataggcttatttgctctctcatgttctrttttttcaatttacttgctctagggtataggatttatgatgtggttctgagtccgtctcatggaattgaactatctgttggagaaaagcttgtcttaaat

SEQ ID NO: 55038 - DNA, 201 bp, Homo sapiens
tctgcttataatcttttatataaaatgggaatactcatgggtttttgaataatgctcataccaaaaagaaaacaaacaaaaaaaaccccaacatattaaarggtgccattgtgctattttattgttttctttaaggcccaaggtaagaaattgtgaaagtcaatgatatgtttcattcattgattcaaaaaatgtttattc

SEQ ID NO: 55039 - DNA, 201 bp, Homo sapiens
agtcactcctttgcaatgccagataacgagagggtgctgcacatggaacagcctttctttctttcttttctatcttttttttttttaacagactttgccattttttttgtgaacctaaggcacttctaagtgctgtgtgggagggaatgtggtagactgatttcattgagactctgccaaattctggtcttgcggccatca

SEQ ID NO: 55040 - DNA, 201 bp, Homo sapiens
ggaaaatgagaagaattttctctcaaaaattctgtacaattttgctggtgtttttatactattctctgccaacatgcatacacacacacacacacacacaygcacacaaatacacacacacacccacattccaataaccagtacagccacctggcgtatagtagacatacgctcaataaatatgaatgaataaatgaagtt

SEQ ID NO: 55041 - DNA, 201 bp, Homo sapiens
ttaattaatggaaaactcaggaatctttataagtgacttctgaagctgagtttataacttttcatcatatgtcaatctgacttgttggtagaagactttgtttttttttttttgaggcagggttgccctcttgcccaggctgaagtgcagtggtgtgattttggctcactgcaacctccacctcccgggttcaagcaattc

SEQ ID NO: 55042 - DNA, 201 bp, Homo sapiens
ctgctgttgcagggaattagctgcctttgtcccctgtggtttaattaactctttcttcactttgactgactattatgaagcactctgagaatgcttgatgrgatgtgttgggcatagcaatgtgaaatgttatctctctgagatttcaagcatgactccacaccacatcatctctatctctgaggaatggactaggtttcc

SEQ ID NO: 55043 - DNA, 201 bp, Homo sapiens
catgactccacaccacatcatctctatctctgaggaatggactaggtttccagcagcatgttaacattgtatgagtaatgtttgattggccttgaaatctttttttttttttttttttgagacggagttttgctcttgttgcccaggctaaagtgcagtggtgctatctcagctcactgcaacttctgccccccggttcaa

SEQ ID NO: 55044 - DNA, 201 bp, Homo sapiens
aagctatgtaattccctgttgtttttgccattcatgtgagtggcatggcatttaggaaagaggacttggattgatcattgatgctttcattcataaattamaacttctcaggtatctcctgggcttatgtgaagtcagtgcgtctaactacactggagagagaatggtttcacagatgctttaaaccacaagctctgtgtg

SEQ ID NO: 55045 - DNA, 201 bp, Homo sapiens
ttgtggaagaaaccctattatgcacaaaacttgccccaagtttcagctcagagattgcataatcctgaaattgatgtcctccttgtctgctttttagtagwttcaattatctccatggtttactacattttaaaggttgtaaacttttaaagactcattttgtgttcaaggagtttgtttgttcctttgcttttttataga

SEQ ID NO: 55046 - DNA, 201 bp, Homo sapiens
gtggagacagttgtgcaatttggtcacagagtgtcctaggtgcttttgcttcattgctcctccactgaagcacgctggcagctggcctccttcccctgggmctaaggatatcttggctggaagctctgctctgaaaaggggcatggccaaactttcactagggctcttcgttggggagcacgatggacaaaagccttcttg

SEQ ID NO: 55047 - DNA, 201 bp, Homo sapiens
tttttgatgcatgaggtcacaacagatgtgaaagagatcagctgtgccgagacctaatgcacacatgattctctttgcagtgtatccacagggacctggcrgcacgaaatatcctcttatcggagaagaacgtggttaaaatctgtgactttggcttggcccgggatatttataaagatccagattatgtcagaaaaggag

SEQ ID NO: 55048 - DNA, 201 bp, Homo sapiens
gacaaccagacggacagtggtatggttcttgcctcagaagagctgaaaactttggaagacagaaccaaattatctccatcttttgggtaagactcagccayattaaaaagacaaatttcaataggaatttttggaaggaacttaggactttcagtgtaagtgcagaattttccctatggggtctttgttggttggagaaat

SEQ ID NO: 55049 - DNA, 201 bp, Homo sapiens
actgctggcacggggagcccagtcagagacccacgttttcagagttggtggaacatttgggaaatctcttgcaagctaatgctcagcaggtttgtcacctycatccaagaagcacctacaaagagtacttagatgtcaaggactttcctactgcctgaactgtctcatggctaccatgccatcctctcagccattgaataa

SEQ ID NO: 55050 - DNA, 201 bp, Homo sapiens; identical to SEQ ID NO: 10428

SEQ ID NO: 55051 - DNA, 201 bp, Homo sapiens
gacaaggtcagtggtgctgtttgaaaatggctgttttgagagttataagatataatctatttctaagcacctggcccttgaaagcactcagtaaaagatayctattaagtgagctgcttaaaatcacatccttgagatgaatccagttcctctgacccctaagtccatgttgtttcctcccatgccaaggagggccctcag

SEQ ID NO: 55052 - DNA, 201 bp, Homo sapiens
tttttatttgtaaaagtaatactttcttggtttgaaaaaaattatagaaatatatgaagcaaaaagtacatgttctcatccctctgcctctgtgcctcaaycatttccccaaggtaggtatttttttggtgtgtacccttctagatattttctgcaaaattttctattatgcatgtatgtctccatgtatctcttctctat

SEQ ID NO: 55053 - DNA, 201 bp, Homo sapiens
aggaaatcttggaactgcagctactcagaccctcaaggtctttgacgtttcacttgaaatgaaaaactaaatcaaatgaccatttacagtaagttgaccttttttttttttttattttcttccagaaaaaccttttgttgcttttggaagtggcatggaatctctggtggaagccacggtgggggagcgtgtcagaatccc

SEQ ID NO: 55054 - DNA, 201 bp, Homo sapiens
gactttggagtcaaaaaagaaagaaaggaaaaagggagagaagaaagaaggaagtgagagaagggagaaggaagaaaggggaagagggaaagggagtggaragggagggaggaagagggagagagaatgaaaaactcagatgatggtggcaggaatgcattctctaaagatttacaccttcctttaacatgaggtggttta

SEQ ID NO: 55055 - DNA, 201 bp, Homo sapiens
gagtgaggaaggaggacgaaggcctctacacctgccaggcatgcagtgttcttggctgtgcaaaagtggaggcatttttcataatagaaggtcagtgggakaaaaaaaaatgtggtacatatacaccatggaatgctatgcagccgtaaaaaggaatctgatcatgtcctttgcagctgcatggatggagctggaagccat

SEQ ID NO: 55056 - DNA, 201 bp, Homo sapiens
tgagcaatgttttgcaagctttaaattttccattaacaattctgtaggccaggtgtggtggcttatgcctgtaatccctgcactttgggaggccaaggcaggggggatggctagaggccaggagttcgagactagcctgggcaatgtagtgagaccctgtctctacagaaaataaaagaaaaattagctgggcttggtggt

SEQ ID NO: 55057 - DNA, 201 bp, Homo sapiens
gggagaatcgcttgagcctaggaattggaggctgcaataagctatgattgtgtcatggtactccagcctggaacatagaaagaaaccctgtctctaaaaawaaataaataaataaataaataaataaataaataaataaataaattaaattcaaaaaaagaattctgtagactccattcaagttacgggtgtgtaactgtt

SEQ ID NO: 55058 - DNA, 201 bp, Homo sapiens
acaaaaagtataagtttccaactgttgatactcattcaattgtgtctttccaggtgcccaggaaaagacgaacttggaaatcattattctagtaggcacgrcggtgattgccatgttcttctggctacttcttgtcatcatcctacggaccgttaagcgggtaaaaaaataatttcccttctgcccatgcacattggtttt

SEQ ID NO: 55059 - DNA, 201 bp, Homo sapiens
ggctgcaataagctatgattgtgtcatggtactccagcctggaacatagaaagaaaccctgtctctaaaaataaataaataaataaataaataaataaatmaataaataaataaattaaattcaaaaaaagaattctgtagactccattcaagttacgggtgtgtaactgttgtcctctaggatttttccaagttggtaag

SEQ ID NO: 55060 - DNA, 201 bp, Homo sapiens
ctgctttgcttccctaaggactcctaacttgttttcctaaaacctattcttagaaataggctagaatccagtacatttgcttagacttcaatgtagtacgmtgttgaggtaatctcattttgctaagtgttgacgtggattttttcagcatgattccttttgatgttcagttggttgggacaagatatttccacagcactt

SEQ ID NO: 55061 - DNA, 201 bp, Homo sapiens
gcccttgtgcaaattggaaaaaggatcctcctttgtagctttatgccaggatgcatggtctggcaagcaaagttgggaatggctttcaccttcttgcctgrttaccctcgtgcagggctcagccaacacagttgtacttagtggttctgggtacagggaaaaaggactgtggttatattaaaattgtttcttaatatattg

SEQ ID NO: 55062 - DNA, 201 bp, Homo sapiens
agggctcagccaacacagttgtacttagtggttctgggtacagggaaaaaggactgtggttatattaaaattgtttcttaatatattgtggaatcagatamttatagaccatctagagacatggaaaggaagatagtgaaatacaaaaatagcatgttctccagaattggaatatgtaaaagatgttcatatgtaaaagat

SEQ ID NO: 55063 - DNA, 201 bp, Homo sapiens
gttgtacttagtggttctgggtacagggaaaaaggactgtggttatattaaaattgtttcttaatatattgtggaatcagataattatagaccatctagaracatggaaaggaagatagtgaaatacaaaaatagcatgttctccagaattggaatatgtaaaagatgttcatatgtaaaagataatttgcaaaacaagaa

SEQ ID NO: 55064 - DNA, 201 bp, Homo sapiens
agcggcttatcaagtcttccttccaaccatacttcctcaggcgagtcttgataaatatcctggcctttattaagttatgtttccagtgatattttatttakttgtttttatgtttatttttatttttttgaggtggagtctcatgctgttgcccaggctggagtgcaatggtgcgatctcggctcactgaaaccttcgcct

SEQ ID NO: 55065 - DNA, 201 bp, Homo sapiens
ttctctcaaaaattctgtacaattttgctggtgtttttatactattctctgccaacatgcatacacacacacacacacacacacgcacacaaatacacacmcacacccacattccaataaccagtacagccacctggcgtatagtagacatacgctcaataaatatgaatgaataaatgaagttgagggcatacatttaag

SEQ ID NO: 55066 - DNA, 201 bp, Homo sapiens
ccacctcccgggttcaagcaattctcatgcctcagcctcctgagtagctgggattacaggcatgcgccaccacacctggctcatttttgtatttttagtasagacagggttttaccatgttgcccagcctggtctcgaactcctggcctcaggtgatccatccgcctcggcctcccaaagtgctgggattataggcatgag

SEQ ID NO: 55067 - DNA, 201 bp, Homo sapiens
cagcatacaaaaagacatacttacaattaaggctaatacaactcttcaaattacttgcaggtaaggattcattctagatctagatttcttgtgttaagtamctgattgtttattgagtggaaataatttccagtagagcagaattataatagagcttgtagtaattgttcataagtggtgaggtttctaagaactgatgta

SEQ ID NO: 55068 - DNA, 201 bp, Homo sapiens
ccctttgccaataggttttgtgcatttcaaagctatctttctccatctgccttttttctcttgtggccaagggagtgtgtaattttgaggtggctcatcasagccttagatgtggaccatgcctgtgaattagtgggaagtgtagcagtccatacaggatcaaacacatagtcttagtgccatcagcctcatgtgccaact

SEQ ID NO: 55069 - DNA, 201 bp, Homo sapiens
agagatacggggctgcggtctccagggagatggcagccatatggagttgggaatggggtgagggtaaaaagcaaaagaattgtcttctctctgccaactcmtttgtttgccatttcttctgcagtggaatggtgcccagcaaaagcagggagtctgtggcatctgaaggctcaaaccagacaagcggctaccagtccggat

SEQ ID NO: 55070 - DNA, 201 bp, Homo sapiens
aactaaatgtggggattgacttcaactgggaatacccttcttcgaaggtaacgctaatgattcaaagccagacctccaaatacttagataataagccccartgaagtttgcttgagagataggggcctctttggccagataaaatgtaagagccttaaacacacacacatacacacccactcacacacacatacacacaca

SEQ ID NO: 55071 - DNA, 201 bp, Homo sapiens; identical to SEQ ID NO: 10400

SEQ ID NO: 55072 - DNA, 201 bp, Homo sapiens
caacatggaaggaatctttggtgtaatcgttaagcaatgctatattgtcctttttactactgttctgtattttactttactctttttttttttttttttttgagacagggtctcactctgtcacctgggctggagtacagcagtgtgatctcagctcactgcaacctccgtccccccaggttcaagcaattctcctgcctc

SEQ ID NO: 55073 - DNA, 201 bp, Homo sapiens
gcaacatggaaggaatctttggtgtaatcgttaagcaatgctatattgtcctttttactactgttctgtattttactttactctttttttttttttttttttgagacagggtctcactctgtcacctgggctggagtacagcagtgtgatctcagctcactgcaacctccgtccccccaggttcaagcaattctcctgcct

SEQ ID NO: 55074 - DNA, 201 bp, Homo sapiens
ttgtttgaatggcttgattaacttatagaaatgatgcctttatatttatttggaaaaacattagaattgctgcctaatcatggcagtcaatgctatccagrtagtcacaaggattccgagttttaattggactagagataattaagattcacttgtgaacaatagaccattgctcttctgacatggaaaatttttggtttt

SEQ ID NO: 55075 - DNA, 201 bp, Homo sapiens
tacatgtgcatgtgtctttatagcagcatgatttataatcctttgggtatatacccagtaatgggatggctgggtcaaatggtatttctagtttagatccytgaggaattgccacactgtcttccacaatggttgaactagtttacagtcccaccaacagtgtgaaagtgttcctatttctccacatgctctctagcacct

SEQ ID NO: 55076 - DNA, 201 bp, Homo sapiens
gggtacccgggtgaggggcggggctggccgcacgggagagcccctcctccgctccggccccgccccgcatggccccgcctccgcgctctagagtttcggcwccagctcccaccctgcactgagtcccgggaccccgggagagcggtcagtgtgtggtcgctgcgtttcctctgcctgcgccgggcatcacttgcgcgccgc

SEQ ID NO: 55077 - DNA, 201 bp, Homo sapiens
tcctatttgttcatactctcttatttgcccagcaaggtcaatgccagtttaggcctagggagtcattttttcttagttgatatgacttagaaagcttgggwgcctgcccaacatcaattacttttttaaagctggtattttctaggtcttgatatttattaagaccctagcatagtggacaatttttctttctctcatgct

SEQ ID NO: 55078 - DNA, 201 bp, Homo sapiens
tgggtatttacttatactctctctatttattccgtctcatacttcgtcctatttgttcatactctcttatttgcccagcaaggtcaatgccagtttaggcytagggagtcattttttcttagttgatatgacttagaaagcttgggtgcctgcccaacatcaattacttttttaaagctggtattttctaggtcttgatat

SEQ ID NO: 55079 - DNA, 201 bp, Homo sapiens
gggaaatggggagatgtaaatgggcttggggagctggagatcgccgccgggtacccgggtgaggggcggggctggccgcacgggagagcccctcctccgcyccggccccgccccgcatggccccgcctccgcgctctagagtttcggctccagctcccaccctgcactgagtcccgggaccccgggagagcggtcagtgtg

SEQ ID NO: 55080 - DNA, 201 bp, Homo sapiens
aacaaaaaactatgttggtctacaaatatgaatttgaagttattgagagccttgttgaatagatttttgttgtaaacgtgtctctagaatagtatggcatwgtctcagcttcctatgaatgaaggacataccttttcttttttaaaatatttgttacacaggaaagtgtgtctagaatgtgatctgtggcaataaattatg

SEQ ID NO: 55081 - DNA, 201 bp, Homo sapiens
tagtgagcacttactttattagctcatctcatctttgaagctgagattggaactcaagttcctgactacaaagctatgctcttgacctctaggtcacgtgrcatccctagcaagaacttgaaaatttcttctgaatgaacaaaatagaaatcactaagtgtcctaaatttatttaaattatttcacttgccaagatgcact

SEQ ID NO: 55082 - DNA, 201 bp, Homo sapiens
acgtggcatccctagcaagaacttgaaaatttcttctgaatgaacaaaatagaaatcactaagtgtcctaaatttatttaaattatttcacttgccaagawgcacttgtcaaaatacacagagagagatgtgctctggcttatgtttttatagaattacttttgttctccagaatacttcagggaaataggggcagaaata

SEQ ID NO: 55083 - DNA, 201 bp, Homo sapiens
tagagtcgtgtggggcagcagaaacactgatgggaaggaagaaagcttagaagccagcaagacagctgaccgttccattgaagtcaaaagcattaggcatrtttttaaagaactttgccgtatattatcagatgttgcccacatcatgacactcagagtcaggcaaggtagaaacaatgatctttttttttgatgtattat

SEQ ID NO: 55084 - DNA, 201 bp, Homo sapiens
tgaccttttttttttttttattttcttccagaaaaaccttttgttgcttttggaagtggcatggaatctctggtggaagccacggtgggggagcgtgtcaraatccctgcgaagtaccttggttacccacccccagaaataaaatggtaactactggaaataaatgcaaagcatcatttcgtgtgagagcaaatcctttga

SEQ ID NO: 55085 - DNA, 201 bp, Homo sapiens
gagaattttttttcataggtataaaaatggaataccccttgagtccaatcacacaattaaagcggggcatgtactgacgattatggaagtgagtgaaagaracacaggaaattacactgtcatccttaccaatcccatttcaaaggagaagcagagccatgtggtctctctggttgtgtatggtgagtccattcaattttc

SEQ ID NO: 55086 - DNA, 201 bp, Homo sapiens
aagaacagaataaccaaagtctgaatcttttccttactcttgactctaattaaagaaaaattaaatcataatatgcgctgttatctctttcttatagccawgctgtctcagtgacaaacccatacccttgtgaagaatggagaagtgtggaggacttccagggaggaaataaaattgaagttaataaaaatcaatttgctc

SEQ ID NO: 55087 - DNA, 201 bp, Homo sapiens
ttcttagaaatagcctcacagtctggcacttcatattaatacctccctgaaattaatttttcaggggacagagggacttggactggctttggcccaataawcagagtggcagtgagcaaagggtggaggtgactgagtgcagcgatggcctcttctgtaagacactcacaattccaaaagtgatcggaaatgacactggag

SEQ ID NO: 55088 - DNA, 201 bp, Homo sapiens
cttaagttaaatgaataaatctcacagggagtaaaataaacttagatgtttaaagaaggtagataatgagaaacaaagggtatgctcatgatctcccaagkcgcaatagttgtaagtatggatgggctgtgaaactgagccaacatctggtgaggtagtcataggctctggtaagttgaaaataaatgaacatggaaagaa

SEQ ID NO: 55089 - DNA, 201 bp, Homo sapiens
atagtaatactcacccctagagaggtaccgtggtgaacacatcatgagatgctgcttagacagcttctggcacagtgtcaggcttgcggcagattatcagygagggcttcctgaacaagtgaatgcaggaatgattgactacggtaccagtagtgtttgacaactgttacttttaggggttggacttagaaagtaggcttt

SEQ ID NO: 55090 - DNA, 201 bp, Homo sapiens
tttgagatctgtgaaggtagtgctttgtaaacctctgttggccattttcctgggagctaccaagtattggtgaggcctgcagggaaaaacaatgtggcatrttttaaagttgcattactttaaaaaataaatctgtgcaaagttataggcttatttgctctctcatgttctgttttttcaatttacttgctctagggtata

SEQ ID NO: 55091 - DNA, 201 bp, Homo sapiens
tcaccacgtgaggttttaaaaatcctaattcagttggttccatttatttctcctgaaacaaaatatatttgttgtctgcatgaggttaaaagttctggtgyccctgtttttagcattaaataatgtttaccaaagcccagatttaattctgtgtgttactagaagttattgggtaatgttatatgctgtgctttggaagtt

SEQ ID NO: 55092 - DNA, 201 bp, Homo sapiens
ccgctccggccccgccccgcatggccccgcctccgcgctctagagtttcggctccagctcccaccctgcactgagtcccgggaccccgggagagcggtcartgtgtggtcgctgcgtttcctctgcctgcgccgggcatcacttgcgcgccgcagaaagtccgtctggcagcctggatatcctctcctaccggcacccgca

SEQ ID NO: 55093 - DNA, 201 bp, Homo sapiens
gagactggcccaagattacccagcgagtctgtggtcgcctgtgctctagcccagttccttttctaggactctggtttgcgacagggacctcggctggagcrtgtcctgagatgccgacacaccctcaggctcttgggaggctggggtgggaaggcgcctggggttggcaggcaggaggtgcctccgcaggcgagaaaaggc

SEQ ID NO: 55094 - DNA, 201 bp, Homo sapiens
aggaggagagacatagagtattcaaggtttaacaaacctatttgaccagagcaccttttttcccctgagcaaattcattaatctctcactccaaacagttygagaaatgcttctctgttgtaattctttgttcccccttctggtacggcatattaaaacttcaggatattttcccatgacattaaggtgcttccctacgtg

SEQ ID NO: 55095 - DNA, 201 bp, Homo sapiens
agagtattcaaggtttaacaaacctatttgaccagagcaccttttttcccctgagcaaattcattaatctctcactccaaacagttcgagaaatgcttctytgttgtaattctttgttcccccttctggtacggcatattaaaacttcaggatattttcccatgacattaaggtgcttccctacgtgtcctgatactcttc

SEQ ID NO: 55096 - DNA, 201 bp, Homo sapiens
actcaggtgtcataataagagatactttggggtcaagtcatccccagcatccttcaagtcacaccacatagatcacatggattttctgttggcttgtctgscttcaaggttatggcagaattgagaaagagatgtgaagtaggctcctggcctagctgtgcccagaaaatatgtgctcgcagttagctgctttgcttccct

SEQ ID NO: 55097 - DNA, 201 bp, Homo sapiens
agctttcatatcattgagtgttagtgttaatgaagacctaattttaaaattctgttagaattagagattttgctttggatttttaatatattaaacattgygtagagctcatagtggagatgtggtaaatatctgaggaattcgtttacattttcaagtaatgtgtttggccaaataagatattttgggacctgaattgtc

SEQ ID NO: 55098 - DNA, 201 bp, Homo sapiens
ggatcgatggatttctatgaactcatcctaacttgtctctcaaagtctagattttggtccctttactctgccaaatctatgatgccaagtattgcatcgaratatgttgacatattttcaaatgtataagcttattagcatttcataaactacacttgcaaataaagatttcaaagaccatggcagttttgtcatttccaa

SEQ ID NO: 55099 - DNA, 201 bp, Homo sapiens
tttagaaatattaattccatttcttgaatttgtataatcattcatatagccacttagaggtagggtccctatgtaatcatccaaagcaggacatttggagrgtgaagggggagttattaaataattaagccaggacaaaggagtaaactggactatccatgttaaattgggatgtatggtcaccctatctagttgatgtct

SEQ ID NO: 55100 - DNA, 201 bp, Homo sapiens
tccagaattggaatatgtaaaagatgttcatatgtaaaagataatttgcaaaacaagaatggttgtgttagaaaaaaatataatgggttatattttttaawttaaaagctttataaataattgttaattctaatagtaacggaattctggtctggccattttcattttaggaggttagacagtaaagcttctttcttcaat

SEQ ID NO: 55101 - DNA, 201 bp, Homo sapiens
tttagactgtcatcagtttttccattgccttgaaatgtggtggctaaaactggatgccatgccctttgaagggcttggctcgtgtggttagggctttgtgratgagtgattttttgttctatgtagctccttgtgttctgttgttacctctctgaccacagcctgctttctcttcattgtaactgcacttccctgtgggct

SEQ ID NO: 55102 - DNA, 201 bp, Homo sapiens
tgaaatgtggtggctaaaactggatgccatgccctttgaagggcttggctcgtgtggttagggctttgtgaatgagtgattttttgttctatgtagctccktgtgttctgttgttacctctctgaccacagcctgctttctcttcattgtaactgcacttccctgtgggctgcttacccatcttgtttttagttctctcct

SEQ ID NO: 55103 - DNA, 201 bp, Homo sapiens
ttccttcccgtctttgagctggaagggtaacagtgcacaaattaattaatattggttatgggatttgaacatagaagggctttttattgagtagtagcatrtgtacctcttacagttatttctttagaactttctgaagagtccagctcaagcttgccaatgaaaacgaatgacatttaatggagcaaaaacaaaaaacaa

SEQ ID NO: 55104 - DNA, 201 bp, Homo sapiens
tagtttgaagtcaggtagcatgatgcctccagctttgttcttttggcttagatttgtcttggcaattcaggctcttttttggttccatatgaactttaaartagttttttccaattctgtgaagaaagtcattggtagcttgatggggatggtattgaatctacaaattaccttgggcagtatggccattttcacgatatt

SEQ ID NO: 55105 - DNA, 201 bp, Homo sapiens
ctgatatccagatttccaccctttgcagggtgagaaaggggaaagggtcagagaaagaaaaaaaaaaagtcgaataattcagggaaaaaaatttcttactycctaagacaagaatcacatgtcttagaagacactcacacccacatacagtaccaggatcatctgtccatggttactgaattttctttataatgacttggt

SEQ ID NO: 55106 - DNA, 201 bp, Homo sapiens
tagtaatactcacccctagagaggtaccgtggtgaacacatcatgagatgctgcttagacagcttctggcacagtgtcaggcttgcggcagattatcagtragggcttcctgaacaagtgaatgcaggaatgattgactacggtaccagtagtgtttgacaactgttacttttaggggttggacttagaaagtaggctttg

SEQ ID NO: 55107 - DNA, 201 bp, Homo sapiens
ctagcttcatgatttgttgcccctttaaaccatttgaaaaatatttacttagcatttatttagagaaaaggctgagaagtgtgtgggggagggaccactcmtgtctagacttagctttgcctctaatttcccctgtggaccagctctggcctcaagtttgcatgcttcctgcaagaaaacacatacttgctgggctcatct

SEQ ID NO: 55108 - DNA, 201 bp, Homo sapiens
atactcacctgttgtttatgccaagcattttagaacatagaatcagcgtacttaccaaaagctggtgacagtggaccctcatcccttaattgtttgaagckctcaacttttagatattgcaatagaaaaacagaataagaaaatggtttttactctaactttatttcattttttgctctgtttatcttttcctttcttcag

SEQ ID NO: 55109 - DNA, 201 bp, Homo sapiens
tcattcatattggtcaccatctcaatgtggtcaaccttctaggtgcctgtaccaagccaggaggtgagtaactgtgggtggttttggtcacccaattttarcatgcctctctgatagtgtttgagggaaagcagtcaactcctctggccttgattttcttagcttagaatactttgcggattcctaggaataaatatattt

SEQ ID NO: 55110 - DNA, 201 bp, Homo sapiens
gttgctctgggatgttctctcctgggcgacttggggcccagcgcagtccagttgtgtggggaaatggggagatgtaaatgggcttggggagctggagatcsccgccgggtacccgggtgaggggcggggctggccgcacgggagagcccctcctccgctccggccccgccccgcatggccccgcctccgcgctctagagtt

SEQ ID NO: 55111 - DNA, 201 bp, Homo sapiens; identical to SEQ ID NO: 10432

SEQ ID NO: 55112 - DNA, 201 bp, Homo sapiens
ttctctgcacccccgaccccagcaggagaggtgagagctgtggggaggggggggtttcagttcactaccccggattaggttttcctatcaatgcacattcstttgtcctcttcaacaaaaggacgaaaagcaaaaaaccacaacccacagctttctagttgctgacttaacccaattttcctgtacccccagcatgtcttt

SEQ ID NO: 55113 - DNA, 201 bp, Homo sapiens; identical to SEQ ID NO: 10404

SEQ ID NO: 55114 - DNA, 201 bp, Homo sapiens
gttctgcacagctttgtgatgaagggtggggctgttgctgttgtgtgttcttggggatggcacttccagattggggatgagaacattagggtctcctgaargacactggtaaactgtgggtcaggctggccttgtagagagttcctcatctgttcctgttgttacagtctctttcagtaaatgaatggaagagtctaggtt

SEQ ID NO: 55115 - DNA, 201 bp, Homo sapiens
gatgccatgccctttgaagggcttggctcgtgtggttagggctttgtgaatgagtgattttttgttctatgtagctccttgtgttctgttgttacctctckgaccacagcctgctttctcttcattgtaactgcacttccctgtgggctgcttacccatcttgtttttagttctctcctttaatataccttccatttcaac

SEQ ID NO: 55116 - DNA, 201 bp, Homo sapiens
acctctctgaccacagcctgctttctcttcattgtaactgcacttccctgtgggctgcttacccatcttgtttttagttctctcctttaatataccttccrtttcaacagctttttgtttctgacacatgatttgtattgttgtcttaaagttctatgttcagatatgaaagccacacaccctatgtagccaagaagtccc

SEQ ID NO: 55117 - DNA, 201 bp, Homo sapiens
gcaagaagtcatgctattgatttttgataactggagaagtagacttctttgtcaagaagaagaggcctttaaattttgcctttcaacccttaccccaggaygaaagatagaagacccttgggtttaacatagtgatcacacacgaaaggcatggagccttcttaggacctgtgtgtttttggtagagactgtgacaagtgg

SEQ ID NO: 55118 - DNA, 201 bp, Homo sapiens
tgcttacccatcttgtttttagttctctcctttaatataccttccatttcaacagctttttgtttctgacacatgatttgtattgttgtcttaaagttctrtgttcagatatgaaagccacacaccctatgtagccaagaagtccctgtgccctttgtttttaatgaaaaggcacttgaagaactgaagccataacaacag

SEQ ID NO: 55119 - DNA, 201 bp, Homo sapiens
ctcattgattctggagcttgggccgtgttacctcttttttgcccagttagtttgggtctgatctttgtttccaaggtaaatctgtgttcactgttggccaytgagacttataaaaagtcttcctatgtttgagaagaaaacctaaaattcttgaaatcgaggaagatttgggggtgaattatggagaaatttctgtggaga

SEQ ID NO: 55120 - DNA, 201 bp, Homo sapiens
tgaactggaattaaattgaactggccttgagaaaatcaccttaattttttgtttattctctttcatttacataaatgtctgagtttacatggtaatttgtrtggcatcctacttataagccttggaaaggattttggagtttatattatgagaatgcatcaatacagtgaaattttaaaaataccttagataatgctattt

SEQ ID NO: 55121 - DNA, 201 bp, Homo sapiens
ggttaatttagcttccaaaggcttgctctgtaagcaagttatgtaatatttcataacatgtggatgaaaggtaggcaatattaagaagtggcaatccctagcactgtttattggtacactgcctgtctttgggtataccattaaattctgcttcctgtctaagcttaaagttctaggagttgggctgtccaagattttggc

SEQ ID NO: 55122 - DNA, 201 bp, Homo sapiens
cctaaatttatttaaattatttcacttgccaagatgcacttgtcaaaatacacagagagagatgtgctctggcttatgtttttatagaattacttttgttytccagaatacttcagggaaataggggcagaaataaggaggtcagttgggaggctaattgcagttatccaagtgagagttgaggggtggcttagacaaggg

SEQ ID NO: 55123 - DNA, 201 bp, Homo sapiens
gtcaaaatacacagagagagatgtgctctggcttatgtttttatagaattacttttgttctccagaatacttcagggaaataggggcagaaataaggaggwcagttgggaggctaattgcagttatccaagtgagagttgaggggtggcttagacaagggtagttgaggtggaggtagtgagaggtgatctgcttctggat

SEQ ID NO: 55124 - DNA, 201 bp, Homo sapiens
tgtgctttccagctgggaaggaaatcaaacttctgctgttgcagggaattagctgcctttgtcccctgtggtttaattaactctttcttcactttgactgrctattatgaagcactctgagaatgcttgatgagatgtgttgggcatagcaatgtgaaatgttatctctctgagatttcaagcatgactccacaccacatc

SEQ ID NO: 55125 - DNA, 201 bp, Homo sapiens
gtgaggattaagtgaatgaattcatgcaaagcacttcaaacaatgcttggcacataataaatgtatttactgtgctatttcagctgttttctgtagccttyccctgatctcctaaacttgagaggacagagagaactatctctgtaatacagatgagaggcacaggatttcaacacttccataaagtcattcagcttgtta

SEQ ID NO: 55126 - DNA, 201 bp, Homo sapiens
gcatgactccacaccacatcatctctatctctgaggaatggactaggtttccagcagcatgttaacattgtatgagtaatgtttgattggccttgaaatctttttttttttttttttttgagacggagttttgctcttgttgcccaggctaaagtgcagtggtgctatctcagctcactgcaacttctgccccccggttca

SEQ ID NO: 55127 - DNA, 201 bp, Homo sapiens
cttctcttatcttcttattcatcagtgaatttcagagtttggtccagctttttttcctgtgaccctttgtactggaggaaggcttattgcttctttgacaraggagcaaaatgttatgccagaatccattcgtaagttggctcttacaaaattagttaataatgctcacttaaaaaaataccagtgagcattaattttgga

SEQ ID NO: 55128 - DNA, 201 bp, Homo sapiens
ttaaacatctattgaatccttattaccaccatcaccattttacactttatagagcacttccatgagatgatctcatctgagtctcgtaacagtccttaagrtaggtaagaattattattttcattgacaaatgatgaagctgctgcctgaaatgattaaaagataatgctcaaggacattccaaatccttattttcaccaa

SEQ ID NO: 55129 - DNA, 201 bp, Homo sapiens
aggcacctgctgcatgaagagtgggatgatgggctgcgtttaagacctagaagactccatgggaaggaagctacattcactgtctgtacctctgggtcatsccacatgatccagcgtagcccaaggtcaatgggacgatcacttcagtgagcagatagctctgtaaattcctccatagaggcactgtctaccccttgtcta

SEQ ID NO: 55130 - DNA, 201 bp, Homo sapiens
ttttaaattttcattttattgcaaggctgagaggcctacttgaataagcatgagctttgcaaactggggaaacatttagcaatatacagttgacctgtgarcaactcagggattgggggaactcaggggagttcccctaactttccctcctctgcagtcaaaaatccatgtataggccgggcgcggtggctcacgcctgta

SEQ ID NO: 55131 - DNA, 201 bp, Homo sapiens
caggaaatcttggaactgcagctactcagaccctcaaggtctttgacgtttcacttgaaatgaaaaactaaatcaaatgaccatttacagtaagttgaccttttttttttttttattttcttccagaaaaaccttttgttgcttttggaagtggcatggaatctctggtggaagccacggtgggggagcgtgtcagaatcc

SEQ ID NO: 55132 - DNA, 201 bp, Homo sapiens
catgcgccaccacacctggctcatttttgtatttttagtagagacagggttttaccatgttgcccagcctggtctcgaactcctggcctcaggtgatccayccgcctcggcctcccaaagtgctgggattataggcatgagccaccatgcctggccggtagaagactgactgtgtctgttgaagagtttatttaagtttca

SEQ ID NO: 55133 - DNA, 201 bp, Homo sapiens
cctctctgcccaagatttattatgatacattgtcttccaaatcagccaaaccaccgttcctctgcctcctgctgcttcactcatatcatggctgggcctgygtacaaaagtcatctggcgtggtgaagctgaagtgaaacgtaggaccatgtgctctggccatgtttgtttaagaggccgtgtaaatgagctttgtggtgg

SEQ ID NO: 55134 - DNA, 201 bp, Homo sapiens
aagttatactaccatgttcccctctcatggaattgcccacctggtacacagatgtgtaagacccttctccttagattttgtgcaaagcttctagtttgatrttgtagttgatgtatcagagatgtgcaggcacgttccaactctgaaggcttttgaagttgacactgttggcttggttgggagcttttcttttttcctttt

SEQ ID NO: 55135 - DNA, 201 bp, Homo sapiens
ttttataagaattgccaaataaatgtaaggcattattggttgaatgatactaaaatttggcacttccaagagaaatttgaagggattctagggtattattkactagaatcttcatgggagggaagttttcacctggggaggctgtgtctaattagaggaaaaatccataaaggtgaccctgaacctttcttttgtgatggg

SEQ ID NO: 55136 - DNA, 201 bp, Homo sapiens
ataaactttttaatttttaaaactttttcactcgttttaacacttagcttaaaaaacaaaaactgtacagctgtacaaaaaatgttctttctttatattcktattctataaacatttttgtatttttaacttaaacttttttttacttaaaaatttttttgttaaaaactaagatagaaacacagacattggccgggcgca

SEQ ID NO: 55137 - DNA, 201 bp, Homo sapiens
cgagtctccttgtacccgtatctatcagccctgaccccatggtgcctccacccccataggtgtccctgagcctgtggcgtctcctgagcctgcaacctgcycctcctggtccatctgcctgtccccacccctgtcccctgcagtggccccttctcacccctccccagcactagtccccttggccaggctgacttgttcact

SEQ ID NO: 55138 - DNA, 201 bp, Homo sapiens
gtgtggtggtggtgcgtgcctgtactgacagctactggggaggctgaggcaggaaaatcgcttgaacccagagacagaggttgcagtgagccgagatcgcrccactgcagtctagcttgggcaacacagcgagactcatctaaaaaaaaaaaaattggcgggcatggtgtctcaagcctataatcccagcaccttgggacg

SEQ ID NO: 55139 - DNA, 201 bp, Homo sapiens
agatagggtttcaccatgttgcacaggctggtcttgaactcctgacctcgtgatccacccacctcggcctcccaaagtgctgggattacaggcgtgagccwccgtgcctggcctggagtttcttttggggatgatgatgaaaatcttcaaaaattgattttattgatggttatacacttctataaatatatttaaaggaaa

SEQ ID NO: 55140 - DNA, 201 bp, Homo sapiens
ccccactgtgtgttacagggaccggcagaagctgaagggtctcagaggaggaggctgctggttccagcaaatggtgctgaccccactgagagtaagtgttktgctcctggagatgcagcagaaatggtgggaatagggacggtgtcctaactggtgtccccattgctgagagtgctcttccagagcattccatgccagaaa

SEQ ID NO: 55141 - DNA, 201 bp, Homo sapiens
aattgtcttctcccatctcttcttcccactctacctcatcctttctgcaccctattaatgacactagccactctgtctatcctcttctccacctcctctcktctcctttgttgttcaggagaacaacagccctgaggggctgccctgtcctgcatggcaccactgacttcagtgggctaatagctctttatctgtgcctaa

SEQ ID NO: 55142 - DNA, 201 bp, Homo sapiens
gccctgggtgtgggcttctgagttggctctttgccttcctaaggtgtgtttctggcgcttgggtctcctacgagggcctggggctgaggacaatgctcacmacgagattctgagcaacgcagactcgctgtccactttcgtctctgagcagcaaatggaaagccaggagccggcagatttgacaggtgtcactgtacagtc

SEQ ID NO: 55143 - DNA, 201 bp, Homo sapiens
taattccagcagcattgtagtgagaacccttgtatgtgtcatatgtccatatgtcaatgttccctgaagtatcgggcagccctttagaagaggaatttttrggtacatgagctcatcaatgtagaattttgtttggatattgctaaattgtacttcgggagaagattgtgccagttttactctcacaccaagaatacaaaa

SEQ ID NO: 55144 - DNA, 201 bp, Homo sapiens
tttaaacgaacatttctttgttttcactgtttttgcgtaagatcagtgtcttgtctctcagagtctttatgagaaggcctgctctcctactcatgcttttwctcacattcagacagtagattcctaatttcttcttgcccctttttgttctaatattttcaggtgtagaagctttaatttttaaccagtgaaatctgtaga

SEQ ID NO: 55145 - DNA, 201 bp, Homo sapiens
tttttcttgataccccacgattccttgcacagcgtttctaccaggcgccgacatgccctccttggatgaatgagtaacatgggttctaggaagcccgcacsaatgcagatgtgacgtcctcagcctttcatagacatgtttcatgtgagaggtgggaagaacagctgaacagaaggctgagcactgtccaggtccagagtc

SEQ ID NO: 55146 - DNA, 201 bp, Homo sapiens
ctttttcttgataccccacgattccttgcacagcgtttctaccaggcgccgacatgccctccttggatgaatgagtaacatgggttctaggaagcccgcaycaatgcagatgtgacgtcctcagcctttcatagacatgtttcatgtgagaggtgggaagaacagctgaacagaaggctgagcactgtccaggtccagagt

SEQ ID NO: 55147 - DNA, 201 bp, Homo sapiens
cccaagtgcatggacagggtgagttgatttctccaggagctgggggcatcaggggctcaggaactgcttcttgcccacagtgtagtccaggtgggtgggtmcccgtgctctcatggctgccctgagtctctgaagtggcctggatgctgtgcattgactatgggggacacaggcccttttgagcatcatacaggctggtgg

SEQ ID NO: 55148 - DNA, 201 bp, Homo sapiens
agtgattgggtcactgggttctgctgacctttcccaggggagtatttggtgctttttcatgaggcctgcattcacccagcgctgggtcactgctgggggtmcctgagaagtcatgtaaagccacctcttatttccagaatgatagacatgtttagagaagaagtggcttcccccagaccatgaggctggcccgagactaca

SEQ ID NO: 55149 - DNA, 201 bp, Homo sapiens
cccatccaggcagggggcagtcagctcctcaactggatgacaagagtcgagacgagaagtggttgtgggatttatgtagctttgttcagagcaaaacacaragcagaaaacagtgatgttccacttgtttgtttttagcctacttccctttatgctccccgctcctgaaggatctcccgagttagcagggcctcatgtgga

SEQ ID NO: 55150 - DNA, 201 bp, Homo sapiens
tgcaaccctagggccctggtgtcatccgtccctctcccaaggctgggggtcccctcatctcccagccaagtctgggaaggcagggccagttcctccactgktcaggcccatccaggcagggggcagtcagctcctcaactggatgacaagagtcgagacgagaagtggttgtgggatttatgtagctttgttcagagcaaa

SEQ ID NO: 55151 - DNA, 201 bp, Homo sapiens
gctgaggcaggaaaatcgcttgaacctgggaggcggaggttgcagtgagccgagatcgtgccactgcactccagcctgggcgacagagcttgactccatcwcaaaaaaaaaaaaaaaaaaaaaaaaaaaaaaaaaggcaggctgaatcactcgccaggtagtgacggaggaggccgtaaaagcctcttagaggccagaccc

SEQ ID NO: 55152 - DNA, 201 bp, Homo sapiens
tcgtgccactgcactccagcctgggcgacagagcttgactccatcacaaaaaaaaaaaaaaaaaaaaaaaaaaaaaaaaaggcaggctgaatcactcgccmggtagtgacggaggaggccgtaaaagcctcttagaggccagaccccgcagtggcctctgtgtccttcattccgccacccatccgtccaccgagcgcctgc

SEQ ID NO: 55153 - DNA, 201 bp, Homo sapiens
tggcctggatgctgtgcattgactatgggggacacaggcccttttgagcatcatacaggctggtgggccattctgtagccctgtgcttcctacagcccagrtgagacccttaccccacagcctgtaccctggggatggggtgagcccccaagcccagcaccagggcctggccccagcagcaggtcctggatgtgctgagca

SEQ ID NO: 55154 - DNA, 201 bp, Homo sapiens
caatgttgtattttttgtttcagtgttattagagattttcaaggatccaggaattttttgagactgggagtagatgacctagagactccagattagaccgytggggagggagcagggaagactgcagtcgcacctctgcacttaggaaactgtggtcggctggggccagttcctgccacccgccatgcctgtgaatggaga

SEQ ID NO: 55155 - DNA, 201 bp, Homo sapiens
gcggggacagtcctgatgaagaggagaggggagcagcaccggctggggtggggcctctgccgctgcctcttcctgtgtggtttttcagggcttaggctgcscctctcacctggcttgtctgtggggaggagatctttgttctctggctgcttttaagattttctccttaacagtgtggtttcagcacttcgatggtggcaa

SEQ ID NO: 55156 - DNA, 201 bp, Homo sapiens
tctgtagcatttttggtctccccttctgtataatagcagccgtgttttggcttctgcagggctaaggtcctctgagcagctgcttctccacatctctgccmtgcactcggccttggagctcctggtgttcctcagcagagtccacagggctcttcggggtcccatccctgtgctgtagcctggaacctgtgacctgaggcg

SEQ ID NO: 55157 - DNA, 201 bp, Homo sapiens
gtgcctttttaaacctgaagttcattatttaatatttgattcagtatcctgctttttaaaaaatttacacatcacctaaccctcattagtaaaagcgtgtrtatgtctgtgtgtatgtgaacactgcccaatcacaggagaatatccatttttctcaagggtacatgaaacattctccaggacacactatatgttaggcca

SEQ ID NO: 55158 - DNA, 201 bp, Homo sapiens
catttttggtctccccttctgtataatagcagccgtgttttggcttctgcagggctaaggtcctctgagcagctgcttctccacatctctgccatgcactyggccttggagctcctggtgttcctcagcagagtccacagggctcttcggggtcccatccctgtgctgtagcctggaacctgtgacctgaggcggtgagct

SEQ ID NO: 55159 - DNA, 201 bp, Homo sapiens
aactgtacagctgtacaaaaaatgttctttctttatattcttattctataaacatttttgtatttttaacttaaacttttttttacttaaaaatttttttsttaaaaactaagatagaaacacagacattggccgggcgcagtggctcacacctgtaatcccagcactttgggaggccaaggcaggcggatcacgaggtca

SEQ ID NO: 55160 - DNA, 201 bp, Homo sapiens
ttctgtataatagcagccgtgttttggcttctgcagggctaaggtcctctgagcagctgcttctccacatctctgccatgcactcggccttggagctcctrgtgttcctcagcagagtccacagggctcttcggggtcccatccctgtgctgtagcctggaacctgtgacctgaggcggtgagctgaggccaccactgggc

SEQ ID NO: 55161 - DNA, 201 bp, Homo sapiens
tttccttatagggagagcataagcaagaagctttattatttttcagcagtaaccttagttgccccagcgccattactgaataatcacatttttatcatcgrtagtgtcatcatcataacacatcagcaaggaagtttttccttcacagtggcacggtggctcactcctgtaatcccagcactttgggaggccgaggcaggt

SEQ ID NO: 55162 - DNA, 201 bp, Homo sapiens
ctgtataatagcagccgtgttttggcttctgcagggctaaggtcctctgagcagctgcttctccacatctctgccatgcactcggccttggagctcctggkgttcctcagcagagtccacagggctcttcggggtcccatccctgtgctgtagcctggaacctgtgacctgaggcggtgagctgaggccaccactgggctc

SEQ ID NO: 55163 - DNA, 201 bp, Homo sapiens
atagcagccgtgttttggcttctgcagggctaaggtcctctgagcagctgcttctccacatctctgccatgcactcggccttggagctcctggtgttcctyagcagagtccacagggctcttcggggtcccatccctgtgctgtagcctggaacctgtgacctgaggcggtgagctgaggccaccactgggctcacctcat

SEQ ID NO: 55164 - DNA, 201 bp, Homo sapiens
caatttccaagtcagcctgtaacagtgctgcttactgtgtacacgcacatacacgcacatgcacacacatgcatgtacacacatgcacacacacatgcacrtacccacacatacaggtacacacatgcacacagccccctagtgttggtttgtaccagttcatgtattttgatttgacattgaagggctttttcttttctt

SEQ ID NO: 55165 - DNA, 201 bp, Homo sapiens
tgcagggctaaggtcctctgagcagctgcttctccacatctctgccatgcactcggccttggagctcctggtgttcctcagcagagtccacagggctcttyggggtcccatccctgtgctgtagcctggaacctgtgacctgaggcggtgagctgaggccaccactgggctcacctcatgggcttggagggaaagtcactc

SEQ ID NO: 55166 - DNA, 201 bp, Homo sapiens
gcatgtacacacatgcacacacacatgcacgtacccacacatacaggtacacacatgcacacagccccctagtgttggtttgtaccagttcatgtattttsatttgacattgaagggctttttcttttctttttttttcttttttttgctatttaggaaaacattgttttaaacgaacatttctttgttttcactgttttt

SEQ ID NO: 55167 - DNA, 201 bp, Homo sapiens
ctcatgtggatccccaggcccggggatctttgtccagtgtcccagcccccagcccacccctgcccaacactgccctctaagaaggagtgctgcatgggccyctccctggccactaagggaaccgtcttctcttctaggttgtggaggggaccccaagtgcatggacagggtgagttgatttctccaggagctgggggcatc

SEQ ID NO: 55168 - DNA, 201 bp, Homo sapiens
ccagagtcaccaggagctcgttgtcaggttttcacttgctattagtagagatttttttttaaggtactatttttagtgttagaagtgaattcaggccgggygcagtggctcacccctgtaatcccagcacttcgggaggctgaggtgggcagatcacgaggtcaaggagatcgagaccatcctgaccaacatggtgaaacc

SEQ ID NO: 55169 - DNA, 201 bp, Homo sapiens
gccacgttggccagtctggtctcaaactcctggcctcaagtgatagacattcgcctgccttggcctcccaaagtgctgggattacagacatgagccaatgygcctggccacacattggtctttcagttactgcactggaagttttctctgtaatccaatgacaacaatttttaattatatgaaaaatttacttaaaacatc

SEQ ID NO: 55170 - DNA, 201 bp, Homo sapiens
gcagattctctggtgaccttgacgcccgtcagcgccttgggggccacagaggccaggcagtgtgggtgggctctctgtggatgggaggtgggtgggcaatggagcaacaggtttgcccatgcagggggctctccaggttctctccttgggttctgggcctgatgtgggatcctctgccccttctgaactgagtcccaactc

SEQ ID NO: 55171 - DNA, 201 bp, Homo sapiens
ccaggtgccccagagggatggtcaaggtcaaggattgtacgccctggagtgacatcgagtgtgtccacaaagaatcaggtacaaagcccactggggaagcyccagctgcagaggagacagggaccagcagcccgagactcctgtcttttcctgtcttttctcaggcaatggacataatatatgggtgattttggttgtgac

SEQ ID NO: 55172 - DNA, 201 bp, Homo sapiens
ctgccccaagtcctagtgtctctggccgggctctatcttcctccttgtgatcaccccccatcctcccatcctgtgcaaccctagggccctggtgtcatccrtccctctcccaaggctgggggtcccctcatctcccagccaagtctgggaaggcagggccagttcctccactggtcaggcccatccaggcagggggcagtc

SEQ ID NO: 55173 - DNA, 201 bp, Homo sapiens; identical to SEQ ID NO: 10437

SEQ ID NO: 55174 - DNA, 201 bp, Homo sapiens
cgaggcagcagaatggcgtgaacctgggaggctgagcttgcagtgagccgagatcgtgccactgcactccagcctgggtgacagagcgagactccgactcaaaaaaaaagaacacttatgtgtctttaagatcataaaactgtaaattcaactgaagaacaaaatgcacaaggaaaagataaatttcttgatatatatgaa

SEQ ID NO: 55175 - DNA, 201 bp, Homo sapiens
atggagatatttttttcaatgatgtgatttttgcatataactttataatctaaatggaacttgttttgtgtttcagtgcaaagcgaggcactccctgaatygttctagtcactgtctggtttttccaacccctttgagctgccgattctcccatttccctctgctttgggtccctccttaatcacaggttaaatgctcatc

SEQ ID NO: 55176 - DNA, 201 bp, Homo sapiens
cgagactccgactcaaaaaaaaagaacacttatgtgtctttaagatcataaaactgtaaattcaactgaagaacaaaatgcacaaggaaaagataaatttcttgatatatatgaaacacaagaaagaaaaagaagattgaaaagagccatatgttttcaatgtatgtttctttgtattttgtgtgtttttatgtgtttatt

SEQ ID NO: 55177 - DNA, 201 bp, Homo sapiens
ttcttcctaattttcatatagttaactttatgcaactttttagtttctcgtgagactgagaaggtcctttctctctccaaacttgtaagaaaaatttctcrtgcagtacttgtgtgatttcatactttacagttgacaccttgatagacctagtctctatttccttatagggagagcataagcaagaagctttattatttt

SEQ ID NO: 55178 - DNA, 201 bp, Homo sapiens
ctgtttgtaccttctactgaccaagagctcactgagggcagggattaggactttttgtgagtttccagggatgcaggtggcattgccctggtctctaggcytatgtggccattaatcacttaaaacacagccactttgaattgagatgtgcagtgagtgaaaaatacactctgggtttcgaacacttagtattcaaaataa

SEQ ID NO: 55179 - DNA, 201 bp, Homo sapiens
gctttttccctaatctgatgtaataaataatgaatcatggtccttttgtatgactccaagtgttggtgacagctgaagggtgggtgtcctgtgtgagcccragtgtgctggtgcagaatctggccctcagaactccttggcaaactgagttgagctgagctgagggggagggagttggggtggtgaggaaaggtcaaggga

SEQ ID NO: 55180 - DNA, 201 bp, Homo sapiens
gctcacttgtactgtgggttaactggaggaaggggctcagcttgtggccacacgggcttgtgatcttcccctggagtgtgattcctcctaacgcaggcctyccctgcagcccagggaagattagtgtgtgcccagcacagaaggctcctggaactgcagctctgaccccagagcagggaggccaagggggtaaagtgtgca

SEQ ID NO: 55181 - DNA, 201 bp, Homo sapiens
ctttgccttctgctgtgattgtaactttcctgaggcctccctagaagccaagcagatgccagcatcatgcttcctgtacagcttgtggacctgtgtgccarataaacctcttttctttataaatcacccagtgtctggtactaatttatagcaatgtgagaacaaactaatacaaagtctctctgcagcgtcccaagttgg

SEQ ID NO: 55182 - DNA, 201 bp, Homo sapiens
cctcctaacgcaggcctcccctgcagcccagggaagattagtgtgtgcccagcacagaaggctcctggaactgcagctctgaccccagagcagggaggccragggggtaaagtgtgcatgctcagacccttccccagcctaaacaagggagcatagggggaccccctgcagatacgaggagactatccttcccctgacgcc

SEQ ID NO: 55183 - DNA, 201 bp, Homo sapiens
tgccaaataaacctcttttctttataaatcacccagtgtctggtactaatttatagcaatgtgagaacaaactaatacaaagtctctctgcagcgtcccargttggtgcaggaattatatggcaaggggactcactgagagacaaacagccttttacaacagagtcacactgtattagtctgttttgcattgctataaaga

SEQ ID NO: 55184 - DNA, 201 bp, Homo sapiens
aacgcaggcctcccctgcagcccagggaagattagtgtgtgcccagcacagaaggctcctggaactgcagctctgaccccagagcagggaggccaaggggstaaagtgtgcatgctcagacccttccccagcctaaacaagggagcatagggggaccccctgcagatacgaggagactatccttcccctgacgccttctca

SEQ ID NO: 55185 - DNA, 201 bp, Homo sapiens
acaggaagcatggcagcttctgcttctaggagacctcaggaagcctccaatcatggcagaaggcaaagggggagtgagctgtctcacatggccagagcagkaggtagagaggggaaggtgccacacacttacaaacaaccagatctcaggacaactcactcagtatcaggagaacagcaccacaaaattgtggttaatcat

SEQ ID NO: 55186 - DNA, 201 bp, Homo sapiens
agacctagtctctatttccttatagggagagcataagcaagaagctttattatttttcagcagtaaccttagttgccccagcgccattactgaataatcayatttttatcatcgatagtgtcatcatcataacacatcagcaaggaagtttttccttcacagtggcacggtggctcactcctgtaatcccagcactttggg

SEQ ID NO: 55187 - DNA, 201 bp, Homo sapiens
cgcaggcctcccctgcagcccagggaagattagtgtgtgcccagcacagaaggctcctggaactgcagctctgaccccagagcagggaggccaagggggtraagtgtgcatgctcagacccttccccagcctaaacaagggagcatagggggaccccctgcagatacgaggagactatccttcccctgacgccttctcagg

SEQ ID NO: 55188 - DNA, 201 bp, Homo sapiens
cctcccctgcagcccagggaagattagtgtgtgcccagcacagaaggctcctggaactgcagctctgaccccagagcagggaggccaagggggtaaagtgygcatgctcagacccttccccagcctaaacaagggagcatagggggaccccctgcagatacgaggagactatccttcccctgacgccttctcagggacatt

SEQ ID NO: 55189 - DNA, 201 bp, Homo sapiens
gtgtgtgcccagcacagaaggctcctggaactgcagctctgaccccagagcagggaggccaagggggtaaagtgtgcatgctcagacccttccccagcctmaacaagggagcatagggggaccccctgcagatacgaggagactatccttcccctgacgccttctcagggacattgggcagggagagtggctcctctttca

SEQ ID NO: 55190 - DNA, 201 bp, Homo sapiens
caaggaaacaatcaagatgaatgaggggtcccacatcccatcatggtctggatgtagtgatctggtgagtttcagttctttgctactttttttgagatgcytgcaggtctttcctgaggaagtaactcagataaaacaaatgttaagtttccagtcgttaaggaccagaagggtcaatttctgtttatcaaaaaaaccttt

SEQ ID NO: 55191 - DNA, 201 bp, Homo sapiens
cctgtgtgtacccaggtgccccagagggatggtcaaggtcaaggattgtacgccctggagtgacatcgagtgtgtccacaaagaatcaggtacaaagcccrctggggaagccccagctgcagaggagacagggaccagcagcccgagactcctgtcttttcctgtcttttctcaggcaatggacataatatatgggtgatt

SEQ ID NO: 55192 - DNA, 201 bp, Homo sapiens
caacctcagaacaattctgagttgctcattttaagatcaataaggcatttttttagggtgtgtatgcctgagagaggaaatcagtgtgaatatcaaacttrcctctgaaacagcctaacacaatgctaatccgagaggaacaaggcaaggaaaccccctggtgaatgactcatctcaggaagaggcagggcagggtcagga

SEQ ID NO: 55193 - DNA, 201 bp, Homo sapiens
tacagtacttgcgtgtgccaagctctgttcttagcacttcatatgtaaatgaacacacttaatcctcatacaaccagactgtacaggaaccctcattgtcyttgttttagacaaacagcatgagactcagaacatttgttcagtagaggggctgggcaggaggatgagcaaccctcggggcagcagcagtgattgggtcac

SEQ ID NO: 55194 - DNA, 201 bp, Homo sapiens
gtgtgccaagctctgttcttagcacttcatatgtaaatgaacacacttaatcctcatacaaccagactgtacaggaaccctcattgtctttgttttagacmaacagcatgagactcagaacatttgttcagtagaggggctgggcaggaggatgagcaaccctcggggcagcagcagtgattgggtcactgggttctgctg

SEQ ID NO: 55195 - DNA, 201 bp, Homo sapiens
taggccttcgggcctgtgatgggaggggctgccatgatgacctctaacatgccctggagacattttccccattgtcttggggattaacactcagctcctcrttacttatgcaaatttatgcagccatctttaatttctcctcagaaaatgggttttcttttctagcacattgtcaggttgcagattttccaaactttaatg

SEQ ID NO: 55196 - DNA, 201 bp, Homo sapiens
aattttttgttgtacaggtttcatagtattcttttataatttttttatttctgtataatctgtagtaatgtgctctctctcatttctgattctaatacagwcatgcctcagttaatgatgggaactcattctgacaagtgcatcattgtgcaaacatcatagagtgtacctccacaaacctagatgatatagcctactgca

SEQ ID NO: 55197 - DNA, 201 bp, Homo sapiens
aaagagcaatataaacccagaataagtataagaaaggcaataatgagagaaaatctatagaatagaaaacagaaaaaccctgaaagtaataaagttaacayagacattatggctatttgaaaagaataataaatcattagcgaaactcatcaaagagagagagacaaaactaagttatcaaaataaaagagaggacatcac

SEQ ID NO: 55198 - DNA, 201 bp, Homo sapiens
agaagaaataatgctaatcttataagactctcaggaaactgagtttattttataaagccagaataatgagtatacccaaacttagaaagacattacagaawaagacaatgataaatcaatatctctcatgaatacagacacaaaaatatgcttaagaaagtattagcaaatcaaacctagcaatatgtaaaaaagataata

SEQ ID NO: 55199 - DNA, 201 bp, Homo sapiens
tggctgtgagctatgtgggaccagaggtttttcaccatctccatggtgacccaagggggaaagtgatgtgctgcaggtttccgggctggctgatggtcagrgtcagtactagactgcaggacccctgactcagaccaaggcattccccactgtgtgttacagggaccggcagaagctgaagggtctcagaggaggaggctg

SEQ ID NO: 55200 - DNA, 201 bp, Homo sapiens
agtgtgggtgggctctctgtggatgggaggtgggtgggcaatggagcaacaggtttgcccatgcagggggctctccaggttctctccttgggttctgggcytgatgtgggatcctctgccccttctgaactgagtcccaactcatctggctgtctctgtggctttctccacccagctctgatgctgttctttgacaagttt

SEQ ID NO: 55201 - DNA, 201 bp, Homo sapiens
caaaccaggaactttccggaatgacaattctgctgagatgtgccggaagtgcagcacagggtgagacaacagccaaggggctcccagcagcctcaaagaamccacagaagcaagaaccctaaaaagacccgagtctccttgtacccgtatctatcagccctgaccccatggtgcctccacccccataggtgtccctgagcc

SEQ ID NO: 55202 - DNA, 201 bp, Homo sapiens
tttgacccaggaattcaagttagatgcaacatttgaaagtcaatttgattaaacatttgaatagcataaaagagaaaaacaatataatcatctcaatagaygccaaaaaataacatttgatacgtttcaatgtgtcaaacgttattgtttattgttatatttcacattctattaatggtaaaaacagcaaagtagaaatga

SEQ ID NO: 55203 - DNA, 201 bp, Homo sapiens
atttgaaagtcaatttgattaaacatttgaatagcataaaagagaaaaacaatataatcatctcaatagatgccaaaaaataacatttgatacgtttcaawgtgtcaaacgttattgtttattgttatatttcacattctattaatggtaaaaacagcaaagtagaaatgaaagggaatttgatctggtaaagggcattgt

SEQ ID NO: 55204 - DNA, 201 bp, Homo sapiens
ttcaagcacattacgtttattgtgtactttatttctattcttatcacattataatatataatgaaataattatacaacttatcataatgtagagtcagtgrgagccctgagcttgttttcctgcaacgagatggtcctatctgagggtgatgggagacggtgacagataatcaggcataagattctcataaggagtatgca

SEQ ID NO: 55205 - DNA, 201 bp, Homo sapiens
acacagcaatgggaacatagccctttgggagagttgtgtccaccaggtacattctaagactgatctctaatcctttacacctctcttttccttaccctatrctatatacaaaaattatctcaaaattcatcaataacattccttttccatgttcttcaagttttctgtttcctacagtttctggttcttctattcaacaga

SEQ ID NO: 55206 - DNA, 201 bp, Homo sapiens
gacggtggagttgaggtgacatttcactggcatggagacctgaaaccaaaagcaggatgagccgggcacggtggctcacgcttgtaatcccagcactttgkaaggccgaagcgggcggatcacgagatcaggagctcgagaccagcctggccaaaacagtgaaacccccgtctctactaaaaatagaaaaaaaattagccg

SEQ ID NO: 55207 - DNA, 201 bp, Homo sapiens
cgccttcctggttcaagcgattctcctgcctcagcctcccgagtagctgggagtacaggctcctgccaccacgcccggctaattttttgtatttttagtasacacggggtttcactgtgttagccaaatccgcccgcctcggcctcccaaagtgctgggattacaggcgtgagccaccgcgcccggccctccatccttctt

SEQ ID NO: 55208 - DNA, 201 bp, Homo sapiens
gccttcctggttcaagcgattctcctgcctcagcctcccgagtagctgggagtacaggctcctgccaccacgcccggctaattttttgtatttttagtagwcacggggtttcactgtgttagccaaatccgcccgcctcggcctcccaaagtgctgggattacaggcgtgagccaccgcgcccggccctccatccttcttt

SEQ ID NO: 55209 - DNA, 201 bp, Homo sapiens
ttcaagcgattctcctgcctcagcctcccgagtagctgggagtacaggctcctgccaccacgcccggctaattttttgtatttttagtagacacggggttwcactgtgttagccaaatccgcccgcctcggcctcccaaagtgctgggattacaggcgtgagccaccgcgcccggccctccatccttcttttcttagacaa

SEQ ID NO: 55210 - DNA, 201 bp, Homo sapiens
accacgcccggctaattttttgtatttttagtagacacggggtttcactgtgttagccaaatccgcccgcctcggcctcccaaagtgctgggattacaggygtgagccaccgcgcccggccctccatccttcttttcttagacaaattggttaaacacgcagcccggcaggaaaaagtaactttctctcctctgctcgttg

SEQ ID NO: 55211 - DNA, 201 bp, Homo sapiens
cacgcccggctaattttttgtatttttagtagacacggggtttcactgtgttagccaaatccgcccgcctcggcctcccaaagtgctgggattacaggcgkgagccaccgcgcccggccctccatccttcttttcttagacaaattggttaaacacgcagcccggcaggaaaaagtaactttctctcctctgctcgttgtc

SEQ ID NO: 55212 - DNA, 201 bp, Homo sapiens
ggcttctgcagggctaaggtcctctgagcagctgcttctccacatctctgccatgcactcggccttggagctcctggtgttcctcagcagagtccacaggrctcttcggggtcccatccctgtgctgtagcctggaacctgtgacctgaggcggtgagctgaggccaccactgggctcacctcatgggcttggagggaaag

SEQ ID NO: 55213 - DNA, 201 bp, Homo sapiens
aaggtcctctgagcagctgcttctccacatctctgccatgcactcggccttggagctcctggtgttcctcagcagagtccacagggctcttcggggtcccmtccctgtgctgtagcctggaacctgtgacctgaggcggtgagctgaggccaccactgggctcacctcatgggcttggagggaaagtcactcacccaggaa

SEQ ID NO: 55214 - DNA, 201 bp, Homo sapiens
gagagaagtccctgcaccacgaccaggaacacagcatgtcagtgcaaaccaggaactttccggaatgacaattctgctgagatgtgccggaagtgcagcasagggtgagacaacagccaaggggctcccagcagcctcaaagaaaccacagaagcaagaaccctaaaaagacccgagtctccttgtacccgtatctatcag

SEQ ID NO: 55215 - DNA, 201 bp, Homo sapiens
ctccacatctctgccatgcactcggccttggagctcctggtgttcctcagcagagtccacagggctcttcggggtcccatccctgtgctgtagcctggaayctgtgacctgaggcggtgagctgaggccaccactgggctcacctcatgggcttggagggaaagtcactcacccaggaagtaggtgatgagcactttactc

SEQ ID NO: 55216 - DNA, 201 bp, Homo sapiens
tgcgatctaaatggtgctttttccctaatctgatgtaataaataatgaatcatggtccttttgtatgactccaagtgttggtgacagctgaagggtgggtrtcctgtgtgagcccgagtgtgctggtgcagaatctggccctcagaactccttggcaaactgagttgagctgagctgagggggagggagttggggtggtga

SEQ ID NO: 55217 - DNA, 201 bp, Homo sapiens
cccacagtctggtggaggaggtgtcactagggacctaaataactatcaggaagcaggggggccacctcccccaccccccacctccagagaggctgtgccgrctccagggatgccatccctccctacttgactccagcagttgcaaggccccaggtcatggtattggtggcttagaggatgtggtttcattaaaatcaacat

SEQ ID NO: 55218 - DNA, 201 bp, Homo sapiens
gtgaatattaagcaacatacttataaataactcatagttcacggatgaaatcaaagagaattcaaaatatttctttttttttttttttgaattggcttctygctctgtcgcctaggctggaatgcagtggcgtgatcccggttcactgcaacctctgcctcccgggttcaagtgattctcctgtctcagcctcccgagtag

SEQ ID NO: 55219 - DNA, 201 bp, Homo sapiens
agggtgttggagttagtaaaatgctttctctgtgtttttgagataatcatgtgacttttggttttcattctattgatataatttgttacatcaatttattytgggatgttgaaccaacctttcattcctaggataaaacttatttggtcctggtatataattcttttttgttttgttttgttttttgtttttgagatggag

SEQ ID NO: 55220 - DNA, 201 bp, Homo sapiens
ctataagaattatacaactcttgtaagaaaacagcaattttaccttggggtatatatccaaaagaattgaaagaaagggcataaagagattttgtacaccygtgttcatagcagctttattcacaatagctaaaatgtgaacacaaaccaagtgcccattgacagatgaatggataaacgtaatacatatacacacaatgg

SEQ ID NO: 55221 - DNA, 201 bp, Homo sapiens
taacttaaaaatcttatattaacctaagttaaatgatggttatttgtattagtctgttttctgttgctatcactgaatacctcagagtagggagtgggtamtttataaagaaaataaatttatgtattatggttcttggggctaggaagtccaagggcagtcaacaggccaaatctagggagggccttcttgctaatgggc

SEQ ID NO: 55222 - DNA, 201 bp, Homo sapiens
aaggcaacaaatgagttattattattattactattattattattttgagacagggtcttgctctgtagcccaggttggagtgcaatggtgtgatcacggcwcactgcagcctccacctcccagggctcaggtgattctcccacattagcctcccgagtagctgggactacaagcatgtgccaccatgccagctaatttttg

SEQ ID NO: 55223 - DNA, 201 bp, Homo sapiens
atatatttaaaggaaagaattacatcatatataaagtatatctcagtaaagttcttaaggattaaaagaagaatggtatcaaaatcaatgactcagaggtstgcattacttacccgtaaaataagtataaattaaactcaaaggtagtaacaacatgacaaggaaataataagactgaaatcaatgaaatagaattcaaac

SEQ ID NO: 55224 - DNA, 201 bp, Homo sapiens
taaaataagtataaattaaactcaaaggtagtaacaacatgacaaggaaataataagactgaaatcaatgaaatagaattcaaacaataaaaggaatcaayaagctaagagttggttctcagaaatgatcaacaaaattaataaaagtaataaactggccggacgagatggctcatccctgtaatcccagcactttgggag

SEQ ID NO: 55225 - DNA, 201 bp, Homo sapiens
tcagaaatgatcaacaaaattaataaaagtaataaactggccggacgagatggctcatccctgtaatcccagcactttgggaggccgaggcaggcgattcmccttaggtctggagtttgagaccagccggaccaacatggaggaaccccatctctactaaaaatacaaaattagccaggcgtggtggcacatgcctgtaat

SEQ ID NO: 55226 - DNA, 201 bp, Homo sapiens
aaatgatcaacaaaattaataaaagtaataaactggccggacgagatggctcatccctgtaatcccagcactttgggaggccgaggcaggcgattcacctkaggtctggagtttgagaccagccggaccaacatggaggaaccccatctctactaaaaatacaaaattagccaggcgtggtggcacatgcctgtaatccca

SEQ ID NO: 55227 - DNA, 201 bp, Homo sapiens
tcaccttaggtctggagtttgagaccagccggaccaacatggaggaaccccatctctactaaaaatacaaaattagccaggcgtggtggcacatgcctgtwatcccagctactccggaggctgaggcaggagaatcgcttgaacccaggagaccgaggttgcagtgagccgagatcacgccactgcactccagcctgggca

SEQ ID NO: 55228 - DNA, 201 bp, Homo sapiens
aatttatgtattatggttcttggggctaggaagtccaagggcagtcaacaggccaaatctagggagggccttcttgctaatgggctctgatatggtttggrtctgtggccccaccaaagtctcatgttgaattgtagtccccagtgttggaggtggggcctggtggaggtgattggattatgagggcagatttctcataaa

SEQ ID NO: 55229 - DNA, 201 bp, Homo sapiens
gacaggcacactaaaatctcagaactcaccactaaagaacttatccatgtaacaacaacaacaacaaaaagcagctgtaccctcaaacctatggaaattaraaaaatgtttcaaaagaaaatatcttgagacaaatgaaaacaatataccataagttacaggatatgaaagcagtgttataatggaaaatgatagctgtaa

SEQ ID NO: 55230 - DNA, 201 bp, Homo sapiens
ttttggaggcttgggggaatggaatgtgagattgatcttgtaatgggtgagatctggaagccactcatgccagtccctgctttgtccccacaggtcgtacstagctcagctgcaaccatcaaacttcatgatcaatcaattggcacacagcaatgggaacatagccctttgggagagttgtgtccaccaggtacattctaa

SEQ ID NO: 55231 - DNA, 201 bp, Homo sapiens
gtggcgcgatctcggctcactgcaagctctgcctcccgggttcacaccattctcctgcctcagccttccaagtagcagggactacaggcgcctgccaccamgcccagctaattttttgtattttttagtagagacggggtttcaccgtgttaaccaggatggtctagatctcctgaccttgtgatctgcctgcctcagcct

SEQ ID NO: 55232 - DNA, 201 bp, Homo sapiens
agatctcctgaccttgtgatctgcctgcctcagccttccaaagtgctgggattacagtcgtgagccaccgtgcccagcctataattctttttgtatgcttktggattcaacttgctagtattttgttgcaaatttttgcaacaatattcataagaatcgttagtctgtagttttctttctttatgaggtccttttctggtc

SEQ ID NO: 55233 - DNA, 201 bp, Homo sapiens
tgtgaacccaaattttaggtaaagcagtttccatggcagtttgatttttaaaggccaaacctctgcagactccaaacagcatcgcagagaacaccacctaraaccaactaatcaggcccaatgctgcttagaacagcaacataaaagcctggatacaggaactccatcctactttctcattcagcagcaaacttcagtttc

SEQ ID NO: 55234 - DNA, 201 bp, Homo sapiens
gaacagcaacataaaagcctggatacaggaactccatcctactttctcattcagcagcaaacttcagtttccaagcaatattggagccaaacagtattacraaagaataccaagtttactgaattccaatttcccatgactctagcaaacacatagaaataatcaccaaaacataatacaactgctgcagcaacaaacaag

SEQ ID NO: 55235 - DNA, 201 bp, Homo sapiens
gaaactatgctttgcagtgtggttttcattgcaagtattttctcctactttgttttcatcttagtcaagatttcttccatgcagttttcttcctaattttyatatagttaactttatgcaactttttagtttctcgtgagactgagaaggtcctttctctctccaaacttgtaagaaaaatttctcatgcagtacttgtgt

SEQ ID NO: 55236 - DNA, 201 bp, Homo sapiens
attttctcctactttgttttcatcttagtcaagatttcttccatgcagttttcttcctaattttcatatagttaactttatgcaactttttagtttctcgwgagactgagaaggtcctttctctctccaaacttgtaagaaaaatttctcatgcagtacttgtgtgatttcatactttacagttgacaccttgatagacct

SEQ ID NO: 55237 - DNA, 201 bp, Homo sapiens
acaaccagactgtacaggaaccctcattgtctttgttttagacaaacagcatgagactcagaacatttgttcagtagaggggctgggcaggaggatgagcraccctcggggcagcagcagtgattgggtcactgggttctgctgacctttcccaggggagtatttggtgctttttcatgaggcctgcattcacccagcgct

SEQ ID NO: 55238 - DNA, 201 bp, Homo sapiens
tttctcttacccactcctcagccccaaggtcgccctgggagttcttcgcaggcaggaccgtgactcgcgtggctttcgggaggctgattacccacgccccrtgcccgtgcagcgctgggtgcagaggaaccgctggaaggacctgtcccccgtgggacccccaccaagtctcatcccgtgtcatgtgccagatagtctccc

SEQ ID NO: 55239 - DNA, 201 bp, Homo sapiens
agtagtttgtgtctttctaggaatttgcccctttcatccaaggtacctaattttttgttgtacaggtttcatagtattcttttataatttttttatttctrtataatctgtagtaatgtgctctctctcatttctgattctaatacagtcatgcctcagttaatgatgggaactcattctgacaagtgcatcattgtgcaa

SEQ ID NO: 55240 - DNA, 201 bp, Homo sapiens
tactcgggaggctgaggctgaggcaggataatcgcttgaacctgagaggcagaggttgtagtgagctgagattgcgccactgcactccagcctgggtgacrgagtgtgactccttctcaaaaaaaaaaaaaaaaagaaacacagacattaacctaggtctacacaaggacaggttcatcaacatcactgtctttcacctcc

SEQ ID NO: 55241 - DNA, 201 bp, Homo sapiens
cagctttccatcaagagtcccccccctccctccctgtgtgtacccaggtgccccagagggatggtcaaggtcaaggattgtacgccctggagtgacatcgmgtgtgtccacaaagaatcaggtacaaagcccactggggaagccccagctgcagaggagacagggaccagcagcccgagactcctgtcttttcctgtcttt

SEQ ID NO: 55242 - DNA, 201 bp, Homo sapiens
atttaatcttacttatcaaaagcttgactcaaagatcattttgttttggttgggcttgtagtcttaagtttttgtgccaaactgatatctcaaaatatctrgcaaagacaaatataagcccagacaaaaatgtatgctgacaattctgaagacacttctgttttcttattttaccaataattttaaagctgacttgtttag

SEQ ID NO: 55243 - DNA, 201 bp, Homo sapiens
aaagaagagtttcctagccaccgccacgatcctctgggaactctgtggcaattcattcattggcttttctctcccttcccaggatctcatagatcagaacrtcctggagcctgtaaccggtgcacagagggtgtgggttacaccaatgcttccaacaatttgtttgcttgcctcccatgtacagcttgtaaatcaggtaca

SEQ ID NO: 55244 - DNA, 201 bp, Homo sapiens
ctggatctttctggctgcttcatggttgaggaggggcatcatgggaagcttcacataccatgggtgacctcatggccacccaggaatcaaaggttaatttmatactaaaagattgtgtttcttctgaaacacaatctctctctctcggccccacttccaccaaagacaaattatagcaggaccaatgtacctgcaaaataa

SEQ ID NO: 55245 - DNA, 201 bp, Homo sapiens
ctcagataaaacaaatgtaagatttgagctttaagaacagaagggtcaatttctatgtttatcaaaacaacaacaacaacaaaaaaaccttttgatggacmtattgggttgatttcagttctccctttctatttatcaatcccacagtcacagagagtctggtcctggatctttctggctgcttcatggttgaggaggggc

SEQ ID NO: 55246 - DNA, 201 bp, Homo sapiens; identical to SEQ ID NO: 10444

SEQ ID NO: 55247 - DNA, 201 bp, Homo sapiens
tgtgtttttttatgttatgtgatgtttgtgtatttttgatatttttataagatgtctacctccttttttttttttttgagacagagtctcttgtcacccakactggagtgcagtggcaacgatctccactcactgcaagctccgcctcctgggttcacaccattctcctgcctcagcctcctgagtaactgggactacagg

SEQ ID NO: 55248 - DNA, 201 bp, Homo sapiens
aggcggaggttgcagtgacctgagatggggccattgctctccagcctggacgacagggcaacaccccatctcaaaaaaaaaaaaaaaagcaatacagaagkttacatgaatgtaaaaaaccttttagatctcagtctttctaaacaattaaaaacctaataaaggcaacaaatgagttattattattattactattattat

SEQ ID NO: 55249 - DNA, 201 bp, Homo sapiens
gtcttgctctgtagcccaggttggagtgcaatggtgtgatcacggctcactgcagcctccacctcccagggctcaggtgattctcccacattagcctcccragtagctgggactacaagcatgtgccaccatgccagctaatttttgttttttattttatttatttatttatttattttgagacagagtcttgctctgtca

SEQ ID NO: 55250 - DNA, 201 bp, Homo sapiens
aggaagaggcagggcagggtcaggagagtctatggaggagaagacctggaacaagacctctctctcttgctctctttctctctctccctctctctctctcwcacacacaaacacacacacaacctcacacccccatgagcccaaatctgtgaactgagaacctcacttctctgacctcaccttccatctcccttaatcaga

SEQ ID NO: 55251 - DNA, 201 bp, Homo sapiens
aagagatcaatagatatcattccatctgaagtgcaagggaaaatgaaactgaaagaaaacaaggaagcgagtctccgtgacacgtggtacaatatcatgcrgtacacacggaaccagaaccaagaagaaatggctggaaaagatgaaagaaaaaaaaagttgatatagtctaaaatgtagtgaaaaaacatcaacttatag

SEQ ID NO: 55252 - DNA, 201 bp, Homo sapiens; identical to SEQ ID NO: 10446

SEQ ID NO: 55253 - DNA, 201 bp, Homo sapiens
ctgagttggctctttgccttcctaaggtgtgtttctggcgcttgggtctcctacgagggcctggggctgaggacaatgctcacaacgagattctgagcaaygcagactcgctgtccactttcgtctctgagcagcaaatggaaagccaggagccggcagatttgacaggtgtcactgtacagtccccaggggaggcacagt

SEQ ID NO: 55254 - DNA, 201 bp, Homo sapiens
ggccccaccagctacattacggttcagatttcaacgtgagccctggcagggacaaaggacccgtagcagacaccaaggccttctgccatcccacaggaccytctcatcccaccatccctcagccttcttcctgtgcatttataggcaccttaacttttaaaattctgactgaagaacaaatcgcattggatgttttctatc

SEQ ID NO: 55255 - DNA, 201 bp, Homo sapiens
ggtggctcacgcttgtaatcccagcactttggaaggccgaagcgggcggatcacgagatcaggagctcgagaccagcctggccaaaacagtgaaacccccktctctactaaaaatagaaaaaaaattagccggacgtggtggcgggcacctgtaatcccagttactcaggaggctgaggcaggaaaatcgcttgaacctgg

SEQ ID NO: 55256 - DNA, 201 bp, Homo sapiens; identical to SEQ ID NO: 10440

SEQ ID NO: 55257 - DNA, 201 bp, Homo sapiens
gaaggaagttcagggttagccaacaggagccgcaggtgccccgaaaagggggcggggtcaggggtgccctgaactccgaatgcgaagttctgtcttgtcayagccaagcacgctgcttcttggattgacctggcaggatggcgccaccaccagctagagtacatctaggtgcgttcctggcagtgactccgaatcccggga

SEQ ID NO: 55258 - DNA, 201 bp, Homo sapiens
agcaaccctcggggcagcagcagtgattgggtcactgggttctgctgacctttcccaggggagtatttggtgctttttcatgaggcctgcattcacccagygctgggtcactgctgggggtccctgagaagtcatgtaaagccacctcttatttccagaatgatagacatgtttagagaagaagtggcttcccccagacca

SEQ ID NO: 55259 - DNA, 201 bp, Homo sapiens
ggatcacgagatcaggagctcgagaccagcctggccaaaacagtgaaacccccgtctctactaaaaatagaaaaaaaattagccggacgtggtggcgggcmcctgtaatcccagttactcaggaggctgaggcaggaaaatcgcttgaacctgggaggcggaggttgcagtgagccgagatcgtgccactgcactccagcc

SEQ ID NO: 55260 - DNA, 201 bp, Homo sapiens
ccttaatcagacgcccacaaacctcagagttgtgtcccagcatcacttgttttgactgccctccccgactgccttgacttcgtatctgcctaggaacctgsctgtgtggacttttccctctatgtggacctttccctctatgtctaccggtgtccctgccaccagtggcatttgtcacctctgcctgggcagcccctcgtg

SEQ ID NO: 55261 - DNA, 201 bp, Homo sapiens
tctccgtgacacgtggtacaatatcatgcggtacacacggaaccagaaccaagaagaaatggctggaaaagatgaaagaaaaaaaaagttgatatagtctmaaatgtagtgaaaaaacatcaacttatagattcaaaaagttcataaacccctcataaaaataaatgtaaagaaaaccctacctggacacatcatagtcat

SEQ ID NO: 55262 - DNA, 201 bp, Homo sapiens
ggctgagcactgtccaggtccagagtcaccaggagctcgttgtcaggttttcacttgctattagtagagatttttttttaaggtactatttttagtgttaraagtgaattcaggccgggcgcagtggctcacccctgtaatcccagcacttcgggaggctgaggtgggcagatcacgaggtcaaggagatcgagaccatcc

SEQ ID NO: 55263 - DNA, 201 bp, Homo sapiens
aacttccactggtggtgaaggggaaggacagctggattctgcccatcaggggaaggggtggggaggatggcaggaggagggggatgagatccggaagggasacggggaggggccaggttcattctaacaaccaggtgtcatggggaactaagattgacaactcctgggggaatgtgggagggggcggttatggcaccaagc

SEQ ID NO: 55264 - DNA, 201 bp, Homo sapiens
ggtcatttcctgaaaaaggaactcagataaaacaaatgtaagatttgagctttaagaacagaagggtcaatttctatgtttatcaaaacaacaacaacaamaaaaaaaccttttgatggacatattgggttgatttcagttctccctttctatttatcaatcccacagtcacagagagtctggtcctggatctttctggct

SEQ ID NO: 55265 - DNA, 201 bp, Homo sapiens
gatctcaatgaaattaaagtgttaagcaataacaatatctagaaggactccaaaaatgtgaatattaagcaacatacttataaataactcatagttcacgratgaaatcaaagagaattcaaaatatttctttttttttttttttgaattggcttcttgctctgtcgcctaggctggaatgcagtggcgtgatcccggttc

SEQ ID NO: 55266 - DNA, 201 bp, Homo sapiens
gggtgttggagttagtaaaatgctttctctgtgtttttgagataatcatgtgacttttggttttcattctattgatataatttgttacatcaatttattckgggatgttgaaccaacctttcattcctaggataaaacttatttggtcctggtatataattcttttttgttttgttttgttttttgtttttgagatggagt

SEQ ID NO: 55267 - DNA, 201 bp, Homo sapiens
agcaagtcacatcttacttggatggcagcaagcaaagagcttgtacaggaaaactccaccttataataaccatcagatatcatgagacttactcactatartgagaacagcatgggaaagacctgcccctgtgattcagatatctcccaccaggtccctcccacaacatgtgggaattcaacatgaaatttgagtgagaat

SEQ ID NO: 55268 - DNA, 201 bp, Homo sapiens
gggcagctccgcccctgtggcattgcaaggtatagcgcccctcctggctggtttcacgtgccggtgttgagtgtctgcagcttttctaggtgcacggtgtwtaagttatcagcagttctaccattctggggtctgaaggacaatggccctcttttcacagctccactaggcagtgccccagtagggactccgtgtgggggc

SEQ ID NO: 55269 - DNA, 201 bp, Homo sapiens
tagtcccagctactcaggaggctgaggcaggagaatggtgtgaacccaggaggcggacttgcagtgagccgagatcatgccactgcactccagcctgggcracagagcgagactctgtctcaaaaacaaaaaacaaaacaaaacaaaaaaagaattatataccaggaccaagtaagttttatcctaggaatgcaacattgg

SEQ ID NO: 55270 - DNA, 201 bp, Homo sapiens
gctactcaggaggctgaggcaggagaatggtgtgaacccaggaggcggacttgcagtgagccgagatcatgccactgcactccagcctgggcgacagagcragactctgtctcaaaaacaaaaaacaaaacaaaacaaaaaaagaattatataccaggaccaagtaagttttatcctaggaatgcaacattggttaaaaac

SEQ ID NO: 55271 - DNA, 201 bp, Homo sapiens
tgcctcccgggttcaagcgattctcctgcctcagtctcccgagtggctgggattacaggcatccgccaccacgccccgctaattttgtatttttagtagakgctgcgtttctccatgtcggtcaggctggtctcgaactcctgacctcaggtgatccgcccgcctcggcctcccaaagtgctgggattacaggcgtgagcc

SEQ ID NO: 55272 - DNA, 201 bp, Homo sapiens
atagaaaaggcccaataaaaatatggtataaaaggttaaaaaagatgatgtagttgtctagggcacttaccatgaatggagcttgcaggactggatcttgyctgggtgagtcagtgagtggtgagtgaatgtgaaggcctgggacattcctgtacactactatggactttataaacactgtacatttaggctacaccaaat

SEQ ID NO: 55273 - DNA, 201 bp, Homo sapiens
gggctccacaaatgtgcagaaataccctaagaaagtaaaccctagatccaatgattcactggtcagaatgtcttttttagcaatagtcattgaaatgataygaaatttcttcagaatgatcaaccaatatttattgagcatcttctcagtagtaagcccttaacattctttcagatttcctaaattttgaaggggcttgtt

SEQ ID NO: 55274 - DNA, 201 bp, Homo sapiens
ttgtgggttcctcatactggagtgagccttggcaaaaatggtgtgtgtgtgtgtgtgtgtgtgtgagagagagagagagagagagagagagaggagacagragagaaggagaagaggggagaggggaggagggacagagagagagagaggtctcctacagagagcttggagctcaggctgctttgctcatttgagtgtaat

SEQ ID NO: 55275 - DNA, 201 bp, Homo sapiens
ctctgttgttattctccatttgttcattatatctatcttttctttgaaatccttgaaaatatttataatagctattttaaagtcctctgctaatcccgatrtctgggacatcttggcttctgttgatattgaatacttctttttttccccttaattaagggtttccttttcctgctttttcacatatctagtagattttta

SEQ ID NO: 55276 - DNA, 201 bp, Homo sapiens
ctgttacagatcctcagacaatgcttccttgaagaagacttgcctgtctaaactgccttcccatcccaatccctgttaccttctatcctttctctgctttrttttcatttgttatctctcttcttcccaagaatgtaagctccataagaacaggatcatattttgaatcccctagaaaagtgcctagtgtaatatttgttg

SEQ ID NO: 55277 - DNA, 201 bp, Homo sapiens
aacaggtgcctttctccgacgtccgcgggcgacgcctgccgcaccttgcccgctgccgcgcccctcccgggcacccctcgccctcggcgcccctgcccccrcccccagtgccagggcggaggcagtcccggctcgcaggtaattattgccagcggagcccgccggggagcgggggtgggcgcgccggcggtgggcgggcgg

SEQ ID NO: 55278 - DNA, 201 bp, Homo sapiens
gctcgggtacctggtggcgcacaacctcctcctggtgagtgcgaggggccaggcggagggccacgcaggggagacagagggcctccacaggggccaggggkaagtgtgggaactgagtctcccccagacgaggcttcacttggacacgtgtatgtggtcaccgggggaaactgagcagttctgacttcccttggaaggcgt

SEQ ID NO: 55279 - DNA, 201 bp, Homo sapiens
ccttgacctcccaggcttaggtgatcctcatacctcagcctcccgagcaactaggactacaggcccgtgccaccatgccgggccaagacggggtttggacrtgttgccccagctggtctccaactcctggcctcaagtgaccctcccgcctcggcctctcaaagtgctgggattataggcatgagccaccgcacctggcca

SEQ ID NO: 55280 - DNA, 201 bp, Homo sapiens
tttagcaatagtcattgaaatgatatgaaatttcttcagaatgatcaaccaatatttattgagcatcttctcagtagtaagcccttaacattctttcagayttcctaaattttgaaggggcttgttttccagcatttgactggatactctagtaagcacttattggatgtctagtgtgtccgaagccttgtgttagttgct

SEQ ID NO: 55281 - DNA, 201 bp, Homo sapiens
actgtggggtgacctacctttgaaataatgtattggttctagctgatttttatattgttagtcattaagttaggcttgatgagaaacagatataatctgakttggggattcaagtattatattgcatttctcctcacaactagagataaatttgccatggtttttctcttcataggctcatgccaaagtctggcatctcta

SEQ ID NO: 55282 - DNA, 201 bp, Homo sapiens
tcctgccccaaatcacaaaggtggagcctagaccttctcagtctccaccaactgtatttcggttagccacaatcctatctacccacatccaaatggacacygtggctctgcaacttctgtcaaaagggctctttggcaacaggaaaaacgtcatggctccattgtattgtagaggatgggaatgggtgttccggctaaatt

SEQ ID NO: 55283 - DNA, 201 bp, Homo sapiens
agcagtaagtgaggctcacaccggtcatagttagaggagtagggaatctaaacctaagtctcttctactccaaaccccaagttttatcagtatgtcacatygctactgtgggctgaattccttagcaggggttgtttcctccacctgcaatattcttccttttggtttgttcatcctctagagagagaagggatacgcatt

SEQ ID NO: 55284 - DNA, 201 bp, Homo sapiens
agaagtgagaacatgcagtgttcggttttctgtgaaacagaccttttaggtgcagatgactacaatttaaaatttttaaaacagacttcaaagtctaaatkaccatactttttaaaattggaaataactttaatataaaaaatcatgaaaaaaagtcaaaattatctgctttttttttcttatttttaacatgttggaaga

SEQ ID NO: 55285 - DNA, 201 bp, Homo sapiens
atgagattgaaccaacttttatcccaaattggtaccatgttaaatgtccttattttacctgtgcctgttatgggcctaacaatccaccaaaacaaacacartgtggggttactacgaccatcatgttgacaggatgagctgcaagattccagcagtgttggcaacatggctgcactggttcactcagacagagaggaagga

SEQ ID NO: 55286 - DNA, 201 bp, Homo sapiens
gatttcttagagacggtgccatgcctgggatgaccaccaagttaggatgctgtaaagagtaatcaaataagtttcaacagggttttggcatgaggtgagcmgttaatccaaatgatatctgaaatgctttctaatgctgcaagtgtattcctctgtaaaataatcaactacttaaaagacactctcacttgcattatgtca

SEQ ID NO: 55287 - DNA, 201 bp, Homo sapiens
tggaatagactgacctttttttctgtttaaaatctcaattgatcagtttataaaattcaatttcctttcgatattataccagttgttgtctaattatggcygtgaccataaattttgcctaagacatttcagttggttttccatgtgaatcaaagctttggataatttatatccaacatgttagatggcaaattcaatagt

SEQ ID NO: 55288 - DNA, 201 bp, Homo sapiens
tttcaatgtttggctattaaaaatagtatttagatgaatgttcttggccatacagttaatgacttcactgagtccttgtcaataactttattaaatcccawtcttaagacaacaagcctataagattaacataccaggaataattagaaagcattgcaagactatatgtaaccatctccctgttaatcatccttagttgtt

SEQ ID NO: 55289 - DNA, 201 bp, Homo sapiens
tacatggtaaacatatttgaatattagacatttcaattgttttcaatgtttggctattaaaaatagtatttagatgaatgttcttggccatacagttaatracttcactgagtccttgtcaataactttattaaatcccattcttaagacaacaagcctataagattaacataccaggaataattagaaagcattgcaaga

SEQ ID NO: 55290 - DNA, 201 bp, Homo sapiens
taaggtcttggatagaggaccatcatagaaacacatagaacagacatttagtccatgctagggagagggaagatgtcaaggaatgcttcctggaggtggcracatctaagctgagttttaaagtgggtgtaagagtgaaggaactgggaataggtaaaacataccttagagagctgcacctccaaagcatggaaggctaga

SEQ ID NO: 55291 - DNA, 201 bp, Homo sapiens
aatgatatacagaaaaggtcagttaccactttcttttatgattgcattaatttgcttcttttctctttttttctctagtcagtcttgctaaaggttggtckgttttgttgatttttttcaaagaaccaacttttgattttgttgattctataatttttctgctctgtattttgtgtatatccattctaatttttattagtt

SEQ ID NO: 55292 - DNA, 201 bp, Homo sapiens
taacaagttacaaagaaatagggttatgaataaaccttgtgggatattgttagtcaccttctctcaagtcgatctgtcccatgaatcaatgtttcaaacaytgaccagcatttgatacttaataagcaacgagtaagtttttgttgaaccaatgaatactcttaaaatatattttttcaagtggcaacagtactatcttat

SEQ ID NO: 55293 - DNA, 201 bp, Homo sapiens
tattttttgaagagcttgaaaagagtcgtgttaattcttctttaaatatttggtacaattcactattaaagccactagtcctgggcttttcttagtttgawagtttttgattactaattcaatctcttttacacctagattagattttgtattttttccttagccacttttggtaatgtgtgtgcttccgggaatttggcc

SEQ ID NO: 55294 - DNA, 201 bp, Homo sapiens
ccaagctgctgcctgttcacacatattcgtctaactgggtgtcagggaaagcagatatgagcccccttgcattggttaaatcctgagcaacttttaaggawctgcacacagagactactggctattttttgtggataaagttgtagatagttatttttgggaaattatttatgtgttctattaggtggttgttttgtggga

SEQ ID NO: 55295 - DNA, 201 bp, Homo sapiens
gcagtaagtgaggctcacaccggtcatagttagaggagtagggaatctaaacctaagtctcttctactccaaaccccaagttttatcagtatgtcacatcrctactgtgggctgaattccttagcaggggttgtttcctccacctgcaatattcttccttttggtttgttcatcctctagagagagaagggatacgcattc

SEQ ID NO: 55296 - DNA, 201 bp, Homo sapiens
agtcccagctactctggaggctggggcaggagaatggcatgaacccaggaggcggagcttgcagtgagccgagattgcgccactgcactccagcctgggtracagagcaagagtccgtctcttaaaaaaaaaaatgactggatgtgtcatcttttatgccaggatatgtgagcccaggagaaaggcttctgagctccctcc

SEQ ID NO: 55297 - DNA, 201 bp, Homo sapiens
tctgacctaaggtcagccactaattggccccagaggtctctctctcagatcacacggtccttttttcctcatcagcttggggaccccacccctcctcctgrcagtctcctcctgtgcagaacccaacaaacacaaaattaagtcactctcaaacccacagcagatgagagcttctctggaagctccctggtggggaaaggc

SEQ ID NO: 55298 - DNA, 201 bp, Homo sapiens
gtcaggctggtctcaaactcctgatctcatgatctgcccgccttggccccgcaaagtgccgggattacaggcgtgagccactgcgcctggcctctctctcrgactttctaccatcagtcagattgaatttgttaaattctgtcactgaccctaaacccaacaaaaggcaagagttatgtttatttagcacttcctctacct

SEQ ID NO: 55299 - DNA, 201 bp, Homo sapiens; identical to SEQ ID NO: 10464

SEQ ID NO: 55300 - DNA, 201 bp, Homo sapiens
ttgctttgaattacttcctcaggactgcccaggtgacgctaatgtttactctgcccttcacaggtagataccactctgtctcagtttaccgacctgaatgyttacctgtgggatgtccaccacagtaaaaggcttattaaagtggatggggttgtgaccaagaagaggaaatcctactgtgttgactttgctgccatccag

SEQ ID NO: 55301 - DNA, 201 bp, Homo sapiens; identical to SEQ ID NO: 10449

SEQ ID NO: 55302 - DNA, 201 bp, Homo sapiens
ggagggctcagggctctgtctagattcactccaggccattgctttgaatactgctgcatcccgatgactggagattttgagtctccacccaggtttccccragcatcagactggcatagacaaccgccttctccacgtggatgtctaatgggcatgtcacattgaacacatacatcccaaaccaaacccctgcttcccctt

SEQ ID NO: 55303 - DNA, 201 bp, Homo sapiens
taccgccatagccacagaaccaacccttcactttccttaagtctatggtcacaagctccttctcaaaggaggcacacctctaaccacccccatttggtgayttcctgtctcctggaggcccccggaactagtcttctctacttccagcaacccactttacgagcagcggagaagactgactacttctgggggcctcgagga

SEQ ID NO: 55304 - DNA, 201 bp, Homo sapiens
agggatattgatctgtaactattattttcttgtggtggctttatctggctttggtatcaagataatgctggccacattggctaagttagaaagtgttcttycttctattttttgaagagcttgaaaagagtcgtgttaattcttctttaaatatttggtacaattcactattaaagccactagtcctgggcttttcttagt

SEQ ID NO: 55305 - DNA, 201 bp, Homo sapiens
ttgtacagagcagtaagtgaggctcacaccggtcatagttagaggagtagggaatctaaacctaagtctcttctactccaaaccccaagttttatcagtaygtcacatcgctactgtgggctgaattccttagcaggggttgtttcctccacctgcaatattcttccttttggtttgttcatcctctagagagagaaggga

SEQ ID NO: 55306 - DNA, 201 bp, Homo sapiens
caaacaactctatagcaagaaagcaaataacccaattaaagaatgggcaaaggatctgagtagacatttctcaaaaggagacatacaaatggtcaaatctrtgaaaaaatgctcaacatcactaatcatcaggcaaatgcatattaaaaccacaatgagatatcacctcaccctagttacaatagttgttataaaaaaaga

SEQ ID NO: 55307 - DNA, 201 bp, Homo sapiens
catagtagttacttaataaatatttgagtgaaaggataaatgaatgaataattccacattattggatgttcaagttgtttccattcaactttattgttgtrggggagtataatacaatcttggtgaagagccaccaacttaggaagaactatgaagaagcatgttatttactcctgcttgtgggtggggtgcattgggaaa

SEQ ID NO: 55308 - DNA, 201 bp, Homo sapiens
ttgaccctaagaatgtcacaaaaatgtttagcaactgtcaagattattacatacagagatgactattgtgttctcagatatgctgtatgtcttagttcatyttgtacagctataagagtagctgagactaggttatttatttatttatttatttattttttgagacggagtcttgctgtgttgcccaggctggagtgcagt

SEQ ID NO: 55309 - DNA, 201 bp, Homo sapiens
tctttttgaccctaagaatgtcacaaaaatgtttagcaactgtcaagattattacatacagagatgactattgtgttctcagatatgctgtatgtcttagytcatcttgtacagctataagagtagctgagactaggttatttatttatttatttatttattttttgagacggagtcttgctgtgttgcccaggctggagt

SEQ ID NO: 55310 - DNA, 201 bp, Homo sapiens
gcttttatcatcccagagagtctcttcccatgtcagcaactccagattcacttcctctcctaatataggacagtcacatgtctctattccagcaaaacaayctcagggaaggtatctcattggcctggcttgggtcattcaacttgaagtacaagaagagaaaacagtattcttttatttttatagatttcctgtaaaatc

SEQ ID NO: 55311 - DNA, 201 bp, Homo sapiens
ttgctttccagaaagtgaatgagctggttccccaacccctcttgtgttagtttgagtcctgaaagaagtaaatgtcaagataggattagatgtacaagaamtttattggggaaagaattgtgaaggataaaggggaaggagctaggggaggcattgaacctttggatcatgatgtgtgtccaacaactatgaaggagagtg

SEQ ID NO: 55312 - DNA, 201 bp, Homo sapiens
ttcctcatctttgaaatgggagtgtctatcttagcacagtgctgaacataggaaatattcaataccttgggtatctaccccagacgttatttttttcctaractcatacaacttacccttaatgtgcatgtgatttcttgttaatcagatattttgagctcaataatgtaaaactagggactattacagtcaaaatgattc

SEQ ID NO: 55313 - DNA, 201 bp, Homo sapiens
tagcagcaactttaccgcgtctcctggggtccttgctggatcgtgaaaacatacttccggagaaagtgttccctagataatgaattatttcttgtcctgtrttaagttccagttccttggtcaaggaccccagcgctactcctcaggatttgcagtgcatgctcaatcttgaagcaatgttgggatatagtatcttttctt

SEQ ID NO: 55314 - DNA, 201 bp, Homo sapiens
tcagatttttgtaaaatgcttttcctgtgttaattgagataatcatatgggttttctccccctttactctattgatgtaatgcattacaacgatttttttwaatgtttacccatctttgcattcctggaataaatactagttgattgtgctgtataattcttaaaatatgctgctggatttgttttgttagtatttggttg

SEQ ID NO: 55315 - DNA, 201 bp, Homo sapiens
caattctccaaattgggggcggtctatttcacagcaataggtaactgacgtaaaaggaaaggaaacaatgaagtaattccagaaaatttcctatagctggwggacatgcattttcatattgaatgggaagaatggggtgggggggtcatacctctgtgttattgcagggtcctggctcctagggacctaggcacctcttca

SEQ ID NO: 55316 - DNA, 201 bp, Homo sapiens
gaagaatgggccacctctgtaagctccaaatattcccaggtttccccaaccggggccttgaccttggcataactgatctgccttggctgagcatttaaacmtccctaaatctctgcaagtctatcaggtcctaggcctgctgctaagtttctctactcttccactgtaggagagaaggctgtggctcttatattgagcctt

SEQ ID NO: 55317 - DNA, 201 bp, Homo sapiens
cctcccgagtacctgggattacaggcatgtgccaccacacctggctaagtttcgtattttcagtagagacggggtttcaccatgttggtcaggctggtctsgaagtcctgacctcaggtgatccacccacctcggcctcccaaagtgctgggattacagtcttgagccactgtgcccggccagcatctttgaacatatcaa

SEQ ID NO: 55318 - DNA, 201 bp, Homo sapiens
aaaaataggtagtgggccctgctgctgggcttggcttgctgggcacacaaagtgagaagggcattgtgcctttctaggaaacatcccttgcaaagtcagtrcaggtgagacagtgtggccattcccaccacagcatgaggtcttttgaatggctgaagcgtcaggtgggaaaggatgaggagctgaagaagaaagcctggg

SEQ ID NO: 55319 - DNA, 201 bp, Homo sapiens
tagagtaaaataaaaggttttagcaatcatatacagcagtagactttaccttgaagatttaacaaaggtttgaaagcaaaatgctatgatactgaatataytaatgtttgagggcttgtgaaaaggtcttaatataggaatcatatatcttcttttagattgtgtcttggggaacattgggggtcagtttttctatcagtg

SEQ ID NO: 55320 - DNA, 201 bp, Homo sapiens
atgagaaactgacctggctgtagcaaaacagctaggctgggaagtgatgctgtttacatttatatgcgattctactggtcttcctgttactttgtagaagrctgtaaggcttggtgctcagagctagaaatgcaacttatttgatttgctaagaagtccaaagcaggtaggggtgccaagctgctgcctgttcacacatat

SEQ ID NO: 55321 - DNA, 201 bp, Homo sapiens
agccaaaaacaattccttatgagtacactaagggcacaatttggaatgctgcacccttctctccaaaactcttccaatcttcatcttgtttaagttagatycaaagataaataaatttaaagcatatcaatatttaagatccgattaagacagtaaaaagataaaacactctcttttcatactgtggtttttgatcctttt

SEQ ID NO: 55322 - DNA, 201 bp, Homo sapiens
attacagtaaaatgtataaatgccttaagagaaataagtacttgcttaggaacctatttcaagaaaggagagataggttagcgttttggggaggtagtacrggagcagtcagggaaagcaatacttgtaagatcagaggctggcaatctttttctgtagagggctaagttttggactttgcagatcctacagtgtctgttg

SEQ ID NO: 55323 - DNA, 201 bp, Homo sapiens
aacattgggggtcagtttttctatcagtgttagtatgtagtaagtaatggcatacatctaagcttgagattttgctcatttctgtattcttagcacttatrtatccaacatataataggtgttggataatatttgttgaataaatgactaaataaatgtcttggcataagaattatgccatctacaaaaccgtcactttta

SEQ ID NO: 55324 - DNA, 201 bp, Homo sapiens
ctatctggcatgggctgtgagggggctcctaacctagggggcctttttactccttcctggccagagctgccatttccaagtttctgcactgtcagaaaagrgggataaggtaagattcctgccctcatgtcacagattagtaggggagaggtaattgtcaaataattacagtaaaatgtataaatgccttaagagaaataa

SEQ ID NO: 55325 - DNA, 201 bp, Homo sapiens
gtggtacaagacatctttccagccctgtagaatatctattataaataaggaactattttttcaaggtgctcagaaatccaaaaaacatattagataggccrattttgagggcatttatttgtagagttatataggtttgattagagtctttcgtcaagaagaaaaatcattggcttaccaaacgagaagcattacacttta

SEQ ID NO: 55326 - DNA, 201 bp, Homo sapiens
tcatgtaactttgcagtgtcctctactctaggtgtccattcagcttatcctttgactctggccttcttctcctttgactctggctttatccatgtgacttwctttagccaacaatcataatgctggcaaacactgagaaaatgcttattagtgtctgcttagtctcttgcttctctgcaattgccatgagaaaatgcccaa

SEQ ID NO: 55327 - DNA, 201 bp, Homo sapiens
tattgtctatttctcaaaagtagcatacgtcataatttcatgtgatttctaaaggagatctaatctcaaacttagttcttagagtaaaataaaaggttttrgcaatcatatacagcagtagactttaccttgaagatttaacaaaggtttgaaagcaaaatgctatgatactgaatatactaatgtttgagggcttgtgaa

SEQ ID NO: 55328 - DNA, 201 bp, Homo sapiens
gcagtatcctgccaattttccacatccagctgttcacattctaatgcattctgcaatggatgattttgagcatatgactgatcatcactgtctcagaaatktatgctaatctattgtgacctattctgtcaaatccaaataactttacattcaaaacttttcatattctggccccatactgtctattgtaatcttattttc

SEQ ID NO: 55329 - DNA, 201 bp, Homo sapiens
agctgcaggggaggatgggggcatgggaggcaagcccgttgccctgtcagagcctcttggggatgctgctcttccccgcctgtcctctcttctctttgatktctcatcatgtggtcctctttcctctgccttttcctctcttcggtgtcccaagttcttccatagagacctgtgtccccttgttcccatcaggcctttatg

SEQ ID NO: 55330 - DNA, 201 bp, Homo sapiens; identical to SEQ ID NO: 10452

SEQ ID NO: 55331 - DNA, 201 bp, Homo sapiens
ttaaggaagtcctcagacaatgtaatcccaatactcttcttgaagttgaggtaatagggtgccagaaagaaaaagaaaataaatctctagtgccttctaamattttttcaatcctttgacctttttgaaaacggtcacctttaattcagaactaaagtaacatctggagggcccttttcttagatagggagaagacataaa

SEQ ID NO: 55332 - DNA, 201 bp, Homo sapiens
gtgtaagttatgaaatcttttttatttcatttgaaggaagtttttatttaaatacaaataaataagccctttattgtcacctactttggaaaagtccagakaaaacaatcttaagtaacaaaactccaaaattacaacatgattttcaaaaactaccctgacctttgtcttgcctggttgttacagtgtacttttaactaa

SEQ ID NO: 55333 - DNA, 201 bp, Homo sapiens; identical to SEQ ID NO: 10454

SEQ ID NO: 55334 - DNA, 201 bp, Homo sapiens
aaaaacccataccactggataatgcttgataatttctagagtcctttttttttgtattttggggcaggtaaattcattgagagacccagagagtttagctractttcctgtgggtaccaagggtcagagctggggtcaaaactcaggttttctgaacccctattcccagtgtacattccatgactccaggctgcctcccgc

SEQ ID NO: 55335 - DNA, 201 bp, Homo sapiens; identical to SEQ ID NO: 10456

SEQ ID NO: 55336 - DNA, 201 bp, Homo sapiens
tttggtactatttgattttaaactatataaatgcatttattaatttaaagtaatttaaaaaacccataccactggataatgcttgataatttctagagtcmtttttttttgtattttggggcaggtaaattcattgagagacccagagagtttagctgactttcctgtgggtaccaagggtcagagctggggtcaaaactc

SEQ ID NO: 55337 - DNA, 201 bp, Homo sapiens
gtattggttctagctgatttttatattgttagtcattaagttaggcttgatgagaaacagatataatctgagttggggattcaagtattatattgcatttstcctcacaactagagataaatttgccatggtttttctcttcataggctcatgccaaagtctggcatctctacaatacttctttccgtcccactcagggag

SEQ ID NO: 55338 - DNA, 201 bp, Homo sapiens
ttcccttccatagtactgatgcatttttgttaaccattacctaattttgcttgagtctattatttctgaaattcacattatcttcccttttaaagttgagwaaattttcattcttcaagcgccttattttctataatctctcaaagtaactgatggctgttgcatgatcataagtgcaaattattttgctagaccacactt

SEQ ID NO: 55339 - DNA, 201 bp, Homo sapiens
cctcactgtggggtgacctacctttgaaataatgtattggttctagctgatttttatattgttagtcattaagttaggcttgatgagaaacagatataatytgagttggggattcaagtattatattgcatttctcctcacaactagagataaatttgccatggtttttctcttcataggctcatgccaaagtctggcatc

SEQ ID NO: 55340 - DNA, 201 bp, Homo sapiens
ttaatactattacaatggcaattaaatttcaacatgagttttggaggggcaagcattcaaatcatagcaccatataatacaataaaaattttctgagctargtttggtaaatttattctaggaatccatgttgtctcctagttatcttcccttccatagtactgatgcatttttgttaaccattacctaattttgcttgag

SEQ ID NO: 55341 - DNA, 201 bp, Homo sapiens
tgagatattgaacccacttctatgataacagcattaattcattgatgaggacagagacctcattgcctaattggcctaaagtgagacctcttaaaggtctygcttaatactattacaatggcaattaaatttcaacatgagttttggaggggcaagcattcaaatcatagcaccatataatacaataaaaattttctgagc

SEQ ID NO: 55342 - DNA, 201 bp, Homo sapiens
tgaatggagttttcaaagaggatatgttaggggaataaaggctgataaacaacacttgtatttgtaggaaaatagggagagtaaatcaaggaattcaaagrgaaagagaaactcacttcaagtaggggagaaaaaacccctataattttcactcttccttgtaaataaaaaggaaacaaatgaaaataagatattagaagt

SEQ ID NO: 55343 - DNA, 201 bp, Homo sapiens
ctataagagtagctgagactaggttatttatttatttatttatttattttttgagacggagtcttgctgtgttgcccaggctggagtgcagtggcacaatmtcggctcactccaagctccgcctcccaggttcacgccattctcctgcctcagcctcccgagtagctgggactacaggcacctgccgccatgcctggctaa

SEQ ID NO: 55344 - DNA, 201 bp, Homo sapiens
cagtccatttaattaagattatttgtaggattaaattaatcctttaagaattattccatttcaatttttaaaaaatctaatgaatgatagataacaaaaarcggtccattcagtattacccctgaaacatatttgggtgattggtgataccatccatgtctctccaacttcagcttcatatactcagctgagtaccaggca

SEQ ID NO: 55345 - DNA, 201 bp, Homo sapiens
agtccatttaattaagattatttgtaggattaaattaatcctttaagaattattccatttcaatttttaaaaaatctaatgaatgatagataacaaaaagyggtccattcagtattacccctgaaacatatttgggtgattggtgataccatccatgtctctccaacttcagcttcatatactcagctgagtaccaggcat

SEQ ID NO: 55346 - DNA, 201 bp, Homo sapiens
tttattaacattttttgtttgaagtacagatgtcacgtcatccatgaaccggtatcattatagcttgataaaatactcaaactgaaagcagtgatgtacaytaattttaaatataatggttaagcaaatgttatttccatatctataagtgcattttatttgataattagaatgttagaatcagaaggaatttggaaaatc

SEQ ID NO: 55347 - DNA, 201 bp, Homo sapiens
agataacaaaaagcggtccattcagtattacccctgaaacatatttgggtgattggtgataccatccatgtctctccaacttcagcttcatatactcagckgagtaccaggcatcttcattgaaagctagacttgtgacctaaatagaacttgatcccttcccttccccaactccttattttttgttttctttgagttcct

SEQ ID NO: 55348 - DNA, 201 bp, Homo sapiens
tttcttgtaaatggaatattgtgcttgcagtctgctctcacacaatatctgggaaggagttttaaagagtgaggaagaacagtaaagattttcctaggcaratacgttatgtgacctttgttgatttccagagcacataatatcccaatttcatccagtggacaggaaaagagaggaagagggaaaaggtggcctctcaag

SEQ ID NO: 55349 - DNA, 201 bp, Homo sapiens
tagacttgtgacctaaatagaacttgatcccttcccttccccaactccttattttttgttttctttgagttccttgattcctcttcccctcctcacatgcmacatgtaacatccaattcatcagcaggttctacagattctgccttcaataatagcctaaatctagccacttgttactatcttttttggtccaaaccatca

SEQ ID NO: 55350 - DNA, 201 bp, Homo sapiens
aggaaagaaatacaatttttaataaaggcataagtggagaggtaaaatacatatttctggtttcaacgtgtccatattctttcttgtaaatggaatattgygcttgcagtctgctctcacacaatatctgggaaggagttttaaagagtgaggaagaacagtaaagattttcctaggcaaatacgttatgtgacctttgtt

SEQ ID NO: 55351 - DNA, 201 bp, Homo sapiens
taagctattataacaaattcttttatttcattagcttttcaaaatgtggataactacacactcaacccaaggaatctacatttttccactgactgctaaaraccaatggaaataactctagtccccgtagcacctcactgtggggtgacctacctttgaaataatgtattggttctagctgatttttatattgttagtcat

SEQ ID NO: 55352 - DNA, 201 bp, Homo sapiens
cttattttttgttttctttgagttccttgattcctcttcccctcctcacatgcaacatgtaacatccaattcatcagcaggttctacagattctgccttcrataatagcctaaatctagccacttgttactatcttttttggtccaaaccatcatgatcttttgcctggaccattgcaatagttgtctaactggtatcctt

SEQ ID NO: 55353 - DNA, 201 bp, Homo sapiens
tttaaaggaatttatttcctcacagttctgttggctgggaagtccaagggcaagtctctggcatctggtgagagacttcttgctgctttctcccatggtgraaggtgagagggcaagagagagacaaaaggaggctgaactcatccttttacaaggaacccatgcctgagatattgaacccacttctatgataacagcatt

SEQ ID NO: 55354 - DNA, 201 bp, Homo sapiens
attatcttatattctcaaaaatatcattgctctaaactagaattttattataattaatttgtgcaaaagttgtctttctttcaatgaatgttatctttttraggcataaaggaaattttaggtggaggaggagaatagaatacatgcttactgggaggacaagtaataataggtgagtaaaaacacacagcttattgaatt

SEQ ID NO: 55355 - DNA, 201 bp, Homo sapiens
attttttgttttctttgagttccttgattcctcttcccctcctcacatgcaacatgtaacatccaattcatcagcaggttctacagattctgccttcaatratagcctaaatctagccacttgttactatcttttttggtccaaaccatcatgatcttttgcctggaccattgcaatagttgtctaactggtatccttgct

SEQ ID NO: 55356 - DNA, 201 bp, Homo sapiens
attggttattaaaatgttgatgtatgattattaaaaggcagcccatggtatgtctcttctgtatgaataagtatgtaaaaagtatgtaaagattactgtayagttcatgggtgggactgggctctctctagcctctgtccttcattctccctgccagtgccttttcccttgcagtgtcccttccctggctgcatactcaag

SEQ ID NO: 55357 - DNA, 201 bp, Homo sapiens
ccttctgaattatcttatattctcaaaaatatcattgctctaaactagaattttattataattaatttgtgcaaaagttgtctttctttcaatgaatgttrtctttttaaggcataaaggaaattttaggtggaggaggagaatagaatacatgcttactgggaggacaagtaataataggtgagtaaaaacacacagctt

SEQ ID NO: 55358 - DNA, 201 bp, Homo sapiens
agttctgccaagaagttaaattaccagatttacttgatgtggctttattctttcttagagctggtctattcctgctttgttcttacttctcaggtaatgamcttcctgagtttcagctggatgcctgaagtgctcagctgcatttttctactctggctattctgaaatgcaatattttccagacctacccaacctttggta

SEQ ID NO: 55359 - DNA, 201 bp, Homo sapiens
ctcctttttgaacacattgttttttgaaggttacggtcaagtccaagaaaaaattttaaaataggaaaagaattaatcaaatcatttcaaaatcatagcastgttttaacaatgccaattattttgagttgaagaaaagaaggaaaatgtaaactatgcattcaagtaatgtcaatgcaccttctcaggtgcaaaatgaat

SEQ ID NO: 55360 - DNA, 201 bp, Homo sapiens
gaagagtggtctataattataaaaaattccattgtatgacttcagctacctgcaaaactgaccgagattaatgcattctttgtttgctttcactctttcaytccctgttcagcgcttattctacagaaaggtgcctggtagatttaggacatgactgttcataggcctcaaatgcggtcaaattaggaaagtcccctggtt

SEQ ID NO: 55361 - DNA, 201 bp, Homo sapiens
aatccgttagaggaatgttggtacgcttatacagtggaatactaattggttattaaaatgttgatgtatgattattaaaaggcagcccatggtatgtctcytctgtatgaataagtatgtaaaaagtatgtaaagattactgtacagttcatgggtgggactgggctctctctagcctctgtccttcattctccctgccag

SEQ ID NO: 55362 - DNA, 201 bp, Homo sapiens
ttgtactgattcttcttgggaagaaagaagattgcttgttagaattttagctacgagagatgactatgaaacagtaaattaactccaacgacctgagtcaytttgaaaactcccagtctcaggataaaaaatataatcctatttagaaattcctggtgtgatcacagatgtagcattggttcttttcatgaaacccgtaaa

SEQ ID NO: 55363 - DNA, 201 bp, Homo sapiens
tactactgaattcaatagtgcatttagtcagaaatagttaaaatatctcccaaacagcttgaatcactcctttttgaacacattgttttttgaaggttacrgtcaagtccaagaaaaaattttaaaataggaaaagaattaatcaaatcatttcaaaatcatagcactgttttaacaatgccaattattttgagttgaaga

SEQ ID NO: 55364 - DNA, 201 bp, Homo sapiens
agagaagtatgtgtgagactcttggtgtccagaggaggggcatgcagcacagtatgggggtccatggggttgcagcgatttcttagagacggtgccatgcmtgggatgaccaccaagttaggatgctgtaaagagtaatcaaataagtttcaacagggttttggcatgaggtgagcagttaatccaaatgatatctgaaat

SEQ ID NO: 55365 - DNA, 201 bp, Homo sapiens
tgttaaggtaatccgttagaggaatgttggtacgcttatacagtggaatactaattggttattaaaatgttgatgtatgattattaaaaggcagcccatgktatgtctcttctgtatgaataagtatgtaaaaagtatgtaaagattactgtacagttcatgggtgggactgggctctctctagcctctgtccttcattct

SEQ ID NO: 55366 - DNA, 201 bp, Homo sapiens
taggatgctgtaaagagtaatcaaataagtttcaacagggttttggcatgaggtgagcagttaatccaaatgatatctgaaatgctttctaatgctgcaartgtattcctctgtaaaataatcaactacttaaaagacactctcacttgcattatgtcatttaatcctcacagtgtccctacgggacaatagatgtcattc

SEQ ID NO: 55367 - DNA, 201 bp, Homo sapiens
aagccaaacatccctgtcatctctttggtagtttattttcaaactttcaatcttattaaatttcatctccaatgtgcaaagataagaggaagtttaccgcwgatggtggtttattctttaaaactggacatcagctaaatgtgttaaggtaatccgttagaggaatgttggtacgcttatacagtggaatactaattggtt

SEQ ID NO: 55368 - DNA, 201 bp, Homo sapiens
cgcagtggctcacacctgtaatcccagcactttgggaggctgaggcgggtggatcacctgagatcaggagtttgagaacagcctggccaacatggtgaaaycccgtctctactaaaaatatggaaaattcaccagacgtggtggcaggtgcctgtaatcccagctacttgggaggctgaggcaggagaatcgtttgaacat

SEQ ID NO: 55369 - DNA, 201 bp, Homo sapiens
ccaagttcttccatagagacctgtgtccccttgttcccatcaggcctttatgccagccctgcacaggtgcggggacagtggtaggggcgtctcactcccgrctcaactacattctcccagaaattgtctgcagtcaaacacaactcagcgtggacattgctcaccaaaggtatactgcttgggctgcacgagagattcagt

SEQ ID NO: 55370 - DNA, 201 bp, Homo sapiens
taaccatctccctgttaatcatccttagttgttgcaacatcctaaatagtgaccttcccacactctgcctcataatatttaatctgtcaaatgtaccatcygcaaagggagtgaactggctcgtgaagaggtggtgaagctggttcaactcagtttaacagacaatgagggcctccgtgtgccagggagggagtgagggaa

SEQ ID NO: 55371 - DNA, 201 bp, Homo sapiens
ccttctatggcatcctgcacaggacttcactttgctcagatgcctcctcccgcgctcttccctttatttaaccatttgtctccattttaccccttcgctakctggggtaatcctgttcccttcatctgtatctctgaaaatggcatcttgccctcccttggtgctcagaaggtggcttctggtttaccgaatagcctgatt

SEQ ID NO: 55372 - DNA, 201 bp, Homo sapiens
ttcaaatcccacctgttcttctggagccagctaacacgctcccttgggccccatgcctgaatgccatctcttccttctatggcatcctgcacaggacttcrctttgctcagatgcctcctcccgcgctcttccctttatttaaccatttgtctccattttaccccttcgctagctggggtaatcctgttcccttcatctgt

SEQ ID NO: 55373 - DNA, 201 bp, Homo sapiens
ctataagattaacataccaggaataattagaaagcattgcaagactatatgtaaccatctccctgttaatcatccttagttgttgcaacatcctaaatagygaccttcccacactctgcctcataatatttaatctgtcaaatgtaccatctgcaaagggagtgaactggctcgtgaagaggtggtgaagctggttcaact

SEQ ID NO: 55374 - DNA, 201 bp, Homo sapiens
cctacctccaggatgtgtccagaatcaaaccacttctccccttatctatgactacgatggaggtgcaagacaccatccaaccttgcctgggtaatgggaasagcctcactgctggggttcttatttctgccttgccccctgcagtgtgccatgatggatgctctacagggtgacattatgtgtggacaagacagagtcctt

SEQ ID NO: 55375 - DNA, 201 bp, Homo sapiens
tcacgtaaggaagtagggctaggagatattaatctgggcattgttgagcattagcatcagtgtgcaggtctcagcccatctgtctgcaatgtttgttgaarccatcacttcttgtcccttgaatccttcctcaacttggatttcaggctctggctctcccttgcttctcctctcagctccctggcgattccctcttagtct

SEQ ID NO: 55376 - DNA, 201 bp, Homo sapiens
tacatattattgagataaaaaggcagagaaagaagaacaagaccaggctcaaaatgaccttacagttgggtagttttgggtaacgcaatccttggtgaacytcagtttcctcatctttgaaatgggagtgtctatcttagcacagtgctgaacataggaaatattcaataccttgggtatctaccccagacgttatttttt

SEQ ID NO: 55377 - DNA, 201 bp, Homo sapiens
gtagccatgctctatgaaccatctttataactccctggcttctggcagttaagcaccactcactatctggcctctgtaatttcaacttctgaccatccccrtgggtggcaacaagcccagctctgtgacacctctgctaccagcagccctggcctggagagcggtgcccccactgaatgtctcagtgagattggcaccccc

SEQ ID NO: 55378 - DNA, 201 bp, Homo sapiens
aaccacactgtttatacattctcctgtgaatggacatttgtgttgttttcagttttctgctattgcgatttaagctactataagcatttttttttaattgygatggggtttcgctcttgttccccaggctggagtgcagtggcagcgatctcagctcactgcagcttctgccacgtgggtccaagcgattctcctgcctca

SEQ ID NO: 55379 - DNA, 201 bp, Homo sapiens
gaagaagacttgcctgtctaaactgccttcccatcccaatccctgttaccttctatcctttctctgctttattttcatttgttatctctcttcttcccaakaatgtaagctccataagaacaggatcatattttgaatcccctagaaaagtgcctagtgtaatatttgttgaatgaatatgatccctgcaattaaaagcta

SEQ ID NO: 55380 - DNA, 201 bp, Homo sapiens
aaaagctgatagagaaaaatggcttccctcctttacctgaaaatcagcccctagaagggacatttccctgtgactttgcttggggagttgttgacaactayattcaagtaagtcagctgacaaaaccaatcagcagtctcaccaagccctatcactagtaagtagtgcttccttcctaggctgattgtcatggcacattgt

SEQ ID NO: 55381 - DNA, 201 bp, Homo sapiens
agaagaaaaatcattggcttaccaaacgagaagcattacactttatttatttaagtaggaaacgctcagctgctcttgaaccatgatgcaagtgcccagcraagggtcatgttgctcttgtcccctcttccctttgcagccatcaagctggatggggtggatgtcatcgggtataccgcatggtccctcatggatggtttc

SEQ ID NO: 55382 - DNA, 201 bp, Homo sapiens
acttaacaccatgtcgaaactgctaccacaaaaaggcaaatgcgaaagaagggggaaagagcaggccgatgactttccgctatccaccactccataaagcrtatttcattttcctgtaattgtatcctgttcaatgatgtagaaatcctcacacactcacatgccactttttctttgggtgaaaagcgttctctactgcaa

SEQ ID NO: 55383 - DNA, 201 bp, Homo sapiens
ctcatgcctgtaatccccacactttggcaggccaaggcaggaggatcaattgaggctagaaatttgagaccagcctgggcaacatagtgagacccgtctcwacaaaaacttctaaaaattagccgggcgtggtgctgtgcacctgtagtcccagctactcgggaggttgaggtgggaggatcacttgaactcaggaggttg

SEQ ID NO: 55384 - DNA, 201 bp, Homo sapiens
gtagtaaatacataggaagaaatagtatatagaaaaagtatggtttcaatccataagaaataaaggaaactcccaggacgagagcagctcttgacagcatytagtccaaactggacttggaggctggaaacttctagcagggaaggaagagctctgggtgaaaaagtagactcaacagaatagatacgatcatagaaaaca

SEQ ID NO: 55385 - DNA, 201 bp, Homo sapiens
caggtggacttttatccgccgttcattttgccctgctttggaaggacggttttccagtttcattagtgacacgtcattttatctttgacttccacagtcartacttagaatctggcttggtcctgttggctcatgcctgtaatccccacactttggcaggccaaggcaggaggatcaattgaggctagaaatttgagacca

SEQ ID NO: 55386 - DNA, 201 bp, Homo sapiens
acataatccaaagtcaattaaatagtaagctattataacaaattcttttatttcattagcttttcaaaatgtggataactacacactcaacccaaggaatytacatttttccactgactgctaaagaccaatggaaataactctagtccccgtagcacctcactgtggggtgacctacctttgaaataatgtattggttct

SEQ ID NO: 55387 - DNA, 201 bp, Homo sapiens
atgctttctaatgctgcaagtgtattcctctgtaaaataatcaactacttaaaagacactctcacttgcattatgtcatttaatcctcacagtgtccctaygggacaatagatgtcattcccacttgtacagagcagtaagtgaggctcacaccggtcatagttagaggagtagggaatctaaacctaagtctcttctact

SEQ ID NO: 55388 - DNA, 201 bp, Homo sapiens
gaataaggaaatacaggtcaggaaatttgtaaagaaataatataataaaatgccccagaactgaagaacatgagcttttaactttaaagagccgactgagytcctagctcaatgaatgtatagacatgtaagggtattgaaagttcaccttcagtgtcatgtttcctaagaagctaatggaagatatgcaccagcaaaatt

SEQ ID NO: 55389 - DNA, 201 bp, Homo sapiens
gtaattagtatgagcgatttgtctactgtatatatgctcaaattacatatactatgcacttttgagaaatactttacaagtttttctttcattaaaatgtrtttggggccgggcgcagtggctcacacctgtaatcccagcactttgggaggctgaggcgggtggatcacctgagatcaggagtttgagaacagcctggcc

SEQ ID NO: 55390 - DNA, 201 bp, Homo sapiens
agtacccttctcaagctaactccctaactgacgtagtcaaaataagttctttgtatgtcagttctgaggtgtgtgtgttttcacttacaaacagtactctrcagctttaagacattatattaaagtcctgagaagtgatttttaaaccactgaacttcatcttttccctcctggctagtatttcagactttcagtgtttga

SEQ ID NO: 55391 - DNA, 201 bp, Homo sapiens
gggaggtccagctgcagtgaatcatgatcacagcactgcaatctggcctgggtgacagagcaagacactatttcaaaaaaaaaaagaccaagcatggtggytcatgcctgtaatcccagcactttgggaggctgaggcaggtggatcatctgaggtcagaagttcaagaccagcctgaccaacatggtgaaaccccgtctc

SEQ ID NO: 55392 - DNA, 201 bp, Homo sapiens
gatgactggagattttgagtctccacccaggtttccccgagcatcagactggcatagacaaccgccttctccacgtggatgtctaatgggcatgtcacatygaacacatacatcccaaaccaaacccctgcttccccttctctattatgatgactttttactcttccagttgttggaccccgaatcttaactactcccctt

SEQ ID NO: 55393 - DNA, 201 bp, Homo sapiens
cattagcatcagtgtgcaggtctcagcccatctgtctgcaatgtttgttgaaaccatcacttcttgtcccttgaatccttcctcaacttggatttcaggcyctggctctcccttgcttctcctctcagctccctggcgattccctcttagtctcctttgcttgttcctcctcaccttgcctgtaaatagtggagggctcag

SEQ ID NO: 55394 - DNA, 201 bp, Homo sapiens
tcccattcttaagacaacaagcctataagattaacataccaggaataattagaaagcattgcaagactatatgtaaccatctccctgttaatcatccttakttgttgcaacatcctaaatagtgaccttcccacactctgcctcataatatttaatctgtcaaatgtaccatctgcaaagggagtgaactggctcgtgaag

SEQ ID NO: 55395 - DNA, 201 bp, Homo sapiens
agctcttgaaacaaagttcttaatgtcccctgaaatcagcactagggactgtagttggggagttcagccccagcagtgcctctgagtctttgttctgtatrtgggttctaagaggattagaatcaagttggaaatacacgtgttcccatttcccaccttcaactcccctcaccgcctgagattcttgcaaacatttgtgca

SEQ ID NO: 55396 - DNA, 201 bp, Homo sapiens
aattgttattatagtgacttataggatcattttattataagataaagacttgcgtgctctctggtgctctggtgttttaaataatcaacatgttttagatmtttttgcccactcatggccctctgattaacttctcagttatatttttcaatgcttacacaaaaaatttgccaaacactaaccatccttcctagaaatgca

SEQ ID NO: 55397 - DNA, 201 bp, Homo sapiens
aagttataaatccctccagatcaaagtgctactaaactctacttgctattttataacctttttctgttcagagtattttagaaacgtttttacatgttaaytgatattcttttgcattatcctgaataatggtatttctttagttatactatcatgtattaaaacattcatacatggtaaacatatttgaatattagacat

SEQ ID NO: 55398 - DNA, 201 bp, Homo sapiens
gttgaaagggttcctcacttatgacattgttagcctgataaaattaattgtaacacccttgtgcaaaatattttattaattttgacagcaggaaatattgmtatgccatggtaaagttgtctcaagtatttcttcctccttttttctccttagtgttcaaatttaggcaccattgttttggggattcatttataatcatgt

SEQ ID NO: 55399 - DNA, 201 bp, Homo sapiens
cagggtgagatgaagcagagacttttaataaccatcaagcaggcctgccatccaactgctatgagccattttccctttttgaattttatttttttaatctytagagcaatacatgtttatggtaggaaatgaaaaaaatatatagatgggtaaaatgaagtgaattataccacccacaatcctgctgtaaaacaggtttta

SEQ ID NO: 55400 - DNA, 201 bp, Homo sapiens
ttcaccggggtgtgaagaccgctttatacaatctcaaacaaagctagtcatagaaacacagaaacaactgcagggtgatatagattgttctaccacatctrtatttccacagtgctctctacagttgaaagggttcctcacttatgacattgttagcctgataaaattaattgtaacacccttgtgcaaaatattttatta

SEQ ID NO: 55401 - DNA, 201 bp, Homo sapiens
caggcagagaccatagggcaagttggagaacaggtgggcagggtgagatgaagcagagacttttaataaccatcaagcaggcctgccatccaactgctatsagccattttccctttttgaattttatttttttaatctttagagcaatacatgtttatggtaggaaatgaaaaaaatatatagatgggtaaaatgaagtga

SEQ ID NO: 55402 - DNA, 201 bp, Homo sapiens
gctattgttttagaatctgacctaaggtcagccactaattggccccagaggtctctctctcagatcacacggtccttttttcctcatcagcttggggaccycacccctcctcctggcagtctcctcctgtgcagaacccaacaaacacaaaattaagtcactctcaaacccacagcagatgagagcttctctggaagctcc

SEQ ID NO: 55403 - DNA, 201 bp, Homo sapiens
tgtgatttttgtgatttcatacttatgtatgtcttttcataaggatgttttagagcggtgattcttatactttttcaatccttttatggatctgaaaaacyctaaagaccaccagtgtatggctggtgatagaaaaactatgggaagaatggtctcactttttgaagaaaacataagcaagttatcagttcatactggaag

SEQ ID NO: 55404 - DNA, 201 bp, Homo sapiens
tcaatgtgcctgggacttggatttcaggcagagaccatagggcaagttggagaacaggtgggcagggtgagatgaagcagagacttttaataaccatcaarcaggcctgccatccaactgctatgagccattttccctttttgaattttatttttttaatctttagagcaatacatgtttatggtaggaaatgaaaaaaat

SEQ ID NO: 55405 - DNA, 201 bp, Homo sapiens
ttggatttgtttggaaacacattgtgatttttgtgatttcatacttatgtatgtcttttcataaggatgttttagagcggtgattcttatactttttcaayccttttatggatctgaaaaaccctaaagaccaccagtgtatggctggtgatagaaaaactatgggaagaatggtctcactttttgaagaaaacataagca

SEQ ID NO: 55406 - DNA, 201 bp, Homo sapiens
atgctagggagagggaagatgtcaaggaatgcttcctggaggtggcgacatctaagctgagttttaaagtgggtgtaagagtgaaggaactgggaataggyaaaacataccttagagagctgcacctccaaagcatggaaggctagataatcttagaacttcaagtggggttcaatgtgcctgggacttggatttcaggca

SEQ ID NO: 55407 - DNA, 201 bp, Homo sapiens
aagacttatttttaaatttagaattcagccacatattctgaacaaagtcagtactaaaaccatttctaaacacttttaattaaagccatagataatatggscagagcagtactgggttattgaggtgacttagtgctctgagctgctggtaatgttgtaataatggctaaattagattttatgtcagttccacaaaacctg

SEQ ID NO: 55408 - DNA, 201 bp, Homo sapiens
gctggagtggacctgaggttcatcacctgtttccttccacccaccatttaaaagcagcttatttgtgtgaaactttttgttgggttctgtgggggatacgwataggcaaatgacagggagcttataatttagccaaagagaaaatgtctatatgttctgtggaattcagagtattttcctcgacttccaaaattattttcc

SEQ ID NO: 55409 - DNA, 201 bp, Homo sapiens
tttgtacagagttttgtatcacaataaaatattttatgtacatgtataaacattttaataaaagtgtttaaatgtacaacttttggtacccaattctgatsacttgtgggcctactggaagacttatttttaaatttagaattcagccacatattctgaacaaagtcagtactaaaaccatttctaaacacttttaattaa

SEQ ID NO: 55410 - DNA, 201 bp, Homo sapiens
cttttcagctcagcaatactgctgtgtattgtgtgagcttcatttgcctcagccatacctagaacacaacccaaggcagaaagctggagtggacctgaggytcatcacctgtttccttccacccaccatttaaaagcagcttatttgtgtgaaactttttgttgggttctgtgggggatacgaataggcaaatgacaggga

SEQ ID NO: 55411 - DNA, 201 bp, Homo sapiens
cttcttgtcccttgaatccttcctcaacttggatttcaggctctggctctcccttgcttctcctctcagctccctggcgattccctcttagtctcctttgmttgttcctcctcaccttgcctgtaaatagtggagggctcagggctctgtctagattcactccaggccattgctttgaatactgctgcatcccgatgactg

SEQ ID NO: 55412 - DNA, 201 bp, Homo sapiens
ggggcgcgggcataaaggggcgcggcgcggggccccggagcctggctcccgcgcagcatgcccgccagcgccccgccgcgccgcccgcggccgccgccgcmgtcgctgtcgctgctgctggtgctgctgggcctgggcggccgccgcctgcgtgcggagccgggcgacggcgcgcagacctgggcccgtttctcgcggcct

SEQ ID NO: 55413 - DNA, 201 bp, Homo sapiens
gttttgaagtctccacacagctcatcgttgccttgcccgtagttgtagctcagtgaaataaaaatctgtccgtagaaggtgatgtctgtgactggtgagcygagagcttgtggggttggtgttgtatttgggtgcatgtgaatcagtgcatctcctgctccattggtgttaaaaggctcccatcgtcctgggaacacaata

SEQ ID NO: 55414 - DNA, 201 bp, Homo sapiens
ctttgtgtagatttcttctctccagtacgttgacctgcttcagagtcctcatcattgctttcttccttttcagctcagcaatactgctgtgtattgtgtgrgcttcatttgcctcagccatacctagaacacaacccaaggcagaaagctggagtggacctgaggttcatcacctgtttccttccacccaccatttaaaag

SEQ ID NO: 55415 - DNA, 201 bp, Homo sapiens
acaacttatttattttcatctttcttgatcctttcttcagttggatgttgtctttgagggcagaggttgtcctctatgttttgaagtctccacacagctcrtcgttgccttgcccgtagttgtagctcagtgaaataaaaatctgtccgtagaaggtgatgtctgtgactggtgagccgagagcttgtggggttggtgttg

SEQ ID NO: 55416 - DNA, 201 bp, Homo sapiens
acctttggtattcatctcccagacctgtggctgcttctctttgctgagcctcacaaaatcttgtcctgtgcatggacagccacggatccttgggaaatctyatgcagacttctaggtccttcctttgtgtagatttcttctctccagtacgttgacctgcttcagagtcctcatcattgctttcttccttttcagctcagc

SEQ ID NO: 55417 - DNA, 201 bp, Homo sapiens; identical to SEQ ID NO: 10462

SEQ ID NO: 55418 - DNA, 201 bp, Homo sapiens
tgtgtgagagagagagagagagagagagagagaggagacaggagagaaggagaagaggggagaggggaggagggacagagagagagagaggtctcctacaragagcttggagctcaggctgctttgctcatttgagtgtaatccaggaggatgcaccttttctctcggacttgaagaccaactgctcagccttcacagctc

SEQ ID NO: 55419 - DNA, 201 bp, Homo sapiens
caaggaatctacatttttccactgactgctaaagaccaatggaaataactctagtccccgtagcacctcactgtggggtgacctacctttgaaataatgtrttggttctagctgatttttatattgttagtcattaagttaggcttgatgagaaacagatataatctgagttggggattcaagtattatattgcatttctc

SEQ ID NO: 55420 - DNA, 201 bp, Homo sapiens
tggaaaaaaatctctaagattatctaacataaatgatgtgaatttatatttttaaatcctaatggagacattcattttggcaatagtagaatgcattcatktaacacctttctcatttggagtcttgaggaacttgaattaatttttaaaaacccatttgtaaatgagaaactgggttataatatttgtaattacttaact

SEQ ID NO: 55421 - DNA, 201 bp, Homo sapiens
cggcatccggggcagcccgcggctcgggtacctggtggcgcacaacctcctcctggtgagtgcgaggggccaggcggagggccacgcaggggagacagagrgcctccacaggggccagggggaagtgtgggaactgagtctcccccagacgaggcttcacttggacacgtgtatgtggtcaccgggggaaactgagcagtt

SEQ ID NO: 55422 - DNA, 201 bp, Homo sapiens
gtgtgagccagtgttcctggccaaatgcagctgatttttgtattgacattgtattctgccaacttgctaaattaacttattcgttttaatagtttttctgkttttttaaaaatcttaggatttctacacagacaatcatgtttttaatgaacaacaaagtttgtttttttgtttgtttgtttttcccttttcaatcaacat

SEQ ID NO: 55423 - DNA, 201 bp, Homo sapiens
ctacatattattgagataaaaaggcagagaaagaagaacaagaccaggctcaaaatgaccttacagttgggtagttttgggtaacgcaatccttggtgaasctcagtttcctcatctttgaaatgggagtgtctatcttagcacagtgctgaacataggaaatattcaataccttgggtatctaccccagacgttattttt

SEQ ID NO: 55424 - DNA, 201 bp, Homo sapiens
ccttgcccgtagttgtagctcagtgaaataaaaatctgtccgtagaaggtgatgtctgtgactggtgagccgagagcttgtggggttggtgttgtatttgrgtgcatgtgaatcagtgcatctcctgctccattggtgttaaaaggctcccatcgtcctgggaacacaataggaaagagaacaggtgggaaggcactggat

SEQ ID NO: 55425 - DNA, 201 bp, Homo sapiens
ggatgttgtctttgagggcagaggttgtcctctatgttttgaagtctccacacagctcatcgttgccttgcccgtagttgtagctcagtgaaataaaaatmtgtccgtagaaggtgatgtctgtgactggtgagccgagagcttgtggggttggtgttgtatttgggtgcatgtgaatcagtgcatctcctgctccattgg

SEQ ID NO: 55426 - DNA, 201 bp, Homo sapiens
aggcactgggactactgcattttggtccattacttccttgcgcacaaaaaccctttcttttcaccacgaatacactatgaacatgtttttttcttcagtgytggcatctcttgattccttccctccaggtctttgtgcgagttttactctttaaaccccagatattgtcatatttttctctgttaaacttttccaaacaac

SEQ ID NO: 55427 - DNA, 201 bp, Homo sapiens
gctgcaagattccagcagtgttggcaacatggctgcactggttcactcagacagagaggaaggagctgagggaaaccagaaattaggtaatgggcttgcasccttggggagagccccagagtggagtagtacctctgaatctgcatgctctgggatgtgctgcctaaatgcagaagaccaggccttttcccctcccagccc

SEQ ID NO: 55428 - DNA, 201 bp, Homo sapiens
aatcagagaagcagaagaacataataaatacccactgtcctactcaatagagactataactgctatctctgtacaaatcctttaaaatcctgtcttatgtrtatttattttacatctgtacatatgattccaaaattaggtaatactgtacgtggtctatctatagctaactatagtttgtaatttaataagctatatttg

SEQ ID NO: 55429 - DNA, 201 bp, Homo sapiens
attttccagacctacccaacctttggtattcatctcccagacctgtggctgcttctctttgctgagcctcacaaaatcttgtcctgtgcatggacagccamggatccttgggaaatctcatgcagacttctaggtccttcctttgtgtagatttcttctctccagtacgttgacctgcttcagagtcctcatcattgcttt

SEQ ID NO: 55430 - DNA, 201 bp, Homo sapiens
atagggagcctggtcaatattgtctctttttaaagggtgttgtatttagttctgccaagaagttaaattaccagatttacttgatgtggctttattctttsttagagctggtctattcctgctttgttcttacttctcaggtaatgaccttcctgagtttcagctggatgcctgaagtgctcagctgcatttttctactct

SEQ ID NO: 55431 - DNA, 201 bp, Homo sapiens
gatattatagggagcctggtcaatattgtctctttttaaagggtgttgtatttagttctgccaagaagttaaattaccagatttacttgatgtggctttaktctttcttagagctggtctattcctgctttgttcttacttctcaggtaatgaccttcctgagtttcagctggatgcctgaagtgctcagctgcatttttc

SEQ ID NO: 55432 - DNA, 201 bp, Homo sapiens
catcccttaccaatgggttcattcatccactccttcattccacaaatacgtagagagcacctacagtggacgggtaccatctcctaggtactggagatatygcaaagaaaaggccatatgtccattactatggagttcacattcttatgggaaataaaggaaataagcaagtaaatgaacaagataatttgagacagccat

SEQ ID NO: 55433 - DNA, 201 bp, Homo sapiens
ttctttttttccccttaattaagggtttccttttcctgctttttcacatatctagtagatttttattatgctctgtgtgctatgaatgagatattataggragcctggtcaatattgtctctttttaaagggtgttgtatttagttctgccaagaagttaaattaccagatttacttgatgtggctttattctttcttaga

SEQ ID NO: 55434 - DNA, 201 bp, Homo sapiens
taatagctattttaaagtcctctgctaatcccgatatctgggacatcttggcttctgttgatattgaatacttctttttttccccttaattaagggtttcmttttcctgctttttcacatatctagtagatttttattatgctctgtgtgctatgaatgagatattatagggagcctggtcaatattgtctctttttaaag

SEQ ID NO: 55435 - DNA, 201 bp, Homo sapiens
tcgcttttcagttctagaattttcatgttttcttcagttgttgtttctctgttgttattctccatttgttcattatatctatcttttctttgaaatccttraaaatatttataatagctattttaaagtcctctgctaatcccgatatctgggacatcttggcttctgttgatattgaatacttctttttttccccttaat

SEQ ID NO: 55436 - DNA, 201 bp, Homo sapiens
tggctttttagagaaacctttaatatctttgtgagttttagggattacattatttattcttattattattccatttagaattaatattgttaatcccattmaaaaatttgtttatttcgcttttcagttctagaattttcatgttttcttcagttgttgtttctctgttgttattctccatttgttcattatatctatctt

SEQ ID NO: 55437 - DNA, 201 bp, Homo sapiens
cactttatatttatagtatatttcttgcacacagaatgtaattgaaacttacttttctaaaatctactttctttttttttttttgagatggagtcttgctstgttgcccaggctggagtgcagtggcacaatcttggctcactgcaatctctgcttcctgggttcaagcaattctcctgtctcagcctcccgagtagctgg

SEQ ID NO: 55438 - DNA, 201 bp, Homo sapiens
gtagggatattagcaagatccttcacttgtctgggctttctgtctttgagtcacctttgcgcagtttttcactggacttcacaagcctctgaggcggcagrgcagacaggacatccttattttatagaggaggaaacttaggcttacagaggtttcctgccccaaatcacaaaggtggagcctagaccttctcagtctcca

SEQ ID NO: 55439 - DNA, 201 bp, Homo sapiens
gttgtgtgctgtaattttttaaaattgctgaagtgtcatggtttgctatttcgtatttattgaaaaaatgtaaatgctatatttaacagaatggcagtaastctgtttcaatctgaagacttaatcttactaatcatggtaatatatgctggctggagttgggaatatttcataaaatactggaataaatttgtgcttata

SEQ ID NO: 55440 - DNA, 201 bp, Homo sapiens
ggaacccctctgtgtctccagtaataattctgtgattaatgggttagatggattctggtcacaagctggatattttgttaacaacctagcgtcaatgactkggaatgattttcaccgcagcatgatttagtattgaatagaatgatttaactaatgttaattagttctgtacagataaattaatgaagcaagaagctcaat

SEQ ID NO: 55441 - DNA, 201 bp, Homo sapiens
caagagtccgtctcttaaaaaaaaaaatgactggatgtgtcatcttttatgccaggatatgtgagcccaggagaaaggcttctgagctccctcctgctcgstgtgcaattttctgccctgccccgactctctccttctctcccagcctcctgctatttgaaatctccttatcctaatttccctcctcagagtggattccac

SEQ ID NO: 55442 - DNA, 201 bp, Homo sapiens; identical to SEQ ID NO: 10450

SEQ ID NO: 55443 - DNA, 201 bp, Homo sapiens
aagctggagtggacctgaggttcatcacctgtttccttccacccaccatttaaaagcagcttatttgtgtgaaactttttgttgggttctgtgggggataygaataggcaaatgacagggagcttataatttagccaaagagaaaatgtctatatgttctgtggaattcagagtattttcctcgacttccaaaattatttt

SEQ ID NO: 55444 - DNA, 201 bp, Homo sapiens
ccttacaaaaaaaaggaaattctgtcatttgtgatgacatggatgaacctggagggcattatgttaaatgaaataagccatgcacagaaagacaaatactstatgatctcagttatatgtggagtctgaaaaagttgaactcacagaagcagagaggagaacgatggttgccaaaagatgagatgtgggagtggaggggtg

SEQ ID NO: 55445 - DNA, 201 bp, Homo sapiens
gagttcccattgtcaaagaaagtatcttgaattaattttgttgtatgagatactttcattctgttttcaatgacctttctcggtgtgtatataggggttgsgggaagcgagaatagaaaaatttgagcttacctgaaaaagataaaacattctgcagattttgataaaagggcattttagctggggcttagatattgctgc

SEQ ID NO: 55446 - DNA, 201 bp, Homo sapiens
gagttgagattgtgccattgcactccagcctgggggacagagtgagaccaggtttttttaaaaaaaaagaaaaagaaaaaagaatcaccatatgactcagyattcctaattcctattacgggtatatatccaaaggaaatgaaatcggtatgccgaaggaatatgtgcattgtgttgtttactgtattaccattcacaata

SEQ ID NO: 55447 - DNA, 201 bp, Homo sapiens
caaacactaaccatccttcctagaaatgcagtggactttgtatttagggaaattagtaacaggtgaatgctccattttgctgatgttgcaaacaaactgtyagttggtgtaaagtattaattttgctttcacatttcttttggtttggtgtttagtcattcttgtatcttatttagaagcgagttcccattgtcaaagaaa

SEQ ID NO: 55448 - DNA, 201 bp, Homo sapiens
ctcatctctacaaaaaatagaaaaattagccaggcatggtggtatatgcctgtagtcccagctacttggggagactgaggtgggaggattgcttgagcccsagggacttgagactgcagtgagttgagattgtgccattgcactccagcctgggggacagagtgagaccaggtttttttaaaaaaaaagaaaaagaaaaaa

SEQ ID NO: 55449 - DNA, 201 bp, Homo sapiens
ctcgacttccaaaatttggggctactagctagttggtaggaaggaattccagatccatttttcttctagatttttttcagactccatgtttcaaaatctaratggaaggtaagaaggaagcaaggagggcatcacatacgagagagacttataccccaaagtggatcattagcacattatgagataatatggtattattct

SEQ ID NO: 55450 - DNA, 201 bp, Homo sapiens
acttgagaaaaatgtatattctgatttttttaggtgggtggcatgttctattaatatatatgtctgttagctctagttgaattatagtgatgttcaaagcytccattttgttattaatataaccatgccagatttttaatgctgtccatttgcataatatgtctctttccattctttttcttttacatgatcactttatat

SEQ ID NO: 55451 - DNA, 201 bp, Homo sapiens
tttctctgttgttattctccatttgttcattatatctatcttttctttgaaatccttgaaaatatttataatagctattttaaagtcctctgctaatcccratatctgggacatcttggcttctgttgatattgaatacttctttttttccccttaattaagggtttccttttcctgctttttcacatatctagtagattt

SEQ ID NO: 55452 - DNA, 201 bp, Homo sapiens
tatcctggaaaatgtatcatgtgcacttgagaaaaatgtatattctgatttttttaggtgggtggcatgttctattaatatatatgtctgttagctctagktgaattatagtgatgttcaaagcttccattttgttattaatataaccatgccagatttttaatgctgtccatttgcataatatgtctctttccattcttt

SEQ ID NO: 55453 - DNA, 201 bp, Homo sapiens; identical to SEQ ID NO: 10457

SEQ ID NO: 55454 - DNA, 201 bp, Homo sapiens
gggaggatttgctaggagtaactgcaggaagagaatgagcagggtggatgaaagaaacacgtttgttcttaagccgcacagatagcattactctctggagmtgtcacgagttcagtgttaatccaataagatctgtcttgcttgtggcacaagttcacactgttgtgaaagtgtcaaaacacaactcccggagagtcagat

SEQ ID NO: 55455 - DNA, 201 bp, Homo sapiens
tgcttttcttaatcatattaaggaagttcctttctagtcctagttttctgagtgtttttattatgaaagactttcagatttttgtaaaatgcttttcctgygttaattgagataatcatatgggttttctccccctttactctattgatgtaatgcattacaacgatttttttaaatgtttacccatctttgcattcctgg

SEQ ID NO: 55456 - DNA, 201 bp, Homo sapiens
gtatggctggtgatagaaaaactatgggaagaatggtctcactttttgaagaaaacataagcaagttatcagttcatactggaagcaaataaatggatcakctggaggatctaatagatcatgcccataaaatctttactttagatttaaatcctacaagttctatttttagagtccctaggataaacttgcatatacaaa

SEQ ID NO: 55457 - DNA, 201 bp, Homo sapiens
ccgcctcggcctcccaaagtgctgggattacaggcatgagccaccacgcccggcccataaatgcttttcttaatcatattaaggaagttcctttctagtcstagttttctgagtgtttttattatgaaagactttcagatttttgtaaaatgcttttcctgtgttaattgagataatcatatgggttttctccccctttac

SEQ ID NO: 55458 - DNA, 201 bp, Homo sapiens
gccctgctcagaatggaggtcttggtgttctttgtgggttcctcatactggagtgagccttggcaaaaatggtgtgtgtgtgtgtgtgtgtgtgtgagagwgagagagagagagagagagagaggagacaggagagaaggagaagaggggagaggggaggagggacagagagagagagaggtctcctacagagagcttgga

SEQ ID NO: 55459 - DNA, 201 bp, Homo sapiens
gttgaaatcagatgggaacagatcatttaggataaccagcaggctctaccacattgcctaactcccaggcatattgtgagaattaaaagcaccttatataygtcaacgtgttttgaaaaaatacaaaaagctctacaaaagtgagctataaatttatcattaataataatagtaataatagcaaaatacttgagaaatggt

SEQ ID NO: 55460 - DNA, 201 bp, Homo sapiens
ttagtgggtgtgagtgctcgttggggttttaatttgcattttcctgatagtgttgatgttgaggacatttctatgtgtttactgagcattggtgaagattstcttgtgaaatatctattcaaatattttgctcatggtgggaaggggagttatttttcttttactactgataggtaggcttacgtatttatttcggatata

SEQ ID NO: 55461 - DNA, 201 bp, Homo sapiens
tatctccccagcggggagggtttagggttgtctgtgggacctgcctctgtctcatcatccatcaccattgtcctgctgatgggtgcagaggactgaggacragtggttggagttctccctgtgccggaccctgtagagagtccagagccctggctcccaaaggaggcatatttgtagggctcttttcgtgagggtccagag

SEQ ID NO: 55462 - DNA, 201 bp, Homo sapiens
gaactcatccttttacaaggaacccatgcctgagatattgaacccacttctatgataacagcattaattcattgatgaggacagagacctcattgcctaaytggcctaaagtgagacctcttaaaggtcttgcttaatactattacaatggcaattaaatttcaacatgagttttggaggggcaagcattcaaatcatagc

SEQ ID NO: 55463 - DNA, 201 bp, Homo sapiens
ctctgcctggaatgcccttcccgtaccctctaccgcctctgcccaatcctccgggttctctgctccttccacacacccccatctcaggtcccagtcttttktagcattcttcactttttctgttacagatcctcagacaatgcttccttgaagaagacttgcctgtctaaactgccttcccatcccaatccctgttacctt

SEQ ID NO: 55464 - DNA, 201 bp, Homo sapiens
tcactgtaatgttggctgtggattttcataattttttgtttgtttgtttttttgtttgagacggagtttctcttgttgcctgggctggagtgcagtggcgygatctcggctcatcacaacctctgcctcctgggttcaagcgattctcctgcctcagcctccagagtagctgggattacaggtgcctgccaccacaccgac

SEQ ID NO: 55465 - DNA, 201 bp, Homo sapiens
cactatgtagtgaggacatagagcctctttaacattggtccctgttaggagaaagtttctcccataacatactaaatacatgttttaatagccgttccttstgaaaggtccaacttcactattttatttttttagtaaaatcttagttaacaaattaatggaggttaggtggaattttgccccaaaagtcctgtattttct

SEQ ID NO: 55466 - DNA, 201 bp, Homo sapiens
ccagagactggtttaatagagatcacctgtcagccagcaatgacgatgtgttagatgccacacagctccatcctatatattcagaggaaggaatgataacytgtcttactaggtagagaggcagtaaaacttactgctgtcctaaattgttgcctccagacaaatcactaagtgaaaggttgtaactttttgtcttcctta

SEQ ID NO: 55467 - DNA, 201 bp, Homo sapiens
aagtggtctcagattagtagcctctgtacatggaaactagcttacctcccggcgagcatcccaagagaactaggaggaagtggtatggacttctttttttyttcttcttcttcttttcacttattcttgatatcatgtagcttcatttctatcagagcagtcacatgcccacagattcaagggggagggtccacagatccg

SEQ ID NO: 55468 - DNA, 201 bp, Homo sapiens
ataggaaatattcaataccttgggtatctaccccagacgttatttttttcctagactcatacaacttacccttaatgtgcatgtgatttcttgttaatcaratattttgagctcaataatgtaaaactagggactattacagtcaaaatgattcatcctgaagccttctagttattttatttgtgactttgaatatacatt

SEQ ID NO: 55469 - DNA, 201 bp, Homo sapiens
tgatccgcggttgagcctggctgtggaccagagcatctctgttggcctcgcttacacaagtggtctcagattagtagcctctgtacatggaaactagcttmcctcccggcgagcatcccaagagaactaggaggaagtggtatggacttcttttttttttcttcttcttcttttcacttattcttgatatcatgtagcttc

SEQ ID NO: 55470 - DNA, 201 bp, Homo sapiens
tgtatttttgaaaatctcagagtagattttaagtattcttctttttctttctttttctttcttttcttcttttcttttcttttttcttttttgaaacagastcttgctctgttgccaaagctggagtacagtggtgtgatctcagctcactgcaacctccgcctcccgggttcaagtgattctcctgcctcagcctcctga

SEQ ID NO: 55471 - DNA, 201 bp, Homo sapiens
atattcataaagatccaacatcagactaatagaagttctggaaagagagaataaggaaatacaggtcaggaaatttgtaaagaaataatataataaaatgscccagaactgaagaacatgagcttttaactttaaagagccgactgagttcctagctcaatgaatgtatagacatgtaagggtattgaaagttcaccttca

SEQ ID NO: 55472 - DNA, 201 bp, Homo sapiens
ctcactgcaacctccgcctcccgggttcaagtgattctcctgcctcagcctcctgagtagctgggattacaggtgcctgccaccatgttggtgaatttttstatttttagtagagacaggagtttcaccatgttggccaggctggtctcgaactcctgaccttaggtggtccacctgcctcggcctctcaaagtgctggga

SEQ ID NO: 55473 - DNA, 201 bp, Homo sapiens
ctttccagctcacagtgatctgcctggaatgcctttttccgtctctccaggatctacatctttcaatataaggtttagaaactacctcctacaggaagacktccttgatttccctcagcaagaaagaatctttccttcctctgaatcgccattgcattaaaaaaaaaatccatcttctggcgttttcactttcagacttat

SEQ ID NO: 55474 - DNA, 201 bp, Homo sapiens
tggttgtaaaaaataaaaaccaaaataaagccaaaataaataagcagcagcactaggccgggcacagtgtctcacacctgtaatcccagcattttaggagrccgaggtgggtggatcacaggaggtcaggagtttgagaccagcctggtcagcatggtgaaaccctgtctctactaaaaatacaaaaattagccaggtgtg

SEQ ID NO: 55475 - DNA, 201 bp, Homo sapiens
ttctttgatttgttccctgttgtgccccaaagtgctagaatcatgccaggcacacaatagatgctcaataaatacttctggaatgaaaatccccctccacktagaccagtgagttccaaacttttttgatcttgacccatagtaagaaaggcattttccatgttgaatatacaccattgaaacaaaattttcacagaaaaa

SEQ ID NO: 55476 - DNA, 201 bp, Homo sapiens
ataaagccaaaataaataagcagcagcactaggccgggcacagtgtctcacacctgtaatcccagcattttaggaggccgaggtgggtggatcacaggagrtcaggagtttgagaccagcctggtcagcatggtgaaaccctgtctctactaaaaatacaaaaattagccaggtgtggtggtgtgcccttataatcccagc

SEQ ID NO: 55477 - DNA, 201 bp, Homo sapiens
attccagttttaaaaaatttgtgttttcttattcaaaaagcaatacatatttcgttacataaaagtcagaaaatcagagaagcagaagaacataataaatrcccactgtcctactcaatagagactataactgctatctctgtacaaatcctttaaaatcctgtcttatgtgtatttattttacatctgtacatatgattc

SEQ ID NO: 55478 - DNA, 201 bp, Homo sapiens
tcgctcttgttccccaggctggagtgcagtggcagcgatctcagctcactgcagcttctgccacgtgggtccaagcgattctcctgcctcagcctcccgartacctgggattacaggcatgtgccaccacacctggctaagtttcgtattttcagtagagacggggtttcaccatgttggtcaggctggtctcgaagtcct

SEQ ID NO: 55479 - DNA, 201 bp, Homo sapiens
gcaggtgcctgtaatcccagctacttgggaggctgaggcaggagaatcgtttgaacatgggaggcagaggttgtagtgagctgagatcgcaccattgcacwccatcctgagcaacaagagcgaaactccatctcaaaaaaatgtattttgtacataactagaataatcaactggattgaaagttaatataaattttagaat

SEQ ID NO: 55480 - DNA, 201 bp, Homo sapiens
tttctaagtattttacgattttggtaccactgtaagtggcattgtatttaaaatttattttctgtttgttttctgttcatatataaatgcaattgattttyttttttttttttttttttttttttttttttgagacagaggcttactttgtcacccaggctggagtgcagtggcgtgatcagcactcactgcagacttgaa

SEQ ID NO: 55481 - DNA, 201 bp, Homo sapiens; identical to SEQ ID NO: 10471

SEQ ID NO: 55482 - DNA, 201 bp, Homo sapiens
cacctgccgccatgcctggctaattttttgtatttttagtagagacggggtttcaccgtgttagtcgggatggtctcgatctcctgaccttgtgatccacycacctcggcctcccaaagtgctgggattacaggcgtgagccaccgcgcctggccctatttttttttttttaaaggaatttatttcctcacagttctgttg

SEQ ID NO: 55483 - DNA, 201 bp, Homo sapiens
aaatcccagttactagacttcccagtattaataattttggtatgccaggaatttttaaaacatttctaacaaattttttcagaaatcagaatgactgaaakgtataacaataggaaattaggaaatcaataagtaatcattgaaaagtgagtgattgaattagttggaacaatctatgccatccatcctgtgggggaaaaa

SEQ ID NO: 55484 - DNA, 201 bp, Homo sapiens
tattcagttagttttttatatacacatttaagcttttgctaatctaccttgtgatttcttcattgacttattgcttgtttgagtgtgtcaacaatttccaygtatttgtgaatattctagttttccttttgttattgatttctagtttcatttcattgtggtaagaaacaatactttttatgatctcaacagtttaaaatt

SEQ ID NO: 55485 - DNA, 201 bp, Homo sapiens
agtagagacggggtttcaccgtgttagtcgggatggtctcgatctcctgaccttgtgatccacccacctcggcctcccaaagtgctgggattacaggcgtkagccaccgcgcctggccctatttttttttttttaaaggaatttatttcctcacagttctgttggctgggaagtccaagggcaagtctctggcatctggtg

SEQ ID NO: 55486 - DNA, 201 bp, Homo sapiens
tagaaggtgatgtctgtgactggtgagccgagagcttgtggggttggtgttgtatttgggtgcatgtgaatcagtgcatctcctgctccattggtgttaaraggctcccatcgtcctgggaacacaataggaaagagaacaggtgggaaggcactggatgaaggaatgtggagaatggaggaaaagttgatcagattgttg

SEQ ID NO: 55487 - DNA, 201 bp, Homo sapiens
aagattaacataccaggaataattagaaagcattgcaagactatatgtaaccatctccctgttaatcatccttagttgttgcaacatcctaaatagtgacyttcccacactctgcctcataatatttaatctgtcaaatgtaccatctgcaaagggagtgaactggctcgtgaagaggtggtgaagctggttcaactcagt

SEQ ID NO: 55488 - DNA, 201 bp, Homo sapiens
tttggtgaaaaataaatcccagttactagacttcccagtattaataattttggtatgccaggaatttttaaaacatttctaacaaattttttcagaaatcrgaatgactgaaaggtataacaataggaaattaggaaatcaataagtaatcattgaaaagtgagtgattgaattagttggaacaatctatgccatccatcc

SEQ ID NO: 55489 - DNA, 201 bp, Homo sapiens
gattttgctcatttctgtattcttagcacttatatatccaacatataataggtgttggataatatttgttgaataaatgactaaataaatgtcttggcatragaattatgccatctacaaaaccgtcacttttaaaaaaaacaacaaagatttttgaacctgtagatccagccagaaagcaagaaatatcttcacctttcc

SEQ ID NO: 55490 - DNA, 201 bp, Homo sapiens
ggagcttctttgggcctccgagtgggagaaaagtgagagcaggtgcttccccagcggcgcgctccgctagggcccggcaggatcccgcccccaagtcgggraaagttggtcggcgccttttctccccgacgaagccgctccagggctgctctcagaggacgcgcggcaggcaaagagaatgaacctgagcgtccacgaaac

SEQ ID NO: 55491 - DNA, 201 bp, Homo sapiens
agaagtttgagaccagcctgggcaacatagtgagaccttgtctctactaaaaatcacaaaaattagctgggcacggtggcatatacgcctgcagattcagytacttgggaggagaggcgggaggattgcttgagcttgggaggtccagctgcagtgaatcatgatcacagcactgcaatctggcctgggtgacagagcaag

SEQ ID NO: 55492 - DNA, 201 bp, Homo sapiens
ggattacaggtgcctgccaccacaccgactaattttgtatttttagtagagacggggtttctcgatgttggtcaggctgctctcgaactcctgacctcagdtgatccgcccgcctcggcctcccaaagtgctgggattacaggcatgagccaccacgcccggcccataaatgcttttcttaatcatattaaggaagttcct

SEQ ID NO: 55493 - DNA, 201 bp, Homo sapiens
tcccagcactttgggaggctgaggcaggtggatcatctgaggtcagaagttcaagaccagcctgaccaacatggtgaaaccccgtctctactgaaaatacraaaattatccaggtgtagtgatgcacacctgtaatctcagctactcgggaggctgaggcagaagaatcacttgaactggggacgtggaggctgcagtgag

SEQ ID NO: 55494 - DNA, 201 bp, Homo sapiens
cctccaggatacgaggaaggtcgtgtacaaagaggctgaaaaggctggggatggttttagggcttgtgggagtgggcccagtggaggaagggaggaaagcraaggatagaggagaactgtaggcaacgaattcaagtgtgtccagaaagtcagagcatgcctgagttgagaaagtggagtggaagggcaaggcagtaatat

SEQ ID NO: 55495 - DNA, 201 bp, Homo sapiens
gaaagaccagtgcacaggcaattgaacgagaaacaggaatgtcggaattcgagggcttaggagtgaagcatttccagcttgcatcaagaggactgatgaargagaagccagccgttggaggggaagctcagggagtgttcctccaggatacgaggaaggtcgtgtacaaagaggctgaaaaggctggggatggttttaggg

SEQ ID NO: 55496 - DNA, 201 bp, Homo sapiens
gagctgagggaaaccagaaattaggtaatgggcttgcagccttggggagagccccagagtggagtagtacctctgaatctgcatgctctgggatgtgctgsctaaatgcagaagaccaggccttttcccctcccagcccacgctttcgaaagtgcctttgggggaagatggcggcagcacccatggcttggtaagggatca

SEQ ID NO: 55497 - DNA, 201 bp, Homo sapiens
acaggacacctacaatatggtgaaatcttgttttacatgatttctgcataccagaaaagacttggtgactactactcaagtcccccgacctctgctttttyttttttttttttttttttttttttttttttacccattgggttagagaagaaaacaatttcaacctacatattattgagataaaaaggcagagaaagaaga

SEQ ID NO: 55498 - DNA, 201 bp, Homo sapiens
atagtgttccaaggtcacagtattgcatttaaggcatattggttttataaccatattttttcccctttaaattatgagaaccacgagtctctggtaagtarccccaaggcttcaaaatacaacatttcaatcaacagggggcagtagtggtaagccagagaggacacaacagagatataattagaggaagatggatgggtc

SEQ ID NO: 55499 - DNA, 201 bp, Homo sapiens
ctgataaacaacacttgtatttgtaggaaaatagggagagtaaatcaaggaattcaaagagaaagagaaactcacttcaagtaggggagaaaaaacccctrtaattttcactcttccttgtaaataaaaaggaaacaaatgaaaataagatattagaagtcagtaagaatttatgggagtataaagttggttttatggatg

SEQ ID NO: 55500 - DNA, 201 bp, Homo sapiens
gctgtcctaaattgttgcctccagacaaatcactaagtgaaaggttgtaactttttgtcttccttatccacatgtctttcaactagtcagtaatctttctstctcaggctgagttctttatctgtaaacaaaaacagtattttagaggaaccctttatgtcatctccaaatacttagtttcctagaatgtgtagcttttcc

SEQ ID NO: 55501 - DNA, 201 bp, Homo sapiens
gtctccagtaataattctgtgattaatgggttagatggattctggtcacaagctggatattttgttaacaacctagcgtcaatgacttggaatgattttcrccgcagcatgatttagtattgaatagaatgatttaactaatgttaattagttctgtacagataaattaatgaagcaagaagctcaatctctgatttattg

SEQ ID NO: 55502 - DNA, 201 bp, Homo sapiens
tggtgtgatctcggctcactgcaacctctgcctcccaggttcaagggattttcatgcctcagcatcccaagcagctgggactacagaggcgtgccaccacrcccagctaatttttgtatttttagtagagatggggtttcaccatgttgcccaagttggtctcgaactcctggcttcaagtgattcgcccgcctcagcctc

SEQ ID NO: 55503 - DNA, 201 bp, Homo sapiens
tccgccgttcattttgccctgctttggaaggacggttttccagtttcattagtgacacgtcattttatctttgacttccacagtcaatacttagaatctgrcttggtcctgttggctcatgcctgtaatccccacactttggcaggccaaggcaggaggatcaattgaggctagaaatttgagaccagcctgggcaacata

SEQ ID NO: 55504 - DNA, 201 bp, Homo sapiens
ggctaagttagaaagtgttctttcttctattttttgaagagcttgaaaagagtcgtgttaattcttctttaaatatttggtacaattcactattaaagccrctagtcctgggcttttcttagtttgatagtttttgattactaattcaatctcttttacacctagattagattttgtattttttccttagccacttttggt

SEQ ID NO: 55505 - DNA, 201 bp, Homo sapiens
atcgatgacgggctgcatgctgaggacgaccagctgagggtgtattatatgcagaattacataaacgaagctctcaaaggtaaggagccctagctgcggcwatctcctgaaggttatgtcaccagagggcatgacacttgattaaatctccaacatcaacacacactgccacccttggaatggagggctatccattttgtg

SEQ ID NO: 55506 - DNA, 201 bp, Homo sapiens
ttttttttttttttttttttttttttttttttacccattgggttagagaagaaaacaatttcaacctacatattattgagataaaaaggcagagaaagaaraacaagaccaggctcaaaatgaccttacagttgggtagttttgggtaacgcaatccttggtgaacctcagtttcctcatctttgaaatgggagtgtctat

SEQ ID NO: 55507 - DNA, 201 bp, Homo sapiens
actcccccagtcaggtggcggtagtgccctgggggttgcgcaaagtgctgaactggctgaagttcaagtacggagacctccccatgtacataatatccaayggaatcgatgacgggctgcatgctgaggacgaccagctgagggtgtattatatgcagaattacataaacgaagctctcaaaggtaaggagccctagctgc

SEQ ID NO: 55508 - DNA, 201 bp, Homo sapiens; identical to SEQ ID NO: 10453

SEQ ID NO: 55509 - DNA, 201 bp, Homo sapiens; identical to SEQ ID NO: 10455

SEQ ID NO: 55510 - DNA, 201 bp, Homo sapiens
ttccaaacatctctcagattgccctgttgttttgcttttcagtagtcatcacctttgtccagaaccttaattgtatctgcattttggcagtatcctgccarttttccacatccagctgttcacattctaatgcattctgcaatggatgattttgagcatatgactgatcatcactgtctcagaaatttatgctaatctatt

SEQ ID NO: 55511 - DNA, 201 bp, Homo sapiens
taaaatctactttctttttttttttttgagatggagtcttgctgtgttgcccaggctggagtgcagtggcacaatcttggctcactgcaatctctgcttcstgggttcaagcaattctcctgtctcagcctcccgagtagctgggattacaggcacctgtatttttagtagagacggggtttcaccatgttggtcaggctg

SEQ ID NO: 55512 - DNA, 201 bp, Homo sapiens
gcctgccaccacaccgactaattttgtatttttagtagagacggggtttctcgatgttggtcaggctgctctcgaactcctgacctcaggtgatccgcccrcctcggcctcccaaagtgctgggattacaggcatgagccaccacgcccggcccataaatgcttttcttaatcatattaaggaagttcctttctagtccta

SEQ ID NO: 55513 - DNA, 201 bp, Homo sapiens
gcaggacaggcagacctgatccaattaacccctgggtttcaaccctgctaaatgcagctcaatatttgtcttgataatttgcctatttggctttacataarataaagccttttctgatgaaatctaattgagtctgaagttgtattaaatggtatcggaaacttcccagcaggaaggctacgtaaaagtggccgggcgtgg

SEQ ID NO: 55514 - DNA, 201 bp, Homo sapiens
aaaatctactttctttttttttttttgagatggagtcttgctgtgttgcccaggctggagtgcagtggcacaatcttggctcactgcaatctctgcttccygggttcaagcaattctcctgtctcagcctcccgagtagctgggattacaggcacctgtatttttagtagagacggggtttcaccatgttggtcaggctgg

SEQ ID NO: 55515 - DNA, 201 bp, Homo sapiens
atttgtcttgataatttgcctatttggctttacataaaataaagccttttctgatgaaatctaattgagtctgaagttgtattaaatggtatcggaaactycccagcaggaaggctacgtaaaagtggccgggcgtggtgactcacgcctgtaatcccagcactttgggaggctgaggcaggcagatcacaaggtcaagaa

SEQ ID NO: 55516 - DNA, 201 bp, Homo sapiens
tgtctcagcctcccgagtagctgggattacaggcacctgtatttttagtagagacggggtttcaccatgttggtcaggctggtcttgaactcctgacctcrtgatccacctgccttggcctcccaaagtgctgggattacaggcgtgagccactgcacccagcccctaaaatctgctttcatagcatctgtcttgtacttg

SEQ ID NO: 55517 - DNA, 201 bp, Homo sapiens
tccagaaaacccacagggaaccttgagcaaagggtggaaatgccactaataatggtgacaggacacctacaatatggtgaaatcttgttttacatgatttytgcataccagaaaagacttggtgactactactcaagtcccccgacctctgcttttttttttttttttttttttttttttttttttttacccattgggtta

SEQ ID NO: 55518 - DNA, 201 bp, Homo sapiens
ctcccaaagtgctgggattacagtcttgagccactgtgcccggccagcatctttgaacatatcaatttgtaagttttatcttaatattgtacaagtctttkggggggcttatgttgtcatttctcttggtaaatacctaggtatgaacttgctagattatagagaaaatctatctttaattttataagaaactgtcaaata

SEQ ID NO: 55519 - DNA, 201 bp, Homo sapiens
atcattacatgataactcaaatagcagtcctgaaaaagtgcatttcaattcagatctctcttttttcttccttcacaattctcatttccgaaaaatgaaakaagccagaggatcctttatgaggagttacagtataacttatgcgtggctgtttcctgtgtttactgctactcagtgagaaatacgggagatgggagagtg

SEQ ID NO: 55520 - DNA, 201 bp, Homo sapiens
gtttcattagtgacacgtcattttatctttgacttccacagtcaatacttagaatctggcttggtcctgttggctcatgcctgtaatccccacactttggsaggccaaggcaggaggatcaattgaggctagaaatttgagaccagcctgggcaacatagtgagacccgtctctacaaaaacttctaaaaattagccgggc

SEQ ID NO: 55521 - DNA, 201 bp, Homo sapiens
cacaagtggtctcagattagtagcctctgtacatggaaactagcttacctcccggcgagcatcccaagagaactaggaggaagtggtatggacttcttttytttttcttcttcttcttttcacttattcttgatatcatgtagcttcatttctatcagagcagtcacatgcccacagattcaagggggagggtccacagat

SEQ ID NO: 55522 - DNA, 201 bp, Homo sapiens
ttgagcctggctgtggaccagagcatctctgttggcctcgcttacacaagtggtctcagattagtagcctctgtacatggaaactagcttacctcccggcragcatcccaagagaactaggaggaagtggtatggacttcttttttttttcttcttcttcttttcacttattcttgatatcatgtagcttcatttctatca

SEQ ID NO: 55523 - DNA, 201 bp, Homo sapiens; identical to SEQ ID NO: 10460

SEQ ID NO: 55524 - DNA, 201 bp, Homo sapiens; identical to SEQ ID NO: 10463

SEQ ID NO: 55525 - DNA, 201 bp, Homo sapiens
aaaatatttagtaaaatatttgaaaagtaaggtcaaagcaatgctgtaaaagtagtacaagatgataaagaaatagaacacatttttgaaagggaaaaagmtttaaaggatattcataaagatccaacatcagactaatagaagttctggaaagagagaataaggaaatacaggtcaggaaatttgtaaagaaataatata

SEQ ID NO: 55526 - DNA, 201 bp, Homo sapiens
tgtttaaatttgagctgaatgtagaggactttaactatctttcatattacttatgaactatgtgttttaaaccatgctttaaactagtaaaaggctgtggractatcctgagccaaagaatcatttcaccatcttttctatacttcttgagttttatagtaaacacacagttaatgtgagattgttattagctaaaagaag

SEQ ID NO: 55527 - DNA, 201 bp, Homo sapiens
acttgatagaagtgagagagcaattgttgataccaatggaatcacggtttttggaacaaggattttggatgaagaagtttttgaggtaaaaataaatccarctctaagctgaatattgacaaatcagatgaactgggttaacaacagtaaaaatatcgctttatagcaatacgttataaagcaaagttgaaaactctaaag

SEQ ID NO: 55528 - DNA, 201 bp, Homo sapiens
taaacgctgatgttataaaaagttgcaatgttccctaagttctttcactaaagagtcaactttaaatgcagttttcagtgtagctttcagtatacactaaygcactttctacatgaggacatattccttctaaattctcttgcaatttaattcaaaacctaaaggtattttttttccattttaaaatactttctgttttag

SEQ ID NO: 55529 - DNA, 201 bp, Homo sapiens
ggatagctacctgatagacttgtaaacattctacttctttccatatgctaatcttatttgtattgatttaacagggtgaacgaggtcctcaaggtcctccrggtcctcctggtgatgatggaatgagggtatgttaatacttcttttcttaagaaatatttaaaattaaaacataataaaacaaaatcatgttgaaatgat

SEQ ID NO: 55530 - DNA, 201 bp, Homo sapiens
attatactgtgaaagcatttatcatgagtttttatactcacaattaactataccattttatgtaaatatggagtttaaaaaatgctgagatatctccatcrttgtatacaatttttaatgattatgtttaggtatttaaaagccagaattttattagatacacttttattttctccttacttttggagaagtaatcaagca

SEQ ID NO: 55531 - DNA, 201 bp, Homo sapiens
cattgtccaaatgttctatactctcattcattttgtcaatgacagggagaagatggagaaattggaccaagaggtcttccaggtgaagctgtaagcaactyactttttatttttaagtaatatttctagtttttaggactagtgactggtgttacacatataaaaacaatgataaacccaggtaaacattgcagtcttagc

SEQ ID NO: 55532 - DNA, 201 bp, Homo sapiens
atggatgaaatacaagctccgagagacacttttgcatggattcagggattattttactgaagctatttatttttattttccacattgagcctttctgtggmgatatgtgaatattttttaatatcaaatttctgtacttttcatgcataaattttctattttcagtctagcaacatacctgaaacacttttaaacagcatc

SEQ ID NO: 55533 - DNA, 201 bp, Homo sapiens
taatgatttattacattttgctaagtatattagatacagcttgcattaatattttgaaatattttccagaatctcatgagggaaaactgtttgagggtggrtagaggtattttccaattgagaagaacaaaaatctattgtgtaatatagcccattaaaaactttttatattttcctctggcagggtccccaaggggagcc

SEQ ID NO: 55534 - DNA, 201 bp, Homo sapiens
tttaattggattacttgtttttttctattgagttgtttgagttccttacatgtttttaatattaaccccttatcagatgtatagtttgcaaatattttctyctgttctaaaggttgtctcttcactttgttaattttttcttttgctttgtaaatactttttagttaaatgtaatcctatttggatgtggtagggctggga

SEQ ID NO: 55535 - DNA, 201 bp, Homo sapiens
tgctatctttctataagaaaatcgacagtctcacaattttctatgtagtcctagcaatatttaaaatgtgaatgtaggaaaatacatacttttcttttttyaaaaaaatttgagcaaacttgcagaagcccctctcttcccagggaaaaatgactcattcaatgtttagggaatgccaggactaatagccacctgcaggag

SEQ ID NO: 55536 - DNA, 201 bp, Homo sapiens
ttgagcatttttttcatatacccgttagccatttgtatgtcttcttcaagatatgtttattcagacatcttgtccatttttaattggattacttgtttttktctattgagttgtttgagttccttacatgtttttaatattaaccccttatcagatgtatagtttgcaaatattttctcctgttctaaaggttgtctcttc

SEQ ID NO: 55537 - DNA, 201 bp, Homo sapiens
agggttgatggataatataacataggagtgcaggtatctctttgacatactgattgcatttcctttgtatgtatactcagtagtgcgattgatggcactasctctaattttttgaggaaattttttactattttctatatggctgtattaatttacattttcaccaatagtatgaaacagttcctttttctctacatctgc

SEQ ID NO: 55538 - DNA, 201 bp, Homo sapiens
cttcaacatcctgatgtcatttacttaggacatatacccagtagtagggttgatggataatataacataggagtgcaggtatctctttgacatactgattkcatttcctttgtatgtatactcagtagtgcgattgatggcactagctctaattttttgaggaaattttttactattttctatatggctgtattaatttac

SEQ ID NO: 55539 - DNA, 201 bp, Homo sapiens
gccaagaacacatagctaggagatggtgggttgattccatatattggctattatgaataatattgcaataaatattggactgcagatatcccttcaacatmctgatgtcatttacttaggacatatacccagtagtagggttgatggataatataacataggagtgcaggtatctctttgacatactgattgcatttcctt

SEQ ID NO: 55540 - DNA, 201 bp, Homo sapiens
atatataggaaactttaaattccagatgcacatatgcctatgtacacacacacacacacacacacacacacacacacagacacagacacacacacacacasagacaccccttctgtgttgcttaaccataatttgattccagatttgagatattttgaatttgagaatgttgttatggtttatattactacctgctgcccc

SEQ ID NO: 55541 - DNA, 201 bp, Homo sapiens
ttataaattataattgagatacatatgaatgtttataaatcatatataggaaactttaaattccagatgcacatatgcctatgtacacacacacacacacrcacacacacacacacacagacacagacacacacacacacacagacaccccttctgtgttgcttaaccataatttgattccagatttgagatattttgaat

SEQ ID NO: 55542 - DNA, 201 bp, Homo sapiens
atgcatatatatatatatatatatatatatatatatatatatatattttagagttttaacttgttgagtttactgctttttatgctacatatgacttagtrtatttagttatttttattaaaaactgaatttaacttatgtttaataatatctatatcttgattgaaaattaaaatttttataaagatattgagctttgga

SEQ ID NO: 55543 - DNA, 201 bp, Homo sapiens
gtattatcatatatgtttgccctaggcaattatatataaattgccccggcatgcatgcatatatatatatatatatatatatatatatatatatatatatwttagagttttaacttgttgagtttactgctttttatgctacatatgacttagtgtatttagttatttttattaaaaactgaatttaacttatgtttaata

SEQ ID NO: 55544 - DNA, 201 bp, Homo sapiens
atccccaaaatgtgtacagagaattgctgtctctaaatggtcccagtctggttgagtgggtatatgtgccctaccatgagatggtgtcctgtccaggactrgttcccgccctgcgtcctgaatgtttgggttgggctccagccatttggggccctgaactgggataagcaggttggaaatgaatgaacaaatgaatgaatg

SEQ ID NO: 55545 - DNA, 201 bp, Homo sapiens
ggaggcagaggcgggcggattacctgagctcaggcattctaaaccagcttgggcaacacggcgaaaaccgatctctactaaaaatacaaaaaaaaaaaaaaattagctaggtgtggtggcgggcgcctgtagtctcagctactcgggaggctgaggcaggagaatggcgtgaacccggcaggcgagcttgcagtgagcgga

SEQ ID NO: 55546 - DNA, 201 bp, Homo sapiens
tttgattttattgaaatcatacaaatttattgataggtgatgtttaatgtatccttaggaacacttttttttttcttaatataaatgcatcaaactcatgytttttttatttttaatctggatttttctggtgtcttcatttctcattcatctttgtaggtagggatttcttttgatactaatttttctaacagaacataa

SEQ ID NO: 55547 - DNA, 201 bp, Homo sapiens
tgtaggcgtaagtactgtgttattgttaacatagtgtattattggtttgggaatttcttttacagcattacaaacatgtaacaactcttagctgtggttcraattttactttcccttcccaactcattaaggaaaatcacaaatacaaagccttgtttaataactttggatatctttacatatgtggattgataaacaaat

SEQ ID NO: 55548 - DNA, 201 bp, Homo sapiens
aattctattattaaatattactaatgttttgattttattgaaatcatacaaatttattgataggtgatgtttaatgtatccttaggaacacttttttttttcttaatataaatgcatcaaactcatgctttttttatttttaatctggatttttctggtgtcttcatttctcattcatctttgtaggtagggatttctttt

SEQ ID NO: 55549 - DNA, 201 bp, Homo sapiens
tcattctagggtcctgttggttttcctggagatcctggtcctcctggggaacctggccctgcagtaagtatcagggaaaaatcaagaaattattttggagkgaatgtttccaatttctgtattgttaataaagaaaaaaaaatctaataacctaagtgaactcccaaaaacagaaagaaaaagaaaacataaaaagtaatt

SEQ ID NO: 55550 - DNA, 201 bp, Homo sapiens
tccaatttctgtattgttaataaagaaaaaaaaatctaataacctaagtgaactcccaaaaacagaaagaaaaagaaaacataaaaagtaattgcaaatgyaggaaaatccatatagttggagactattgcaccaacactaagtgattaagctcttcatgcaacataggtacaacaattggattagattcctagactttga

SEQ ID NO: 55551 - DNA, 201 bp, Homo sapiens
actctttaggtaattctattattaaatattactaatgttttgattttattgaaatcatacaaatttattgataggtgatgtttaatgtatccttaggaacwcttttttttttcttaatataaatgcatcaaactcatgctttttttatttttaatctggatttttctggtgtcttcatttctcattcatctttgtaggtag

SEQ ID NO: 55552 - DNA, 201 bp, Homo sapiens
cacagatttatattaaattagtttcatgatgaaataaagtccagatggaagtagccacattacgtcaagagcagaatatttggatttttctcttgtttgcmgtttccaaaagctcttgaaattaaaactctttaggtaattctattattaaatattactaatgttttgattttattgaaatcatacaaatttattgatagg

SEQ ID NO: 55553 - DNA, 201 bp, Homo sapiens
tgcgtaggctttagcagaaacttgagtgtggccctgggtctagatgccaagatctgagctctccctaatgagagtcagccctcccggaggccgatctctgmgaccaggttattccttccacacgcttagtggctttcagcttcccgagtagcaggcagcgctagattattcccttgggtgacttttcctgctaaatacagt

SEQ ID NO: 55554 - DNA, 201 bp, Homo sapiens
taaaaactttttatattttcctctggcagggtccccaaggggagcctgggcctccaggtcaacaagggaatccaggacctcaggtaagtctaagccactgmagctcctttgaaataatggggggaagatgctatctttctataagaaaatcgacagtctcacaattttctatgtagtcctagcaatatttaaaatgtgaat

SEQ ID NO: 55555 - DNA, 201 bp, Homo sapiens
atctggtgtgagtcttcagatttttgatgcacatgcatttggtttcagacttaaatgattaggtgcgaatggtggaggcataaaacaattacatacgatgwctagaaataatattcacttcaagtcaagaatactgtcaaatggtatcagggtggatcaatctgtgaagaaatgatagaggtgagaaagaggatcctactt

SEQ ID NO: 55556 - DNA, 201 bp, Homo sapiens
tatctggtgtgagtcttcagatttttgatgcacatgcatttggtttcagacttaaatgattaggtgcgaatggtggaggcataaaacaattacatacgatstctagaaataatattcacttcaagtcaagaatactgtcaaatggtatcagggtggatcaatctgtgaagaaatgatagaggtgagaaagaggatcctact

SEQ ID NO: 55557 - DNA, 201 bp, Homo sapiens
cctccaggtcaacaagggaatccaggacctcaggtaagtctaagccactgcagctcctttgaaataatggggggaagatgctatctttctataagaaaatmgacagtctcacaattttctatgtagtcctagcaatatttaaaatgtgaatgtaggaaaatacatacttttctttttttaaaaaaatttgagcaaacttgc

SEQ ID NO: 55558 - DNA, 201 bp, Homo sapiens
cagtgataatgttgataagaaaaaaaaaaagtccgttcccagtcagggccactatgtggcgattacatgttctccctgtgcctccgtgggatttcactggrcactctggtttccttccacatccccaaaatgtgtacagagaattgctgtctctaaatggtcccagtctggttgagtgggtatatgtgccctaccatgaga

SEQ ID NO: 55559 - DNA, 201 bp, Homo sapiens
tgttctaaaattccttggggtgtatgggaatatatacagattcttataactcactatgtactatagtgagctaataatttgctgttttaaaagcatattaytgtgatttgatatctgatatatgaaataaattcttttaaaatagggtcttcctggtccacaaggtccaattggtcctcctggtgaaaaagtaagttactc

SEQ ID NO: 55560 - DNA, 201 bp, Homo sapiens
taaggaattatgtgtagattgcccctggaaaatatatattaagtatacatattatatgtattatcatatatgtttgccctaggcaattatatataaattgscccggcatgcatgcatatatatatatatatatatatatatatatatatatatatattttagagttttaacttgttgagtttactgctttttatgctacat

SEQ ID NO: 55561 - DNA, 201 bp, Homo sapiens
aattctggcagcttcacaaatacgtatttctaaacttgcattcatttcactattttacatttgagagaagatgtaaaaagtaatttttaaaatatctgaakagtcgacagaaaaatcagtttgtacacaagtttggaaacagccaatatatacaaattttccatctgtgagacgatgagggataatgaagatggtaaatac

SEQ ID NO: 55562 - DNA, 201 bp, Homo sapiens
ttaatccctgtaaagaacttagtccagagactggcacatattaggctctccctggcagttattatgattagcattttcttagttatgaggtaagagaaaakaacacatataaaacagatatcctattggcttaaaaacatagccgttgcaagcaggactagtgcaaaaaaatgttctcaaacatcattataatttttatat

SEQ ID NO: 55563 - DNA, 201 bp, Homo sapiens
tctatttcagggtccccctggtccacaaggtcctattggatacccgggcccccggggagtaaaggtaacgttaaattgttttcacattatttactttcaawgtgaaatgttatattcacttaatacttctaatttattccacagggagcagatggtgtcagaggtctcaagggatctaaaggtgaaaaggtaaaatttaat

SEQ ID NO: 55564 - DNA, 201 bp, Homo sapiens
gtgagtggtgaagtggaaggagcatagagttggtatttacacagatcttaagagtaatcttagtttgttctctggttcttaaatctcaatctgcacaggasggataagaacatatggtttgtgagggttaatccctgtaaagaacttagtccagagactggcacatattaggctctccctggcagttattatgattagcat

SEQ ID NO: 55565 - DNA, 201 bp, Homo sapiens
tttattttggggtatagcagggtgagtggtgaagtggaaggagcatagagttggtatttacacagatcttaagagtaatcttagtttgttctctggttctyaaatctcaatctgcacaggacggataagaacatatggtttgtgagggttaatccctgtaaagaacttagtccagagactggcacatattaggctctccct

SEQ ID NO: 55566 - DNA, 201 bp, Homo sapiens
aaacaaacaaacaaaatagatacgttgtggactttgcagtccattttatgtattatttacctctgcccaattgtgattatgacagtggggatgcattttgkttttccttttcagaaaaattacagccttcatagatgtgttcatgtctatcctcaagtctttattcagttctactttggagaatggcttcagagcaaaaat

SEQ ID NO: 55567 - DNA, 201 bp, Homo sapiens
cctgggcaacagagcaagactccgtctcaaaaacaaacaaacaaacaaacaaaatagatacgttgtggactttgcagtccattttatgtattatttacctytgcccaattgtgattatgacagtggggatgcattttgtttttccttttcagaaaaattacagccttcatagatgtgttcatgtctatcctcaagtcttta

SEQ ID NO: 55568 - DNA, 201 bp, Homo sapiens
caaaaaattagccgggcgtggtggcgggcgcctggagtcccagctactcaggaggctgaggcaggagagtggcgtgaacctgggaggcggggcttgcagckagccgagatcgcgccactgcactccagcctgggcaacagagcaagactccgtctcaaaaacaaacaaacaaacaaacaaaatagatacgttgtggacttt

SEQ ID NO: 55569 - DNA, 201 bp, Homo sapiens
gcaaataattttaaaaaagtatgaaaggtgctataatagaggttagcagatctaacccagcttagggagacagagaatgttttctgcagaagatgcattaycaggtatattcttatccttcaggtgaggtggagctaagtgtttgaaacagagagtagggtttataaaggcccagaagcaagccagagaacatggtggatt

SEQ ID NO: 55570 - DNA, 201 bp, Homo sapiens
atatagaaacggaggcccagagtaattaagtaatctgtccaagtcacacagatgctaagaggcagaggtggacttaagaagcagttttgctctttaacackgtaatgatgcggttcactactggtcatgggagtgtgcaaagaagcttagagaaggaattagagatgaaacaatcaaagtattatgagatgtttcatcagt

SEQ ID NO: 55571 - DNA, 201 bp, Homo sapiens
aatctaaatccttacagctccctgattaaatttgtatactgtcccataaccagtcaattttgtggggtaataagttttgtttgtatgtttgacattaaaayaaatttaaattatcaaatatagctagccgtgctgattcttagaaacaaaacatattgtaacttcatttgaaagtaagtaataatttgttgaaaattcctt

SEQ ID NO: 55572 - DNA, 201 bp, Homo sapiens
atgtccaaatatttttattctaaaaataaccttaggatttcttcattgaaagaggcatgttattaggacattttttttttttaataaaggcgtgctttttmtttttctcctagggcccacgaggtttgctgggtccaaggggaactccaggagctccagggcagcctgtatgtattgctggaaacattgaagattttctag

SEQ ID NO: 55573 - DNA, 201 bp, Homo sapiens
taacccggtaagtgagtttggtcccctctaatgtggcatttatgccaaactcaccttggagcttttcttagaaagatttgaaatcctgagactctggaacrtagatggtaaatctgacttttcatcatttcatatattcgtaagcattctcaattgaattaattctttagaaattttttggcgggagaagagaaatattct

SEQ ID NO: 55574 - DNA, 201 bp, Homo sapiens
taattaagaaagaaaacaaaataagctatcactatttaaaaaaattaacattatatgttttctatctggattttaaaatataaaggtgtgttcactaattrtttctctaaatactatctttgtaaatgtgtagaaggtcttccataaaatatgaacttaagcagaatgttggatgtgagtaggcacagatgataacataat

SEQ ID NO: 55575 - DNA, 201 bp, Homo sapiens
tttatgccaaactcaccttggagcttttcttagaaagatttgaaatcctgagactctggaacatagatggtaaatctgacttttcatcatttcatatattygtaagcattctcaattgaattaattctttagaaattttttggcgggagaagagaaatattctcagcaggttttgtcatgactttaacctcttcacctcca

SEQ ID NO: 55576 - DNA, 201 bp, Homo sapiens
ataaagagaatttgattcactttgttctaactataaataattttaccatctaaatttaccagctctaactataaatatctagaggaagtttaggtatctgwaatagggctgagattttccaggaaatattgacatgtggaaatgaagaaagagggttggtttccatccagattttgaaaatttatgtgggccacaaaataa

SEQ ID NO: 55577 - DNA, 201 bp, Homo sapiens
gagggggtgtgggtagggtgggaggagagaggtaaggaacagttcctacgtggcaccaccaaatattcaatggccagacctgctcggaagtctgcaacccwgtcagtacccacggagggagagcgacttcactcctcccctccgccttctccctccctctttcccccgccctttcccgaaaaggcatctggctggagcggt

SEQ ID NO: 55578 - DNA, 201 bp, Homo sapiens
ggcatttgttgtggaatgtataagactcatataaaaataacagaaatattgcatatgtttcagaaaagtatctggtgtgagtcttcagatttttgatgcasatgcatttggtttcagacttaaatgattaggtgcgaatggtggaggcataaaacaattacatacgatgtctagaaataatattcacttcaagtcaagaat

SEQ ID NO: 55579 - DNA, 201 bp, Homo sapiens
gcattatcttttaattttaagctttatttaagagatttaaagagatttcattcattttaatatttaacttataaaaatataaatcaaattctaaaatgcayaatttataagagcagaattaataatgagagcagatgtgtaaaaatataaatgttttcacatataaaatctgtttcggtattcctagtttgaactttaagt

SEQ ID NO: 55580 - DNA, 201 bp, Homo sapiens
acttgtatctacatatattttgtgcattcatgacatacttaactttttcttaatgtttttgatatttttagcctactttgttcttctggaaggtttctcamattgtcacaaatctccaaaaatgtgttttaaatttatgtattgaaccatattcatacataactggacctatacatttcaaattagtattgttcaagggtc

SEQ ID NO: 55581 - DNA, 201 bp, Homo sapiens
agaaaatgagttacttaaaaatgaaatttacaaattggcaagataagcctaggcaatacaataagatcctgtctttacaaataaatcaatcaatgaataarctgggcatgctggtgcatgcctgtagtcccagctacacaggaggctgaggcaggatgatcatgtaagcccaggagtcccaggctgcagtgaggtatgatt

SEQ ID NO: 55582 - DNA, 201 bp, Homo sapiens
ataggcaatttactagagagatccactgctcatgtggaaatgatatttaagcagatacttgccacatttgggttcaccacaatagcaacaggaggtggctwacaaatgattacagtagtacagaatgcactacacttaatcttatgcagttttcatttattgctgcatctttatgtttgtttacatttctctccactatga

SEQ ID NO: 55583 - DNA, 201 bp, Homo sapiens
gacgagttagtggatgcagcacaccaacatggcacatgtatacatatgtaactaacctgcacattgtgcacatgtaccctaaaacttaaagtataataataaaaaaaaggaataaaaagagacaattttaaggaccttgttggccatctactcattactccaaaatcatgcaacatgctcacaaaaagtgttgaaaatatt

SEQ ID NO: 55584 - DNA, 201 bp, Homo sapiens
tccacagggagcagatggtgtcagaggtctcaagggatctaaaggtgaaaaggtaaaatttaattgtttagatggtattaatttctgtgtattatgttaayatttaaatttattcaacagacattttatttcttgaatatatgagtgattactacatactacgcaatgctagtataattttgtattctttatcctcacaac

SEQ ID NO: 55585 - DNA, 201 bp, Homo sapiens
tacaataagatcctgtctttacaaataaatcaatcaatgaataagctgggcatgctggtgcatgcctgtagtcccagctacacaggaggctgaggcaggaygatcatgtaagcccaggagtcccaggctgcagtgaggtatgattgtaccactcaactccagcctgggtgacagattgagaccccatctcaaaaaataaaa

SEQ ID NO: 55586 - DNA, 201 bp, Homo sapiens
cttgctgctttacattagaaaagtgtgaactttttacacgtcttgtaatacaaattcaatttcaagcatttccatagtctgcaaataagactcatagaaartagctgcccttctcatgtaatctgagctccgatcgccagtgagtgagacggggaacatctcactaattatttcatctaatatctattggattttaacatt

SEQ ID NO: 55587 - DNA, 201 bp, Homo sapiens
ataaacaaattgaaaaaatatcatatttgctgaagttagaacattaaaactatgggctgtttactgtatacattccctttgatgaactgtccataaaaggaacaaacaaagaagtcctgctgccttaaataaacgtgtcaattgtattgtgactatattattctaattagtttaaaacgcgattaaatttgcccaccagga

SEQ ID NO: 55588 - DNA, 201 bp, Homo sapiens
tgtactacctaagtctttactcatttaagtttttatacaaagatttaaggattttaatttttgtggagatagtgtagtatcaattgtcttttagatgttayatttccataggttccataataaacatgagcatgcacgcgtgcacacacacacacacacatgcacacacacgtgttagtatttatacacaggacattagaa

SEQ ID NO: 55589 - DNA, 201 bp, Homo sapiens
ataaatcaatcaatgaataagctgggcatgctggtgcatgcctgtagtcccagctacacaggaggctgaggcaggatgatcatgtaagcccaggagtcccrggctgcagtgaggtatgattgtaccactcaactccagcctgggtgacagattgagaccccatctcaaaaaataaaaagtagcaagataagttatttaatt

SEQ ID NO: 55590 - DNA, 201 bp, Homo sapiens
tgaagataatatattgaatggtagattttaaagtggataaaaaccttagatttatgaagaataagtaagttattgaaataaagatcagaatatcaaaaaasattgaaaccgataagaaattaattaggtgagacagatgaaaaattattgacattagcctttgtaagagccaggattcaggcctgagttttgttggtaatt

SEQ ID NO: 55591 - DNA, 201 bp, Homo sapiens
gcattaaattcttcagctttagattcttcaccttgcttttgctttaagttgtcatataatgacttcactttttcttgaatcatattgaacttcatagctayataatggctttctcatagccaccctcacccacataaagctgcattttcaatataagattttaaaaaagatgttttgcaaaagttcaaggcttttgcactt

SEQ ID NO: 55592 - DNA, 201 bp, Homo sapiens
taaacaaattgaaaaaatatcatatttgctgaagttagaacattaaaactatgggctgtttactgtatacattccctttgatgaactgtccataaaaggaacaaacaaagaagtcctgctgccttaaataaacgtgtcaattgtattgtgactatattattctaattagtttaaaacgcgattaaatttgcccaccaggaa

SEQ ID NO: 55593 - DNA, 201 bp, Homo sapiens
agatggttttccaggattcaaaggtgacatgggtctaaaaggtgacagagtaagtatagagaaaatgtacaccagtacacaaaatttaatatatatatatwttttttcctttgcttatctttaaatatagtaagcatatgataaataaaatgtttgtactacctaagtctttactcatttaagtttttatacaaagattta

SEQ ID NO: 55594 - DNA, 201 bp, Homo sapiens
ctggtgcatgcctgtagtcccagctacacaggaggctgaggcaggatgatcatgtaagcccaggagtcccaggctgcagtgaggtatgattgtaccactcractccagcctgggtgacagattgagaccccatctcaaaaaataaaaagtagcaagataagttatttaatttgagcctcatcatgatcataataaaaccaa

SEQ ID NO: 55595 - DNA, 201 bp, Homo sapiens
aagcaatgtcttgagtatattcatgaccaccacacggaggaagctgtgcagataaaggagaaccaggagtgaataagctctaaaagaaagatgtgccggckgggcgcagtgactcacgcctgtaatcccaacaatttgggaggccgaagcgggcggatcacctgaggtcaggagttcaagagcagcctggccaacttggtg

SEQ ID NO: 55596 - DNA, 201 bp, Homo sapiens
aaacaaattgaaaaaatatcatatttgctgaagttagaacattaaaactatgggctgtttactgtatacattccctttgatgaactgtccataaaaggaacaaacaaagaagtcctgctgccttaaataaacgtgtcaattgtattgtgactatattattctaattagtttaaaacgcgattaaatttgcccaccaggaaa

SEQ ID NO: 55597 - DNA, 201 bp, Homo sapiens
tttatatttcattgtcctaaatgttgctagctatcatttattttatttgctttaaagaactctttggtgtaatactacttccctacatatgagatactctrcataatcattgtaatgatacatctctatttatactgatattggcatattattattttatttatgggatgagactcaaacttatatggcttatccttttag

SEQ ID NO: 55598 - DNA, 201 bp, Homo sapiens
acttgtctcaagccatccttagaattccataatgaggggagagaattatctccaaaaatatgttatgaggctttacgtagcaatgtatatatattgcgaayatactaagcaatgtcttgagtatattcatgaccaccacacggaggaagctgtgcagataaaggagaaccaggagtgaataagctctaaaagaaagatgtg

SEQ ID NO: 55599 - DNA, 201 bp, Homo sapiens
caagttatctgagtagcatcattattattatttcaaagttacaggatctttgcttttctgtttctcttctataatgcaaatcctatttcaaactataccayatttgttcatggtgaaatgattcactgacattgtatactaatgacatcttctttcttccttatataaagagcatgctggattttaaatttgatatattaa

SEQ ID NO: 55600 - DNA, 201 bp, Homo sapiens
tttatttatgggatgagactcaaacttatatggcttatccttttagcaaatgtatttcataatgatgttctgtaagatttaaaaattaggcaaagctgccrgggtgtggaggctcgcacatgtaatcccaacactttgggagaccaaggcgggtggatcacctcaggtcgggagttcgagaccagcctgatcaacatggag

SEQ ID NO: 55601 - DNA, 201 bp, Homo sapiens
tttcaaaatatattatcttttcacttaatatgtatcatacattcattagatgcacaggtttttactgatgtcaccagttttcttacaaattatgtaagaayagacattatgacatttctggaagatcctttctcctaacctactctaatttctgttagaataccgacaaagttgaaattattccattactgcctgtctttt

SEQ ID NO: 55602 - DNA, 201 bp, Homo sapiens
tcacagggcaattggggccactactgttttctaatggtatctttatttcaggggtatttttcacactgaatatcctcacattaaacatagaatgtgaatgrgttttacttgtctctcagcaatacaaatttgaatcaatatttacaaacatttctctttccaaaaatatatttaatttataataaaacttgtctctgaaaa

SEQ ID NO: 55603 - DNA, 201 bp, Homo sapiens
tcaaacttatatggcttatccttttagcaaatgtatttcataatgatgttctgtaagatttaaaaattaggcaaagctgccagggtgtggaggctcgcacmtgtaatcccaacactttgggagaccaaggcgggtggatcacctcaggtcgggagttcgagaccagcctgatcaacatggagaaaacccgtctctaccaaa

SEQ ID NO: 55604 - DNA, 201 bp, Homo sapiens
acagtgccatttaaataggtgacaagctaatattaaaattatgatggagttgggattttcttatcaagtgaaattatcttcctatcttataaaaaattagrtgttaaatctatatgattccttttgatattctttcttaaaaaaggatgaaaacagaaaatgaagtgacaatcttttataaaggaatttacaaaacaatta

SEQ ID NO: 55605 - DNA, 201 bp, Homo sapiens
acatgaagcatccttttttagtacatttagtgttgctataaaagaatacctgaggctgggtaatttataaagaaaagaggtttatctagctcacagttctkcaggctctacaggaagcatgatgccaacatctgcttctggtgagggcctcaggctgctcccactcatgctggaaggagaagcagagggggtgtgtgcagt

SEQ ID NO: 55606 - DNA, 201 bp, Homo sapiens
tttaaaaattaggcaaagctgccagggtgtggaggctcgcacatgtaatcccaacactttgggagaccaaggcgggtggatcacctcaggtcgggagttckagaccagcctgatcaacatggagaaaacccgtctctaccaaatatacaaaattacccaggcatggtggtgcatgcctgtaatcctagctactcgggaggc

SEQ ID NO: 55607 - DNA, 201 bp, Homo sapiens
tactgtacaggcaaatgaagctccctattcatagaacttgagtgcacagagtatcaggggaagcttccttcctctgtttgactggtaaactgacatccggkcttaaaggagtgaaccttagactgtgtgaggtagttggctttccttcctcactcagattttcacatagactccctgaaaggatgactgccagaaagagca

SEQ ID NO: 55608 - DNA, 201 bp, Homo sapiens
tagtgagaccctcatcttcacaaaaacttttaaaaattacccaggtgtggtggcacatgcctgtagtcccagctacttgggaggctgaggtgggaggattrcatgagcctgggaggtccaggctgcagtgagtcatgattgttctactgtactccaatctgaacaacagagggagaccctctctcaagaaaacaaaaagta

SEQ ID NO: 55609 - DNA, 201 bp, Homo sapiens
ttaggcaaagctgccagggtgtggaggctcgcacatgtaatcccaacactttgggagaccaaggcgggtggatcacctcaggtcgggagttcgagaccagmctgatcaacatggagaaaacccgtctctaccaaatatacaaaattacccaggcatggtggtgcatgcctgtaatcctagctactcgggaggctgaggcag

SEQ ID NO: 55610 - DNA, 201 bp, Homo sapiens
aataattcatcttcagaagttctacctatataaattaataatgcaatgttggttgccaatgaataaagaacataaagtgcaatatggagcatcagccatayatgtactttatattacttacttgttcactaataaacttctggcattgcatgtttattattctaatttggattaataaatatgtcaatttattttataagt

SEQ ID NO: 55611 - DNA, 201 bp, Homo sapiens
ttttttaacttatatgggtgctttagcaactcagggtacaaataaaggcaccactaattttccttcctccctccctccttcttttcttcctttcttccttycttcctttctctctctttcctttttttttaatttttattttattattattatactttaagttttagggtacatgtgcacaacctgtaggtttgttacata

SEQ ID NO: 55612 - DNA, 201 bp, Homo sapiens
cattgtatgtcttatttatgggatatttttatgtccatgtccatcttaatgtcttttcaggtttaaaatgcaggttgaatttttatgtaaattatgaatgyctattaccactaggacaccttgttagattctttcacatgggaatcttcagcagttgtatctttggccatacttttggagtcattatttgaaagtaaaatc

SEQ ID NO: 55613 - DNA, 201 bp, Homo sapiens
gttctcttggagaatgatgaaagtcgccaagcaaatggggtgggggcggaggactagggattgggagggaaggggagggggtgtgggtagggtgggaggaragaggtaaggaacagttcctacgtggcaccaccaaatattcaatggccagacctgctcggaagtctgcaaccctgtcagtacccacggagggagagcgac

SEQ ID NO: 55614 - DNA, 201 bp, Homo sapiens
ctatacttgatacaaatttgggcaaaaagtgagaataaaagacttgccctttaaaataattccttactaggtgacttagttgctttatatatatatatatwtatatttttcttatggtagagatttttgagtgtcattatccagtaatagttaagtgtggagtgattaatcaaaatggcaaatcatacatatagcactcgt

SEQ ID NO: 55615 - DNA, 201 bp, Homo sapiens
tggatgacatatattttatgtatacatatagtatgacttttattaatgtcagataatcattatgacacacttgtgtgttgtttgtttaacagttttttttwaaacaagtggcaaactgaagaaaaaaataggagagaacgtagtagtgcaaattctaataaaggtttttattttggattgtcaaagtatctgaaattacat

SEQ ID NO: 55616 - DNA, 201 bp, Homo sapiens
ctcttcagcacccaaggctgctcaagctcaggaacctcagatagatgaggtgaggagcacaagaccagagaaggtcttcgtatttcagtgatatggacatmgcagtgcagtttttgaacttatacttatttattccattttaattaagctatgctttgtattttaattgtgttgtaatatttccaggaaaaagtgacttga

SEQ ID NO: 55617 - DNA, 201 bp, Homo sapiens
ttggtctacctacccatcaaccctgcttcctagaatggagaaatgtcctaattagcatccctatattattaatcagttagattagaaactctaggaggtgrgtctggaaagcaggtaagaagaaaggggctaaaaccttctccaatttaatttcattgatagaaaattttgatagggaaactgattctaatgaaaactatt

SEQ ID NO: 55618 - DNA, 201 bp, Homo sapiens
tgtcaggaatcgatagtgagccctgaagaagtgtagttttgagtgcccaggatcagcaggtgaaatggtcctggcttccagagtatgtgctagtccaacartgcaaagagatcgaatttgtccatttggttccttaatcagaaatcagaaactcagatatgcttctgataagaaatgcagtgtttgctaaactcattaata

SEQ ID NO: 55619 - DNA, 201 bp, Homo sapiens
aaaaataaaccacatctcgctttggtatatgtgtactttaatatgctaactgaatctgtgtctgtttgtttttgtttttttttttttcccagggggacatycagcagtttttgatcacaggtgatcccaaggcagcatatgactactgtgagcattatagtccagactgtgactcttcagcacccaaggctgctcaagctc

SEQ ID NO: 55620 - DNA, 201 bp, Homo sapiens
gtggtacacttcctttagttaaccatttagaaaatggtttactaaaacatgtaaaatccattcttccacatctaataatagaggtattcctgctgccctayacaacttggtaaaaagccatgttacattttttgctgacacacattcccaggatgccctaagagcttagtaaatgccaaatgcattcatttgagaaaaaaa

SEQ ID NO: 55621 - DNA, 201 bp, Homo sapiens
tacagtgtatgctgttatgaaaatattgaaaagttatgaaaacatgaaaatgaaatagctgagaaaatccctttaaattggctgattctctctctagggarttcctggtcctgctggtcccttaggtccacctggtcctccaggcttaccagtaagtacaagacaaaataaccttataaggtagggttaagttacaaatat

SEQ ID NO: 55622 - DNA, 201 bp, Homo sapiens
aataaaataaacttaaggacttaattaatggagttttacttttttgtaacttgaaatgcctttttgggaaaaaaaaaaaggcttggttgatacctttattwtatgtctctacttgtattgttttttgaggagtgaacacttggataaggtcatggtgttaaaagatacgttgttgccgggcgcggtggctcacgcctgtaa

SEQ ID NO: 55623 - DNA, 201 bp, Homo sapiens
atacttgatacaaatttgggcaaaaagtgagaataaaagacttgccctttaaaataattccttactaggtgacttagttgctttatatatatatatatatatatttttcttatggtagagatttttgagtgtcattatccagtaatagttaagtgtggagtgattaatcaaaatggcaaatcatacatatagcactcgtat

SEQ ID NO: 55624 - DNA, 201 bp, Homo sapiens
acttgatacaaatttgggcaaaaagtgagaataaaagacttgccctttaaaataattccttactaggtgacttagttgctttatatatatatatatatatatttttcttatggtagagatttttgagtgtcattatccagtaatagttaagtgtggagtgattaatcaaaatggcaaatcatacatatagcactcgtatgt

SEQ ID NO: 55625 - DNA, 201 bp, Homo sapiens
aaaagagaaatgtgttatcaaaggaaggattattttcatttaaaaactaaaaaaaaatttgtactgttattgttggcccatgccttcagactggagttcasagtacagtcttctcattacaaagctacatactctttaacctgtagacaatcttttttttttttttttttttgagacagagtctcactctgctctgttgcc

SEQ ID NO: 55626 - DNA, 201 bp, Homo sapiens
caccgaagcctcaaactcatgggttcaagtgaccctcctcccttagcctctcaagtagctgggacagcaggtgcacaccaccaattattctagtttttgcttttttttttttttttgtagacaaaatgtctcactgtgttacccaggctggttgcaaattcctaggttcaagcggtcctcccacctcaggctctcaaattg

SEQ ID NO: 55627 - DNA, 201 bp, Homo sapiens
ctatacctctgtgtggagtaattatcagattccattgtggtatcctgataaggctgatgttactcagtgtgtttattctcaggtgattgcactgataagaycttgtaataaatcctctgtcttttgtggaattaattaaactcttgtcgtctaaaataatatatgatactgatgcatttaaatatgtttacccataaaagg

SEQ ID NO: 55628 - DNA, 201 bp, Homo sapiens
caccaagataagcaatttgagcttttaaaatattaaaagttcataaccagtggacttatataattcaaatatttcaaatgaagtggcagcatgaaaaacakttggaagtataaaggtagaaagaattcgattcctttccttctcagtataaaggtcaaagctgacacccctataaaaaaaaaggttaacaagagaaaaata

SEQ ID NO: 55629 - DNA, 201 bp, Homo sapiens
gctacaaattggtttctatatgttgtcttttcacaggaagataaatagggcaactgtttagaactctagtgtatatttataaaatataaacgaactcttcrataggactagagtgaattcatctaaatattaatgagattaggaatctgattaagatatggtgtgtttctctatagggtattatgggtcctccaggtctac

SEQ ID NO: 55630 - DNA, 201 bp, Homo sapiens
aaatattaaaagttcataaccagtggacttatataattcaaatatttcaaatgaagtggcagcatgaaaaacagttggaagtataaaggtagaaagaattygattcctttccttctcagtataaaggtcaaagctgacacccctataaaaaaaaaggttaacaagagaaaaatattaaaaatgtatttgattatagttcaa

SEQ ID NO: 55631 - DNA, 201 bp, Homo sapiens
ggtcctccaggtctacaaggccccactggaccccctggtgaccctggcgatagggtaagtgaatggacatgatatctcattacaaatgcatgtcatacagrcttaaataattaaaatgtattctacaagtataacatgttatcttactgcgtgtgggaggggtaaaggcagcatgaattcagtgctgcacaacattttagt

SEQ ID NO: 55632 - DNA, 201 bp, Homo sapiens
gaggcaggagaatggtgtgaacctgggaggcagagcttgcagtgagccgagatcgcgccgctgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttaca

SEQ ID NO: 55633 - DNA, 201 bp, Homo sapiens
atttattaatttttgaatttacttgcttccctgacaagtatgacatggctatgtagaaatgtctccttatattgaaagcttatggacatataccttatatstatgagtcacatacttatcaacagatgtatatattacatatttaatattttctatattcatatccatatcttggatttctggacagcatagtcacaccta

SEQ ID NO: 55634 - DNA, 201 bp, Homo sapiens
aggcaggagaatggtgtgaacctgggaggcagagcttgcagtgagccgagatcgcgccgctgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttacat

SEQ ID NO: 55635 - DNA, 201 bp, Homo sapiens
attctcattaattttagaatagatggataaataatttatattttaaatatttgttttttgtataaattttttctgctatttacagaacgtattattctgamagttaaaatcttatctgtattgtacatagtagacacttgcagcaaaactattgtattcaaatttaaatcaagtactttgccttctaattatttagtctgt

SEQ ID NO: 55636 - DNA, 201 bp, Homo sapiens
ggcaggagaatggtgtgaacctgggaggcagagcttgcagtgagccgagatcgcgccgctgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttacatg

SEQ ID NO: 55637 - DNA, 201 bp, Homo sapiens
tcgcacctgtaatcccagcactttgggaggccaaggcgggcggatcacctaaggttgggagttcgagaccagcctgaccaacatggagaaaccccgtttcwactaaaaatagaaaattcgccgggtgtggtggcacatgcctgtaatcccagctactcgggaggctgaggcaggagaatggcttgaacccgggatgtggag

SEQ ID NO: 55638 - DNA, 201 bp, Homo sapiens
gcaggagaatggtgtgaacctgggaggcagagcttgcagtgagccgagatcgcgccgctgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttacatgg

SEQ ID NO: 55639 - DNA, 201 bp, Homo sapiens
gatttcattcatgtgttcttaaactgagaatgataaaacttcagttaccatttaaacagcttccaaatgtggcattctcagctatgttaatttcaggaacrtaacggtatgagtgaatattttctctttattttaggtctccttttctttctcattattttacaaaaaagtaattaagtttgcttgtgacaaaagatttgt

SEQ ID NO: 55640 - DNA, 201 bp, Homo sapiens
ctaatagctttatcgaagtgtaatttaaatactataaatattcccttgttttaagtgtacaagtgaattatttttactaaatttacagatgtgctgcaatytaagtttcggaatacttataccactccagaaataatcctcgtgttaatattcagtccatgtttccaccccctcagacctagctaacaattaatttgcttt

SEQ ID NO: 55641 - DNA, 201 bp, Homo sapiens
agaccatcctggctaacactgtgaaaccccgtctctactaaaaatacaaaaaattagccgggcgtggtggcgggcgcctggagtcccagctactcaggagrctgaggcaggagagtggcgtgaacctgggaggcggggcttgcagcgagccgagatcgcgccactgcactccagcctgggcaacagagcaagactccgtct

SEQ ID NO: 55642 - DNA, 201 bp, Homo sapiens
ctaaaatgtatttgattttttgaagtcagaattaacatctgtcttagctttaaggttttattttgttttgttttgtattcttttaagactctatttgtttwaatgcagctgaaaaattattcagcatttatgttcaaaaaagattatttagtattatcacacatttctgcttttgataacaaaatgttaaataaaatatct

SEQ ID NO: 55643 - DNA, 201 bp, Homo sapiens
gagcagaagaatgatctaatttgacttacgttttactaataatattaatattggagatcagaggaagcattatagagtgctgatatgtgccatgtactaargtctttatacattgttaactcatttagttttattgattcctttaagaaagtaatgttaacaaactaattttcctggtaagggaactgaggctcagagagt

SEQ ID NO: 55644 - DNA, 201 bp, Homo sapiens
actctgaatgaaatgccactaatgatccagccagtgtttttcctagtctggatagttccctaaaacgcttgcagttacacttattttcctggcatttcacyttaaaaagtatgctggcaccagcatagagtgattctttgacgaaacaaattgttctcttcgtgagtcatacaggctgaaacataaaacagtaaaactcag

SEQ ID NO: 55645 - DNA, 201 bp, Homo sapiens
ttcagtaagaactaagtaaaatctgttttaaggaagaaagtaacaaataactgcctttacattgacctaatctataatctaggtgaacatcttaacctttwttttttcaaatttaagtgtatatgttacagctgaactcagatatttttattaccaaaaataagacaatttataaagatgatatgagacagttgctaataa

SEQ ID NO: 55646 - DNA, 201 bp, Homo sapiens
actcaggaagtcaggcttgcactgcgctcttttgcaaatcatgtcgaattctgaattatgtattgtggttgtttcctttcacttatggagcagctaaatakaaattaatgcttattaaatttactcaatattttatcactgaatccagacctctaaaaacagctttatccaaaatagcacatttggttatagctataagaa

SEQ ID NO: 55647 - DNA, 201 bp, Homo sapiens
tcaggaccacagagaaactctcaagtctcagttttactgagactttacaactttaggcttttacaactaatttacattattatcctataaacaaattagayataatagcacgttgtgtttctttttttgactgttagcaaactccatgctaaggttttaatctatatttggtaaatgtagaaaatattttgaattcatctt

SEQ ID NO: 55648 - DNA, 201 bp, Homo sapiens
attggattgatcctaaccaaggttgctcaggagattccttcaaagtttactgtaatttcacatctggtggtgagacttgcatttatccagacaaaaaatckgagggagtaagtaccaatctgttttggtggtgaatgttgacagttcctgccatgttttgcaatattgaactaaacaggaaaattatactgtcatattttc

SEQ ID NO: 55649 - DNA, 201 bp, Homo sapiens
atattttgccttcctctgttctttgtgaatgttttttaaggtaaaatagagatcatattgcaaaatataaattttaagtgtttaaatcactttaaaaaatatgtaaagatcatggtaagatatttccatcaaattatatttcactaattatgataatcacattcttttagtcctccaatcattggatatgacaacttatgc

SEQ ID NO: 55650 - DNA, 201 bp, Homo sapiens
gtcccctataacccttagtatgcctatacccggttgtctttccccttttcctttagagctgataaagacaacaaaaaggaaatgactcaatcttcactacrtagaatgtacaggatctatctcaaatttttctctttgtctcattttgtataatctaatttgtgtcattttaaaacgattttaagcactctttattttctt

SEQ ID NO: 55651 - DNA, 201 bp, Homo sapiens
ctggagtgtgcagtggcataatcttggctcactgcaacctctgcctcctgggttcaaaggatcctcctactttagcctcccaagtagctgggactacaggsatgcgccaccatgcccggcaaatttttttgcattttttctagagttggggtttcaccatgttgcccagtctggtctcaaactcctgagctcaagcaatct

SEQ ID NO: 55652 - DNA, 201 bp, Homo sapiens
caggagaatggtgtgaacctgggaggcagagcttgcagtgagccgagatcgcgccgctgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttacatgga

SEQ ID NO: 55653 - DNA, 201 bp, Homo sapiens
agtgtgcagtggcataatcttggctcactgcaacctctgcctcctgggttcaaaggatcctcctactttagcctcccaagtagctgggactacagggatgygccaccatgcccggcaaatttttttgcattttttctagagttggggtttcaccatgttgcccagtctggtctcaaactcctgagctcaagcaatctgccc

SEQ ID NO: 55654 - DNA, 201 bp, Homo sapiens
aggagaatggtgtgaacctgggaggcagagcttgcagtgagccgagatcgcgccgctgggctccagcctaggcgacagagctagactccgtctcaaaaaaaaaaaaaaaaaaaaaaaaaaaaatggagccatttagaaaaaataggtatttatttgatatgaaccttttgtcttctgctttatctgaacttttacatggaa

SEQ ID NO: 55655 - DNA, 201 bp, Homo sapiens
tttaaatagtatatgtagttagttaaatatgaaggcctatgtaatatttatagtgaaactacatttgacctattattagctgtacacttttattttaaaayatgtatatcgatccccacgaaaagtatatattgacacattatggtgtactgctactgaagaaaaagataatgagaattttaaacctttaatctgacatag

SEQ ID NO: 55656 - DNA, 201 bp, Homo sapiens
agtgagctgagatcactgctctccagcctgagcaacagagcaaaacttcatctcaaaaaaaaaaaaagaaagaaaagaaaaagaatatatatatatatatwtatatatatatatatatatatatgaggattcaataccaacatcaattttcatattaaattgtatttattatgaaactcaagactctttttaattacaaaa

SEQ ID NO: 55657 - DNA, 201 bp, Homo sapiens
tgtcatcaatagctccgaaatttatgtactgagaagaaatgaatcctattaccagaagaaaaaaaataatatgtcacttggaatataccagacatatggawtatatcacttttctccaccaaatattacaaatgaggaaactgatctgggaaggtttacttgaagctagctaacaaaataactaaactggaaataggcctc

SEQ ID NO: 55658 - DNA, 201 bp, Homo sapiens; identical to SEQ ID NO: 10497

SEQ ID NO: 55659 - DNA, 201 bp, Homo sapiens
ttcctcagtgaatgctgtcttaagatgaaatttacctaaatgtacaataaatgagaatcaagactcttctatttatgtagtatatctgattgaataataaygttcgatgctgtcactgaaatcaaaaaatgacacaaaagtgtcttatagaaaatattaaactgtttcctattttaaaaattccccaagtgattcatatgt

SEQ ID NO: 55660 - DNA, 201 bp, Homo sapiens; identical to SEQ ID NO: 10498

SEQ ID NO: 55661 - DNA, 201 bp, Homo sapiens
tgtcttaagatgaaatttacctaaatgtacaataaatgagaatcaagactcttctatttatgtagtatatctgattgaataataatgttcgatgctgtcaytgaaatcaaaaaatgacacaaaagtgtcttatagaaaatattaaactgtttcctattttaaaaattccccaagtgattcatatgtaatattatagaatca

SEQ ID NO: 55662 - DNA, 201 bp, Homo sapiens; identical to SEQ ID NO: 10500

SEQ ID NO: 55663 - DNA, 201 bp, Homo sapiens
tcttcttgattacgatcattctcgttggtgtgaaatgttatctcattgtggttgtaatttgcattttcctaatcactacttttgttgaacatcttttcacrtgcttattggccatttctataacttctttgataaaatagctgttaaactcttttggttaatattctaattggattatttatcttaatattgagttgtaag

SEQ ID NO: 55664 - DNA, 201 bp, Homo sapiens
tggtttggctgtgtccccatccaaatctcatcttgaattcccccttgttgtgtgagaacccggtgggagacaattgaatgataggggcaagtcattcaaaygctgttcttgtgacagtgagtaagtttcacaagatctgatggtttataaagaggtgttcccctgaacaagctctctcattttttgcctgccaccatccac

SEQ ID NO: 55665 - DNA, 201 bp, Homo sapiens
gtttgtatatattttgtggaaattaacatttctcagatccttactttcccactgtggaaacaataaaaaagccacaattttttttataatatcttatggcrgaagtagcaatgacaagaaatgtgttcaaaagtattaccactttttttctgtgattgaatcttacgcatgaatgataataaaacttcctaacagaatatt

SEQ ID NO: 55666 - DNA, 201 bp, Homo sapiens
ctcatcttgaattcccccttgttgtgtgagaacccggtgggagacaattgaatgataggggcaagtcattcaaacgctgttcttgtgacagtgagtaagtytcacaagatctgatggtttataaagaggtgttcccctgaacaagctctctcattttttgcctgccaccatccacgtaagatgtgacttgttcctccttgc

SEQ ID NO: 55667 - DNA, 201 bp, Homo sapiens
tactagattattaagaggaatttgctcttaggaaaagttgttatatctgaattacctgtgccaagccagataaaatgtataatctagtttactgcatttcyggtggtaagaagagagctgttttatgtaatactgcttctgcctctgatctgaatatatccagcctgtaggttcaaaatcaatctcttaccatcaaaagga

SEQ ID NO: 55668 - DNA, 201 bp, Homo sapiens
ggagtgcagtggtgtgatctcggctcactgcaacctccacctcctgggttcaagtgattctcctgcctcagcctcccaagtagctggaactacagatgccyaccactacgtctggctagtttttgtatttttagtagagacagggttttaccatattggccagtctattctcgaactcctgaccttgtgatccgcccgtct

SEQ ID NO: 55669 - DNA, 201 bp, Homo sapiens
ttgaacagttgcagttagcaaaatataaagaatagctttcccacatatatgtatgtatgcgtataaaacagtagaatccatttaatgacaatttattaaaygcaatatctatgaggattatgagatcaaataacaggcagaatttcaaagtagcttaattcattatttagttcacttgaaataaaataaacttaaggactt

SEQ ID NO: 55670 - DNA, 201 bp, Homo sapiens
aagggtatcagcgagggaagatgaaatgaatgaaatgaagcaagaagggaagtttagagaaaaaagaataaaaagaaatgagcaaagcctccaagaaataygggactatgtgaaaagaccaaatctacgtctgattggtgtacctgaaagtgatagggagaatggaaccaagttggaaaacactctgcaggatattatcca

SEQ ID NO: 55671 - DNA, 201 bp, Homo sapiens
tttaaaagtactataaacatacatgatgcatatatagatatatatttatattatatataatatatatttatatacataagtatcatatatatatatatatatatatatacgatagcaacttttttgtttttcagcaatagattcacttgattcattataatttgtatataattaagtatggcattctagaatttctatccc

SEQ ID NO: 55672 - DNA, 201 bp, Homo sapiens
catagaatgtacaggatctatctcaaatttttctctttgtctcattttgtataatctaatttgtgtcattttaaaacgattttaagcactctttattttcytagtcttactgaaaatgaattatatgtatataaaaatactgtttatattgtaaattttcacctactcactaacttttctgttcctttgcaacaggtaaga

SEQ ID NO: 55673 - DNA, 201 bp, Homo sapiens
atttaaaagtactataaacatacatgatgcatatatagatatatatttatattatatataatatatatttatatacataagtatcatatatatatatatatatatatatacgatagcaacttttttgtttttcagcaatagattcacttgattcattataatttgtatataattaagtatggcattctagaatttctatcc

SEQ ID NO: 55674 - DNA, 201 bp, Homo sapiens
tatttaaaagtactataaacatacatgatgcatatatagatatatatttatattatatataatatatatttatatacataagtatcatatatatatatatwtatatatatacgatagcaacttttttgtttttcagcaatagattcacttgattcattataatttgtatataattaagtatggcattctagaatttctatc

SEQ ID NO: 55675 - DNA, 201 bp, Homo sapiens
tgcgcaatacaagggctgtgtgggaagtagttatgtctgtgattatatggtttccctcattttttcctttgaattatggttcaaatgcaatctctgatgcrtttttcaattacactaaaattctaagcattttggcaactttcctttaccacagaaaacagttgagaaaaaaaaatcattaactgtatggggtgtttgaaa

SEQ ID NO: 55676 - DNA, 201 bp, Homo sapiens
gatacgattaggatattttaaagtaaaaattgatgtgaccagttttgtattttaaagagatcattttggcagcgagatgtggaagcatttgtgcctatccktcctagctttgttttcatacacagcccaaaatgttcttttctgaaattatcaaatcaaattcatttctaccaactgaaataaaaacccctccatcaaacc

SEQ ID NO: 55677 - DNA, 201 bp, Homo sapiens
ttcataaaatttaagttaattaactaaaatagataatatattatatttttctgacatttttgataaatataccaaatacatcctatgataaattgtgatawctcctaaatatttcctgtgatttaatttctgagttcactcatatattaattgcttagtagcaattgatgttacataactctctgagtccagtataaaata

SEQ ID NO: 55678 - DNA, 201 bp, Homo sapiens
ctccacaaaaatttggaggatagggttttttaaagatagtttggtgagcaggaggctaggaaatgagaactgctgcttggttgaggatgcaatcatagggrtatggaaaatggtccttgtgtgctgattcagcttctggctggggaacatgaggccagttaaatcacgaatcatgggtctgagtggagtcagctggttgtc

SEQ ID NO: 55679 - DNA, 201 bp, Homo sapiens
actaacttgcttttgattttacggactcatagtcaaggagggacttgcttattctcagatggaactttggactgtggacttttgggttaatgctggaatgygttaagactttgggagactgttgggaaggcatgattggttttgaaatgagaggccatgagattttggaggggccagtggtggaatgatgaggtatggctg

SEQ ID NO: 55680 - DNA, 201 bp, Homo sapiens
ttttctgacatttttgataaatataccaaatacatcctatgataaattgtgatatctcctaaatatttcctgtgatttaatttctgagttcactcatataytaattgcttagtagcaattgatgttacataactctctgagtccagtataaaataacaagacacaaaataaatattagttaaagggaggaactttgaagac

SEQ ID NO: 55681 - DNA, 201 bp, Homo sapiens
cctcggccatgtggaatcagctactcttagagttcttccacattagatgttgagaattaaaggatgtgtgattaaaggatgaaagaatcaatgaaagaggktctacttaaggttttacaccaagtagaatcatcttttattttttccacttaaacatgcatttcacataataagtctattaaaaaatactggtattcaggc

SEQ ID NO: 55682 - DNA, 201 bp, Homo sapiens
gtacttactaatattattgagggaaataatacaatctttacctctttaatgatatgaatcaatatatttctggcctatattgctttcctttttgttctctragcttcagtttattgtggtattcaaaaactaatttgctaatttaaaaaaagacctatctaagattataagcaggctaaaacctagcatacctttgacatg

SEQ ID NO: 55683 - DNA, 201 bp, Homo sapiens
taagtaccaatctgttttggtggtgaatgttgacagttcctgccatgttttgcaatattgaactaaacaggaaaattatactgtcatattttcatttatcwgcttttcttacaaaataattagagtacttcatttgcataaacatgaataagcaccaaattgatgcacagagttaacaaatacttctcttctttatttttt

SEQ ID NO: 55684 - DNA, 201 bp, Homo sapiens
aagacctatctaagattataagcaggctaaaacctagcatacctttgacatgttaaatttagttttaatttatctttacatggcatttcctccaaataatwtatttaaaagttatttaaatggttattacttatgaattgaagccagtgactcaggataagaatttcattcatagtatatgtacacgttaaagctttttaa

SEQ ID NO: 55685 - DNA, 201 bp, Homo sapiens
ttgaattccttttttttctttttcttcttggaaaataaaacatgactttgggttaattccagcagtattttatctttggaaatgcatataaagctataaartgattttaaaatcctaagagaaagagaaacctgaggtttggcatcaggataaaaattgctcattattatttatcttttttattcataaaaattcatccac

SEQ ID NO: 55686 - DNA, 201 bp, Homo sapiens
tcgaattattatctcagtttctctgacaagccaatatggacgaatggttaatttaaaatgctgctacagaaaaattactattttttctctacttttcaaakcctgtttttgaaaatcttgccaataataactaattctacaaagctgaaaaaataactttaaacatcattatttgtaaatgtgacaaaataggaaaatatc

SEQ ID NO: 55687 - DNA, 201 bp, Homo sapiens
ttgctttcctcgccttttctacacactcctcagtaccccctcatccaggatcagaacagaatcagctggaaaattaaattactcaccctcttaatgtcagytcccataaattttttcctccttctccctcagagtacagttcaactcttttaagaggaaagccactgaatgaacctagtgctgaatttaaacgtttaagag

SEQ ID NO: 55688 - DNA, 201 bp, Homo sapiens
tagtgagatgctggctatttcatgataacaaggatttaaatcaagtttggttgagagtctctgtgtaatacaagctgaatttttaaaaggttaaaaaaagrtgtttatataagatttttaaaagagaatgctagcactagaaattatagaaattgctaatcaatcttaccttctcaataaatgaggaaactaagacacaaa

SEQ ID NO: 55689 - DNA, 201 bp, Homo sapiens
tcctaggcttatcttattattatggtgccctggggcctaatattaatgtacacatcatgcagctaaaccacagaaaataccaggtcattgggtgaataacytgactgccttcaaggagaaataaaaagaggttctggtaaaaggtgatgttagaatccagatagctcttcagcctgcacttaagttcagtggtagagacca

SEQ ID NO: 55690 - DNA, 201 bp, Homo sapiens
catttggtaaaactttgctgaatgaagtgagggcgttgttgacattgctaatgacttgattgtccataacctaaccacctgagatgtgatatatagctatrtgtatcacctactctcaatgtctatggaagtatcttgaaccaatttctgctgatattattgtgatttcctgagactatcagtctctattttggttctagg

SEQ ID NO: 55691 - DNA, 201 bp, Homo sapiens
tgtttacagagtgtcttaaaacatgtcatacgattaacataaaacactgtaaaatgccttctgggaaaaaataggactgtaagttttttattgaatttttycagtttctttctagtatattttatgactattaaacacctgaaataagaatttatattggaaaagttggcaggattccatttagtcaagttaggactgtaa

SEQ ID NO: 55692 - DNA, 201 bp, Homo sapiens
tttgattaatttgctaaatataaggcagatttaaatacctttatgtaaggctttaattgaggctggggttgaattgttaatgaatgatatgtattattttrtgtgctttttctaagctctctcaaatgcattatgtatttgaagaaacttacatccatcaaatataagcttgtcatgtttacttccaaatgccatagtttc

SEQ ID NO: 55693 - DNA, 201 bp, Homo sapiens
aacccagggcctcctggggaagcaggtgtaggcgtaagtactgtgttattgttaacatagtgtattattggtttgggaatttcttttacagcattacaaayatgtaacaactcttagctgtggttcgaattttactttcccttcccaactcattaaggaaaatcacaaatacaaagccttgtttaataactttggatatct

SEQ ID NO: 55694 - DNA, 201 bp, Homo sapiens
ccttaatcttggttttgtggaccattaaaggaggaggatgccttgtatgctaaagatgccagttttactcaataactttaccttttttagctgtgaaaatktttatggcactattgaatctaaatatttatagttcattcaatctgtaacaatgagcttgtttacagagtgtcttaaaacatgtcatacgattaacataaa

SEQ ID NO: 55695 - DNA, 201 bp, Homo sapiens
ccaaagtaaaaaaatgaacaaaaaaagttagcatatgtgcattatttgtttggttttaaaagtatgctattacttatataatttgattttgataaaaaaaatagtgagatccttttgcaatgcatgtgacattcacaagaacatcatctgtgtagacagtttctatttagttttcttacattttatttgctttcactctat

SEQ ID NO: 55696 - DNA, 201 bp, Homo sapiens
ttttaaaacgattttaagcactctttattttcttagtcttactgaaaatgaattatatgtatataaaaatactgtttatattgtaaattttcacctactcrctaacttttctgttcctttgcaacaggtaagaatttcatcatggccaaaggagaaaccaggaagttggtttagtgaatttaagaggggaaaactggtatg

SEQ ID NO: 55697 - DNA, 201 bp, Homo sapiens
tgggatcaaatgatgaggagatgtcctatgacaataatccttttatcaaaacactgtatgatggttgtgcggtgagtataagttctgcttgtctcccttcwcagagatgataggcagcatgtcaccgtttcagtcggtccttagccagatttttctcatgaaatggacgtcagttgttattaacatttgttgcttaatctt

SEQ ID NO: 55698 - DNA, 201 bp, Homo sapiens
acttggctaatactataacccaattaaatcatgatttccatacatttgggatcaccttacatgtttactaattctcttctgaatttaccattaggcaaacrtcgttgatgattttcaagaatacaactatggaacaatggaaagttaccagacagaagctcctaggcatgtttctgggacaaatgaggtaatacgtataga

SEQ ID NO: 55699 - DNA, 201 bp, Homo sapiens
aagctcctaggcatgtttctgggacaaatgaggtaatacgtatagacagtattaaatcacagtcccactttttaaatatgtaatttattttgatatacttyactctggaagaatctataatttctcaaacatctgatgtttttattcttttactaaagtaagagaaacaatagcaatggttcactattactaaaagcagtt

SEQ ID NO: 55700 - DNA, 201 bp, Homo sapiens
tctttgataaaatagctgttaaactcttttggttaatattctaattggattatttatcttaatattgagttgtaagagcagacatatcagatttaagtggttttgaaagtacttttttctgtggatgttttagacatagctgcacagcactattggaaaatgtcctattagttatgttaggttctaaaggttatttttaat

SEQ ID NO: 55701 - DNA, 201 bp, Homo sapiens
tttagacatagctgcacagcactattggaaaatgtcctattagttatgttaggttctaaaggttatttttaatatttagatcagggagtttaatctgggtcactcatattttagattagtgcattaaaaatatactatatttattttgtattgcacttgacacatgcacctattaaattttctaccatgattttatcatgt

SEQ ID NO: 55702 - DNA, 201 bp, Homo sapiens
aacccctggaagttgcgattttttttttttttactgcctctataattttgacttttccaggatgtattagttgcagtcatacagtatgcagccttttcagwttagcccctttcgccaagtaatatgcatttaaggttcttctatgtattctctttttttttttttttcttttttttttgagatggagtctggctctgtctc

SEQ ID NO: 55703 - DNA, 201 bp, Homo sapiens
tttttttactgcctctataattttgacttttccaggatgtattagttgcagtcatacagtatgcagccttttcagtttagcccctttcgccaagtaatatkcatttaaggttcttctatgtattctctttttttttttttttcttttttttttgagatggagtctggctctgtctcccaggctgagtgcagtggcgcaacc

SEQ ID NO: 55704 - DNA, 201 bp, Homo sapiens
ctcactttaaaaataatttaaaaataaaattctgtctatagtcagagtctataagtgatttttagacatagagtgcagtgttctttaaactaagcatggcrgctgtgtaattatgtttttctctagggaggaggtaatgaagacgttgtcaatagcaagttcagtggtcatttacagctcttaagcctctgccattgccca

SEQ ID NO: 55705 - DNA, 201 bp, Homo sapiens
agtatttctgcaagtatttagatttcagagaaaagatatatgtctgctaatacatgtgcatgtctatccacaaaatctagtctgaatttaaaaacgcttaktttttaatttattcctcttcaccaataaaaaagcttaatcaatatgttctactaattttgttatagaaatgagaaaaatgtgtgtaactggactaagata

SEQ ID NO: 55706 - DNA, 201 bp, Homo sapiens
atggtagaaaaccaaggttctataagaaagtgtataagaaatactttgaaggatctcatgcttctaattctcaggaaaatacaattttttggtaagatggyatatcagtccattttcgtgctgctataaagaactgcccgagactagataatttataaaggaaagaggtttaattgactcacagtacagcacggctgggga

SEQ ID NO: 55707 - DNA, 201 bp, Homo sapiens
aatgtgattctttacacacacacacacacacacacacacacacacacaatctaaatgtatctttacttgtgtatttcatagaccattatgtaattacattyatagcacagaaaattgaaacagctatgccttatatagactttatatatatatatataaaattatatatatgcaaaccaaagtaaaaaaatgaacaaaaaa

SEQ ID NO: 55708 - DNA, 201 bp, Homo sapiens
tgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatatagactttatat

SEQ ID NO: 55709 - DNA, 201 bp, Homo sapiens
attgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatatagactttat

SEQ ID NO: 55710 - DNA, 201 bp, Homo sapiens
acattgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatatagacttt

SEQ ID NO: 55711 - DNA, 201 bp, Homo sapiens
acacattgacatgtgaccttaagacattagaccaatattatttaccatacttttccaataaatgtgattctttacacacacacacacacacacacacacamacacacaatctaaatgtatctttacttgtgtatttcatagaccattatgtaattacattcatagcacagaaaattgaaacagctatgccttatatagact

SEQ ID NO: 55712 - DNA, 201 bp, Homo sapiens
tactttaatctgtgtgttgcagtattgagtgttttatgagtgtttgctttttttctttttaattttttttgagacagagtttcacttttgttgcccaggcyggagtgcaatggcatgatcttggctcactgcaacctctgcctcccatgttcaagtgattctcctgcctcatagtccagagtatctgggattacaggcatg

SEQ ID NO: 55713 - DNA, 201 bp, Homo sapiens
aacacattgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatatagac

SEQ ID NO: 55714 - DNA, 201 bp, Homo sapiens
tttccttccatatctattagattttgcttcatgtattttgttaggtgcatatgcattaaagatttatgtctttttggtgcactgacctttttacccttatwatcatgtaatgcctcactttatctctaataattttccctgctccaaagtttgcactgtgtgaaattaatttagctactcctgttttctttttattagttt

SEQ ID NO: 55715 - DNA, 201 bp, Homo sapiens
taacacattgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatataga

SEQ ID NO: 55716 - DNA, 201 bp, Homo sapiens
atgcatttaaggttcttctatgtattctctttttttttttttttcttttttttttgagatggagtctggctctgtctcccaggctgagtgcagtggcgcarcctaggctcactgcaagctccgcctcccgggttcacaccattctcctgcctcagcctcccaaatagctgggactacaggcacccaccaccacgcctggct

SEQ ID NO: 55717 - DNA, 201 bp, Homo sapiens
actaacacattgacatgtgaccttaagacattagaccaatattatttaccatacttttccaataaatgtgattctttacacacacacacacacacacacacacacacacacaatctaaatgtatctttacttgtgtatttcatagaccattatgtaattacattcatagcacagaaaattgaaacagctatgccttatata

SEQ ID NO: 55718 - DNA, 201 bp, Homo sapiens
aggttcttctatgtattctctttttttttttttttcttttttttttgagatggagtctggctctgtctcccaggctgagtgcagtggcgcaacctaggctyactgcaagctccgcctcccgggttcacaccattctcctgcctcagcctcccaaatagctgggactacaggcacccaccaccacgcctggctaattttttt

SEQ ID NO: 55719 - DNA, 201 bp, Homo sapiens
ccattctcctgcctcagcctcccaaatagctgggactacaggcacccaccaccacgcctggctaattttttttgtgtttttagtaaagacaggttttcacygtgttagccacgatggtcttgatctcctgacctcgtgatccacccgcctcagcccccaaagtgctgggattacaggcatgagccaccgcgcctggccctc

SEQ ID NO: 55720 - DNA, 201 bp, Homo sapiens
tatggtgtgtttctctatagggtattatgggtcctccaggtctacaaggccccactggaccccctggtgaccctggcgatagggtaagtgaatggacatgwtatctcattacaaatgcatgtcatacagacttaaataattaaaatgtattctacaagtataacatgttatcttactgcgtgtgggaggggtaaaggcagc

SEQ ID NO: 55721 - DNA, 201 bp, Homo sapiens
taaaaaattagaatcatttcttcatattctataataattttcagtattatggagtcaggttaatatatttttgtatattatgatttgaaatgtataatagkcattttacacaagacagaaataccttgcaatgcataacctaaaattgaaaatgaataatttttatttgagtaggagcaatgagcaaaacttgagttttta

SEQ ID NO: 55722 - DNA, 201 bp, Homo sapiens
cctcaaaatatatgagttggggaaagttcagggaattagttctgtagtaccattggattagaaaatgaaataactatttttgcccatttcaaaggactctytcatgatcattatatttatatttaactatacagttatacatggcatgcatatatatatgtatacataaacttttattaaagtattctacaaattaaatgt

SEQ ID NO: 55723 - DNA, 201 bp, Homo sapiens
gttatacatggcatgcatatatatatgtatacataaacttttattaaagtattctacaaattaaatgtaatccctcataatcataatttgcagatcatggrtgctggttattaaaggttaaatatatcttttagttaggtctaaggttaccaaattaagtgaaaacaaaacaaaaatggaacaacagaaccaagacacctg

SEQ ID NO: 55724 - DNA, 201 bp, Homo sapiens
agactttaaaccaacaaagatcaaaagagacaaagaaggccattacataatggtaaagggatcaattcaacaagaagagctaactatcctaagtatatatkcacccaatacaggagcacccagattcataaaggaagtccttagtgacctacaaagatacttagactcccacacaataataatgggagactttaacacccc

SEQ ID NO: 55725 - DNA, 201 bp, Homo sapiens
gtataaattttttctgctatttacagaacgtattattctgaaagttaaaatcttatctgtattgtacatagtagacacttgcagcaaaactattgtattcmaatttaaatcaagtactttgccttctaattatttagtctgttttactgattatattaggataatagtttttcttcatgtattttatcgaagattttatta

SEQ ID NO: 55726 - DNA, 201 bp, Homo sapiens
atcttagggcaagcaagatactttttaaaccgcaggttgcctcagtattccacaaggtgcttcaactattagagagagtattttctcttgtagaaattctwggaaataacaaagtattatttttttctcactagcgtgatagcaagctaagatatttcaaatatttttgtctaaaaaatcttcaaatacactagaatatac

SEQ ID NO: 55727 - DNA, 201 bp, Homo sapiens
aaataaggtggaaagggcaaatgcaaattagataaagtagacttacgttataagttattctagttctagtaaatattattttgatatttatttattttggktatttcatttatttttctagggccccccaggacgtcctggcttaccaggggctgatggtctacctggtcctcctggtactatgttgatgttaccggtatg

SEQ ID NO: 55728 - DNA, 201 bp, Homo sapiens
ataagtcagatgtaattcttatcttcgcttgtataggtaagttggtttttttcccctctgggttcttttaatatttttaaatttatcttagattttctgatatttgaaaatgatattcccagatttttggtctgatatttgaatattatacttctggaattttggtttgatgtctgacattaatttgggcaaattctcagt

SEQ ID NO: 55729 - DNA, 201 bp, Homo sapiens
tgccttattttaagaaattgatacagcaacctcaaacctcagcaaccaccaccctaagcagttatagacacagaggtgagaccctccaccagcaaaaataytacagtttgctgaaggttcaaataatcgttagtattttttagcagtaaagtatttttatattaagatacatacatttattttacactgaatgtttttgta

SEQ ID NO: 55730 - DNA, 201 bp, Homo sapiens
gtggggtaatgaaaaggcaaaacctaatgacttgtagattcccagcttgtataacagaaggacagaaaggacctctgaatgcaatcaaaaatattatcttstgcaaaactgatgaaattttgactcttagaaaataatttattttaaattacaaaaatatattttatcggaaacagaagttgagttcattatcaaggcact

SEQ ID NO: 55731 - DNA, 201 bp, Homo sapiens
tgttcactcttgtctttatgatgtttttctttggtcactatcagtatatattctctttaaattatgtatttaaacatgttcctacttcttaaatgaaataygttagatgatgatactgtcacatgcttcagcacttccttactaatttatactctctaaagaatatctgtggacattattttctaagttctttttttttaa

SEQ ID NO: 55732 - DNA, 201 bp, Homo sapiens
tatatgagttggggaaagttcagggaattagttctgtagtaccattggattagaaaatgaaataactatttttgcccatttcaaaggactctctcatgatyattatatttatatttaactatacagttatacatggcatgcatatatatatgtatacataaacttttattaaagtattctacaaattaaatgtaatccctc

SEQ ID NO: 55733 - DNA, 201 bp, Homo sapiens
ttccctctctctataacacaggtgcattaaaagcaatttaatgtcatatatgatatgattcagcttttgtagattttcaaatatcagactatattcagttrtttattaaatatgaaaagattgattaagtcaaacactttcaagcctctttttcatgaacaaaaacatgagtaaacacaccaaagttgaaaactctgactt

SEQ ID NO: 55734 - DNA, 201 bp, Homo sapiens
ttagtaataggaattggggtgccaacagtgaataacaagtattcctttatttaaaagaaaaactgaccactttcacataaattatgccaggaaattctagmtaaatcctctaattttctcaggtgaaagttatttcaaatttcttatatcttcataattggaatatagcaggtagtaaagaaatatgtgtctcatatctta

SEQ ID NO: 55735 - DNA, 201 bp, Homo sapiens
ggattacaggtgcatgccaccatgccaggctaatttttgtatttttagtagagacagggtttcgccatgttggccaggctggacttgaactcctgacctcrtgatccacccacctcggcctcccaaagtgctgagattacaggcgtgggccaccacgctgcttcacacctatattcttcccacacctgaatcaaacaatgg

SEQ ID NO: 55736 - DNA, 201 bp, Homo sapiens
attaaaataataaatatatagaaatgcaattaccaattatttatttttattctctgacaggtattttctctgagggacttagaacaggcaccaaaaaaaaaggatgatgctaaaaattgatatgtaaaaagctgatacccaaatatctggtattgtgttggaggaataaacgtgtcagttcaactgttaactctttatgaa

SEQ ID NO: 55737 - DNA, 201 bp, Homo sapiens
taatttataaggaaaatagggttacttggcttacagttcagcaggttgtacaaagaagcctggggctggcatctgcttggcttatggtgagggcttttgtwctgtgtcaaaacatggcagagaagttcaaaggggaaccgggcctgaacaaggagggaccaaaccctgcaggagtgctgactttaaaacaaccctctttca

SEQ ID NO: 55738 - DNA, 201 bp, Homo sapiens
attacttcatcaaagtgcagcaagagctcaccagattaagtttctgccccttcgtttatgcaaacatatgaggaataagttattgggacaacaatttgtcygtaggcattgtctttgttttgtactactataacagaataacacagactctgtaatgtataataagcacagatttattggctgaaggatgggacatccaag

SEQ ID NO: 55739 - DNA, 201 bp, Homo sapiens
ggcatctgcttggcttatggtgagggcttttgtactgtgtcaaaacatggcagagaagttcaaaggggaaccgggcctgaacaaggagggaccaaaccctrcaggagtgctgactttaaaacaaccctctttcatgggaactaattcattccttcaagaaacaattcaatctccccagagcaagaactcaatcgctatgca

SEQ ID NO: 55740 - DNA, 201 bp, Homo sapiens
tgaaggatatatacacacacacacatatatggagtgagagagagtgtgcattcttggcctaacttcatttttcaactcatcatttaagtggcaatgatttwaaattgacagaccttaaaacagaatctctccacgcataaattacctctttggagaaaggtaggacatttcatgagaatggattaaccctagagtgctttt

SEQ ID NO: 55741 - DNA, 201 bp, Homo sapiens
atgagaactcactatcacaaaaacagcccaagaggatgctggtaaactcttcatgaaggatccacccccaggtccaattacaccacattaggtcccagctycaacactgcggattacaattcaatataagatttgagtgtggacacatatcccaactatatcagtggatgacagggttattccagaaagccatttacacta

SEQ ID NO: 55742 - DNA, 201 bp, Homo sapiens
agtggtcatttacagctcttaagcctctgccattgcccaatcacattcagtacagagagcatcctgggcaggatggtgaaaatggcatgactttctcttgaaaaaaaaaaaaaaaattcctggcatgctagagttctttgagtatgcaagataacagtttgaatctctttccagggttaggtctcatattcacaagtaccc

SEQ ID NO: 55743 - DNA, 201 bp, Homo sapiens
tgtctcaaaaaaaaaaaaaaaaaaaaaagccaacgttttctgtgaaattttataaagactcaatttttcatttttattttaaagtaatgatttttggaatrtttctttcttaaaagattttaaattcaaattgcatttgaaaggcagcaaaattttaggaagcaaaaacatgacattttaataaatcaggaaaatagtttg

SEQ ID NO: 55744 - DNA, 201 bp, Homo sapiens
agagagagtattttctcttgtagaaattcttggaaataacaaagtattatttttttctcactagcgtgatagcaagctaagatatttcaaatatttttgtmtaaaaaatcttcaaatacactagaatatactaatgttaagtggtgtagcagttcacaggattcaaaccaggattctcattaattttagaatagatggata

SEQ ID NO: 55745 - DNA, 201 bp, Homo sapiens
tgtaaataataaactgattcaggtagtttataatggtaatatactctcagatatcccaatatccaacactgattgcatgcacattatgataaacaattatytattcattaggcaaataaatattaatataatttctaatcttgaaaagcattattttaaaaataaaactattcataaacataagttgcatgtgaattatga

SEQ ID NO: 55746 - DNA, 201 bp, Homo sapiens
gatatcccaatatccaacactgattgcatgcacattatgataaacaattatttattcattaggcaaataaatattaatataatttctaatcttgaaaagcrttattttaaaaataaaactattcataaacataagttgcatgtgaattatgaataaattataatttatttttgtaacccacaccttattttccaggaacat

SEQ ID NO: 55747 - DNA, 201 bp, Homo sapiens
tgaaattttataaagactcaatttttcatttttattttaaagtaatgatttttggaatgtttctttcttaaaagattttaaattcaaattgcatttgaaargcagcaaaattttaggaagcaaaaacatgacattttaataaatcaggaaaatagtttgctacataaccaaaagaatactatttttaaaaatttgtactta

SEQ ID NO: 55748 - DNA, 201 bp, Homo sapiens
gcacattatgataaacaattatttattcattaggcaaataaatattaatataatttctaatcttgaaaagcattattttaaaaataaaactattcataaayataagttgcatgtgaattatgaataaattataatttatttttgtaacccacaccttattttccaggaacataaatgtgtaagacaaaagcacagtatcag

SEQ ID NO: 55749 - DNA, 201 bp, Homo sapiens
taggttcaaaatcaatctcttaccatcaaaaggagaaaggtactcaaaaatatgaggaaaacactttttaatgataatgtatttacaatataaatgttgtmttacatctatattaaaaaagtagaagctattacttttgtttttaatgataactatgatttatttattctggctcaagagccttcgcttcgaaaatttggt

SEQ ID NO: 55750 - DNA, 201 bp, Homo sapiens
ataaatgtgtaagacaaaagcacagtatcagtggaatttctttccttttttaaaaattgatgcttaactttgtaaaactatatcccacattctgaatcctrgagtaacttcagctctttagttggagaagctattaaaacattaagaaaagtaatgttgaaaggattctttaatgaaacccttagtgaatatgacagtgag

SEQ ID NO: 55751 - DNA, 201 bp, Homo sapiens
tattctggctcaagagccttcgcttcgaaaatttggtaaatagtaatgtttaattgtatcatggtataatttaacattttaatacaatttaactaatgtcwtatgtttttacaatccaagagcaattttttgtactaacttatcatagcctgtgcttttatttttggtaaaaatatttcataaaatttaagttaattaact

SEQ ID NO: 55752 - DNA, 201 bp, Homo sapiens
atatcatgctagattatgtaaataataaactgattcaggtagtttataatggtaatatactctcagatatcccaatatccaacactgattgcatgcacatkatgataaacaattatttattcattaggcaaataaatattaatataatttctaatcttgaaaagcattattttaaaaataaaactattcataaacataagt

SEQ ID NO: 55753 - DNA, 201 bp, Homo sapiens
attttaatacaatttaactaatgtcatatgtttttacaatccaagagcaattttttgtactaacttatcatagcctgtgcttttatttttggtaaaaatakttcataaaatttaagttaattaactaaaatagataatatattatatttttctgacatttttgataaatataccaaatacatcctatgataaattgtgata

SEQ ID NO: 55754 - DNA, 201 bp, Homo sapiens
gggagaagttggtcaaattggcccaagaggggaagatggccctgaaggacccaaaggtcgagcaggcccaactggagacccaggtccttcaggtcaagcakgagaaaaggttggtaaatgactttaaattcactggtactcttgcagctgatgtttcattatcatttaaatttctttcaataactggtgtcagaaattgag

SEQ ID NO: 55755 - DNA, 201 bp, Homo sapiens
gtacattagttgagttccctttgatttttgataaattattttaaaataacctcataaaaattttagcactgttctatcctctctttttaaattacaatttrtagaaagatgatgagctattttaatccattctagtcactttgtaaacaaaattagaaggctttgtattcatgaattaataataacatgagaacggtggtg

SEQ ID NO: 55756 - DNA, 201 bp, Homo sapiens
ttccaatcatggcagaaggcaaagtgagaatgagacgtctcacatggctggaataggtgcaaaagagagtgagaggggaggtgctacacacttttaaatarccatatctcatgagaactcactatcacaaaaacagcccaagaggatgctggtaaactcttcatgaaggatccacccccaggtccaattacaccacattag

SEQ ID NO: 55757 - DNA, 201 bp, Homo sapiens; identical to SEQ ID NO: 10496

SEQ ID NO: 55758 - DNA, 201 bp, Homo sapiens
aggcatttagtaaatgtttattgaacattgtggttactgaaggtccaaaacatgtttgacactggagactcacaggttaattaggcaggattcttgtgttmggccatttagcagaaggaaaacaacctatgatctagaaaatgcaggacggcatattgttgcaataataattattcagtgaaggccacaagatggagaggt

SEQ ID NO: 55759 - DNA, 201 bp, Homo sapiens
agcctcccgagtagctgggataataggcacccacaaccatgcctggctaatttttctatttttagtagagacagggtttcaccatgttggccaggctggtstcgaactccttacctcagatgatccacctgcctcagcctcccaaactgctgggattacaggcatgagccactgtgcctggcccacttttagattttactg

SEQ ID NO: 55760 - DNA, 201 bp, Homo sapiens
ctacaaaggacatgaactcatcatttttatggctgcatagtattccatggtgtatatgtgccacattttcttaatccagtctatcattgttgaacatttgkgttggttccaagtctttgctattgtgaatagtgccgcaataatgctatttaagaaaattacaaatagaagcccccaccgttctatctcagaaagaaaata

SEQ ID NO: 55761 - DNA, 201 bp, Homo sapiens
cctgcctcagcctcccaaactgctgggattacaggcatgagccactgtgcctggcccacttttagattttactggtaaaacaaaaacctcaaaatactccrcagcactttgaatgagtaattgctcaattaattttattgaacacatgaatgactatttcttagtaatttaatttttttttcttgaacttaagagataata

SEQ ID NO: 55762 - DNA, 201 bp, Homo sapiens
aaaatgtccttctgttcctagttttcagaacatgttttaaaatcatgaatgaatgctgtattttgtcaaatgctttcctgcatctatgatatgataatttrtttattttttctttagcttgttgatggtgatactaatttattttcaaatattgaaacagcctggcatacctgggataaattccacttgactatggcattt

SEQ ID NO: 55763 - DNA, 201 bp, Homo sapiens
aatatgcttttgctgatactgcattttaatttgaaaaacagcaatactgtcatccaacagtatgattacttttaaaaacactttgagagtgagacaagtasctcttgggaatttttgttttgttttgttgttttagtaatctaggtggattcattttcaataactattcatatatgttttcaatgtctatacaggaagaac

SEQ ID NO: 55764 - DNA, 201 bp, Homo sapiens
agatggtacctgccttgcttgatgaagctgactgacattttgaggatttcctttgcaaagggtttctgagtgttccaccaatgtcccctataacccttagwatgcctatacccggttgtctttccccttttcctttagagctgataaagacaacaaaaaggaaatgactcaatcttcactacatagaatgtacaggatcta

SEQ ID NO: 55765 - DNA, 201 bp, Homo sapiens
acagtaaagctcccctagcctccagagaaatgtggaaaaacagaaaatgttgtttcttacacagataactcgagttccctattgtgaagacttatataccytttgctgttcttcacaaagcagaacaataaatgcagatctataagattctaaatattctaaccagcagggagtaattcaggttgcttccaatcagtgcct

SEQ ID NO: 55766 - DNA, 201 bp, Homo sapiens
aaacattttataagtggacattttgtctttattggtattcatgtaataaatctcattcttcctagtaaatggtgtggacaatagaggcacagaaactcctkaaggcaaaacaagtagctttatgtgtgactaatggttttgggagaaaagttaagtttctgagtaaagagtgggtagtaagggcaggagaaaaaacaactt

SEQ ID NO: 55767 - DNA, 201 bp, Homo sapiens
gtattttaggagaaggaatcatgaaacgaaggcataatcggtaattctttgtaattggaacaagaaatatcctagtatatctggaagttttaacatggaagacatttgatgcataacggcttttgatttcctttctattatcctaagggtttaaattaccacttgattttttaaaattaatacacctttcacactattacc

SEQ ID NO: 55768 - DNA, 201 bp, Homo sapiens
cattacgtcaagagcagaatatttggatttttctcttgtttgcagtttccaaaagctcttgaaattaaaactctttaggtaattctattattaaatattaytaatgttttgattttattgaaatcatacaaatttattgataggtgatgtttaatgtatccttaggaacacttttttttttcttaatataaatgcatcaaa

SEQ ID NO: 55769 - DNA, 201 bp, Homo sapiens
ttcatatgttatttaacataacattaatatactatttaccatctattatctatatagtcataaatagtatttatttgtagtgttattattcattgctcaaraattatttgctttactgtaagattcctttgtaaagtttttgttgccctggtgttttgggaaaaaaatgcatattttatttatcaatttcaatgtaatgaa

SEQ ID NO: 55770 - DNA, 201 bp, Homo sapiens
gaatattaatctagcacttttcatttggaaaaaaaataaaatataaaccagactggcttgcagaattgagtgggcttcatttaatggtttatgttagcacyatacattgttaataaaacccaccattttacagtatggttagggaatgtgcatttccaaagggctggccatgtctccccagccaagcctgtcatcactgct

SEQ ID NO: 55771 - DNA, 201 bp, Homo sapiens
ctaaagatttctataacttattttataaaatatattcttttgaacgattttaaggtaattatttgaacttaaatattttatgaggtcattgaattcctcaytttattagtcctcttaacctacttgaaaaataggtagcaagcattataattcaatttttcagatatttaatctcaaggattaagaagtatattgtcaaaa

SEQ ID NO: 55772 - DNA, 201 bp, Homo sapiens
tatataaaattaagcttaagcttatattcaaaaatactcctctatcactaagacttcagttttatcaagttgatttgctttcattgtctatgcattttctytgattattctgtgatattattccaatatttctgtttgagaccattttgtgcagttataacagaataccacagactgggtaatttataatgaacaaaaata

SEQ ID NO: 55773 - DNA, 201 bp, Homo sapiens
ttagatataattattcctcaccatgaatttgctatgtttccttctagaggcattcattgagacccagattatgcctagctgggcagtggccagaggaattyagaccacaaagtacagagagcataaggtggtaataactctattcacccaagatgctttgcctgaaaggaccctttcacagcagtgagaaggtctgagttg

SEQ ID NO: 55774 - DNA, 201 bp, Homo sapiens
aataattagagtacttcatttgcataaacatgaataagcaccaaattgatgcacagagttaacaaatacttctcttctttattttttacccagatgtattmtttctgcacctgcttgctcactaaaattctatggatttccatgacacagcacagctgaatctcaaattttagtgccactaaagtgttcttctgcccaatt

SEQ ID NO: 55775 - DNA, 201 bp, Homo sapiens
agcggacgactggagggcttcaagtgcatggtttgacctttgacttggggttttctacattggcatgcttctgaggtttgcatctcttctcgcctgattcytcccttggggtgggctgcccacaagtgcagtgggctgccagcacttgggaggggccacacacacattttgtttcctggagctgtgcgcatgctcacttga

SEQ ID NO: 55776 - DNA, 201 bp, Homo sapiens
atcattcattttgttatattttgagttatattttcattacgaatactctgacctatccttgtcacttgtcaaaatatttggcatgaaccacaatatctggsctcagaatagctttttttttcttgtgaacatgatttcatttaaaggtctgctcttccttttataaaaatgtcaaaatgattcattgatttcttatttatg

SEQ ID NO: 55777 - DNA, 201 bp, Homo sapiens
tttgatctgtttcaggttcaaagggttatttataactgctctcgatatcataccaatttctatttccagctgatgaaaataaaaactgattttgtttggcmaactcatctttagatgtagtttataatgttaagagagattattagcttagataaattaatattcattatctttaacttcatgaataatatttatggaaag

SEQ ID NO: 55778 - DNA, 201 bp, Homo sapiens
aattttaattgatttcactcttcaaatataaataccttaattgtatattatagtcttgtttttattattttttcaagagaatcatatactattttgtcacrttaatgaaaccaacttattttatgccgtaaagatacatttttacttgactctaggaataatgacaaaaattcagatgcttcacattttttcctagtgcat

SEQ ID NO: 55779 - DNA, 201 bp, Homo sapiens
taattatattttcagtgactgtatttccaaatgggattacattctgagatactgagaattaggacttcaacattacaaatttttgtgggatacaattcaayccatgacaatatgataactatttgatatagctctgctcgtaatgtaaattcaagtcgggttgcattgattttaagtttgttaatttataatgatttaagt

SEQ ID NO: 55780 - DNA, 201 bp, Homo sapiens
gcataactgatgtatatttgatctatcagtttggcaatgatttggtgaacagaatattaagaactgggatagcttggggcaaaaatgtatctttaattgakccacagatattccaaacagctgtgaatagcttacttactaataacaattaggataattcatcataccaactctttgacaaaacctttatatacctattgg

SEQ ID NO: 55781 - DNA, 201 bp, Homo sapiens
gccagaggatgattttaataggtctttggggtctctcaactttggtactttgctagtttcatatccctgtactggctgtatgattaaccattgctcagtayagctgcagtcaggagatccatagattgcagaattatttacagaaaattttttaaagaaaaatatctcgcttaaaccattccaagttcagtaagctgtaca

SEQ ID NO: 55782 - DNA, 201 bp, Homo sapiens
ctcacggggaacacatattctgatactatgtttcatagaatttaaattatataatttaacacattattaaatgtttatcatgtattttatcatgctttgcytttccaaaatacagtaatatggcagattctatatcacttaaccaatgaaatagagttaatttttaattatttgttaatgactcaaatttacataacagga

SEQ ID NO: 55783 - DNA, 201 bp, Homo sapiens
gtctcaaaaaaaaaaaaaaatttacaaatatcagtcctaggatatctaaaactctattattcaaataaatttcatttattatcttgaaaaacacaaggaartggattcatagaggctaacggcagcaatgagcagaaacaagggaggcacattatattagcagttcttattttcattaaacaaccattaagagccagccaa

SEQ ID NO: 55784 - DNA, 201 bp, Homo sapiens
tatataacattagtcttgttgcaatgatttattgatttgtgattttgtcccacctttcttttaaatgaaacattttagataaattttaaatttcattttarctaattgtcattttacattgtgcacacttggatctaacatactaaatggtagttttcatatattttggacaaatgaatattaatatattattctaaaaat

SEQ ID NO: 55785 - DNA, 201 bp, Homo sapiens
cgatagtttactgagaatgatgatttccaatttcatccatgtccctgcaaaggacatgaactcatcattttttatggctgcatagtattccatggtgtatrtgtgccacattttcttaatccagtctatcattgttggacatttgggttggttccaagtctttgctattgtgaatagtgccgcaataaacatacgtgtgca

SEQ ID NO: 55786 - DNA, 201 bp, Homo sapiens
ctgaaaacacacttttcattccattcagttgtcctagaaaacatttttcatcttgcttagtctcctatgggagagcacttgtctctgaggatatcatcagrttagacaaaaggcaccaaggcacacaccttttcctcttctctttgcatcatctccttttggctctaatgctgactcaattgttgtgggagctagtctcta

SEQ ID NO: 55787 - DNA, 201 bp, Homo sapiens
taaaagagtttttagattttcattcttcttaggtaatttaaaagctaaaagatgttataaggggtttgtttcttgcgtggattatgtaattcttaaccagkgtcataattttgattcactacaaaatcaccgcctaaaaccaatctgactattctattggcaaagagattgaaattatgtttcaggaatcaaccagagttt

SEQ ID NO: 55788 - DNA, 201 bp, Homo sapiens
gccagctgttacacagaaaggtgggtgaaggttatgttaacagtggcaaatccatatggtatactaagggttataggagtgaaagtttattaaaaagtttyagaacagaaatgaaagaaagtaaagtacacttggaagagggtcaagcggacgactggagggcttcaagtgcatggtttgacctttgacttggggttttct

SEQ ID NO: 55789 - DNA, 201 bp, Homo sapiens
tgaaggtaggtattgagagaaaaaaatcatattgtttctttttaccatttcaaaacatgcaaatttgatgtttgcatcaaaacattaaattattagtcttycaaatatctcttaattctatagtctaaaaaagtattcactagattaagatttagaaaagaaagtctacatcgatattttgacatctgtacatttttccta

SEQ ID NO: 55790 - DNA, 201 bp, Homo sapiens
gtatatttttataaacattcttataattattttaagctgtatattagattattgtttaggaacataaagtttagtgacgtatataacctcagtattgtacsatttatgtttgtatgtattgttgagaactgcttggctcatgtaatattgtttcattgtcaaagaaacccatttgactcatttttttatcagactttttca

SEQ ID NO: 55791 - DNA, 201 bp, Homo sapiens
atatgattcacatgtcatctagtagttgcaaaaattaaagttaaaatgattttgcaatattgtgttttggttgccaattattatattgaatgagtgcaggyattatgttctttaagcaggaacctcacaattacggtgtccttaatatccacatttataagctgagaaagctgagccctagaggattcctgtaatttcatc

SEQ ID NO: 55792 - DNA, 201 bp, Homo sapiens
ttaaccactaatttgcactctccaaagtgcaaagattatatcaaatatgtgtttctacacccacaggttcaatattttgtgtataatactttctcaataaktatctgttaataaaaaaatgaatattgtggtataaatgtagaatgaattatttccacattctttaatttttaaagatttttgtaatttaatttccatatt

SEQ ID NO: 55793 - DNA, 201 bp, Homo sapiens
acttttacactgttggtgggactgtaaactatttcaaccattgtggaagtcagtgtggcaattcctcagggatctaaaactagaaataccatttgacccasccatcccattactgagtatatacccaaaggactataaatcatgctgctataaagatacatgcacatgtatgtttattgcggcattattcacaatagcaaa

SEQ ID NO: 55794 - DNA, 201 bp, Homo sapiens
aatcacaactttgagataggagtttctggcatcagtattttataaaaagttttccaagttaattttactgcactgtcaggagagaaaatctttgttttacratgaaattaaataattattcttatttctaattctagcatatagaacctaagagttgacatagaaaaagctaaaaatacctatcaacaaaaaatacttcta

SEQ ID NO: 55795 - DNA, 201 bp, Homo sapiens
aagaactaaaataatttttcggtgaagacatagacagatgaaatttgagtgcaatctttctgtcttcctttatactgtaacacagagcttttcctaaatakcagttacagtgcaattgaatacaatggaaatagatttgaaagaatttttttgtcttttggagacggagtcttgctctgtcacccaggttggagtgcagtg

SEQ ID NO: 55796 - DNA, 201 bp, Homo sapiens
aacaaattgaaaaaatatcatatttgctgaagttagaacattaaaactatgggctgtttactgtatacattccctttgatgaactgtccataaaaggaacaaacaaagaagtcctgctgccttaaataaacgtgtcaattgtattgtgactatattattctaattagtttaaaacgcgattaaatttgcccaccaggaaat

SEQ ID NO: 55797 - DNA, 201 bp, Homo sapiens
ttttaaaatattaaaagttcataaccagtggacttatataattcaaatatttcaaatgaagtggcagcatgaaaaacagttggaagtataaaggtagaaakaattcgattcctttccttctcagtataaaggtcaaagctgacacccctataaaaaaaaaggttaacaagagaaaaatattaaaaatgtatttgattatag

SEQ ID NO: 55798 - DNA, 201 bp, Homo sapiens
acctatttaattgcctcttctttatttatgtcctctctcttctttctaacagggacccgctggccagaaaggtgacagtggtcttccagggcctcctgggyctccagtaagtatatgttaacaagagtgatgttctgacagtttgcatctggaagctgccaatgatttctctgaacttataagatagacaaaaagcacatt

SEQ ID NO: 55799 - DNA, 201 bp, Homo sapiens
tgaaaatgaaatagctgagaaaatccctttaaattggctgattctctctctagggaattcctggtcctgctggtcccttaggtccacctggtcctccaggyttaccagtaagtacaagacaaaataaccttataaggtagggttaagttacaaatataacagagacacaaatgctccagatttttatctgtgcttttgcat

SEQ ID NO: 55800 - DNA, 201 bp, Homo sapiens
caaatacaaagaattttacattgcaatacattttctataaaatgtcctataattactgttttataacaagagatgaaataatacttgattaattcatttaytcagaaggttaaaaactaaaatgttttatcaatttgtgctttcaatgcttccaggatttcagatgtcattgtaagttcattttcaattacttcgatgata

SEQ ID NO: 55801 - DNA, 201 bp, Homo sapiens
tgatatcttaaaatttctatatttgatttaaatattaacagctgtgtgaaaatcactctgttccaaaataaattacatcttgtgactgaaaatgttaattkccatgtttattcattatttacttttattattgtagggttccactggattccctgggtttccaggtgccaatggagagaaaggtgcacgggtatgatatat

SEQ ID NO: 55802 - DNA, 201 bp, Homo sapiens
agggagaaaaaggtccccaagggcctgcagggagagatggagttcaaggtcctgttggtctcccagggccagctggtcctgccggctcccctggggaagayggagacaaggttggtattcattattcgtgttagtagatcctgtgaaaaagcttaatttttgtcaagaattctagataattctaatctttatgattaggcg

SEQ ID NO: 55803 - DNA, 201 bp, Homo sapiens
aattgagtataacgtattgtttcctttacttgaaaaaatttgagagataaaatgccattttttatgagtttgtatttattttgcattcttggttttttttkgtttgtttgttttgttttgttttttgttttttgagacggtctcgctcggagtgcagtggcgccatctcagctcactgcaacctccgcctcccaggttcaa

SEQ ID NO: 55804 - DNA, 201 bp, Homo sapiens
tacttgaaaaaatttgagagataaaatgccattttttatgagtttgtatttattttgcattcttggtttttttttgtttgtttgttttgttttgttttttkttttttgagacggtctcgctcggagtgcagtggcgccatctcagctcactgcaacctccgcctcccaggttcaagggattcccctgcctcagcctcccga

SEQ ID NO: 55805 - DNA, 201 bp, Homo sapiens
ctacgtctctgaattcgtcatacagtttcatccctcaaaagttttgtttaagatgctttttatgtttaatgctattttacctccatccccttcattaggcyaactcctatttgcttttaacaaatcatcaagatttttccaagaaccgtttcatgaaaatgttcattctcattgagatacctgtatgttgcaagttaatgg

SEQ ID NO: 55806 - DNA, 201 bp, Homo sapiens
atattttacagttaaacttatgcatattcatttgtattttttatttgttgtatatattattcatgtttagagtattagtatcacattaatagtcacataasattccactactttatgtaactgaatttctttagttcttttttctaagattaaacttttggaatgacaggattttcagtatcatagctactgttagcaaga

SEQ ID NO: 55807 - DNA, 201 bp, Homo sapiens
tgcaaaaggctaagtactgcttttttgaaactcatgtttcagctactttacatgcgcatggttagggagcattaagtaaaatacatttttcacagtggctyacagtcaaataatattcagcaattacagtgcagtgtcaagaagtcagtaatgtcacgaaagtactagcagttatttagagcttttacattgtatttttat

SEQ ID NO: 55808 - DNA, 201 bp, Homo sapiens
actcattgtgtctccactaattgtaataataataattttttgtcttaatcaatacaaactatgatctaactgaattaaaaataaataaatttttttctatygggatatttttattgaactaattggaataattatatgcataaaaaagatgaaaatgcacaactgggtttgtaataaaaaaactgtgaattaatattgaca

SEQ ID NO: 55809 - DNA, 201 bp, Homo sapiens
ttatttttaaatcttcaaatgccttttaaagactgcagagtctctgaagagtagaaattatttcatattaaatgagatgcctattaaaataatgagttttstgttatttattcaacttatattataggagatcattattggtttagagattcctcaaatggaacacttaaaatgatatttttagaaagcattttgttttgt

SEQ ID NO: 55810 - DNA, 201 bp, Homo sapiens
ttcccagatgtatgtagaggggagaaaatatgcaaatagtgaaaaatgtgctggaattcagtgctatatcttctcaaggttccattatagcaaccatatgkagaaagcatatggttatactaaaataactattcagaaaataaacagactgaataacaaaatatctatttttatgtttttaaatgtgaaaataaaaatttt

SEQ ID NO: 55811 - DNA, 201 bp, Homo sapiens
aaattatcaatattatggttacaaattaaaccatagtgttttaaatatataaatttacttagaagccttaaaaataaagcaacattaatcattactatttkcaactccgtattttcaaaactaaactaggtctgtgactagttataggattctctaattcatacctactctgtttttgttttggggttttttttttgttat

SEQ ID NO: 55812 - DNA, 201 bp, Homo sapiens
atggatgtcttgatgcacacacaaggcagaaagtagcaagagactgaacatcaagagagtaaggcagtgcagcatttttctgcatgatgaatataaactgrgtaaatgttttctatgtatgtaaacagatatatgtaaatatatcatgcaacaaattctcagatttcacctactgcatatatttttataaaacaaaatcaa

SEQ ID NO: 55813 - DNA, 201 bp, Homo sapiens
ctatgtcatttgcttaatgggtaggtaccatcagagattttcacttttcatttatagatatataaaataaaattatagcagagcatgctgttattacaaayatctaggctttgagagtgtttgaagtaactaatagaaaaagaaattgcagttgtactttagggcatggatatacattccaaaagtcttctcttgttttca

SEQ ID NO: 55814 - DNA, 201 bp, Homo sapiens
gattgaccctccaattttttccttttattgtagttctatttgagtaaatggctttgccatcctaccattgcttacttgagaaactgcagaattgctctacrttcctctgttaacactttgctccatatttccttatcattctcgtctcactccatcatcagcatccagtcagtttccaaatctcacagatatattttttac

SEQ ID NO: 55815 - DNA, 201 bp, Homo sapiens
tggaatgtgtatggatttaaataaattagaatcttttagaacacacagtatttcagcatgaagtaactataatcaccatgtttatttttaatgttctgaargtttttggggatatgtgttgcctagtgtttaattttaaacctcacaacttgtttataaagcaattttatgttttgtttatttattttagtacacatgcca

SEQ ID NO: 55816 - DNA, 201 bp, Homo sapiens
tagttgtacaatattgtgagtgtaattaatgctactgaattgtacacttaaaaaatctaaaatggcaaatttaatgttatatgtattgatcacaattaaarataataatagtacaatataccaaaaaccactgtttgcttttaagtgggtgttttgtatggtatgtgaattataacccgataaagctgtttatacaaatgg

SEQ ID NO: 55817 - DNA, 201 bp, Homo sapiens
caacagacaaacagagagccaaattatgagtgaactcccattcacaattgcttcaaagagaataaaatacctaggaatccaacttacaaggatgtgaaggwcctcttcaaggagaaatacaaaccactgctcaatgaaataaaagaggatacaaacaaatggaagaacattccatgcaaatgggtaggaagaatcaatatc

SEQ ID NO: 55818 - DNA, 201 bp, Homo sapiens
ttattcctcaccatgaatttgctatgtttccttctagaggcattcattgagacccagattatgcctagctgggcagtggccagaggaattcagaccacaamgtacagagagcataaggtggtaataactctattcacccaagatgctttgcctgaaaggaccctttcacagcagtgagaaggtctgagttgtgaccagaaa

SEQ ID NO: 55819 - DNA, 201 bp, Homo sapiens
ccaccacgctacaatacaatggcccatctgtgaggtcagagagactaactttacttttaaacagagactaatttctagccactcatgtattagaaaaactrtaaaatgaatgtcagactgcttagtcatttccttctcaaaataattgacctaaagtttagaaaagggcaagaaaggcaaacctttaggcacagtaagaga

SEQ ID NO: 55820 - DNA, 201 bp, Homo sapiens
acttctcaaaagaagacatctatgcagccaaaaaacacatgaaaaaatgctcatcatcactggccatcagagaaatgcaaatcaaaaccacaatgagataycatctcacaccagttagaatggcaatcattaaaaagtcaggaaacaacaggtgctggagaggatgtggagaaataggaacacttttacactgttggtggg

SEQ ID NO: 55821 - DNA, 201 bp, Homo sapiens
gtcttaatcaatacaaactatgatctaactgaattaaaaataaataaatttttttctattgggatatttttattgaactaattggaataattatatgcatwaaaaagatgaaaatgcacaactgggtttgtaataaaaaaactgtgaattaatattgacataccttttaatttggggatactaaattagatgcactctatc

SEQ ID NO: 55822 - DNA, 201 bp, Homo sapiens
gctagagaggtcagaggaggtaagaaaaaatggatttggggaggtgggagattgccgtcggtcctactgcttctgcgcccctccccccactttacccttcytccccgctcttcaagaaaaaaaaaaaaaagcaattcccttaaatacaatccagattgtagctgctaccaggttggaattggaaactggagaaagagatga

SEQ ID NO: 55823 - DNA, 201 bp, Homo sapiens
atctgtatagaaccctcagaattctgatattcactcagaagacagtatatagacaattttttcatgggccctttcctaatcatatttatctcattaaagamatctgatactttgaaaattttcaaatgcgaatcttacaacttgatgtctgatagcatagaaatctatcttgaagattcacaacattacaaatgagagtgt

SEQ ID NO: 55824 - DNA, 201 bp, Homo sapiens
catttcaaactataatccaaatgtttgtagggcttttttttttttttgagacaagcactgtacttcagtatgaggcaaacatactttatgtatgtcttcartttgtcaaatgaatatgaaaagacacatattcaaggtcaatatttaataatattaataactttcaaagcctcatcaatacaattacatccatgacattct

SEQ ID NO: 55825 - DNA, 201 bp, Homo sapiens
ctatgtttcatacataattttgtaatatccttcattgataatttggaaattattgatttcctgggtaaggtcctcaaagtgttgacacaattctttatgcratattaatatcataggaaaatactttcagattgggaagatataaagcctgcaatggcagatgagacatttccaaaattctaatttttgctttaaagtttg

SEQ ID NO: 55826 - DNA, 201 bp, Homo sapiens
agaattacagagttccatgttttaatttagtatatataggaattatcttcttattctatagaatattattaggcaaccattctaacatatacaaatagagkttgttatttaaatacaaaccaaacagtgtattaaaattttgtctattttttttcctgtggttatcaaagatctattgactgttcaaaagtttattgagtt

SEQ ID NO: 55827 - DNA, 201 bp, Homo sapiens
ttgttaattgaataatatagggaaattgtccactttaatacttagagaattccaaattcagttatgaattaaaaaacataagtatacctaataatagtctraaataccattgttacacaagggctaatttatattaacactattcttgctctttcctgatattcacagttttggtttgagaagcaggcttcagaaactaaa

SEQ ID NO: 55828 - DNA, 201 bp, Homo sapiens
atattctcatcattaaataatattcacattttacttacagtagtttagaggtaatcacaattttgtttgtagaaagatgtgtagaaattaatctgtcttgwcgatgtttattatattctttagggtgatccaggtcctcaaggtatctcagggaaagatggaccagcaggattacgtggtttcccaggggaaagaggtctt

SEQ ID NO: 55829 - DNA, 201 bp, Homo sapiens
agtacctattgggtctcttttccccttctagaagctgcctgtaactacctactgtattgtttctactggtgagataaagctaccaagacattccccttttycccaccttttaaatacaacctagctgttcagtaagtacaacttacctactttcatctctccagattggcagctacctatttagacaattgaaatatctaa

SEQ ID NO: 55830 - DNA, 201 bp, Homo sapiens
atttgtttctttagccattcagtggtgggtcacatgaattattcattttgaaaacaactgaatatttttgaaaaattttttaagtaatagaataaaataamctattaaagagtattaatgcaaacataaaaaagagacatatatgtgtgaaccagtaaatctcatgagccttttagtataataatatgacccaaaacttat

SEQ ID NO: 55831 - DNA, 201 bp, Homo sapiens
catcagaatcagacagaacttgtttcaaatccttgctacttaaaaatgtgacttgggataagttaatttatttgagtctcagttttctcatttaaaaagcrggcataataactaatttacaatactgaagtgaggactaaattaagaaaatgtatatttaaagcacaaagcctaatgcctgaatctatcagaatctcaaac

SEQ ID NO: 55832 - DNA, 201 bp, Homo sapiens
aaaggactataaatcatgctgctataaagatacatgcacatgtatgtttattgcggcattattcacaatagcaaagacttggaaccaacccaaatgtccawcaatgatagactggattaagaaaatgtggcacatatacaccatggaatactatgcagccataaaaaatgatgagttcatgtcctttgtagggacatggat

SEQ ID NO: 55833 - DNA, 201 bp, Homo sapiens
ttttgcccctttcaaaatcagacatctggctatcccagtggattgtcattctaatcagaaatcatcatggattggcatatttccatggaatcaattcttgyttctcaccaatgattacttttatccagacttctcaaggaaaccacaaatgcagactacctttgactatgtggttgaaaatcatgttagggtagggggcac

SEQ ID NO: 55834 - DNA, 201 bp, Homo sapiens
tacatatatttaccaaaattaacagtattactatgttctacatgtatacaaattggtcactcattcccatatgttatagatacttattttaaaatttttcrtttaaatcataaaacttcaatataattttggttgttcattcaaatggtgtgttcactcttgtctttatgatgtttttctttggtcactatcagtatatat

SEQ ID NO: 55835 - DNA, 201 bp, Homo sapiens
gtggctggagttggaaaagggaggaggaagtttcacaactaccatgcacatttctcaaaaataattttccctcgttatcagcacataaatttttatagcartattttaggttactccaaaggactgattaaactcctatttaattccttttataatgttttagggtgaagatggttttccaggattcaaaggtgacatggg

SEQ ID NO: 55836 - DNA, 201 bp, Homo sapiens
tttgttcatatataatgagctatgctgcctggaaagtatacgtctgtaactttcatgaattttcattatatggtggtgttcaatttttgaatgtaaaaatrgtagttttttctagtaatacattatagaaaacaaacagaaatattagttatctaaagcaaattaaatgctttattgggaagatttatttttaagtaatat

SEQ ID NO: 55837 - DNA, 201 bp, Homo sapiens
ataaagtacatttctcccaatgttagcttgctccatgcccaggaacgatcaagggcagtttgaaggtaaaaggcaagatggagtttattatatcagatctstttcactgtcataattttttccctgttacaatttttgtaaaggacgtttcactcataagaatgttgttattctgtgcctcagggagaagttggtcaaatt

SEQ ID NO: 55838 - DNA, 201 bp, Homo sapiens
gactataaatcatgctgctataaagatacatgcacatgtatgtttattgcggcattattcacaatagcaaagacttggaaccaacccaaatgtccaacaakgatagactggattaagaaaatgtggcacatatacaccatggaatactatgcagccataaaaaatgatgagttcatgtcctttgtagggacatggatgaaa

SEQ ID NO: 55839 - DNA, 201 bp, Homo sapiens
atatctaacagagataggagagaatagatcacaaaagtccagtgaccaatgtcaacattggagtgagccgatgacttgggcaacgtggaatccaaggacaytgcagatgtagcaaacacggagggggcgaggtagtaggatttatgactaagatttgatgtgggcagtgaggacaaatgaaaactgaacaatgacctcaag

SEQ ID NO: 55840 - DNA, 201 bp, Homo sapiens
aattttactatgtcatttttgatggttatttagttaaaataattttcaatttctttttttattttatttccagcccactaattatacagtgatgtttaatrtctagatacttgagcttttcttagagagcttattggtattggtgtctaattctgttgtcttctgagaataaatttggtatgatctcaatccatttagatt

SEQ ID NO: 55841 - DNA, 201 bp, Homo sapiens
tgaaatagtctttcttgtatgattatgagaaattttgtatacatatatttaccaaaattaacagtattactatgttctacatgtatacaaattggtcactyattcccatatgttatagatacttattttaaaatttttcgtttaaatcataaaacttcaatataattttggttgttcattcaaatggtgtgttcactcttg

SEQ ID NO: 55842 - DNA, 201 bp, Homo sapiens
gttttctatttctgtgattaagtaaagtatgatgattgtaaggccattatttataactctgctatagcacatgaaagagtaacataatgaaatagtctttyttgtatgattatgagaaattttgtatacatatatttaccaaaattaacagtattactatgttctacatgtatacaaattggtcactcattcccatatgtt

SEQ ID NO: 55843 - DNA, 201 bp, Homo sapiens
ggtgaaatgacaattttcgagcctcatattttcaaagcaggtaacttgttaactgtgcttgcctccatttgatacataccagttatctattgattggtcarttgatgggtgttctcatccttatttaacagaggaggaaactgaatttcacagaggctctctgacttgaccaagttatgtgcagtcaatatttaatctagg

SEQ ID NO: 55844 - DNA, 201 bp, Homo sapiens
attttttaaaaagaggtctcaaaatgattttcattttgttttaaaatcctctttagtattttaaatgttaatttcaatcatattattttggacaacaaatstttttaaaatgtatcagatgaatttattttgggagggggatcaaactgtggtaacattttaaatgttaatcatttaaagaaacattgatatgaagaatcc

SEQ ID NO: 55845 - DNA, 201 bp, Homo sapiens
agacactccacgagaagaacaactccaagacacataattgtcagattcaccaaagttgaaatgaaggaaaaaatgttaagggcagccagagagaaaggtcrggttaccctcaaagggaagcccatcagactaacagcggatctctcggcagaagccctacaagccagaagagagtgggggccaatattcaacatcttaaag

SEQ ID NO: 55846 - DNA, 201 bp, Homo sapiens
ctataaatcatgctgctataaagatacatgcacatgtatgtttattgcggcattattcacaatagcaaagacttggaaccaacccaaatgtccaacaatgrtagactggattaagaaaatgtggcacatatacaccatggaatactatgcagccataaaaaatgatgagttcatgtcctttgtagggacatggatgaaatt

SEQ ID NO: 55847 - DNA, 201 bp, Homo sapiens
ttttttttttttaataaaggcgtgctttttctttttctcctagggcccacgaggtttgctgggtccaaggggaactccaggagctccagggcagcctgtawgtattgctggaaacattgaagattttctagggaaagcttgttgccaaccttttagaggccataaaagccctcagtagagagccaagagtttattgccttg

SEQ ID NO: 55848 - DNA, 201 bp, Homo sapiens
agtgttaaaataaaagttaatcattatgtgtcaattcaaaataaaaatataaaaattaaaaagcacattaaaaataaatactgattaagaatttatcattrataattagcattcaaattgagatgtgctctaaatgtaaaatatacataatctttcaaaaacatggtaggaataataattaatagcttttatgttaaatac

SEQ ID NO: 55849 - DNA, 201 bp, Homo sapiens
atcagctactcttagagttcttccacattagatgttgagaattaaaggatgtgtgattaaaggatgaaagaatcaatgaaagagggtctacttaaggtttyacaccaagtagaatcatcttttattttttccacttaaacatgcatttcacataataagtctattaaaaaatactggtattcaggcccaacttcaagagat

SEQ ID NO: 55850 - DNA, 201 bp, Homo sapiens
gaagtgagaaaacatccttaaacaattacctacaagttttcacagattttctcgccaaatctgcataccctcatttagatgaatttgttctctctgtcctrtaccagctagatcaaaggggaagcctgggaagcctattttgatgaaaaaattattacttttacatagataccgtgaaattatttggtaattagtctgctt

SEQ ID NO: 55851 - DNA, 201 bp, Homo sapiens
taaacaattacctacaagttttcacagattttctcgccaaatctgcataccctcatttagatgaatttgttctctctgtcctgtaccagctagatcaaagrggaagcctgggaagcctattttgatgaaaaaattattacttttacatagataccgtgaaattatttggtaattagtctgcttatttcattggttaatagt

SEQ ID NO: 55852 - DNA, 201 bp, Homo sapiens
agtctggtgatgcagactttaggggtcagattcttgcaggcacagagtaagagacagaaatgttagtaataggaattggggtgccaacagtgaataacaartattcctttatttaaaagaaaaactgaccactttcacataaattatgccaggaaattctagataaatcctctaattttctcaggtgaaagttatttcaaa

SEQ ID NO: 55853 - DNA, 201 bp, Homo sapiens
cctttcacctcaacctcccaaaacctgggattacaggtgcgcgacccagaacctagctggtaaagtaatttttgattaatgtgtaattatagattttatawgtcagtgtatttccgttaccagtttatacaggtaatatttgagacaaaattgatttttgaattataaattcagttgtagtatactttgaagttaaacgga

SEQ ID NO: 55854 - DNA, 201 bp, Homo sapiens
ggttcaaaggatcctcctactttagcctcccaagtagctgggactacagggatgcgccaccatgcccggcaaatttttttgcattttttctagagttgggrtttcaccatgttgcccagtctggtctcaaactcctgagctcaagcaatctgccctcctgggcctccgaaagtgctaggattataggaatgattcaccgcg

SEQ ID NO: 55855 - DNA, 201 bp, Homo sapiens
tttgagagagagagtctttttttgtcgcccaggctggagtgcagtggtgcaacagggctcactgcagcctcaaactcctggacttgagcgatcctcccacytcagcttcccaagtagctgagactacaagcatgcctcaccatgtgcagctaactttttaaaaacatttatttgtaggacagggtctcactatgcttccta

SEQ ID NO: 55856 - DNA, 201 bp, Homo sapiens
tattattaattcctattttatataattaattttacctgaaagaagattgtaagatacagaacccattgagctagaaggcatttatctaatggacatgattwaaaaaaaaatacaatataaaatttataggcataaattagtaaattaagggaaaatcattttattcattctgtgtgctactccagagctcttgtaatacaa

SEQ ID NO: 55857 - DNA, 201 bp, Homo sapiens
aactattttattttggtttcagctatagctacagaattatattgaagagatatatgtgcatattatcatatataaaatcaacagaagagcaaagtaaaatrgctaatggaaatataaaaagaaaagaaaattttctaacatgtcacatttagactataaaataattaaatatttatgacatgtggtatttaatatttgtaa

SEQ ID NO: 55858 - DNA, 201 bp, Homo sapiens
gaagcaaaaatgaagaatcattggatttattgattattttatttcagaggttaaccctgaggcaagggaaatacgatgttattttatagagtgtgtaaacrtgactacttacttgtgctgaaggcttctttttaactgcttatcagttttagttaaaacattatatatactttctcagtaattagaaagcttcctccaaaa

SEQ ID NO: 55859 - DNA, 201 bp, Homo sapiens
ggatgagctgatggagaagacaccattattttttggacatctcctcaagattttccctctcactcttttcactgaagactgtttatagatacattccactyaaacccatcatctctccactctaaaggcaacagattacgaatagccatgatcataataccacattcttttatctagaactaagggattaaatacttgctg

SEQ ID NO: 55860 - DNA, 201 bp, Homo sapiens
acagagcaagactccatctcaaaaaaaaatagtatacagtatctacaaactacacacattgccatagagtcaaatcagcattctgtctcttcttgatataygttaaaataattattaaaatatttcaattaattttaaataataaacatacttcggtataaatttaataagcattattttcataagtaaaagccatggctt

SEQ ID NO: 55861 - DNA, 201 bp, Homo sapiens
atcatttctacctacttctcaccaggttttctggtggatgtaaaacaaagtatttttttctttttttctacgtaagaacttgggtacaatgtttatccatraagatcattttatttttaaatgagcagctgaacttgaaatcattttatcatgtatgattaattctcctgaacatgtatcagccctcgctcctgattctgg

SEQ ID NO: 55862 - DNA, 201 bp, Homo sapiens
tgttaaaatccttgtacaagttagaattaaaagttataggagaaatataattactatcttatttataatatatcttagcctattaacttgttataatacayacaaaagaaaacattttgttttgggaacaaaatatagcttttcctaaaataacgaacctatattgttatacaacaatgttgtataacagattgtttttgc

SEQ ID NO: 55863 - DNA, 201 bp, Homo sapiens
tcccaagccaaaataacaaagctggaggcatcacactacctgacttcaaactatactacaaggctacagtaaccaaaacaacatggtacttgtaccaaaayagagatatagaccaatggaacagaacagagccctcagaaataatgccgcatatctacagctatctgatctttgacaaacctgacaaaaacaagcaatggg

SEQ ID NO: 55864 - DNA, 201 bp, Homo sapiens
acgatcttggttcactgcaagctccacctccggagttcacaccattctcctgcctcagcctcccgagtagctgtgactacagtcgcctgccaccacgcccrgctaattttttttttttttttttgtatttttagttgagacggggtttcaccggtgttagccaggatggtctcgatctcctgacctcgtgatccgcccgcc

SEQ ID NO: 55865 - DNA, 201 bp, Homo sapiens
cctgcgggagagtctggtgatgcagactttaggggtcagattcttgcaggcacagagtaagagacagaaatgttagtaataggaattggggtgccaacagwgaataacaagtattcctttatttaaaagaaaaactgaccactttcacataaattatgccaggaaattctagataaatcctctaattttctcaggtgaaag

SEQ ID NO: 55866 - DNA, 201 bp, Homo sapiens
gcttcagtttaggtggcacagattcttttacctagttgtccattagttttgaaattaagtttcttaatatcttaaagtgacaatttgcttcataattaatrcttaactgaggggatactttatagaagttattctctaaaaggtatttgtatagttttaaacaaagttatgcagtagcaaagtgagaaatgtatttgcata

SEQ ID NO: 55867 - DNA, 201 bp, Homo sapiens
ctcctaattccaaatgtatggctgtgtgttaaatgtttcaattgaatacatcattatattattttaaaatattatttaaaaatttttaaaccagcactctsataatgtgcatcattttagcatctggaaaattagcagaaaagaattttttccattattttgtttttatttttattttttacttttttgagagagagagtc

SEQ ID NO: 55868 - DNA, 201 bp, Homo sapiens
gactctaagctcctaattccaaatgtatggctgtgtgttaaatgtttcaattgaatacatcattatattattttaaaatattatttaaaaatttttaaacsagcactctcataatgtgcatcattttagcatctggaaaattagcagaaaagaattttttccattattttgtttttatttttattttttacttttttgaga

SEQ ID NO: 55869 - DNA, 201 bp, Homo sapiens
tctttcttatgcactttggatgaaaaaatatttccactctgaatgaaatgccactaatgatccagccagtgtttttcctagtctggatagttccctaaaaygcttgcagttacacttattttcctggcatttcactttaaaaagtatgctggcaccagcatagagtgattctttgacgaaacaaattgttctcttcgtgag

SEQ ID NO: 55870 - DNA, 201 bp, Homo sapiens
ttctcaccaatgattacttttatccagacttctcaaggaaaccacaaatgcagactacctttgactatgtggttgaaaatcatgttagggtagggggcacyctgaatacatattggagttgcatagcaatgtactataataaatctgaaatctgaaaaaaatatgatttttctgctatggaggaaacaatttgtcagcagc

SEQ ID NO: 55871 - DNA, 201 bp, Homo sapiens
atattaactttgaatgtaaatgggctaaatgctccaattaaaagacacagactggcaaattggataaagagtcaagacccatcagtgtgctgtattcaggraacccatctcacctgcagagatacacataggctcaaaataaaaggatggaggaagatctaccaagcaaatcgaaaacagaaaaaggcaggggttgcaatg

SEQ ID NO: 55872 - DNA, 201 bp, Homo sapiens
aaattatgaaattgttatgaataaattcttaaattatccctttaaagatgctaacatctctaccttcagcaaacttattttgttaggaataaccaatgtgratcaagtcaatactactcaagtgatagttggaacactatagaaagtaaaatatcttggttatacattagtagtgttgtggtacacttcctttagttaacc

SEQ ID NO: 55873 - DNA, 201 bp, Homo sapiens
tctcttcaggtagtttcagaagtttgagcagggaggctgggaaatctagtaattagcattaccttcctgaggactaaaggggcaaggggcataaatactgrtacagtgctcagtgaggagctgtagttctgtagaagtactttctagcagtgtcaatagtgataagggtcccagactactgtgacaagctaggaaagtatg

SEQ ID NO: 55874 - DNA, 201 bp, Homo sapiens
tattcttttgggttcactctgagttcccacagaaaacagaactctcttcaggtagtttcagaagtttgagcagggaggctgggaaatctagtaattagcaytaccttcctgaggactaaaggggcaaggggcataaatactgatacagtgctcagtgaggagctgtagttctgtagaagtactttctagcagtgtcaatag

SEQ ID NO: 55875 - DNA, 201 bp, Homo sapiens
tatttaatatatatcatatatatttcacatatatgatctatttcatatatatgatgtatttcatatatatatatatttatatacatgataccaatttctawattaggtcttcaagtagatggtgtttccccaacttctcatattcttttgggttcactctgagttcccacagaaaacagaactctcttcaggtagtttcag

SEQ ID NO: 55876 - DNA, 201 bp, Homo sapiens
gttgtagaaattggggggaagagctagatctaaaacacagtgaagtcaatgcactaactataactgaattaggcaatagcagtttgaaattttaggaaaartattcttcaaatacttatttacaatttctagcatgtatgtgtgtataattgcagagaaaataatcagtgccagaattgtaagtctgggagtcatttaaaa

SEQ ID NO: 55877 - DNA, 201 bp, Homo sapiens
  misc_feature (1)...(201): n = A,T,C or G, or insertion/deletion polymorphism (see Tables 1-2)
aattttataaaaatttatttttcatttatttctttttctttcaaaacgtcattctagggtcctgttggttttcctggagatcctggtcctcctggggaacntggccctgcagtaagtatcagggaaaaatcaagaaattattttggagtgaatgtttccaatttctgtattgttaataaagaaaaaaaaatctaataacct

SEQ ID NO: 55878 - DNA, 201 bp, Homo sapiens
gtgacctttattatatctccatttttagaaattacattggaatatagttggctgtctctcgcattaggctgtgagttaccagtattattttggttactcamaatacggtgcctgaagcacagtaatcatctcacacttacccatttgaattattatgaatacctaatattggaataaattttatatagcattacttaatac

SEQ ID NO: 55879 - DNA, 201 bp, Homo sapiens
ttcattttctttatttttttcacttttcccagggtgcacctggactgaaaggaggggaaggtccccagggcccaccaggtccagttgtaagtatgatgatrataaatagccagacaatcatggttgtgaattacagctcttctttcattactctcatgctgtgattccacagtgtgtgggagagaaaataaacacatgtca

SEQ ID NO: 55880 - DNA, 201 bp, Homo sapiens
aatggaagaacattccatgcaaatgggtaggaagaatcaatatcatgaaaatggccatactgcccaaggtaatttacagattcaatgccatccccatcaarctaccaatgcctttcttcacagaattggaaaaaactactttaaagttcatatggaaccaaaaaagagcccgcattgccaagtcaatcctaagccaaaaaa

SEQ ID NO: 55881 - DNA, 201 bp, Homo sapiens
ttcatcagcatagagatggcaattgtggtgatggaggttgttgagataatccagggacacacatacacatatgcacacatgtatatatgtgtttaggtatstgtgtatgtgtgtatgtaaatctgacaacagatttccaaaccaactggttgatgaaaaaattaagcgactaatatgcttataaaatgctaaataaatttt

SEQ ID NO: 55882 - DNA, 201 bp, Homo sapiens
ggacttcaaacttttgttgattctccctttttcattctagtctagtacccatcaacttcgccatagcctagtgtgatatcttcctagggtattctttgaamagttagggtttaaacaggattaaagagagaaaaattttatggcccgacaaattaaaatcgcacctctttttgtatagccaattacaaataaaatactgca

SEQ ID NO: 55883 - DNA, 201 bp, Homo sapiens
agattctaatgaattgtgtatcaaaggtcaaatgaactgaatgaatgatggagaatgattatttggataaaggagacaagcattttcatcaattcctttamgttttttgtttgttttacacaatgttcaaccaaaatgagcttgttttggtagaagtggctcttaagtggctatatttcttccatttattaaaatttagca

SEQ ID NO: 55884 - DNA, 201 bp, Homo sapiens
ttaataaaaatacaaattagaacaaagtcaataatgtaaatttgtataataaaatgatttctaatatatcattaagtataatagtagaaaacataaagtartatattttccagcttttataaataattttctctgagttttgaaatgatgatgttatctaagtatgttaattattaagaaaaaatactaacaattatattt

SEQ ID NO: 55885 - DNA, 201 bp, Homo sapiens
aagctattacttttgtttttaatgataactatgatttatttattctggctcaagagccttcgcttcgaaaatttggtaaatagtaatgtttaattgtatcrtggtataatttaacattttaatacaatttaactaatgtcatatgtttttacaatccaagagcaattttttgtactaacttatcatagcctgtgcttttat

SEQ ID NO: 55886 - DNA, 201 bp, Homo sapiens
agctaagactgtacattcagtgagcttagagtggtaggataagtgggagtgtccagatatccaagttgtatattcaaggaatgtggaaatcatctgagagycagtggggttctttgaaggaatttaaacatcagagtgacatgagacatggatttttggaagcttaatcaagctggtggaatgaagattgatgggaaaaag

SEQ ID NO: 55887 - DNA, 201 bp, Homo sapiens
gctagagagagagagagagagagagagagagagagagagagagtaaaaagaaaacaaattccctttgttttaatgaacccactaatgcaataacggtattrattaatttcattttgccctcatggcctaatcagctttcattaggccctactcccccacactgttgcattgggaattaagtttccaaaagatgtttttttg

SEQ ID NO: 55888 - DNA, 201 bp, Homo sapiens
taatcacaactttgagataggagtttctggcatcagtattttataaaaagttttccaagttaattttactgcactgtcaggagagaaaatctttgttttaygatgaaattaaataattattcttatttctaattctagcatatagaacctaagagttgacatagaaaaagctaaaaatacctatcaacaaaaaatacttct

SEQ ID NO: 55889 - DNA, 201 bp, Homo sapiens
tattcattatatatgtttcatatatatgatgtatttaatatatatcatatatatttcatatatatgatgtatttaatatatatcatatatatttcacatawatgatctatttcatatatatgatgtatttcatatatatatatatttatatacatgataccaatttctatattaggtcttcaagtagatggtgtttcccca

SEQ ID NO: 55890 - DNA, 201 bp, Homo sapiens
ttcaggtattcattatatatatttcatatatatgatgtatttcaggtattcattatatatatttcatatatatgatgtatttcatgtattcattatatatrtttcatatatatgatgtatttaatatatatcatatatatttcatatatatgatgtatttaatatatatcatatatatttcacatatatgatctatttcat

SEQ ID NO: 55891 - DNA, 201 bp, Homo sapiens
tagcatcaaaacatataaacaaccataaatactttttcttcattgcagggtatggcaggtgtagatggccccccaggaccaaaagggaacatggtatgtarcaaatagtgataaaataactcatatttgaatataagccctaagaaaccattttttgttgttaaatctaaaatataatgatttattacattttgctaagta

SEQ ID NO: 55892 - DNA, 201 bp, Homo sapiens
gtcttgtagagatgctataccttcctgacatgtgacacacatactggttattcaaatccttaaacttactgtttggtcatccagatatacatataaaatayatatttcatatatatgatgtatttcatatatacattatatatatatttcatatatatgatgtatttcatatatacattatatatatttcatatatatgat

SEQ ID NO: 55893 - DNA, 201 bp, Homo sapiens
acctccggagttcacaccattctcctgcctcagcctcccgagtagctgtgactacagtcgcctgccaccacgcccggctaattttttttttttttttttgkatttttagttgagacggggtttcaccggtgttagccaggatggtctcgatctcctgacctcgtgatccgcccgcctcagcctcccaaagtgctgggatta

SEQ ID NO: 55894 - DNA, 201 bp, Homo sapiens
taacatattctagcatgaaatatatctagttatattgtgaacacattataccagacagtagcaataggctttcttggcccattttctaatcaaattgtttmtcttgaaatcctaatttcctcatagctatgtgtaaaggctcatttgctaacatgatgttgtatccatgaaggatgacttataaccctgatgtgcttcact

SEQ ID NO: 55895 - DNA, 201 bp, Homo sapiens
tctttgccaaaaataaaagagcaatctaaagtgattttgcttatctaatttagggaccaaccggtgagactggtccaataggggaacgtgggcatcctggycctcctggccctcctggtgagcaaggtcttcctggtgctgcaggaaaagaaggtgcaaaggtacaacatgcttcagaaaactttttttggcccaaaactt

SEQ ID NO: 55896 - DNA, 201 bp, Homo sapiens
ttgtgttatctttgccaaaaataaaagagcaatctaaagtgattttgcttatctaatttagggaccaaccggtgagactggtccaataggggaacgtgggyatcctggccctcctggccctcctggtgagcaaggtcttcctggtgctgcaggaaaagaaggtgcaaaggtacaacatgcttcagaaaactttttttggcc

SEQ ID NO: 55897 - DNA, 201 bp, Homo sapiens
gagactgctagttcctacccattttttttctaatcttattattttcagtctgaccagatgttgtagggaataaaatattcagttctttcgaaacttctccyaatattttctatctacttctccagctgttaaaagtaacttaactctcatgggtaagaaatttacctatattcacacaattatgtggaatgaataacccac

SEQ ID NO: 55898 - DNA, 201 bp, Homo sapiens
tgtaaaaaattttgtgtgtatcctaatgcaaagaatttctgaacccattttttttattttgaaaccttggttcagcacatttgaaaaaaagcctagaaatwacttcaagaaacactagtttagggattgtattctgccaattcattataatacagggagaaatttatgtaggaggttattagatatattttttataaagca

SEQ ID NO: 55899 - DNA, 201 bp, Homo sapiens
ttttttattgaagctataccttgctgctttacattagaaaagtgtgaactttttacacgtcttgtaatacaaattcaatttcaagcatttccatagtctgyaaataagactcatagaaagtagctgcccttctcatgtaatctgagctccgatcgccagtgagtgagacggggaacatctcactaattatttcatctaata

SEQ ID NO: 55900 - DNA, 201 bp, Homo sapiens
tttaatgaacccactaatgcaataacggtattgattaatttcattttgccctcatggcctaatcagctttcattaggccctactcccccacactgttgcaytgggaattaagtttccaaaagatgtttttttggtgacacattcaaactgtagcaaataaaaaaaaaatgttttctgtaatccattacctttcagaaagag

SEQ ID NO: 55901 - DNA, 201 bp, Homo sapiens
ttatgtagcttatgcactatatccttactatatgactctaatctgcaaaaagaacaaatataatatttaattctaatgtatccattcaagtgttctatctrttcatttataagtatatttagcatctattctctttatttataatccatttagtctgaaacataggtcgttattatgacactccatagaagtggatttact

SEQ ID NO: 55902 - DNA, 201 bp, Homo sapiens
ataatatttaattctaatgtatccattcaagtgttctatctattcatttataagtatatttagcatctattctctttatttataatccatttagtctgaarcataggtcgttattatgacactccatagaagtggatttactgtactcaggtaggtctaggtgtatgtcattgacttatatttagagaaactttatttgta

SEQ ID NO: 55903 - DNA, 201 bp, Homo sapiens
catttagtctgaaacataggtcgttattatgacactccatagaagtggatttactgtactcaggtaggtctaggtgtatgtcattgacttatatttagagraactttatttgtaaaacaaataaactaaaaaaatctgtttgaagatatgggatattgctttatacagggtcatctttatgaatatccttggaagaaatct

SEQ ID NO: 55904 - DNA, 201 bp, Homo sapiens
acactctgtgtgtttggggggcgggggagggtcaatctattttaagtggacaaaaattggcagattattaggaataggttcaagatagggagaacactttyccctgaatttcagtgactccccccaccccacccctccgcttcttcttgcaggttggacgtgcagttctcttggagaatgatgaaagtcgccaagcaaatg

SEQ ID NO: 55905 - DNA, 201 bp, Homo sapiens
tatttgtaaaacaaataaactaaaaaaatctgtttgaagatatgggatattgctttatacagggtcatctttatgaatatccttggaagaaatctcttgckaaccatagctttaaaaatatttgcaatttctttttttcaagtatgctttttatagaatatttaaaatttttttaaatattaactgacttggttttttttt

SEQ ID NO: 55906 - DNA, 201 bp, Homo sapiens
ggctaccatgatatctgttgtgttgtcaacaactattacaaatttaattaccacatgtgaaattgcagggatgtaagggaggaaaattttgattttctatytcaaaatttatttctagaagtccagtcttcaactagtattcccaccaaattaagagtctttctgtttttagggaaaagcaatacatggccatagggtcct

SEQ ID NO: 55907 - DNA, 201 bp, Homo sapiens
tcatggtggaaggcaaaggggaagcaaggcaccttcttcacaagtaagcaggaagaagtgcctagcaaagggggaagagccccttataaaccatcagatcscataagaactcactcattgtcaggagaacagcatgggggaaactgacctcatgattccattgtcttcacttaatctctcccttgacaggtggggataatg

SEQ ID NO: 55908 - DNA, 201 bp, Homo sapiens
tgtagcaatgaacaacccaggtgaagttcctccactcctggagcttaaatatgcgaagtgctgatagttctttgaacgaaaataaatcaagataagagatrtagagtgtactattttagataggacagtttaatatgaatgaatcctcaaagtaaaacatgaggtttcactcatgtttttttgagtgaggttgcattgagc

SEQ ID NO: 55909 - DNA, 201 bp, Homo sapiens
attattttaatgttataagattttgaaatataatgccatatttatcttactgttaccattaatggatccatggctttgatgatatttttccttctggccarcttttcacaatgaagaagtctatgtttccttcatgtctctggtcttcattttcttcattatttaatatctgctttaattctggcaggccagaactgagta

SEQ ID NO: 55910 - DNA, 201 bp, Homo sapiens
acctaactataaaaacctcatatactaaaatattttgagtcaaaagattccagaaatctgtaccagggaagttctatatattatttgtacgggactgagcmaatggttgggtgttcataaattcccagatcaaattaatatttagttattataactaaaaataaacaatataatattatacaaaacataaattttatttgt

SEQ ID NO: 55911 - DNA, 201 bp, Homo sapiens
taggatcgcattatagtccctttgcaaaaaagagcagcttgtgtaaaactcctcatcgtgttctaaaattccttggggtgtatgggaatatatacagattyttataactcactatgtactatagtgagctaataatttgctgttttaaaagcatattactgtgatttgatatctgatatatgaaataaattcttttaaaat

SEQ ID NO: 55912 - DNA, 201 bp, Homo sapiens
ctttaaaacaaccctctttcatgggaactaattcattccttcaagaaacaattcaatctccccagagcaagaactcaatcgctatgcagctattcctgatvgatccaccttaagaaccaaaacacctccatttaggccccacccccaacactgggaattaaatttcaacatgagttttagtggggacaaaccacatccaaa

SEQ ID NO: 55913 - DNA, 201 bp, Homo sapiens
tccagactttaggatagtgattatcaaatgttattttgtaaaaaattttgtgtgtatcctaatgcaaagaatttctgaacccattttttttattttgaaamcttggttcagcacatttgaaaaaaagcctagaaataacttcaagaaacactagtttagggattgtattctgccaattcattataatacagggagaaattt

SEQ ID NO: 55914 - DNA, 201 bp, Homo sapiens
ctcatggtgctggtggatggaaagtccaagatagtggggccacatctggtaaagaacttcttggcacatcatcccatggtagatggagaaagacagggctrgagagagagagagagagagagagagagagagagagagagtaaaaagaaaacaaattccctttgttttaatgaacccactaatgcaataacggtattgatt

SEQ ID NO: 55915 - DNA, 201 bp, Homo sapiens
tgttgagagaaaacagaagcctggactcaagtcttaatggagaattataatgggtgtaagttctgaaagcatctaataagagagaaaaatagtccatgagkttgtttgtttgtgtgtgtgtgtgtgtgtgtgtgtatgtgtgtgtgtgtgtatctccagaggcatgccatcaaacagaacaagacataaacaagttccctt

SEQ ID NO: 55916 - DNA, 201 bp, Homo sapiens
gttgagagaaaacagaagcctggactcaagtcttaatggagaattataatgggtgtaagttctgaaagcatctaataagagagaaaaatagtccatgaggttgtttgtttgtgtgtgtgtgtgtgtgtgtgtgtatgtgtgtgtgtgtgtatctccagaggcatgccatcaaacagaacaagacataaacaagttcccttt

SEQ ID NO: 55917 - DNA, 201 bp, Homo sapiens
tgcaatataagaatattccctagattagtttttgaatatatacttactcacagctcaaaaatgccacttttgtttatataaagctcaaatttcacaatttycttaattatatttttggcaatgtctctccaaattatttctatcaactaactttaagatacccaataattacaaacattgatgtcctcattagaaagaacc

SEQ ID NO: 55918 - DNA, 201 bp, Homo sapiens
caaattcaatttcaagcatttccatagtctgcaaataagactcatagaaagtagctgcccttctcatgtaatctgagctccgatcgccagtgagtgagacrgggaacatctcactaattatttcatctaatatctattggattttaacattttttggggggggtttattatactttaagttttagggtacatgtccacaat

SEQ ID NO: 55919 - DNA, 201 bp, Homo sapiens
tgctgcacccattaactcgtcatttagcattaggtatatctcctaatgctatccctcccccctccccccaccccacaacagtccccagagtgtcatgttcyccttcctgtgtccatgtgttctcattgttcagttcccatctatgagtgagaacatgtggtgtttggttttttgtccttgcgatagtttactgagaatgat

SEQ ID NO: 55920 - DNA, 201 bp, Homo sapiens
cccccctccccccaccccacaacagtccccagagtgtcatgttccccttcctgtgtccatgtgttctcattgttcagttcccatctatgagtgagaacatstggtgtttggttttttgtccttgcgatagtttactgagaatgatgatttccaatttcatccatgtccctgcaaaggacatgaactcatcattttttatgg

SEQ ID NO: 55921 - DNA, 201 bp, Homo sapiens
gagagaaaacagaagcctggactcaagtcttaatggagaattataatgggtgtaagttctgaaagcatctaataagagagaaaaatagtccatgaggttgtttgtttgtgtgtgtgtgtgtgtgtgtgtgtatgtgtgtgtgtgtgtatctccagaggcatgccatcaaacagaacaagacataaacaagttcccttttgt

SEQ ID NO: 55922 - DNA, 201 bp, Homo sapiens
gagaaaacagaagcctggactcaagtcttaatggagaattataatgggtgtaagttctgaaagcatctaataagagagaaaaatagtccatgaggttgttkgtttgtgtgtgtgtgtgtgtgtgtgtgtatgtgtgtgtgtgtgtatctccagaggcatgccatcaaacagaacaagacataaacaagttcccttttgtgg

SEQ ID NO: 55923 - DNA, 201 bp, Homo sapiens
cagaagcctggactcaagtcttaatggagaattataatgggtgtaagttctgaaagcatctaataagagagaaaaatagtccatgaggttgtttgtttgtgtgtgtgtgtgtgtgtgtgtgtatgtgtgtgtgtgtgtatctccagaggcatgccatcaaacagaacaagacataaacaagttcccttttgtgggatgtaa

SEQ ID NO: 55924 - DNA, 201 bp, Homo sapiens
gaagcctggactcaagtcttaatggagaattataatgggtgtaagttctgaaagcatctaataagagagaaaaatagtccatgaggttgtttgtttgtgtgtgtgtgtgtgtgtgtgtgtatgtgtgtgtgtgtgtatctccagaggcatgccatcaaacagaacaagacataaacaagttcccttttgtgggatgtaaaa

SEQ ID NO: 55925 - DNA, 201 bp, Homo sapiens
tgttcagttcccatctatgagtgagaacatgtggtgtttggttttttgtccttgcgatagtttactgagaatgatgatttccaatttcatccatgtccctrcaaaggacatgaactcatcattttttatggctgcatagtattccatggtgtatatgtgccacattttcttaatccagtctatcattgttggacatttggg

SEQ ID NO: 55926 - DNA, 201 bp, Homo sapiens
tggagtgcagtggtgcaacagggctcactgcagcctcaaactcctggacttgagcgatcctcccacctcagcttcccaagtagctgagactacaagcatgyctcaccatgtgcagctaactttttaaaaacatttatttgtaggacagggtctcactatgcttcctaggctgatcttaaactcctgggcccaacctttcac

SEQ ID NO: 55927 - DNA, 201 bp, Homo sapiens
agatcagaatatcaaaaaagattgaaaccgataagaaattaattaggtgagacagatgaaaaattattgacattagcctttgtaagagccaggattcaggyctgagttttgttggtaattagtgatatcataactagagaagggaaaagggaatgccttgcttccccatcctctttcagttatcccagccaaggacaacaa

SEQ ID NO: 55928 - DNA, 201 bp, Homo sapiens
aaatgaaatatgttagatgatgatactgtcacatgcttcagcacttccttactaatttatactctctaaagaatatctgtggacattattttctaagttctttttttttaatttttttttccctttaagtgttcatgtatttgctctctgatagaaacataaattgggggagtacagagatatgtccttcaagtttttttt

SEQ ID NO: 55929 - DNA, 201 bp, Homo sapiens
agtgatgtttaaaagcatatttttggattaccacgtgatgtagtgttgagagaaaacagaagcctggactcaagtcttaatggagaattataatgggtgtmagttctgaaagcatctaataagagagaaaaatagtccatgaggttgtttgtttgtgtgtgtgtgtgtgtgtgtgtgtatgtgtgtgtgtgtgtatctcca

SEQ ID NO: 55930 - DNA, 201 bp, Homo sapiens
gttagatgatgatactgtcacatgcttcagcacttccttactaatttatactctctaaagaatatctgtggacattattttctaagttctttttttttaatttttttttccctttaagtgttcatgtatttgctctctgatagaaacataaattgggggagtacagagatatgtccttcaagttttttttttcacctagta

SEQ ID NO: 55931 - DNA, 201 bp, Homo sapiens
ttactattagtagtagtattatcattaccatcagtgtgtgaatcagagtgccataaaaaaggatgaaataataaactgagaatgaatacacaaatgagctyttgaggaaggagtgatggattttgtgaattgtaataaaagttgtgggtgtgagtataggttaaatataagaccatgccaaatcaaacaaaagacatgggg

SEQ ID NO: 55932 - DNA, 201 bp, Homo sapiens
agatgatgatactgtcacatgcttcagcacttccttactaatttatactctctaaagaatatctgtggacattattttctaagttctttttttttaatttwtttttccctttaagtgttcatgtatttgctctctgatagaaacataaattgggggagtacagagatatgtccttcaagttttttttttcacctagtatgg

SEQ ID NO: 55933 - DNA, 201 bp, Homo sapiens
taattatggcatccttttgaaaaacaagaacatatgaaacccaggcaagtaataaattagttaacaatttaattttgccttattaatgttgttacttttgktgtcattaattaagtaatgtagcaacagttccttaagtgactactctggtccacaggccagagatatataatagaatgcaaaatcagacacaattcctac

SEQ ID NO: 55934 - DNA, 201 bp, Homo sapiens
ttcaccaaagttgaaatgaaggaaaaaatgttaagggcagccagagagaaaggtcgggttaccctcaaagggaagcccatcagactaacagcggatctctyggcagaagccctacaagccagaagagagtgggggccaatattcaacatcttaaagaaaagaattttcaacccagaacttcatatccagccaaactaacct

SEQ ID NO: 55935 - DNA, 201 bp, Homo sapiens
agagacctgctagaattggggactttccttggacaaggcattgatggtgagatgtaaaagatgagaaggaattaactatgcaaagagttctcataggggcwttccaggccagaggaaaaaaatgtgctcaggcaatgtcacaggaatggacatggcatcagatttaagggactgagaaaaatgtctagaagggttggaatg

SEQ ID NO: 55936 - DNA, 201 bp, Homo sapiens
atccagccaaactaaccttcataagtgaaggagaaataaaatcctttacagacaagcaaatgctgagagattttgtcaccaccaggcctgccctaaaagarctcctgaaggcagtgctaaacatggaaaggaacaaccggcaccagccactgcaaaatcaggccaaaatgtaaagaccatcgagactaggaagaaagtgca

SEQ ID NO: 55937 - DNA, 201 bp, Homo sapiens
gaaaagtaaacaagtaaattgacctaagaatgtaggtaacatgatctgattggctttctggatgcagtgtgatgaatagattggaaggaagtaagaatacrtatggggaaaggcaggaggtttttttcagtagctcagaacaaggataccagtattatagagtaaggtgtcagtgatggagataaagtcaatatattcaag

SEQ ID NO: 55938 - DNA, 201 bp, Homo sapiens
ccaaaatttatttatttttaagaatatccttctgaaatgaatataaaataaaaaaattaattacatgtatatggttagtcctcatgtcttggatattgtamaataagacttaagaatgagctacatatttacttcataatcctgttatcatttaccaacatgtgagtacagactctaagctcctaattccaaatgtatggc

SEQ ID NO: 55939 - DNA, 201 bp, Homo sapiens
caatagtatattggagcagataatgggcattcagtctactttttacttggttattcttaaatacatctgctttgattaaattagaaatggccacatttttwaatgactcatatcgtaatgattttttccagtttgtgataatgtttctttctcttctctagggaggtgatggtgaaccaggtcctagaggacagcagggga

SEQ ID NO: 55940 - DNA, 201 bp, Homo sapiens
cgtattctcactcataggtgggaattgaacaatgagatcacatggacacaggaaggggaacatcacactctggggactgttgtggggtggggggagggggragggatagcattgggagatatacctaatgctagatgacgagttagtggatgcagcacaccaacatggcacatgtatacatatgtaactaacctgcacatt

SEQ ID NO: 55941 - DNA, 201 bp, Homo sapiens
ttgttattattactaaaagttattacacttttgttactactaaaactacttttagtatttctttactaattagtatttttatcaggttagataatgtgcarttatatggtaaaatgcaattctttcttatatcagacaccaaataccttgtggtcaccaaagtaatgtaatgaaaataacaaaaaatttgataattgccag

SEQ ID NO: 55942 - DNA, 201 bp, Homo sapiens
aaatgaaccttgataaagttctttgtctgcaaccaagtgagaagcaggctgttttagttttggggatataagagaaaccaggggggtgaatctagaagatyaggaacactctgtgtgtttggggggcgggggagggtcaatctattttaagtggacaaaaattggcagattattaggaataggttcaagatagggagaaca

SEQ ID NO: 55943 - DNA, 201 bp, Homo sapiens
ttaaaaatactcattgttatatcagatcgttgttcaattctggttttttattgtttgcttatttttcagctgctccagttgatgtactaaaagcactagaktttcacaattctccagagggaatatcaaaaacaacgggattttgcacaaacagaaagaattctaaaggctcagatactgcttacagagtttcaaagcaag

SEQ ID NO: 55944 - DNA, 201 bp, Homo sapiens
ataccttggaaaggacgaagttggtctgcagtcgcaatttcgtgggttgagttcacagttgtgagtgcggggctcggagatggagccgtggtcctctaggkggaaaacgaaacggtggctctgggatttcaccgtaacaaccctcgcattgaccttcctcttccaagctagagaggtcagaggaggtaagaaaaaatggat

SEQ ID NO: 55945 - DNA, 201 bp, Homo sapiens
ttacagagtttcaaagcaagcacaactcagtgccccaacaaaacagttatttccaggtatattcactttattattattattgttattattactaaaagttrttacacttttgttactactaaaactacttttagtatttctttactaattagtatttttatcaggttagataatgtgcaattatatggtaaaatgcaattc

SEQ ID NO: 55946 - DNA, 201 bp, Homo sapiens
aagagatttgatgtaatctgatagatcatgaggcatattttgatgactaatagaaaactgagttcctaaagattagtggcagctgtagaattgaacatatrtacccagtaaacttagttgagggcctttaagcatttaaatgacttaaatactcaaagtaggccctggccaatgcttctagtctttgtcaacagaaaaatg

SEQ ID NO: 55947 - DNA, 201 bp, Homo sapiens
acatttgagagaagatgtaaaaagtaatttttaaaatatctgaagagtcgacagaaaaatcagtttgtacacaagtttggaaacagccaatatatacaaaytttccatctgtgagacgatgagggataatgaagatggtaaatacatatatttttactgtaagggtcttaatttgtaattgtgcatttcaggttcaaatgc

SEQ ID NO: 55948 - DNA, 201 bp, Homo sapiens
cctgtgtgaagttgaagttagctaaggtgcctctcttctggctttcccctgctcccattgttgtttagtattatcctttctttcactgagttaatctcctrtaaatccatgggctggttcctagggaggctctagatctggcatctagcaacagactacagggcttagatataattattcctcaccatgaatttgctatgt

SEQ ID NO: 55949 - DNA, 201 bp, Homo sapiens
tctgtgaattctgaagtgatagataaaataattatcaggtttagtgtttttatatctaagaggttatgtgctgacttaatattaaaatttatagcatttaytgtatattttcaaggttgatgagatctgttttgctcctttataaagaaagataaggcatattattctttttagcaacagatatggctctgatttttggaa

SEQ ID NO: 55950 - DNA, 201 bp, Homo sapiens
gcaagagccctcaccccataatttctcattcaacaaatcatatttgatgatataattttaattaaagtaaaatgtttagagaaaatacctaatttatatcyatctatctatctatctatctatctatctatatcaaaaatagggggatgaaacatcagtatgagaaaaggggaatacatgccaagtgacttaaaagatgat

SEQ ID NO: 55951 - DNA, 201 bp, Homo sapiens
aatactcttatactaaatgtttttttttggaacccaaccatttatattcatatgtaattttccagtctttgtaaattagactgtgaaagcttttgaaatartatctattgtttgtccagcatttgaaagtgcaataatttcaccataccactactggcaaaaagcataatattgggagggttactaaacactgaaaatctg

SEQ ID NO: 55952 - DNA, 201 bp, Homo sapiens
ttggtgggactgtaaactagttcaaccattgtggaagtcagtgtggcagttcctcagggatctagaactagaaataccatttgacccagtcatcccattastgggtgtatacctaaaggattataaatcatgctgctataaagacacatgcacacgtatgtttattgcagcactattcaaaatagcaaagacttggaacca

SEQ ID NO: 55953 - DNA, 201 bp, Homo sapiens
gagaaatgcaaatcaaaaccacaatgagataccatctcacaccagttagaatggcaatcattaaaaagtcagggaacaacaggtgctggagaggatgtggmgaaataggaacacttttacactgttggtgggactgtaaactagttcaaccattgtggaagtcagtgtggcagttcctcagggatctagaactagaaatac

SEQ ID NO: 55954 - DNA, 201 bp, Homo sapiens
aagtggtgtagcagttcacaggattcaaaccaggattctcattaattttagaatagatggataaataatttatattttaaatatttgttttttgtataaattttttctgctatttacagaacgtattattctgaaagttaaaatcttatctgtattgtacatagtagacacttgcagcaaaactattgtattcaaatttaa

SEQ ID NO: 55955 - DNA, 201 bp, Homo sapiens
ctcaataaattaggtattgatgggacgtatttcaaaataataagagctatctatgacaaacccacagccaatatcatactgaatgggcaaaaactggaagyattccctttgaaaacgggcacaagacagggatgccttctctcaccactcctattcaacatagtgttgaaagttctggccagggcagttaggcaggagaag

SEQ ID NO: 55956 - DNA, 201 bp, Homo sapiens
gataccatctcacaccagttagaatggcaatcattaaaaagtcaggaaacaacaggtgctggagaggatgtggagaaataggaacacttttacactgttgrtgggactgtacactagttcaaccattgtggaagtcagtgtggcgattcctcagggatctagaactagaaataccatttgacccagctatcccattactgg

SEQ ID NO: 55957 - DNA, 201 bp, Homo sapiens
ctatcccattactgggtatatatgcaaaggattagaaatcatgctgctgtacatgcacacgtatgtttattgtagcactattgacaacagcaaagacttgraaccaacccaaatgtccaacaatgatagactggattaataaaatgtggcacatatacaccatgaaatactatgcagccataaaaaatgatgagttcatgt

SEQ ID NO: 55958 - DNA, 201 bp, Homo sapiens
cccacggagtctcgctgattgctagcacagcagtctgagatcaaactgcaaggtggcagcgaggctgggggaggggcgcccgccattgcccaggcttgctkaggtaaacaaagcagccaggaagctcgagctgggtggagcccaccacagctcaaggaggcctgcctgcctctgtaggctccacctctggggggcagagca

SEQ ID NO: 55959 - DNA, 201 bp, Homo sapiens
tatgcaaaggattagaaatcatgctgctgtacatgcacacgtatgtttattgtagcactattgacaacagcaaagacttggaaccaacccaaatgtccaamaatgatagactggattaataaaatgtggcacatatacaccatgaaatactatgcagccataaaaaatgatgagttcatgtcctttgtagggacatggatg

SEQ ID NO: 55960 - DNA, 201 bp, Homo sapiens
caccagcaatggaacaaagctggatggagaatgactttgatgagctgagagaagaaggcttcagacgatcaaattactctgagctacgggaggacattcaraccaaaggcaaagaagttgaaaactttgaaaaaaatttagaagaatgtataactagaataaccaatacagggaagtgcttaaaggagctgatggagctga

SEQ ID NO: 55961 - DNA, 201 bp, Homo sapiens
actcttaaacaacatgttccagaacagataccttctattctgggtttttggttttttttttgtttttttgagacggcgtctcacgctgtcacccaggctgsagtgcagtggcctgctctcggctcactgcaagctccgcttcccaggttcatgccattctccggagacggggtttcaccgtgttagccaggatggtctcga

SEQ ID NO: 55962 - DNA, 201 bp, Homo sapiens
acaaagctggatggagaatgactttgatgagctgagagaagaaggcttcagacgatcaaattactctgagctacgggaggacattcaaaccaaaggcaaasaagttgaaaactttgaaaaaaatttagaagaatgtataactagaataaccaatacagggaagtgcttaaaggagctgatggagctgaaaaccaaggctcg

SEQ ID NO: 55963 - DNA, 201 bp, Homo sapiens
ttggtcccatggtaagtttttatttttggtgtttgatgggtatgtgttatatgcatggcagtcactggtttgtaaagtattatgtgttctttcattactatgtatatattattgaggtgtatataagcaactgacatgatttagttatatattagtctttagctctggattttgatttggagcaggtagagaataggtaat

SEQ ID NO: 55964 - DNA, 201 bp, Homo sapiens
gagagaagaaggcttcagacgatcaaattactctgagctacgggaggacattcaaaccaaaggcaaagaagttgaaaactttgaaaaaaatttagaagaakgtataactagaataaccaatacagggaagtgcttaaaggagctgatggagctgaaaaccaaggctcgagaactacgtgaagaatgcagaagcctcaggag

SEQ ID NO: 55965 - DNA, 201 bp, Homo sapiens
tggtcccatggtaagtttttatttttggtgtttgatgggtatgtgttatatgcatggcagtcactggtttgtaaagtattatgtgttctttcattactatgtatatattattgaggtgtatataagcaactgacatgatttagttatatattagtctttagctctggattttgatttggagcaggtagagaataggtaata

SEQ ID NO: 55966 - DNA, 201 bp, Homo sapiens
ttggtgtacctgaaagtgatagggagaatggaaccaagttggaaaacactctgcaggatattatccaggagaacttccccaatctagcaaggcaggccaaygttcagattcaggaaatacagacaatgccacaaagacactccacgagaagaacaactccaagacacataattgtcagattcaccaaagttgaaatgaagg

SEQ ID NO: 55967 - DNA, 201 bp, Homo sapiens
ccatttaatgacaatttattaaacgcaatatctatgaggattatgagatcaaataacaggcagaatttcaaagtagcttaattcattatttagttcacttkaaataaaataaacttaaggacttaattaatggagttttacttttttgtaacttgaaatgcctttttgggaaaaaaaaaaaggcttggttgatacctttat

SEQ ID NO: 55968 - DNA, 201 bp, Homo sapiens
gttggaaaacactctgcaggatattatccaggagaacttccccaatctagcaaggcaggccaatgttcagattcaggaaatacagacaatgccacaaagayactccacgagaagaacaactccaagacacataattgtcagattcaccaaagttgaaatgaaggaaaaaatgttaagggcagccagagagaaaggtcgggt

SEQ ID NO: 55969 - DNA, 201 bp, Homo sapiens
aaacactctgcaggatattatccaggagaacttccccaatctagcaaggcaggccaatgttcagattcaggaaatacagacaatgccacaaagacactccwcgagaagaacaactccaagacacataattgtcagattcaccaaagttgaaatgaaggaaaaaatgttaagggcagccagagagaaaggtcgggttaccct

SEQ ID NO: 55970 - DNA, 201 bp, Homo sapiens
gcaggatattatccaggagaacttccccaatctagcaaggcaggccaatgttcagattcaggaaatacagacaatgccacaaagacactccacgagaagarcaactccaagacacataattgtcagattcaccaaagttgaaatgaaggaaaaaatgttaagggcagccagagagaaaggtcgggttaccctcaaagggaa

SEQ ID NO: 55971 - DNA, 201 bp, Homo sapiens
tccacgagaagaacaactccaagacacataattgtcagattcaccaaagttgaaatgaaggaaaaaatgttaagggcagccagagagaaaggtcgggttaycctcaaagggaagcccatcagactaacagcggatctctcggcagaagccctacaagccagaagagagtgggggccaatattcaacatcttaaagaaaaga

SEQ ID NO: 55972 - DNA, 201 bp, Homo sapiens
ttaacaccccactgtcaacattagacagatcaacgagacagaaagtcaacaaggatacccaggaattgaactcagctctgcaccaagtggacctaatagayatctacagaactctctaccccaaatcaacagaatatacatttttttcagcaccacaaaacacctattccaaaattgaccacatacttggaagtaaagctc

SEQ ID NO: 55973 - DNA, 201 bp, Homo sapiens
ctgaaggacccaaaggtcgagcaggcccaactggagacccaggtccttcaggtcaagcaggagaaaaggttggtaaatgactttaaattcactggtactcytgcagctgatgtttcattatcatttaaatttctttcaataactggtgtcagaaattgagttcttactacattaaagataaaatgtttcattatcatttta

SEQ ID NO: 55974 - DNA, 201 bp, Homo sapiens
ttaggcaacattataacattagaaatatgttcaaagcaacaattttcttattcacgtgaagaaatataatgaaggtaaataatgacaaaaatctgcaaatmttccttttgagtgtacaatatgtgattctaatatttaaaaaaaattgaaatcattatttaagcttaattcaacttaaaatattactttgattattatata

SEQ ID NO: 55975 - DNA, 201 bp, Homo sapiens
gatgggtcatatctcaaaataataagagctatctatgacaaaccacagccaatatcatactgaatgggcaaaaactggaagcattctctttgaaaactggmacaagacagggatgccctctctcaccactcctattcaacatagcgttggaagttctgcctagggcaatcaggcaggagaaggaaataaagggtattcaat

SEQ ID NO: 55976 - DNA, 201 bp, Homo sapiens
ttagattgtagcatacaagtcaaacatctggtaatttcatccaaaaagggttctattgagggtaggaagtttatgtaatttttattggcattatttgtgtsacatcatcatttaaatatgaacttctgtatcttttcaaatatgggagtatttaagtcaatgtgcttaattttctaatattttatattcatatataattca

SEQ ID NO: 55977 - DNA, 201 bp, Homo sapiens
tgcaatcaaactagaactcaggattaagaatctcactcaaaaccgctcaactacatggaaactgaacaacctgctcctgaatgactactgggtacataacraaatgaaggcagaaataaagatgttctttgaaaccaatgagaacaaagacacaatataccagaatctctgggacgcattcaaagcagtgggtagagggaa

SEQ ID NO: 55978 - DNA, 201 bp, Homo sapiens
ggaaatttatagcactaaatgcccacaagagaaagcaggaaagatccaaaattgacaccctaacatcacaattaaaagaactagaaaagcaagagcaaacwcattcaaaagctagcagaaggcaagaaataactaaaatcagagcagaactgaaggaaatagagacacaaaaaacccttcaaaaaattaatgaatccagga

SEQ ID NO: 55979 - DNA, 201 bp, Homo sapiens
aaattaatgaatccaggagctggttttttgaaaggatcaacaaaattgatagacccctagcaagactaataaagaaaaaaagagagaagaatcaaatagaygcaataaaaaatgataaaggggatatcaccaccgatcccacagaaatacaaactaccatcagagaatactgcaaacacctctacgcaaataaactagaaa

SEQ ID NO: 55980 - DNA, 201 bp, Homo sapiens
ctgcaaacacctctacgcaaataaactagaaaatctagaagaaatggataaattccttgacacatacactctcccaagactaaaccaggaagaagttgaayctctgaatagaccaataacaggatctgaaattgtggcaataatcaatagcttaccaaccaaaaagagtgcaggaccagatggattcacagccgaattcta

SEQ ID NO: 55981 - DNA, 201 bp, Homo sapiens
aactggtaccattccttctgaaactattccaatcaacagaaaaagagggaatcctccctaattcattttatgaggccagcatcattctgatactaaagcckggcagagacacaaccaaaaaagagaattttagaccaatatccttgatgaacattgatgcaaaaatcctcaataaaatactggcaaaatgaatccagcagc

SEQ ID NO: 55982 - DNA, 201 bp, Homo sapiens
atccttgatgaacattgatgcaaaaatcctcaataaaatactggcaaaatgaatccagcagcacatcaaaaagcttatccaccatgatgaagtgggcttcrtccctgggatgcaaggctggttcaatatacgcaaatcaataaatgtaatccagcatataaacagagccaaagacaaaaaccacatgattatctcaataga

SEQ ID NO: 55983 - DNA, 201 bp, Homo sapiens
ataataagagctatctatgacaaacccacagccaatatcatactgaatgggcaaaaactggaagtattccctttgaaaacgggcacaagacagggatgccytctctcaccactcctattcaacatagtgttgaaagttctggccagggcagttaggcaggagaaggaaataaagggtattcaattaggaaaagaggaagtc

SEQ ID NO: 55984 - DNA, 201 bp, Homo sapiens
gagtgtacaatatgtgattctaatatttaaaaaaaattgaaatcattatttaagcttaattcaacttaaaatattactttgattattatatattttaactktagggaaaacttggagttccaggattaccaggatatccaggaagacaaggtccaaaggtaaaacagcttgatatttatagtttattaacatttcgtgaag

SEQ ID NO: 55985 - DNA, 201 bp, Homo sapiens
attccatgcaaatgggtaggaagaatcaatatcatgaaaatggccatactgcccaaggtaatttacagattcaatgccatccccatcaagctaccaatgcytttcttcacagaattggaaaaaactactttaaagttcatatggaaccaaaaaagagcccgcattgccaagtcaatcctaagccaaaaaaacaaagctgga

SEQ ID NO: 55986 - DNA, 201 bp, Homo sapiens
agaaagctgaaaatggatcccttccttacaccttatacaaaaatcaattcaagatggattaaagacttaaacgttagacctaaaaccataaaaaccctagragaaaacctaggcattaccattcaggacataggcacgggcaaggacttcatgtctaaaacaccaaaagcaatggcaacaaaagccaaaattgacaaatgg

SEQ ID NO: 55987 - DNA, 201 bp, Homo sapiens
acaaaaatcaattcaagatggattaaagacttaaacgttagacctaaaaccataaaaaccctagaagaaaacctaggcattaccattcaggacataggcaygggcaaggacttcatgtctaaaacaccaaaagcaatggcaacaaaagccaaaattgacaaatgggatctaattaaactaaagagcttctgcacagcaaaa

SEQ ID NO: 55988 - DNA, 201 bp, Homo sapiens
acagaattggaagaaaactactttaaagttcatatggaaccaaaaaagagcccgcatcaccaagtcaatcccaagccaaaataacaaagctggaggcatcmcactacctgacttcaaactatactacaaggctacagtaaccaaaacaacatggtacttgtaccaaaacagagatatagaccaatggaacagaacagagcc

SEQ ID NO: 55989 - DNA, 201 bp, Homo sapiens
attttcacaacctactcatctgacaaagggctaatatccagaatctacaatgaactcaaacaaatttacaagaaaaaaacaaccccatcaaaaagtgggcraaggacatgaacagacacttctcaaaagaagacatctatgcagccaaaaaacacatgaaaaaatgctcatcatcactggccatcagagaaatgcaaatca

SEQ ID NO: 55990 - DNA, 201 bp, Homo sapiens
acaccagttagaatggcaatcattaaaaagtcaggaaacaacaggtgctggagaggatgtggagaaataggaacacttttacactgttggtgggactgtamactagttcaaccattgtggaagtcagtgtggcgattcctcagggatctagaactagaaataccatttgacccagctatcccattactgggtatatatgca

SEQ ID NO: 55991 - DNA, 201 bp, Homo sapiens
gcggatctggagacactttcgcttcctttccccggagaaactcgacctatgactctttactttcaagatggctaaaaaaattgaaagcattttgagaaatrggatcctgccaaaagcaactgccaacagcacatgttaaacaataataggtaaaataaattaagtcgatcatttaagatcgattattatcattttaaaatt

SEQ ID NO: 55992 - DNA, 201 bp, Homo sapiens
ttcatagaatttaaattatataatttaacacattattaaatgtttatcatgtattttatcatgctttgcctttccaaaatacagtaatatggcagattctrtatcacttaaccaatgaaatagagttaatttttaattatttgttaatgactcaaatttacataacaggaaagtaagtagtatgttagtgtattatgaaat

SEQ ID NO: 55993 - DNA, 201 bp, Homo sapiens
aaaaatatccttctccctgaatatgtaaactgcatgtcattgtgttccctcattgccacgtgataacactgtcttaggcttgctatacagctttgtcttayaattttttcattgagtttccccaaaaatacttccttgagtagcaggggataaatataatgcttttgaacccttctaaaataagatttacggcatctgtga

SEQ ID NO: 55994 - DNA, 201 bp, Homo sapiens
agtaaagttccttctttacaaactgaaagtcatgtggatatagtaggttataaaaaaattttgtggatcattaccagcattgaaaaaatgaaatagaacaygataaggtaaaatagaatgaaaatatcaaaggctatcatctatgcaaaaggctaagtactgcttttttgaaactcatgtttcagctactttacatgcgca

SEQ ID NO: 55995 - DNA, 201 bp, Homo sapiens
tcaaaggctatcatctatgcaaaaggctaagtactgcttttttgaaactcatgtttcagctactttacatgcgcatggttagggagcattaagtaaaatasatttttcacagtggctcacagtcaaataatattcagcaattacagtgcagtgtcaagaagtcagtaatgtcacgaaagtactagcagttatttagagctt

SEQ ID NO: 55996 - DNA, 201 bp, Homo sapiens
tacaaagtattgttgtgacatgaaagaggaaataataatcttcatggaataatttttgggaagatcaaataagtagtcaagaactaaaataatttttcggwgaagacatagacagatgaaatttgagtgcaatctttctgtcttcctttatactgtaacacagagcttttcctaaatagcagttacagtgcaattgaatac

SEQ ID NO: 55997 - DNA, 201 bp, Homo sapiens
taatcccagctactcgggaggctgaggcaggagaatggcttgaacccgggatgtggaggttgctgtgagctgagattgtgccactgcactccagccttggygacagagctagactccgtctcaaaaaaaaaaaaaaatttacaaatatcagtcctaggatatctaaaactctattattcaaataaatttcatttattatct

SEQ ID NO: 55998 - DNA, 201 bp, Homo sapiens
gtgggtccctgacccctgacccccgagcagcctaactgggaggcaccccccagcaggggcacactgacacctcacacggcagggtattccaacagacctgyagctgagggtcctgtctgttagaaggaaaactaacaaacagaaaggacatccacaccaaaaacccatctgtacatcaccatcatcaaagaccaaaagtag

SEQ ID NO: 55999 - DNA, 201 bp, Homo sapiens
gtcctcgaggttcaagaggtgcaagaggtcccactgggaaacctgggccaaaggtatcacctgtactttttctgtttggatgttactgtagattttttttmcaggcagatgctatgagaaagaattcaaactgatttttcttttcttttcttggtgccagggcacttcaggtggcgatggccctcctggccctccaggtga

SEQ ID NO: 56000 - DNA, 201 bp, Homo sapiens
atactgcatattgaaattgaactgtctttgctagggagtagctggcaaaccaggccctcggggtcagcgtggtccaacggtaggtgccttgatttaaaatsatgtacatttttcatattgaatttagtgtatcaagataatttatttttcaaaaataaaaattgatttagtgtctttggatttgtctggcattagttcggg

SEQ ID NO: 56001 - DNA, 201 bp, Homo sapiens
tacatgtgcatgtctatccacaaaatctagtctgaatttaaaaacgcttattttttaatttattcctcttcaccaataaaaaagcttaatcaatatgttcwactaattttgttatagaaatgagaaaaatgtgtgtaactggactaagatatcactcttatagtcaagacaaaaatagatattttttaaattttaaataca

SEQ ID NO: 56002 - DNA, 201 bp, Homo sapiens
aaaggtaattattgccctaccatgtgaaatattgaaatggcaagttttgaattttaatgaaaactgaaataagtttaacatattaaacatatttaagcatwtgaaaataaatatttttagtcaataggtgactttcttttaatgtgacttattcagctatctcatagaattttgatttatgctttgtgttgtatgtagctt

SEQ ID NO: 56003 - DNA, 201 bp, Homo sapiens
aactggatcattgtacctattttgtacactgatatcatctttgtttattttacagtgttctatttgttaatttttgtatctgtgtttgtgactaaattctrtgaatttcttagggatttgattttacatgttatgtatatgcatagcacattctggaatataagggatatttaaatgtttgtgacatgagtggaaaaatga

SEQ ID NO: 56004 - DNA, 201 bp, Homo sapiens
taggaaaaatcaatatcgtgaaattggccatactgcccaaggtaatttacagattcaatgccgtccccattgggctaccaatgactttctacacagaattrgaagaaaactactttaaagttcatatggaaccaaaaaagagcccgcatcaccaagtcaatcccaagccaaaataacaaagctggaggcatcacactacct

SEQ ID NO: 56005 - DNA, 201 bp, Homo sapiens
tgtgtatcacctactctcaatgtctatggaagtatcttgaaccaatttctgctgatattattgtgatttcctgagactatcagtctctattttggttctargccaacctatgacctctaccctaagcactctcccactttgttatttctgaaagtaaaaatcctctttgcttgagatttagatattgtctccctctagaaa

SEQ ID NO: 56006 - DNA, 201 bp, Homo sapiens
ggtgggcaaagatagttataatcctgcctcgtagtgattatggtctacttgaggagacagtaattaatcaaatagtggtacaagtaaatataaaactacarctatgctagatgctttgaaggagaggtgtatggttcctggagaatacaaaacagaagtttagtaaagtcgaagaaaacttccctgagaaagtaccaattg

SEQ ID NO: 56007 - DNA, 201 bp, Homo sapiens
atcattaaaaagtcaggaaacaacaggtgctggagaggatgtggagaaataggaacacttttacactgttggtgggactgtacactagttcaaccattgtsgaagtcagtgtggcgattcctcagggatctagaactagaaataccatttgacccagctatcccattactgggtatatatgcaaaggattagaaatcatgc

SEQ ID NO: 56008 - DNA, 201 bp, Homo sapiens
aatgttcttaagaaacataaggatgagaaaatatatttagtattcattaaatgtaagtgaatcatcataaagattttccttatcatcatcatcatcttcaygttgaggaggaggaggaagacaaggggctgatcttttctcagggatggcagaggcagaagaagtggaaggggaggcaggagacgcagacacacctgtgca

SEQ ID NO: 56009 - DNA, 201 bp, Homo sapiens
tagtccctttgcaaaaaagagcagcttgtgtaaaactcctcatcgtgttctaaaattccttggggtgtatgggaatatatacagattcttataactcactrtgtactatagtgagctaataatttgctgttttaaaagcatattactgtgatttgatatctgatatatgaaataaattcttttaaaatagggtcttcctgg

SEQ ID NO: 56010 - DNA, 201 bp, Homo sapiens
ctcagcttaaaagggctaggtagtagatattttagttgttgtgagcacacagtctctgttgcagctacgcaactctgttgcagtacaaaagcagctatggrcaatatataaatgaacgggtgtgactatgttccaataaaaactttctttatgaaagctgaaatttcatatagttttcatgtgtcacaaaatattgtcctt

SEQ ID NO: 56011 - DNA, 201 bp, Homo sapiens
attagagatgaaacaatcaaagtattatgagatgtttcatcagtaatctatatggatggtgaaggcaacaagggagaaaggatcaaagacttgggatcaawctgatcagtgaaagggtggtggtgtttaagaggtcaatagactacaataaaaagtacatattaggacctaaaaaaatttaatttcgacactagatagcct

SEQ ID NO: 56012 - DNA, 201 bp, Homo sapiens
agcagcttgtgtaaaactcctcatcgtgttctaaaattccttggggtgtatgggaatatatacagattcttataactcactatgtactatagtgagctaayaatttgctgttttaaaagcatattactgtgatttgatatctgatatatgaaataaattcttttaaaatagggtcttcctggtccacaaggtccaattggt

SEQ ID NO: 56013 - DNA, 201 bp, Homo sapiens
gggaaaaagtatggaacccagttaagtggctattttagtagcacattgggctctgatattctattctcccgtttaataaacctataggtattcaataaagracaggaaaatataattgaacaaaacattgtgctgaattggatacatctgaattgcatacacatggtttgtgccagcagttggcaacatagagataattaa

SEQ ID NO: 56014 - DNA, 201 bp, Homo sapiens
cctttcatcatatcacttccatattgcaaaatctttaatgagctcacggtggcttttgtggaaactcatttggcactccaagccagaacctccccagaatytcatattttttttcatttcctccttaaccattagctccaggtaagcaggtccactcacatattcttgcatgatctaaattttctatcaccttacctttcc

SEQ ID NO: 56015 - DNA, 201 bp, Homo sapiens
caatgttcagtatgaaacgtgttttcagtctttatttagaagtttggtggtgtatttgtgatcagaaatagactgtaggaacttaactctggtttatatcmgtgagcctatggtcaaattggtttcattaaagttgatttgctcaatgtagaagtttccaagagcctatcgaggatattaagtgaggacttactgtacatt

SEQ ID NO: 56016 - DNA, 201 bp, Homo sapiens
aaactcatttggcactccaagccagaacctccccagaatctcatattttttttcatttcctccttaaccattagctccaggtaagcaggtccactcacatwttcttgcatgatctaaattttctatcaccttacctttcccaagctgtttcctctcctagaaagcccttccatcttctcctccttttcaaagtatctgttt

SEQ ID NO: 56017 - DNA, 201 bp, Homo sapiens
tgcttacagagtttcaaagcaagcacaactcagtgccccaacaaaacagttatttccaggtatattcactttattattattattgttattattactaaaasttattacacttttgttactactaaaactacttttagtatttctttactaattagtatttttatcaggttagataatgtgcaattatatggtaaaatgcaa

SEQ ID NO: 56018 - DNA, 201 bp, Homo sapiens
gtgttgtaaactgtaggagtgttgaaagtgtttgccaaggcacacagaaagtctcttgggatactaattggttccattcaattccaagatttaaggaaatmtcactctaatcatttactgatcattaacctaaccagagacctcattggccacaggcagcaaagactacttacttagagaattacttcaaggaaatcacta

SEQ ID NO: 56019 - DNA, 201 bp, Homo sapiens
gttcttattttcattaaacaaccattaagagccagccaattttccagagactgttggcaaagagaaaatattgacacccataaacacattctcaaagtcayaggcaaaattaattaattttatctacttatcactttgatatgaaagttttagcttccttaattattgaaggtaggtattgagagaaaaaaatcatattgt

SEQ ID NO: 56020 - DNA, 201 bp, Homo sapiens
actgttccagtagttggtgttgaaactgaaaacacacttttcattccattcagttgtcctagaaaacatttttcatcttgcttagtctcctatgggagagyacttgtctctgaggatatcatcaggttagacaaaaggcaccaaggcacacaccttttcctcttctctttgcatcatctccttttggctctaatgctgact

SEQ ID NO: 56021 - DNA, 201 bp, Homo sapiens
aacatatttaagcatttgaaaataaatatttttagtcaataggtgactttcttttaatgtgacttattcagctatctcatagaattttgatttatgctttrtgttgtatgtagcttttacaaataatactttgcctccttagggatttcaaggcaagaccggccctcctgggccagggggagtggttggaccacaggtatg

SEQ ID NO: 56022 - DNA, 201 bp, Homo sapiens
tccaataggggaacgtgggcatcctggccctcctggccctcctggtgagcaaggtcttcctggtgctgcaggaaaagaaggtgcaaaggtacaacatgctycagaaaactttttttggcccaaaactttaatttatgtttaactatactcaccccttgtctacagattccatttaaatgaatgtcagaagatgtgtcagga

SEQ ID NO: 56023 - DNA, 201 bp, Homo sapiens
agcaaggtcttcctggtgctgcaggaaaagaaggtgcaaaggtacaacatgcttcagaaaactttttttggcccaaaactttaatttatgtttaactataytcaccccttgtctacagattccatttaaatgaatgtcagaagatgtgtcaggaaaatatttaatgtgcgtttattgtactccaagatattgctcaacatt

SEQ ID NO: 56024 - DNA, 201 bp, Homo sapiens
aggagatggtgggttgattccatatattggctattatgaataatattgcaataaatattggactgcagatatcccttcaacatcctgatgtcatttacttrggacatatacccagtagtagggttgatggataatataacataggagtgcaggtatctctttgacatactgattgcatttcctttgtatgtatactcagta

SEQ ID NO: 56025 - DNA, 201 bp, Homo sapiens
ttcaacatcctgatgtcatttacttaggacatatacccagtagtagggttgatggataatataacataggagtgcaggtatctctttgacatactgattgyatttcctttgtatgtatactcagtagtgcgattgatggcactagctctaattttttgaggaaattttttactattttctatatggctgtattaatttaca

SEQ ID NO: 56026 - DNA, 201 bp, Homo sapiens
taggctagatattgttgattacacatgcacatacacaatggttttgcaaaaagacaacttttcaactaaaggcatctcatttctcaaataataatgcttgytttatttatatgccagagtagtaagaggctcaaataagatatatttgtaaaactattttgaaaaataaaacccgcaacttaatatacactgttttataaa

SEQ ID NO: 56027 - DNA, 201 bp, Homo sapiens
caaaataaattactaataagtagtatagcaggtggtaataagtgtgaaagaaaaagagagcagtaaagaggttagggtgtggcagtggggtgggtagtttwaagaagtgacatcaagccaaatcccactaagaaagtgatatgtaaagaaggtaaagtgcatgccatgctgttcattaaaagactagtgttccaggagaag

SEQ ID NO: 56028 - DNA, 201 bp, Homo sapiens
atttcttatacaacagatatgctactgatgtatctcttagttttcttatatgtgagaatgttgttcttttgccttcattacagaaggatattttcactgascatagaattctgggttgacagttttattattttaggactgtaaaaatgttttgtctctggtccctgtgttttctgatgcacaactcacattcacattgtt

SEQ ID NO: 56029 - DNA, 201 bp, Homo sapiens
gcacttccttatcagcacagacagctaattctactgtgcattttatgctgcttgtgtccttttgggtacctagtactgttgggtaacgagtaagtagtcayctgttaactggctgcttaataaatgagcctacattttttgtatgattttagctcatttttataatttaaaatacacagcatttttatgtgaatactgctt

SEQ ID NO: 56030 - DNA, 201 bp, Homo sapiens
aaagcaaagttgaaaactctaaagggtgacctagtttcttcctctgtgagtatagtggtgatgttttctattgttcagtaagagaatgaccagacaatggygaccgtaacgcctgggaaacatttacagggattggttgatttgaacacagacatgctattctcctgggaaggacaaacggcttaactcttagtagtttgt

SEQ ID NO: 56031 - DNA, 201 bp, Homo sapiens
caaagttgaaaactctaaagggtgacctagtttcttcctctgtgagtatagtggtgatgttttctattgttcagtaagagaatgaccagacaatggcgacmgtaacgcctgggaaacatttacagggattggttgatttgaacacagacatgctattctcctgggaaggacaaacggcttaactcttagtagtttgtatta

SEQ ID NO: 56032 - DNA, 201 bp, Homo sapiens
taaatggtagttttcatatattttggacaaatgaatattaatatattattctaaaaatgaaactttgtagtaaaaagctcatactttttttgaagcagaakatattttaaattttttatcacctcaagcatttatcattagaaagcacatacataaattctaagattatttaaacctatctttttaccacatatcatttca

SEQ ID NO: 56033 - DNA, 201 bp, Homo sapiens
ttgtctagttgggggtttcttttgcctgtgcttttgaggtcttagtcatgaattatttgcctagaccaatgtccagaagagttttccctatgttttctttyagtatttttatagtttcaggtcttatgtttaaattcttgaatccttcttgagttgatttttgtatatggtaagagataggagtctagtttaattcttctg

SEQ ID NO: 56034 - DNA, 201 bp, Homo sapiens
gtcaactttgtcaaagattagtttgctgtaaatatgcttttttagttactacagccttgtagttgaatttgaagtcaggtagtgtgatgcctccagttttrttctttttgcttaagattgctttggcaataagactctttttttggtttcctgtgaattttaggttttttttctaattatatgaaaaatggcatgttcaat

SEQ ID NO: 56035 - DNA, 201 bp, Homo sapiens
tttcctgtgaattttaggttttttttctaattatatgaaaaatggcatgttcaatgtacatgctcaatagacttatcatatttctaaataaatattttaayatggacattttacaattgatttcaatgccaaactacttgtttcatttttaagatatgaatatcagcccttggaaacatcactaacatcattacattctac

SEQ ID NO: 56036 - DNA, 201 bp, Homo sapiens
catatttctaaataaatattttaacatggacattttacaattgatttcaatgccaaactacttgtttcatttttaagatatgaatatcagcccttggaaayatcactaacatcattacattctactgagatgaatgatacctctctttataaataatataaatgcaatttttttttgtaagagttatccaaaaattctgga

SEQ ID NO: 56037 - DNA, 201 bp, Homo sapiens
aatataaatgcaatttttttttgtaagagttatccaaaaattctggaagtatttgctgttcatcttgagagatgaaataatttacacatcacactacttawaataaactctggaaaagtacttgatgtctccaccattaagtgggtaatttaagaatttaaaatatttgtgtattctcacagtaagaaactatgtacacaa

SEQ ID NO: 56038 - DNA, 201 bp, Homo sapiens
ataaatgcaatttttttttgtaagagttatccaaaaattctggaagtatttgctgttcatcttgagagatgaaataatttacacatcacactacttataayaaactctggaaaagtacttgatgtctccaccattaagtgggtaatttaagaatttaaaatatttgtgtattctcacagtaagaaactatgtacacaaaat

SEQ ID NO: 56039 - DNA, 201 bp, Homo sapiens
atgtatacatatgtaactaacctgcacattgtgcacatgtaccctaaaacttaaagtataataataaaaaaaaggaataaaaagagacaattttaaggacyttgttggccatctactcattactccaaaatcatgcaacatgctcacaaaaagtgttgaaaatatttttttcagaatgaatcagtccttattataaaaagt

SEQ ID NO: 56040 - DNA, 201 bp, Homo sapiens
gtaatttaagaatttaaaatatttgtgtattctcacagtaagaaactatgtacacaaaatagtctctgccctgaaattatgtttgtatgtaatatgacacrtttatttaagagcagtggatttgtgtcaggaatattggaaatattagagttaaaaagtaagggaaatttaggcctcacttctttttcaatttaaaagaac

SEQ ID NO: 56041 - DNA, 201 bp, Homo sapiens
atgattacttgaacaagatgttatatttttgtgcattttgaattgtggggcattagcaacagactttcatagctaaaccctactagttacagagatttatktattagtccactgggctagaaaaaaagccattcatatgtaaacagggagataataaaggctatcacatttatgtgtatactcaaatggagcaattttaat

SEQ ID NO: 56042 - DNA, 201 bp, Homo sapiens
gcctgtgttctcccctatctttgaacactcaccctggaatgtctatctcattctcttccatcagcaaacaccttctcctactttatacttcgaaatttaartaaaatatcatagctccagaaaacttttccttatatctccaggtgagccctaataccaaatacatgctcagtatgtacaaggttctgtcatatgcacttt

SEQ ID NO: 56043 - DNA, 201 bp, Homo sapiens
gtcttcctggtgctgcaggaaaagaaggtgcaaaggtacaacatgcttcagaaaactttttttggcccaaaactttaatttatgtttaactatactcaccycttgtctacagattccatttaaatgaatgtcagaagatgtgtcaggaaaatatttaatgtgcgtttattgtactccaagatattgctcaacatttatata

SEQ ID NO: 56044 - DNA, 201 bp, Homo sapiens
aatgggataaaactgtaattaaaaatcatagttttcataatacttggactggccacactctgcagaaattattgtattaagcaaagaaaacatctttttgractttatttatgtactttccttttacactcagattctaaccaagattatataaaatctttttagactcttacttgatatgctactttcagtgctttatgt

SEQ ID NO: 56045 - DNA, 201 bp, Homo sapiens
caaaggtaaaacagcttgatatttatagtttattaacatttcgtgaagataatattaatcacttatgattaccttacaatttgtaacatctctatattatsatgagtacttaaaaataatttcacaaggaaaatcatagagtgtgtggacgcctggagtgcagggagctcaaagagcttaggtgattatggattgcagtat

SEQ ID NO: 56046 - DNA, 201 bp, Homo sapiens
ttctcaatacttacatgttctattcacttttaattgatatgaattctaaatatttacagtgttcctgaggtaacattgatgtgatgtgtagttttgagtaraaatagtgtgaaaatgtatccattttacttttagattagcacttactatcgtgttgtattaccatagttctgtcactgtgatgaagaagctgtatgatac

SEQ ID NO: 56047 - DNA, 201 bp, Homo sapiens
agcatcagctagactatttcattcctgtacttataaatatatcctacagtgtagttttatttaaaattattattataataaacatttgtgaaagttccatrttatttatttgagatgctatcgtttctgacttttatccactagtgtgtaccaaagcctttaattctacataaaatattttaaactatcatatcatgctag

SEQ ID NO: 56048 - DNA, 201 bp, Homo sapiens
atatatatatacaaacacatatgtaatataaatgtggttgtatgttgaacttaattatccattaatgtgtagttttacaaacattattattacttcttttycttatgattttacaaccatgacatttcaacttttgatatgggcaactaacagtgacccatctgtcagtcagaagtcctcgtgggtccctctgtctgtctg

SEQ ID NO: 56049 - DNA, 201 bp, Homo sapiens
catctgtcagtcagaagtcctcgtgggtccctctgtctgtctgctaaaagtcctcatgggtccgtctgtctgtgttctaaatgaagtacttcttttctggsctactgcaattttacaaattaccttgtagagattagatacatttgtcccctctagacagaggtaacacctgagtacagaccttaataaatggagtgtggt

SEQ ID NO: 56050 - DNA, 201 bp, Homo sapiens
tttgtgtatgatgtaaggtaaaggtcaatgttcactgttttctacataatcatatccagttcattcagcacatttttctgaaacgactttcttttcatgayttatattgccttggtctttaaatcagaaattaattgactaccaattagtgcacctattactgaactctctaccttattatttattcattttttttactac

SEQ ID NO: 56051 - DNA, 201 bp, Homo sapiens
ataatcatatccagttcattcagcacatttttctgaaacgactttcttttcatgatttatattgccttggtctttaaatcagaaattaattgactaccaaytagtgcacctattactgaactctctaccttattatttattcattttttttactactaccataatatcttgattactgtagttttagaaaacattttaaaa

SEQ ID NO: 56052 - DNA, 201 bp, Homo sapiens
atagaaaaatttatttttgttattaaagtttttcaatgccttttaaataatataaaaaaataagggctaatctaaaatgatatgataacatttgaattttrtaaatgtaaaagatcatctctgtattctaatactaatttgatcttctctatatagggtgaacctggagaagcagggaacccagggcctcctggggaagca

SEQ ID NO: 56053 - DNA, 201 bp, Homo sapiens
agaaagatttgaaatcctgagactctggaacatagatggtaaatctgacttttcatcatttcatatattcgtaagcattctcaattgaattaattctttaraaattttttggcgggagaagagaaatattctcagcaggttttgtcatgactttaacctcttcacctccagaatgtcataattttataaaaatttattttt

SEQ ID NO: 56054 - DNA, 201 bp, Homo sapiens
acattgtatactaatgacatcttctttcttccttatataaagagcatgctggattttaaatttgatatattaatagtagcagttttacaaatttttttgcrgagagtgagaggtaccacaatctttttaaaaaaggttaaaagaatataatgattttacttgtccatctgataatttttctcaagagatggcctaacatac

SEQ ID NO: 56055 - DNA, 201 bp, Homo sapiens
cagtcgattaattaaaaatagtccattctataattgcataattgcattcaattcagtgattaataatctgatttaatgtagaaccccagtttttttcttgmagaagtttatttgcaataattcttcattggaagcttgaaagtcattattctcttaattttaaagattagaaaattcatgttacttgactttttgtatttt

SEQ ID NO: 56056 - DNA, 201 bp, Homo sapiens
ccattcccactagatgctttgctatcacagatacaggcttattctgcatagacagacctgtggatcatatctcagcatgtgtattagtccattctcatacwgctgtgaggtacacaagaatgggtaatttataatggaaagaggtttaattgactcacaattctgcatggctgggaaggcctcaggaaacttacaatatgg

SEQ ID NO: 56057 - DNA, 201 bp, Homo sapiens
gttgtacaaaaataaatttaaaagtaatagtattatgttttcacatatttatgtgatatgagcagaattattaaccatatgattatattaattagcatgcmtgtttaatgcttgccagatataaattagcactttttaataggacacagttttaaataaagagaatttgattcactttgttctaactataaataattttac

SEQ ID NO: 56058 - DNA, 201 bp, Homo sapiens
agatataaattagcactttttaataggacacagttttaaataaagagaatttgattcactttgttctaactataaataattttaccatctaaatttaccarctctaactataaatatctagaggaagtttaggtatctgaaatagggctgagattttccaggaaatattgacatgtggaaatgaagaaagagggttggttt

SEQ ID NO: 56059 - DNA, 201 bp, Homo sapiens
aatcattttttttatcttttttctggcctcagatggtgggatgctatataatgtggttagtagaacaatgcagtcacaatagctggctttcaacccagctwcaccagttattacctgtattacgttgggcaaattgtgtattttctgtttctcagaggacctaacacccaccctagtgttgggttgaacataagataaatc

SEQ ID NO: 56060 - DNA, 201 bp, Homo sapiens
taacagagtgagaagccactcacacccatcctggaaaggtattaatctattcataagaaatccatccccatgactcagacacctcctattgggctctaccrccaagatttggaataaaatttcaacatgaggtttggaggggagaaatatccatattatagcaataatcaataattattttttcatccaaaattaaagatt

SEQ ID NO: 56061 - DNA, 201 bp, Homo sapiens
acttggactggccacactctgcagaaattattgtattaagcaaagaaaacatctttttggactttatttatgtactttccttttacactcagattctaacsaagattatataaaatctttttagactcttacttgatatgctactttcagtgctttatgtgaagtgttttgtaggacatcatgagaataagtgaggatgat

SEQ ID NO: 56062 - DNA, 201 bp, Homo sapiens
aaaaaaataaaattatggttaagtggatttatgaggtgggtaaaaaataagaaattaagataatttacttgcaaagttatacttgatttttttatatagayatataggcaatggtctcattgaagaaaaagaccagaaaatacctaagggtatatgtaaaccttatttgtaacaaattggacattacacatcaatggaaag

SEQ ID NO: 56063 - DNA, 201 bp, Homo sapiens
aaatactcctactttttattctttgtaaaacattgttgtagcaattttgggtcattttcatttctacacacatgttagaataagcttattaacttctacargaagttgtggttttaatggggatttcatttaacctacagatcataatgaagacaattgaaatttttaaaaatcatggagttttctatttcctgtacataa

SEQ ID NO: 56064 - DNA, 201 bp, Homo sapiens
attcaaatctttcagccaaatcatttttaatgaagtcattgtataactttctgggaataactatagaatattccaaaatgtcttgtggggaaaggataccyagagaattactgttataaagtcctttatgtctatgatttaatctggagcttccacttctaacaaaaataattatatcacatataacattgagatttaaac

SEQ ID NO: 56065 - DNA, 201 bp, Homo sapiens
gtctatattaatgaggaatactagtctatgaatctctgtatttataatgtctttgtcaggttttgatagggttatactggcttcataaactcatctgtgcrgtgatctctccttatctattttctgaaaactttcttatattactgatgttatttccttcttgaatactggatagaattaaccagtgaaaatttcagggcc

SEQ ID NO: 56066 - DNA, 201 bp, Homo sapiens
gataaatttttgaattatatttgagatttgtctccagccagaaatccattaattaaatgtttgttctgacatcttacattcatttgggttgtttcagtatratagaaactattcccaatttttcctggtggccttaaacagcttcagaaatggtttctattatattgaaatgacccaaatttgtctcagaaacatagtgcc

SEQ ID NO: 56067 - DNA, 201 bp, Homo sapiens
ttatttccttcttgaatactggatagaattaaccagtgaaaatttcagggccctgagttttctttttagaattgttttaacatattcaatttctttactcratacaggttaattcggtttttctgtttcttcttgtgttgatcatgttaagttttatttttcaagaaatttttctagttcaactaagttgttggatttgtt

SEQ ID NO: 56068 - DNA, 201 bp, Homo sapiens
atactggatagaattaaccagtgaaaatttcagggccctgagttttctttttagaattgttttaacatattcaatttctttactcaatacaggttaattcrgtttttctgtttcttcttgtgttgatcatgttaagttttatttttcaagaaatttttctagttcaactaagttgttggatttgttcatataaagctgttt

SEQ ID NO: 56069 - DNA, 201 bp, Homo sapiens
ctagcctctcaaagtatagggttattacttcgagatttgcttttttcccagtataaaaatttaaaattacacatttctctctaaacacagttttagctgcrtaacacaattttactatgtcatttttgatggttatttagttaaaataattttcaatttctttttttattttatttccagcccactaattatacagtgatg

SEQ ID NO: 56070 - DNA, 201 bp, Homo sapiens
atgatctcaatccatttagatttattgaggtttgatatatggtctaacatgtagtctatctcagttaatgtaataatgcccttaaaaagaaagtgcattgkgaaattgttcgatgcagacttttataaatgtcacttagatctttccttatatttcttatttttttgtctacttgttctatcagttgttgaggagtgttaa

SEQ ID NO: 56071 - DNA, 201 bp, Homo sapiens
cctgcctcagcctcctgagtagctgggactacaggcgcctgccaacacgcccggctaattttttgtatttttagtagagacggggtttcaccgtgttagcygggatggtcttggtctcctgacctcgtgatcctcccgcctcggcctcccaaagtgctgggattataggcgtgagccaccgtgcccggccaattgctgttg

SEQ ID NO: 56072 - DNA, 201 bp, Homo sapiens
gagtgttccatttcttcagttagaactgggaccaaatatgaccttagagactttacattggcatattcttctttcctgtttttccttgaaatgtttgcctycaccctgagagcagctgaactagctacaaattggtttctatatgttgtcttttcacaggaagataaatagggcaactgtttagaactctagtgtatattt

SEQ ID NO: 56073 - DNA, 201 bp, Homo sapiens
tttgaatttgccccaaaacagccctattttcttttggtatgttgtggtttctcattgttgttttaatttgcaattctctaatgacatatgatgttgaacayattttcataggcttactttccatctgtatatcttccttgttgaggtgttcaacatatttgtgcatttttaagtcagattgttagcttttttattgttgaa

SEQ ID NO: 56074 - DNA, 201 bp, Homo sapiens
aaaacagccctattttcttttggtatgttgtggtttctcattgttgttttaatttgcaattctctaatgacatatgatgttgaacatattttcataggctyactttccatctgtatatcttccttgttgaggtgttcaacatatttgtgcatttttaagtcagattgttagcttttttattgttgaatattgaactttttg

SEQ ID NO: 56075 - DNA, 201 bp, Homo sapiens
catagaataatttgttagaatatctaagtatttcttacaaattataatagcaagaaaaaacaatagaaaaaaatatgccaaaggcatgaaaaagtatttgwcacaaataccccatgaaacaagaaaaaatatttgtagaaatcaggaaagtgtgtaccagaaattacactgagatactatatcacatacaccaattaacaa

SEQ ID NO: 56076 - DNA, 201 bp, Homo sapiens
gtgtatgtgtatatgtatgtcttgtgtgtgtatgtgtatataacgttgaactggaaaatatatattacattatttcatttatataatatgcagaattgttmcagatatgtttagcattttaacataagtggtaaacatgataaagaaacataagccaatgattaacaaaaatttaggatggtagttacttctgtggaaaaa

SEQ ID NO: 56077 - DNA, 201 bp, Homo sapiens
gtggctgacacctgtaatcccagcactttcagagacttaggcaggagtattgcttaagcccaggactttgagacaacatagtgagaccctcatcttcacaraaacttttaaaaattacccaggtgtggtggcacatgcctgtagtcccagctacttgggaggctgaggtgggaggattgcatgagcctgggaggtccaggc

SEQ ID NO: 56078 - DNA, 201 bp, Homo sapiens
ctgaggtgggaggattgcatgagcctgggaggtccaggctgcagtgagtcatgattgttctactgtactccaatctgaacaacagagggagaccctctctsaagaaaacaaaaagtaaacccaaaaattgaagcccaaattacttactaacattatttgcaacctataaactgacactccttttatcttaatttcactgaa

SEQ ID NO: 56079 - DNA, 201 bp, Homo sapiens
tacactaaaattctaagcattttggcaactttcctttaccacagaaaacagttgagaaaaaaaaatcattaactgtatggggtgtttgaaaaaaaaaaaaactggtgagagttaatgccttggcaaattcagaattctaagtagacaggaagcataggttttcattaatcttctgattatggtagttacttcttaagaatt

SEQ ID NO: 56080 - DNA, 201 bp, Homo sapiens
aataactaatttacaatactgaagtgaggactaaattaagaaaatgtatatttaaagcacaaagcctaatgcctgaatctatcagaatctcaaacagtggrtgttattattaagcattgaataagggtttccaattgtagtatcatttataaactaaataaacctattattaaataaaatataaaataaggagtaaaatat

SEQ ID NO: 56081 - DNA, 201 bp, Homo sapiens
tctgatgcatttttcaattacactaaaattctaagcattttggcaactttcctttaccacagaaaacagttgagaaaaaaaaatcattaactgtatggggygtttgaaaaaaaaaaaaactggtgagagttaatgccttggcaaattcagaattctaagtagacaggaagcataggttttcattaatcttctgattatggt

SEQ ID NO: 56082 - DNA, 201 bp, Homo sapiens
attaagcattgaataagggtttccaattgtagtatcatttataaactaaataaacctattattaaataaaatataaaataaggagtaaaatattttcttcyaatatcctagttgtatacatgaaatgatagctcgttagcaataaattcatggtaaagttagttttgtttattgttgattttgctttgttgtttgagttca

SEQ ID NO: 56083 - DNA, 201 bp, Homo sapiens
ccagactggtacctaactataaaaacctcatatactaaaatattttgagtcaaaagattccagaaatctgtaccagggaagttctatatattatttgtackggactgagcaaatggttgggtgttcataaattcccagatcaaattaatatttagttattataactaaaaataaacaatataatattatacaaaacataaa

SEQ ID NO: 56084 - DNA, 201 bp, Homo sapiens
cttatttctaattctagcatatagaacctaagagttgacatagaaaaagctaaaaatacctatcaacaaaaaatacttctattgagttaatgaattctaawtctattcaagcaccatttatttttccaactttacattctctttatgttgtaacatattctagcatgaaatatatctagttatattgtgaacacattatac

SEQ ID NO: 56085 - DNA, 201 bp, Homo sapiens
tatcctagttgtatacatgaaatgatagctcgttagcaataaattcatggtaaagttagttttgtttattgttgattttgctttgttgtttgagttcagcrgtgaccaatactgaactaactgggtgatacacatacaaaaaggatatagaatattaattaactgcactttcagagtatagtatattgtgattttaaggaa

SEQ ID NO: 56086 - DNA, 201 bp, Homo sapiens
acaaactaccatcagaaaatactataaacacctctatgcaaataaactagaaaatctagaagaaatggataaattcctcgacacatacatcctcccaagamtaaaccaggaagaagttgaatctctgaatagaccaataacaggctctgaaattaaggcaataatcaatagcttaacaaccaaaaaaagtccaggaccaga

SEQ ID NO: 56087 - DNA, 201 bp, Homo sapiens
ttcttccttccttcctttctctctctttcctttttttttaatttttattttattattattatactttaagttttagggtacatgtgcacaacctgtaggtktgttacatatgtatacatgtgccatgttggtgtgctgcacccagtaactcgtcatttagcattaggtatatctcctaatgctatccctcccccctccccc

SEQ ID NO: 56088 - DNA, 201 bp, Homo sapiens
tgttacatatgtatacatgtgccatgttggtgtgctgcacccagtaactcgtcatttagcattaggtatatctcctaatgctatccctcccccctcccccsaccccacaacagtccctggtgtgtgatgttccctttcctgtgtccatgtgttctcattgttcagttcccacctatgagtgagaacatgcggtgtttggtt

SEQ ID NO: 56089 - DNA, 201 bp, Homo sapiens
ataaaatctttttagactcttacttgatatgctactttcagtgctttatgtgaagtgttttgtaggacatcatgagaataagtgaggatgataaacttttrtaaatgtaataatattgtttttgagtttgtgttatctttgccaaaaataaaagagcaatctaaagtgattttgcttatctaatttagggaccaaccggtg

SEQ ID NO: 56090 - DNA, 201 bp, Homo sapiens
aacagcctcaaggtatcctgttgccagtcagaccatctggaatcagatcagcaccattgtattgtgatatgcaaataaagtcccatattttgggactttaytgaccttttgttataattttatatttagtaggatttgtggctaaaactgtttcaagaagctcaatgacgcatttaaggcaaatttagatttctgagctct

SEQ ID NO: 56091 - DNA, 201 bp, Homo sapiens
agtttgctgagaatgatggtttccagtttcatccatgtccctacaaaggacatgaactcatcattttttatggctgcatagtattccatggtgtatatgtrccacattttcttaatccagtctattgttgtcagacatttaggttggttccaagtctttgctattgtgaatagtgccgctataaacatatgtgtgcatgtg

SEQ ID NO: 56092 - DNA, 201 bp, Homo sapiens
tcttagtcacaaatgaaggtagggaacatgtatcatttattctttaaaatgtttttctaaaaaacattaaacaatatccttgtcaaatatagaagctagaytattactcttgtagctgcacttcaaaactgtaaaattaatgatctttggatattcaatacagggagaaaaaggtccccaagggcctgcagggagagatgg

SEQ ID NO: 56093 - DNA, 201 bp, Homo sapiens
cagggagagatggagttcaaggtcctgttggtctcccagggccagctggtcctgccggctcccctggggaagacggagacaaggttggtattcattattcrtgttagtagatcctgtgaaaaagcttaatttttgtcaagaattctagataattctaatctttatgattaggcgccaggtgaaaggttacctttttcaaag

SEQ ID NO: 56094 - DNA, 201 bp, Homo sapiens
aagatttggtttaatgggaataatatagattgcaatactgaatatgcacccttttctttaaacagttatgtgaatctctgatcatttttgtctcggtgatmgctgttcaattatggttaattctgtattccttactgttcaaattctggtgttcagatagttaagaaaacatcatgttttggataaatgtttacacattaa

SEQ ID NO: 56095 - DNA, 201 bp, Homo sapiens
tattcattttttttactactaccataatatcttgattactgtagttttagaaaacattttaaaatcatgtgggtaaatactcctactttttattctttgtwaaacattgttgtagcaattttgggtcattttcatttctacacacatgttagaataagcttattaacttctacaagaagttgtggttttaatggggatttc

SEQ ID NO: 56096 - DNA, 201 bp, Homo sapiens
cagaaaaagatcagctttagatcttcacatctttctttaacagcattaataatgagaataagataagctttaagtaaattggagaagaaaaaaatagtaawaggaaagaaaaccctatgaatgtctgacagaacatatagtatgtgtctaacatgttaagatcaagacataattgtatccatttaaaaaataccagatttc

SEQ ID NO: 56097 - DNA, 201 bp, Homo sapiens
aatattgaactttttgtatgttttggataacagtcctttatcaggtatgtcttttgcaaacacatgcacctgctgtgtggtgtattttctgattctcttgwtattgtcttttcagaatagaagttttaaattttaataaagcctagattatcaataaattctttcatggaatatatctttggtgttgtgtctgaagagtca

SEQ ID NO: 56098 - DNA, 201 bp, Homo sapiens
ctgaacaatttaaggtttgtatttagatatttttttgcatgtggctgtccagttgttccagcactattagttgaaaagattatcattgctccattgtattycatttgctccttttgtcaaagatcagtttagtatatttatatggatctttttctaggatctttattctattccattgatctacttatcagttcttccacc

SEQ ID NO: 56099 - DNA, 201 bp, Homo sapiens
tttcttgtcttactgcatcaactaggactcccagtatgatgtagaaatgcaatattaacagaggacatccttgccttctttctgatcagtttgagaaaatktccttctgttcctagttttcagaacatgttttaaaatcatgaatgaatgctgtattttgtcaaatgctttcctgcatctatgatatgataatttatttat

SEQ ID NO: 56100 - DNA, 201 bp, Homo sapiens
acctgtctttaatgagtgtatttaaatcattcatatttaaggcaattatatatatagttagaataatattcaccatatatgttattatgttccatttattrccctgggctcaggtgatccttccagtaccaccatgcctggctgattcttttctatttttttgtagagatagggtctcactgtgttgcccaggcttgtctc

SEQ ID NO: 56101 - DNA, 201 bp, Homo sapiens
gttttttatctacagcatttatttttgattctttgttacagttatcatctttctgcttacattagccattctgttcctgcctgttgtctacttttttattraagttcttagcacgggaatcatagtttgaaaaattcctagaatgataattccaacctttctgccatatctgactctggtttgatgcttattcagtctctt

SEQ ID NO: 56102 - DNA, 201 bp, Homo sapiens
gcagcatgtgctcacatcatgactgtgtcacatttcaataattctcacaatattttaaactttttattattattataagtatggtttatgagaccccaaarcaattacaactgtaacattaaagatccctgatcacagatcaccatagcagttataaaaatgaaaagatttgaaatgtcatgagaattaccaaaataagtt

SEQ ID NO: 56103 - DNA, 201 bp, Homo sapiens
aactggctcaactgaccagctattctcaaattctctcctccttgaggctctctattgcctgagacacagcaatattgaaattaggtcatttagtaaccccmcaatgacctatgtgtgttcaagggaaaggaagagtcacaggttcaagtgttcaagagtcacttgagatcaaaagctagaaatgattaagcttagtgagga

SEQ ID NO: 56104 - DNA, 201 bp, Homo sapiens
caaacactgcattttctcactcaggtgggaattgaataataagaacacatggacacaggaaggggaacgtcacacaccggggactgttgtggggtgggggkaggggggagggatagcattaggagatatacctaatgctaaatgaggagttagtgggtgcagcacaccaatatggcacacgtctacatacgtaacaaacct

SEQ ID NO: 56105 - DNA, 201 bp, Homo sapiens
agccagttcatgatgtttaagaaaataagttgtcttcacaatataaagtgcaaagtgaaacagcaagtgctgatatagaagctgtagacaattatccagargatctagctaaggtaaattgttgaaagctgctacactaaacaacagatttccaatgtaaacaaaacagccttctgttggaagaagataccatctaagatg

SEQ ID NO: 56106 - DNA, 201 bp, Homo sapiens
taacttcatttgaaagtaagtaataatttgttgaaaattccttaatagataataattcagaaaattatttccgttattagacagcttttacttcacttggyatacaggatcaaatcaaagtcagttatgatccagaagcaaagaaaataagcaaaacaaacaatagtatattggagcagataatgggcattcagtctactt

SEQ ID NO: 56107 - DNA, 201 bp, Homo sapiens
aaatctaaatccttacagctccctgattaaatttgtatactgtcccataaccagtcaattttgtggggtaataagttttgtttgtatgtttgacattaaawtaaatttaaattatcaaatatagctagccgtgctgattcttagaaacaaaacatattgtaacttcatttgaaagtaagtaataatttgttgaaaattcct

SEQ ID NO: 56108 - DNA, 201 bp, Homo sapiens
ggctgagtgcagtggcgcaacctaggctcactgcaagctccgcctcccgggttcacaccattctcctgcctcagcctcccaaatagctgggactacaggcrcccaccaccacgcctggctaattttttttgtgtttttagtaaagacaggttttcaccgtgttagccacgatggtcttgatctcctgacctcgtgatccac

SEQ ID NO: 56109 - DNA, 201 bp, Homo sapiens
aggtaagatgatcctgtcattgtttactccatcatttctacctacttctcaccaggttttctggtggatgtaaaacaaagtatttttttctttttttctaygtaagaacttgggtacaatgtttatccataaagatcattttatttttaaatgagcagctgaacttgaaatcattttatcatgtatgattaattctcctga

SEQ ID NO: 56110 - DNA, 201 bp, Homo sapiens
gcttatccaaagtcatagaaataataactactgaatttggattagttgttgggcagttcttactgtggaaactagttatcaattgttgtttataggcttgkcatgtcccagtttttagactctttcttaagagccatcatgattttgaaatatagcagaatattagtagtaggaaaattataagaaataatcaattttcta

SEQ ID NO: 56111 - DNA, 201 bp, Homo sapiens
agaatataaataaggggaagggccatgtggaaaaggtgaccctcgaacttggcttcacagagtgcagaagattacaaaatcgttgaagagcgagaaaataytaggaaagagatgtgatgtttaattagtatctgtttttgcccaagtgggacaaaatttgggagatggactaacatttgttgaattcttgctagcatctaa

SEQ ID NO: 56112 - DNA, 201 bp, Homo sapiens
agtttatatcaatcttatgttaactttacctttagaatattgaccaaataattgtaagtgcaagacaggaattcacagaaacagagtgatgagtattcagyggttatttgtattaaggaaaaagcaaagcaaagtgatgagttctgaggaagagaatgtgaagtctaaaggaaatagaaaagggaaatgaagtaatattga

SEQ ID NO: 56113 - DNA, 201 bp, Homo sapiens
caggagtctgttacctggttaacagtaatacaacttgtggttgactattttattcataaaatattttaatattattaaattaaaaaatacattgatgaaaragtatatgtttattatcaaaaaagtactaactgcaattttctcttataactatagcctcctctttagtatttggaatacttcattggtaaaaatagagtt

SEQ ID NO: 56114 - DNA, 201 bp, Homo sapiens
aactttgtccttactaatttctgcctgctgtatattttcatttctgttagaatggtgtttaccatttaaatgtaatagtggattcatctatttttccttcyatatctattagattttgcttcatgtattttgttaggtgcatatgcattaaagatttatgtctttttggtgcactgacctttttacccttattatcatgta

SEQ ID NO: 56115 - DNA, 201 bp, Homo sapiens
cctggccaacttggtgaaaccctctctctactaaaaatgtttaaaaaattagccgggcatggtgtcaggcgcctgtaatcctagctactcaggaggctgargcaagagaatcgcttgaacccgggaggtggaggttgcagtgagccgagatcatgccacttgcactccagcctgggcgacagagcgcgactccatctcaaa

SEQ ID NO: 56116 - DNA, 201 bp, Homo sapiens
ggcacagatgataacataatatttattgtttaattgagaaataaaagatgaaggtaaaggtatcatacagtatctaacaagtacaggtatggttgaatgaraaagattataataatgatgaaatgatgataatttaagtatttgcattttaaaatcacacacatggtagttaacaatgttgactctggagtcagacagccc

SEQ ID NO: 56117 - DNA, 201 bp, Homo sapiens
atgtatttttattttctttctattacatttttcctcatgtgtttgatttatagaataatgactttaagactcctgaaactggaacttatttttagaaaaaktataactagaagtctgccacttaaaggtttgttttcctttaattgactccaaacactggaataaaatatcttatatttgtatatactttacagtttataa

SEQ ID NO: 56118 - DNA, 201 bp, Homo sapiens
aaatatgtgtctcatatcttatttatttgtgtataataatctgaataaccagtctataagtatttgagaggaggtttattttcctcctattcatagtgtcrgcatgatactttgcctccataaatatttattgaattaattgatagatgaatgattggtaaacagtcaaagacaaatattctcaaagtaacctggctgtta

SEQ ID NO: 56119 - DNA, 201 bp, Homo sapiens
tcaacagatattgcatgttcaaggcacaaactgactatattttgtagaggaaacaggttttcacatttgacaccaaaacataatttttgtttcagaatttraaaaaataaaggtatgctgattatattatatatatgcatactttaaaagtcctctccgaattacatactttataaagtagccgatttagatttaaagaga

SEQ ID NO: 56120 - DNA, 201 bp, Homo sapiens
tttcacatttgacaccaaaacataatttttgtttcagaatttgaaaaaataaaggtatgctgattatattatatatatgcatactttaaaagtcctctccraattacatactttataaagtagccgatttagatttaaagagacttcaattctctaaagaatgaatgtatcattcattgttatagaggattgcaacagagc

SEQ ID NO: 56121 - DNA, 201 bp, Homo sapiens
gattgcaacagagcaaaaataagggactatttttaaaagacctgttatttctgggatagtaccactttatataaaattaaaataataaatatatagaaatrcaattaccaattatttatttttattctctgacaggtattttctctgagggacttagaacaggcaccaaaaaaaaaggatgatgctaaaaattgatatgta

SEQ ID NO: 56122 - DNA, 201 bp, Homo sapiens
attatatccattatactttatctggaaaaagctactgttatatactaaaagtaaacaactatgttgtcagatttattacatgaaaaaggccatgcatttcrcattagctcacctacttaacagtaatctcagttcatcctgatcacctagatgaacttcagagtaccagttggctctccctatgggttctgcatccatgga

SEQ ID NO: 56123 - DNA, 201 bp, Homo sapiens
atattccaaaaataacaattactttaaaaataaatctaaaatttactgccaagttaaatactatgaaataaaatgtaaatgtcaaattctaatgctaactytgtgaaacaggcagtgaaagtactacctaatgcaaaggccatatttgaccttcacaatgatattaattatatgaacttgtcttttgagtctaagtgttaa

SEQ ID NO: 56124 - DNA, 201 bp, Homo sapiens
cttggcttggaaatggttgtcttctccctgtgtctttacatggtctttcctctgtgtgtgtttgtgtcttactcctttcttaaaggagaccagtcagattsaatcaggaccatactagtggcttcgtttaaccttaattaccttcttaaagaccctgtctccaaatacagtcacaatgtgaggtattgggaattaggattt

SEQ ID NO: 56125 - DNA, 201 bp, Homo sapiens
ctggaaaaagctactgttatatactaaaagtaaacaactatgttgtcagatttattacatgaaaaaggccatgcatttcgcattagctcacctacttaacrgtaatctcagttcatcctgatcacctagatgaacttcagagtaccagttggctctccctatgggttctgcatccatggattcaataaaccatagatcaaa

SEQ ID NO: 56126 - DNA, 201 bp, Homo sapiens
tatatattatttgtacgggactgagcaaatggttgggtgttcataaattcccagatcaaattaatatttagttattataactaaaaataaacaatataatmttatacaaaacataaattttatttgtaaatgtaggtgtaagattttatcacatgtggtcaacatttgcatagtaggtattttaacaaatgttagtatctg

SEQ ID NO: 56127 - DNA, 201 bp, Homo sapiens
ttcagttggtggtgttggagaaaaggtaaatatgttagtgacacacagtttgaaacagcatgaattaagaactgtaataatattgggtagtagtttaagtscttctagtatgtgtgtttctaagccttttacatagttatatgattcacatgtcatctagtagttgcaaaaattaaagttaaaatgattttgcaatattgt

SEQ ID NO: 56128 - DNA, 201 bp, Homo sapiens
ttgataccaatggaatcacggtttttggaacaaggattttggatgaagaagtttttgaggtaaaaataaatccaactctaagctgaatattgacaaatcaratgaactgggttaacaacagtaaaaatatcgctttatagcaatacgttataaagcaaagttgaaaactctaaagggtgacctagtttcttcctctgtgag

SEQ ID NO: 56129 - DNA, 201 bp, Homo sapiens
ccagactttaggatagtgattatcaaatgttattttgtaaaaaattttgtgtgtatcctaatgcaaagaatttctgaacccattttttttattttgaaacyttggttcagcacatttgaaaaaaagcctagaaataacttcaagaaacactagtttagggattgtattctgccaattcattataatacagggagaaattta

SEQ ID NO: 56130 - DNA, 201 bp, Homo sapiens
aggcttttcattttgctttttttaaaaaaaaaaagttgtgagttttttattgaagctataccttgctgctttacattagaaaagtgtgaactttttacacstcttgtaatacaaattcaatttcaagcatttccatagtctgcaaataagactcatagaaagtagctgcccttctcatgtaatctgagctccgatcgccag

SEQ ID NO: 56131 - DNA, 201 bp, Homo sapiens
cagcaggggatgtttgggcaaaaaggtgatgagggtgccagaggcttccctggacctcctggtccaataggtcttcaggtaagatgatcctgtcattgttkactccatcatttctacctacttctcaccaggttttctggtggatgtaaaacaaagtatttttttctttttttctacgtaagaacttgggtacaatgttta

SEQ ID NO: 56132 - DNA, 201 bp, Homo sapiens
tgccaattattattgattcttgaaacttggtttggtttcaatgatgcagtctgatagtctgcaggtataggagagatacagttcaaaaataaataaaagtyactgtcttaagtgataaactgaccttactccagaaatgactgttagttattattctacttcttagacttaagagattgaccctccaattttttcctttta

SEQ ID NO: 56133 - DNA, 201 bp, Homo sapiens
gtatatggtaagagataggagtctagtttaattcttctgcttaaggcaaatcagatttctcagcaccatttattgaaaagaggatcttttcctttttgttyttgtcaactttgtcaaagattagtttgctgtaaatatgcttttttagttactacagccttgtagttgaatttgaagtcaggtagtgtgatgcctccagtt

SEQ ID NO: 56134 - DNA, 201 bp, Homo sapiens
agtaaatggctttgccatcctaccattgcttacttgagaaactgcagaattgctctacgttcctctgttaacactttgctccatatttccttatcattctygtctcactccatcatcagcatccagtcagtttccaaatctcacagatatattttttactaatatatgtactgtctgttccatctattccattcctagtat

SEQ ID NO: 56135 - DNA, 201 bp, Homo sapiens
acacacatgtgtatattgtaatatgattactaacttcatgttaatgtgaatacttacattaatatgattattattttagattaatatgaatatatggataygtgtaaatagcataactgatgtatatttgatctatcagtttggcaatgatttggtgaacagaatattaagaactgggatagcttggggcaaaaatgtatc

SEQ ID NO: 56136 - DNA, 201 bp, Homo sapiens
ttccttatcattctcgtctcactccatcatcagcatccagtcagtttccaaatctcacagatatattttttactaatatatgtactgtctgttccatctaytccattcctagtatggctgacttggcttcaattctcaacacttttattgaaatcaactcctaattgatttatctgactccaaactggctgcttccaaatt

SEQ ID NO: 56137 - DNA, 201 bp, Homo sapiens
aaattttctataatgtactgtgaagttaaatttaaaaaaaaaaaagcaagaaatgtctatgacaagtgttatcacattatatacactaaagcaaaatatartatcttatggatagaattaaaatgattccttttctttcatatacatacatatatatatatatatcctacatgtatatgtctatattaaatagggaattct

SEQ ID NO: 56138 - DNA, 201 bp, Homo sapiens
ttctttcatatacatacatatatatatatatatcctacatgtatatgtctatattaaatagggaattctgttaaattcctattaaatactcctaagaggtrtaattatgagatgaacacttcttttgtcacttctccttattttctagtcttctatgccctcctcggccatgtggaatcagctactcttagagttcttcca

SEQ ID NO: 56139 - DNA, 201 bp, Homo sapiens
caagaactgtctatgacaagtgttattacattatatacactaaagcaaaatatcagtaatctcttgctggtataattcaaatgtttccttttctatatgtrtatgtctatattttctacaacaaacattccataatttctttattttattttttactatactttaatgcacaacgtgcaggttagttacatatgtatacat

SEQ ID NO: 56140 - DNA, 201 bp, Homo sapiens
aaattatcttcctatcttataaaaaattagatgttaaatctatatgattccttttgatattctttcttaaaaaaggatgaaaacagaaaatgaagtgacartcttttataaaggaatttacaaaacaattagcttttcaaaatatattatcttttcacttaatatgtatcatacattcattagatgcacaggtttttactg

SEQ ID NO: 56141 - DNA, 201 bp, Homo sapiens
ctgtagttcaataaggtatatagtcaatcgttacagtgttattttccagatcttacaaaaaattgctctcttagaataaaaaactttaaatgttaatattwaaagtttagatcttgtgagattcagagtagaattgaaagccttgtggaattgtgcagtcaccagttgttagattaaaatttaagagagaagatcattttt

SEQ ID NO: 56142 - DNA, 201 bp, Homo sapiens
ccctgttacagtcaatctcaggggatcactagagcggagtttttttaaatggaattccactttggaagaaagcatttatgtacttggaaactattacttaycccatatcccaccctaatctctatcaaataccttcatcaggacacagtgagattaagcttttgttactacaacacaaagtgaagcaaaggatgggcactt

SEQ ID NO: 56143 - DNA, 201 bp, Homo sapiens
aagatcatttttcaattataattgagcactgattcaacatctgcattaactgttttagttatatctaaatttcttctgccttttttgtgatcctattaagktccaaacacataatccatctacaagtcacattattcaatcagatggaattgaacaagacagtatcacaggctggtttttcattgctcattctctagaggc

SEQ ID NO: 56144 - DNA, 201 bp, Homo sapiens
cactactgggtacataacgaaatgaaggcagaaataaagatattcttagaaaccaacaagaaaaaagacacaacataccagaatctctaggacacattcamagcagtgtgtagagggaaatttatagcactaaaagcccacaagagaaagcaggaaagatccaaaattgacaccctaacatcacaattaaaagaactagag

SEQ ID NO: 56145 - DNA, 201 bp, Homo sapiens
gggatcaattcaacaagaagagctaactatcctaagtatatatgcacccaatacaggagcacccagattcataaaggaagtccttagtgacctacaaagakacttagactcccacacaataataatgggagactttaacaccccactgtcaacattagacagatcaacgagacagaaggttaacaaggatacccaggaatt

SEQ ID NO: 56146 - DNA, 201 bp, Homo sapiens
caggatttcatttccagcgaatcaaagcttcataagtgaaggagaaataaaatactttacagacaagcaaatgctgagagattttgtcaccaccaggcctrccctacaagagctcctgaaggaagcactaaacatgtaaaggaaaaatcggtatcagccactgcaaaaacatgccaaattgtaaagaccatcaaggctagg

SEQ ID NO: 56147 - DNA, 201 bp, Homo sapiens
tcaccaaagttgaaatgaaggaaaaaatgttaagggcagccagagagaaaggtcgggttacccacaaagggaagcccatcagattaacagctgatctctcrgcagaaactctacaagccagaagagagtgggggccaatattcaacattcttaaagaaaagaattttcagcccaggatttcatttccagcgaatcaaagct

SEQ ID NO: 56148 - DNA, 201 bp, Homo sapiens
aactccaagaaacataattgtcagattcaccaaagttgaaatgaaggaaaaaatgttaagggcagccagagagaaaggtcgggttacccacaaagggaagmccatcagattaacagctgatctctcggcagaaactctacaagccagaagagagtgggggccaatattcaacattcttaaagaaaagaattttcagcccag

SEQ ID NO: 56149 - DNA, 201 bp, Homo sapiens
ttcttggcctaacttcatttttcaactcatcatttaagtggcaatgattttaaattgacagaccttaaaacagaatctctccacgcataaattacctcttkggagaaaggtaggacatttcatgagaatggattaaccctagagtgcttttcagagtgtttagttccatgcaacaagagattttgactcattgtgtctcca

SEQ ID NO: 56150 - DNA, 201 bp, Homo sapiens
tgcagtgcagtggcctgctctcggctcactgcaagctccgcttcccaggttcatgccattctccggagacggggtttcaccgtgttagccaggatggtctsgatctcctgacctcgtgatccgcccacctcagcctcccaaagtgctgggattacaggcgtgagccactgcgcctggccgtattctggcttgtttttttac

SEQ ID NO: 56151 - DNA, 201 bp, Homo sapiens
ttacctctttggagaaaggtaggacatttcatgagaatggattaaccctagagtgcttttcagagtgtttagttccatgcaacaagagattttgactcatkgtgtctccactaattgtaataataataattttttgtcttaatcaatacaaactatgatctaactgaattaaaaataaataaatttttttctattgggata

SEQ ID NO: 56152 - DNA, 201 bp, Homo sapiens; identical to SEQ ID NO: 10499

SEQ ID NO: 56153 - DNA, 201 bp, Homo sapiens
tatcatgtaatgcctcactttatctctaataattttccctgctccaaagtttgcactgtgtgaaattaatttagctactcctgttttctttttattagttktagaatgttatacctttatacccttccttttactttgtatgtgtttttatatttaaagtgtgtctcttgtagacaacatgtaattgagccttggtttttt

SEQ ID NO: 56154 - DNA, 201 bp, Homo sapiens
aatggaatttatagtgaacaaatcatggaaaatgtaacataggtacacattttccattcaatagatatttactggtgactgagaaatgttataatgttgtrtatattaaaattactacattgttcaaaccaacatacttagactgtgccttgcatatgataactcttatgcacttgttaacagtggctttcatgtaaaagc

SEQ ID NO: 56155 - DNA, 201 bp, Homo sapiens
ccaaaagtgctgattttataggaaacattatatcatttaagtaatcaaatctacatgccaagacttaaattttaattgatttcactcttcaaatataaatrccttaattgtatattatagtcttgtttttattattttttcaagagaatcatatactattttgtcacattaatgaaaccaacttattttatgccgtaaaga

SEQ ID NO: 56156 - DNA, 201 bp, Homo sapiens
acaacttaaaaacaatgtcttatatcttgtgataagggttaaataccagaacagaaactaaattatgttacctaagagaattaattctgcatcctttttctttttttttttttacatgtgcttaagttttgttaatcatagggttggccttacgaatggatttgctgcaggatttagatgttatctagttagatgcataac

SEQ ID NO: 56157 - DNA, 201 bp, Homo sapiens
taaaattagtaggtattaggcaatattagagatgctcctacttaaaaataatttacaaaaaaactcagaaactaattttattatcagttatttatattatytcatgacatgtaaaaataaatattttcaagtttagaagtactaataatacttatgatgattttaaatatggttgtctagatgaatattttctacttctgc

SEQ ID NO: 56158 - DNA, 201 bp, Homo sapiens
tgaattaaaaacgattaaataaaatgagtaaaaaacttgcataaatatagcacaatctgagatatcagtggagatatttctgaagtccacaaaatttatcrtgaagatgaataaacataatatttcatttatgtcagcacaatttttattagtggatgtgtgtttttgagtcatttttgtgatgtaatgttgctcattttt

SEQ ID NO: 56159 - DNA, 201 bp, Homo sapiens
gattaacaggtagttggcaataagaatttaaatgtcaaaatatggatcaaaaggggatcagcttaaaacactaaaaagaagatttaaaatgagatgcccawaaggagacttgaaaggctcaaacattaatctgatcatctaggatacctgtgtgactgtccaggaaagacctgaggagaaggccctgctatttcaaatatg

SEQ ID NO: 56160 - DNA, 201 bp, Homo sapiens
tatttcaaatatggttgactttgaggatctacctagcaaaaagtgagagctaagacagtgttgtaaactgtaggagtgttgaaagtgtttgccaaggcacwcagaaagtctcttgggatactaattggttccattcaattccaagatttaaggaaatctcactctaatcatttactgatcattaacctaaccagagacctc

SEQ ID NO: 56161 - DNA, 201 bp, Homo sapiens
aatcagtgtacttgaagacaaatcagttgatattatctacaatgagaataagggggaaaaatacattaaaaaaagttgacagcctcagtgcgggacaccamcgaacattccaaaataggcataataggagtcccagaaaaagtaagggcagaaaacatatttaacaaagtaatgactgaacacttctcaaagttgatgaaa

SEQ ID NO: 56162 - DNA, 201 bp, Homo sapiens
taggcataataggagtcccagaaaaagtaagggcagaaaacatatttaacaaagtaatgactgaacacttctcaaagttgatgaaacaccttaatctacayggtcaagactctcaacaacttaatctgataaacttgtaaaatctacatccagatacatcataatcaaacatcaaaaaacaaagactgtgagagaatcttc

SEQ ID NO: 56163 - DNA, 201 bp, Homo sapiens
gtaagggcagaaaacatatttaacaaagtaatgactgaacacttctcaaagttgatgaaacaccttaatctacatggtcaagactctcaacaacttaatcygataaacttgtaaaatctacatccagatacatcataatcaaacatcaaaaaacaaagactgtgagagaatcttcaaaacttcaagagtgaagtgactgat

SEQ ID NO: 56164 - DNA, 201 bp, Homo sapiens
taaaaattttatagccagcaaaactgactctcaaacgcaaaggaaacagccaggtgcagtggcatgcacttatagacccagctaattaggaggctgaagtyggaagatagctggagtccaggatttcaataccagctttgggcaacataataagacaccactcttaaaacaaagaaaaattaagacattcccatatttaaa

SEQ ID NO: 56165 - DNA, 201 bp, Homo sapiens
caatcttgaagacattatgataaatgaaagaagccaattgaaaaaggccacatgttgtatggttgaatttaggtgaaatgcccaatttttacaaggggccrggaaaagggaaggatagagagtgactgccactggttgcagggtaacttttaggtgtcatgaaatttttctgcaattagtagtgatggttggacaaggctg

SEQ ID NO: 56166 - DNA, 201 bp, Homo sapiens
aggaagtattattgacataattcttacttttaagtattaattaatatttattccttactcttcttgagaattgtacagtgatattttatatttcattgtcytaaatgttgctagctatcatttattttatttgctttaaagaactctttggtgtaatactacttccctacatatgagatactctacataatcattgtaatg

SEQ ID NO: 56167 - DNA, 201 bp, Homo sapiens
ctgcaataagccatgactaagctactgtactccagccagggtgacagactgagaccctgtcaaaaaaagttatagtacaacaatatacaataatacaaatraaaaaataacaactatttatatagcatttagattttcttaggtattatcagtattctagaggtgatttaaagtataaaggagaaggatgtgggtaggcta

SEQ ID NO: 56168 - DNA, 201 bp, Homo sapiens
tcggattcaggtttattctactagtaaggaattatgagaaaaaaaggtatcagtttttatctatgtctctgaggaagtattattgacataattcttacttktaagtattaattaatatttattccttactcttcttgagaattgtacagtgatattttatatttcattgtcctaaatgttgctagctatcatttattttat

SEQ ID NO: 56169 - DNA, 201 bp, Homo sapiens
cctcatcatgatcataataaaaccaaatattcacatgataagtcggattcaggtttattctactagtaaggaattatgagaaaaaaaggtatcagtttttrtctatgtctctgaggaagtattattgacataattcttacttttaagtattaattaatatttattccttactcttcttgagaattgtacagtgatatttta

SEQ ID NO: 56170 - DNA, 201 bp, Homo sapiens
agacaggtgatttctgcatttccaactgaggtaccgggttcatctcactggggtgtgccagacagtgggtgcaggacagtgggtgcagtgcaccatgcatragccgaagcaaggcgaggcatcaccttacccgggaagcacaaggggtcagggaattccctttcctagtcaaagaaaggggtgacagatggcacctggaaa

SEQ ID NO: 56171 - DNA, 201 bp, Homo sapiens
tcgtgccaccgcactccagcctgggcaacagagcaagactctgtctcaaaaaaaaaaaaaaaaaaaaaagccaacgttttctgtgaaattttataaagacycaatttttcatttttattttaaagtaatgatttttggaatgtttctttcttaaaagattttaaattcaaattgcatttgaaaggcagcaaaattttagga

SEQ ID NO: 56172 - DNA, 201 bp, Homo sapiens
agtgattctcctgcctcatagtccagagtatctgggattacaggcatgcaccaccatgcctggctaattttgtaattttagtagagacaaggttttaccaygttggcgaggctggtctcgaactcccgacctcaggcaatccatccacctcggcctcccaaagtgctgagattacagacatgagccaccgtgcctgacctg

SEQ ID NO: 56173 - DNA, 201 bp, Homo sapiens
actctgtctcaaaaaaaaaaaaaaaaaaaaaagccaacgttttctgtgaaattttataaagactcaatttttcatttttattttaaagtaatgatttttgraatgtttctttcttaaaagattttaaattcaaattgcatttgaaaggcagcaaaattttaggaagcaaaaacatgacattttaataaatcaggaaaatag

SEQ ID NO: 56174 - DNA, 201 bp, Homo sapiens
atgtggcaaacttcatcattgccttattttaagaaattgatacagcaacctcaaacctcagcaaccaccaccctaagcagttatagacacagaggtgagaycctccaccagcaaaaatattacagtttgctgaaggttcaaataatcgttagtattttttagcagtaaagtatttttatattaagatacatacatttattt

SEQ ID NO: 56175 - DNA, 201 bp, Homo sapiens
ggaggagaagtttgtttcaaaatgagtttgaagcattcaagatgtcagtagggaagtcaatgccgatgcggcagaaatagcaagagaactagaattggaartggagctcaaggatgtaactgaactgctgtaacctcatgataaaacttgaacagatgagttgcttcttatggataaggaaataaagtgtttttttctgag

SEQ ID NO: 56176 - DNA, 201 bp, Homo sapiens
aacagaacataatagttggatctatatatttactctaaaaatttcatataaatttcctaacaataattccttttaagcttattgagctttttacttatttrgtattactattacattactgtctttatatatgcacagtttttaaaatgtgttgacttttaaaattagccttttgctcacattttatttgttctttaccat

SEQ ID NO: 56177 - DNA, 201 bp, Homo sapiens
tgattaagcttagtgaggaaggaatgttgaaagctgagataagccaaaggccaggccttttgtgccctgtgaatccaagagttatgaatgcaaaggaaaawatttttaaagaaattaaaagtactactctagtgaacatatgaatggtaaggaagcaaaacagtcttattgctgatatggagaaagtttgagtagtctaat

SEQ ID NO: 56178 - DNA, 201 bp, Homo sapiens
gaatgttatacctttatacccttccttttactttgtatgtgtttttatatttaaagtgtgtctcttgtagacaacatgtaattgagccttggtttttttttgatccactctgacaacctgtctttaatgagtgtatttaaatcattcatatttaaggcaattatatatatagttagaataatattcaccatatatgttatt

SEQ ID NO: 56179 - DNA, 201 bp, Homo sapiens
tgcactaaaaatctttctttctctacctaatcttcctttctctacctattcatccttctctccctgattaacccctggaagttgcgattttttttttttttactgcctctataattttgacttttccaggatgtattagttgcagtcatacagtatgcagccttttcagtttagcccctttcgccaagtaatatgcattta

SEQ ID NO: 56180 - DNA, 201 bp, Homo sapiens
gggaacatcattataagtatgcttcttagggtttgtttgatattttccatctgaagactacttatctatgtaatgctgatcatgacttggacaactctttrgttcaatctgtactaacaaggtcataaaccatgttcttaattttttgccttatttcatccagtaaaatacttatttttatttataagcttctgttcatct

SEQ ID NO: 56181 - DNA, 201 bp, Homo sapiens
aaggctgtggctgtactaagcccactgtattgtaaattttaaaagaatggattttatatgtgaattaattaaatccattataattgattttatatgtgaayggtgtgaacagctcaataactgttatttttaaagaagagaaatgtaagcatagaaatataaatttttgaaccttaaaaataaatcctaattctaagggtg

SEQ ID NO: 56182 - DNA, 201 bp, Homo sapiens
aggctgtggctgtactaagcccactgtattgtaaattttaaaagaatggattttatatgtgaattaattaaatccattataattgattttatatgtgaacrgtgtgaacagctcaataactgttatttttaaagaagagaaatgtaagcatagaaatataaatttttgaaccttaaaaataaatcctaattctaagggtga

SEQ ID NO: 56183 - DNA, 201 bp, Homo sapiens
ttttttttttttttttaagcggggctgtggaattgaattgaatcaaaatatcttccttgtatgaatgtttctagccaatgttaaaagtaaagacactgcaraacttctcaatacttacatgttctattcacttttaattgatatgaattctaaatatttacagtgttcctgaggtaacattgatgtgatgtgtagttttga

SEQ ID NO: 56184 - DNA, 201 bp, Homo sapiens
tggcacttcttacactatttgattatatcttttcaagttattaattttattccaccttatgctagagtttaaatattcttaaccactaatttgcactctcyaaagtgcaaagattatatcaaatatgtgtttctacacccacaggttcaatattttgtgtataatactttctcaataagtatctgttaataaaaaaatgaa

SEQ ID NO: 56185 - DNA, 201 bp, Homo sapiens
ttatatcttttcaagttattaattttattccaccttatgctagagtttaaatattcttaaccactaatttgcactctccaaagtgcaaagattatatcaartatgtgtttctacacccacaggttcaatattttgtgtataatactttctcaataagtatctgttaataaaaaaatgaatattgtggtataaatgtagaat

SEQ ID NO: 56186 - DNA, 201 bp, Homo sapiens
tattttttacccagatgtattctttctgcacctgcttgctcactaaaattctatggatttccatgacacagcacagctgaatctcaaattttagtgccacwaaagtgttcttctgcccaattaccacatcagagacctcacagctgcatattacacccaaaatatctaattttataaagaattaaacttttatatacaagt

SEQ ID NO: 56187 - DNA, 201 bp, Homo sapiens
gtcgggagttttatgaatcagatttatgtgctcaaacttacagggaattgaatgctcaagttaaatggctatcagcccagatattactctaggcctgagtrtaattctgaattaatatggtcatgacacacagatttatattaaattagtttcatgatgaaataaagtccagatggaagtagccacattacgtcaagagca

SEQ ID NO: 56188 - DNA, 201 bp, Homo sapiens
agaagtgtattatgcaaacattatgaaactttttatttaaaataaagttcataaagttagttcttacatgctctgcttacttaatttgatatgtccagttycttggagacatttatgtgtaatagtcattttagttaatatttttaaatcccaccatattttcataagacctttttatattctgtaatttactcaccttaa

SEQ ID NO: 56189 - DNA, 201 bp, Homo sapiens
attactctaggcctgagtgtaattctgaattaatatggtcatgacacacagatttatattaaattagtttcatgatgaaataaagtccagatggaagtagycacattacgtcaagagcagaatatttggatttttctcttgtttgcagtttccaaaagctcttgaaattaaaactctttaggtaattctattattaaatat

SEQ ID NO: 56190 - DNA, 201 bp, Homo sapiens
tccctaggcctttggcaatgcatacaaatgagaaagtgacattagaactatcttaaagttttcaggctgtgttgaacaattagagggtttttaaaaaaaawtttctcataggaaaatttaaaagcatgtgaaatggaaggaatttaagcctcagttgggagcaaaactatatttttggattttttttttttggattttgaa

SEQ ID NO: 56191 - DNA, 201 bp, Homo sapiens
atgcatacaaatgagaaagtgacattagaactatcttaaagttttcaggctgtgttgaacaattagagggtttttaaaaaaaattttctcataggaaaatktaaaagcatgtgaaatggaaggaatttaagcctcagttgggagcaaaactatatttttggattttttttttttggattttgaatttttaagacttagagt

SEQ ID NO: 56192 - DNA, 201 bp, Homo sapiens
tacatatgaatgtttataaatcatatataggaaactttaaattccagatgcacatatgcctatgtacacacacacacacacacacacacacacacacacasacacagacacacacacacacacagacaccccttctgtgttgcttaaccataatttgattccagatttgagatattttgaatttgagaatgttgttatggt

SEQ ID NO: 56193 - DNA, 201 bp, Homo sapiens
tggatttaagtctgcatcttattatttgtattttctttgtactctctgttttctgattctttgttcttcctttcctgcctccagtctttttttttttttttggtgctgagggtttatttgaatattttgtagtattccattttgttttacttattggatttttgctatttttttatttaagaaatactttttataataatt

SEQ ID NO: 56194 - DNA, 201 bp, Homo sapiens
gtccagagactggcacatattaggctctccctggcagttattatgattagcattttcttagttatgaggtaagagaaaataacacatataaaacagatatmctattggcttaaaaacatagccgttgcaagcaggactagtgcaaaaaaatgttctcaaacatcattataatttttatatctcaggcatgctgaatgatat

SEQ ID NO: 56195 - DNA, 201 bp, Homo sapiens
ttaaggagttttaagagtatataaaactttatcctgcataaagattttttgtctgatatatgtttgcaaatattttttccagtatgtgacttgcctttttwttgttttcttattggtgtctttccaagtgtaaatgcttttaattttgataaagtttaatttatcaattttgttgttatgtttgacactctttgtgttcta

SEQ ID NO: 56196 - DNA, 201 bp, Homo sapiens
ggtgagtggtgaagtggaaggagcatagagttggtatttacacagatcttaagagtaatcttagtttgttctctggttcttaaatctcaatctgcacaggrcggataagaacatatggtttgtgagggttaatccctgtaaagaacttagtccagagactggcacatattaggctctccctggcagttattatgattagca

SEQ ID NO: 56197 - DNA, 201 bp, Homo sapiens
aaaatgagctgatgtatgtacagtctttaagatactagtataaatatatatatatatatatacaaacacatatgtaatataaatgtggttgtatgttgaacttaattatccattaatgtgtagttttacaaacattattattacttctttttcttatgattttacaaccatgacatttcaacttttgatatgggcaactaa

SEQ ID NO: 56198 - DNA, 201 bp, Homo sapiens
ggacaaaaattggcagattattaggaataggttcaagatagggagaacactttcccctgaatttcagtgactccccccaccccacccctccgcttcttctrgcaggttggacgtgcagttctcttggagaatgatgaaagtcgccaagcaaatggggtgggggcggaggactagggattgggagggaaggggagggggtgt

SEQ ID NO: 56199 - DNA, 201 bp, Homo sapiens
aaaaatgagctgatgtatgtacagtctttaagatactagtataaatatatatatatatatatacaaacacatatgtaatataaatgtggttgtatgttgaacttaattatccattaatgtgtagttttacaaacattattattacttctttttcttatgattttacaaccatgacatttcaacttttgatatgggcaacta

SEQ ID NO: 56200 - DNA, 201 bp, Homo sapiens
aacactctgtgtgtttggggggcgggggagggtcaatctattttaagtggacaaaaattggcagattattaggaataggttcaagatagggagaacacttycccctgaatttcagtgactccccccaccccacccctccgcttcttcttgcaggttggacgtgcagttctcttggagaatgatgaaagtcgccaagcaaat

SEQ ID NO: 56201 - DNA, 201 bp, Homo sapiens
gaaaatcaaaggagaagatacattcagcaagttccatgttaggaatgttgaagagagagcatgatatacaactggaaatttctagtaggcacttactgagmgagttttagggctcatactgattagaggtttataaatagttgggaatggaggagttcatcagcatagagatggcaattgtggtgatggaggttgttgaga

SEQ ID NO: 56202 - DNA, 201 bp, Homo sapiens
actcttacttgatatgctactttcagtgctttatgtgaagtgttttgtaggacatcatgagaataagtgaggatgataaacttttgtaaatgtaataataytgtttttgagtttgtgttatctttgccaaaaataaaagagcaatctaaagtgattttgcttatctaatttagggaccaaccggtgagactggtccaatag

SEQ ID NO: 56203 - DNA, 201 bp, Homo sapiens
aaaaaatgagctgatgtatgtacagtctttaagatactagtataaatatatatatatatatatacaaacacatatgtaatataaatgtggttgtatgttgaacttaattatccattaatgtgtagttttacaaacattattattacttctttttcttatgattttacaaccatgacatttcaacttttgatatgggcaact

SEQ ID NO: 56204 - DNA, 201 bp, Homo sapiens
aatattcaaccttctctatataattactctatatcagtttcaaatgggaaatataacagaatcttcctcataaggatttatagaaaaaaaatgagctgatrtatgtacagtctttaagatactagtataaatatatatatatatatatacaaacacatatgtaatataaatgtggttgtatgttgaacttaattatccatt

SEQ ID NO: 56205 - DNA, 201 bp, Homo sapiens
tattggattctgtttatacttttgaatatatgaactgatagaattttctgactataggagtgtgtagtatgagaaaaagagaataattaagaatgcctctmaggctaaatgttaatttggtattttgaatattatatatgacaccatgattatgacatatcattatcatagcctacattaattaaacaaaaatatcaagtt

SEQ ID NO: 56206 - DNA, 201 bp, Homo sapiens
ggggcgtctgagctcatgaggtcatagaaggataggggaccctcctgtgaagcagaataatggcttcagcttttactgtgagtattgtatttgatagttttaagaatgcagatccttgatctgacttagatttttaaaaggtggctctggatgcataagagtagaagcagaggccagttaggagtctagctgtgagagatg

SEQ ID NO: 56207 - DNA, 201 bp, Homo sapiens
gtgaagttcctccactcctggagcttaaatatgcgaagtgctgatagttctttgaacgaaaataaatcaagataagagatgtagagtgtactattttagayaggacagtttaatatgaatgaatcctcaaagtaaaacatgaggtttcactcatgtttttttgagtgaggttgcattgagcaaaatcacaaaggaagtgag

SEQ ID NO: 56208 - DNA, 201 bp, Homo sapiens
cacagcagttgtagcaatgaacaacccaggtgaagttcctccactcctggagcttaaatatgcgaagtgctgatagttctttgaacgaaaataaatcaagrtaagagatgtagagtgtactattttagataggacagtttaatatgaatgaatcctcaaagtaaaacatgaggtttcactcatgtttttttgagtgaggtt

SEQ ID NO: 56209 - DNA, 201 bp, Homo sapiens
tgaatatttcattcaacagataaatggccatggtgcatatggagagaaaggacagaaaggagaaccagcagtggttgagcctgtaagtagtagtgtgaatrcactttaaaggttggtaaaattgcttatgagccacgattatgttaaattattatgtatgttcgtgttttaccaatgataatcttgatgtccagatgtttg

SEQ ID NO: 56210 - DNA, 201 bp, Homo sapiens
tattagtccagatatttcagcatgttagagtgaaagaagaaatttgtcttaaaatttaattctgaatttctttgcatatctaggtttacttactcattgaraaaagttaagtaactcatgatcccttgttttatatttagactggggtaaatgaaataactgtatcaaaaagatttactctggttgaagggataaaatcta

SEQ ID NO: 56211 - DNA, 201 bp, Homo sapiens
ttaataatgaattctgttgcactgatattttccatgacttaatgttagtttttgtttaaaaaacagggtaaaattttaagaacctaacaggaaggcaaatrtgagagtgtaaagataaattactgggatattttatttacctgtttcacagttatcatgtacttcattctttttattctctcatgattcaccaaatatgtt

SEQ ID NO: 56212 - DNA, 201 bp, Homo sapiens
acaaggattttgtgctctttttgatcttaggaaagtctaaaggaaattaggaatttcttaatacattttagattttattttcccattggttacagtatttyaatacagtatatacttatttcatattctttgtattccctttccctcctcccctctttcccgtctctcaatagatatgaaaatcctttcatacttaggaag

SEQ ID NO: 56213 - DNA, 201 bp, Homo sapiens
gatgaatataaactgggtaaatgttttctatgtatgtaaacagatatatgtaaatatatcatgcaacaaattctcagatttcacctactgcatatattttyataaaacaaaatcaaggaaaataatatttagggaaaatatattttccctaaataatctctcctccagatattctttatggtagagaacaatctcattaac

SEQ ID NO: 56214 - DNA, 201 bp, Homo sapiens
tccagcaagggaataaccaaggtttaaaaggatgtcatgtaccgacatgccaagtcagactctatacattttaagataaagtccattttctccattgtgamccaggtagaccttagtggactatgattacatccaactagggatgagataaatgtagcaatagtgatggggaccagtgatcaaaatctgaggtatttgatt

SEQ ID NO: 56215 - DNA, 201 bp, Homo sapiens
ttctcgtgatactaactactattctgctcataggaaatgtgctttgtcactcctatgttattatactctgtataagacagtataatacttctatgtaatamaaaaataactcatcaataacattaatttcttatctcttaacatttacactatgtaaaagttaagatggttctcactttgtgaatagtattttgccactaa

SEQ ID NO: 56216 - DNA, 201 bp, Homo sapiens
gttgggattacaggcgtgagccaaggtgcctggctgaaggtcaactttttaaaaagacagagcagacgtgtttttgccctctagttgtatagctctggttygtaagcactttatgtgtttatgcttctatttttctctctagtgggcggcatcttaactgaatgctgatgaggtgatttgtctatcactttcatttacttt

SEQ ID NO: 56217 - DNA, 201 bp, Homo sapiens
tcatcttatttctctgaaccaataactgtgatttttatttgacagtagccgttttgaagaatgatgtccatttcacttttgcttagccttcctttcatctrtgatctatatttccctcctcgtttatttatgttttccattccatctttcaccacattttacagaaaaagaaatccaatttcaaaaagaagatgaggacag

SEQ ID NO: 56218 - DNA, 201 bp, Homo sapiens
tcttatttctctgaaccaataactgtgatttttatttgacagtagccgttttgaagaatgatgtccatttcacttttgcttagccttcctttcatctatgmtctatatttccctcctcgtttatttatgttttccattccatctttcaccacattttacagaaaaagaaatccaatttcaaaaagaagatgaggacagtgg

SEQ ID NO: 56219 - DNA, 201 bp, Homo sapiens
ttccctcctcgtttatttatgttttccattccatctttcaccacattttacagaaaaagaaatccaatttcaaaaagaagatgaggacagtggctactaamtcaaaggaaaaatccaaaaagtttacaccccccaaatctgaaaaattttcatccaagaagaagaaaagttatcaagcatcagcaaaagccaaactagggg

SEQ ID NO: 56220 - DNA, 201 bp, Homo sapiens
tcatgaagaatacaattcagtttaactttgttaaatatctggtatacattttggtataattttatcaggaaatgaatataagaaatgtaatttagttttargaaaatttatgtaaaatgtctctcaattaggcaaatagatttatgtgaaaacacaaaattgtgaataataaatgtttagggtgagaatggattttaactt

SEQ ID NO: 56221 - DNA, 201 bp, Homo sapiens
attcatccagcattttagttcagagctatgattatagcaatattctcaccatagatattatgcagtctctgtagacagcatatactccttatctaagaatmcaaaaaaaattacggttattggacatttaattttagtgaaaaattactcatcatttatctacatattttcattcacaagattgtgtaatactattatcta

SEQ ID NO: 56222 - DNA, 201 bp, Homo sapiens
aaattacggttattggacatttaattttagtgaaaaattactcatcatttatctacatattttcattcacaagattgtgtaatactattatctaatattaytctatcatctagatttactatggaatagaaaatgagttacttaaaaatgaaatttacaaattggcaagataagcctaggcaatacaataagatcctgtct

SEQ ID NO: 56223 - DNA, 201 bp, Homo sapiens
aacaattttcttattcacgtgaagaaatataatgaaggtaaataatgacaaaaatctgcaaatcttccttttgagtgtacaatatgtgattctaatatttwaaaaaaattgaaatcattatttaagcttaattcaacttaaaatattactttgattattatatattttaactgtagggaaaacttggagttccaggattac

SEQ ID NO: 56224 - DNA, 201 bp, Homo sapiens
gaagcaatatgcagtgaaactgcattgtttgatattaagaactaatcgaaaactcttaagcttttaaagaaacaacagaaagaatacgtttgtaaattgggtcattacaatgcctctttaaagtgggcatgtatggctacggactagacaaagacaaaaaatacaaactttaggccaaaattagcacttaaataaatgttt

SEQ ID NO: 56225 - DNA, 201 bp, Homo sapiens
ctatttttggaatatataactgttcacttacagtcctctaacatctattacatttatactttttgacaggcattgttcaaagaactttagttatattaaayatgactaaaacctgatgacaaactatttctgtctctattatgacaggcattgttgaaataactttagatgtatcatagtaaacatgacaaaaacctgatg

SEQ ID NO: 56226 - DNA, 201 bp, Homo sapiens
aaggattttgtgctctttttgatcttaggaaagtctaaaggaaattaggaatttcttaatacattttagattttattttcccattggttacagtattttaatacagtatatacttatttcatattctttgtattccctttccctcctcccctctttcccgtctctcaatagatatgaaaatcctttcatacttaggaagac

SEQ ID NO: 56227 - DNA, 201 bp, Homo sapiens
tgaatgtttataaatcatatataggaaactttaaattccagatgcacatatgcctatgtacacacacacacacacacacacacacacacacacagacacasacacacacacacacacagacaccccttctgtgttgcttaaccataatttgattccagatttgagatattttgaatttgagaatgttgttatggtttatat

SEQ ID NO: 56228 - DNA, 201 bp, Homo sapiens
ttgagatacatatgaatgtttataaatcatatataggaaactttaaattccagatgcacatatgcctatgtacacacacacacacacacacacacacacasacacagacacagacacacacacacacacagacaccccttctgtgttgcttaaccataatttgattccagatttgagatattttgaatttgagaatgttgt

SEQ ID NO: 56229 - DNA, 201 bp, Homo sapiens
gattgagtcccagctttcaattattttaggcatatatgtgggagtggaattgctgggtcatatggcacttctgtatgagtctacttaaatgaaaattctcraatgagtaactagagacagaaagtatataagaggttgtcagggggtaggaggttgaaggagtgaagagttattgcataatggtgatgaagtttgagttga

SEQ ID NO: 56230 - DNA, 201 bp, Homo sapiens
tgattgagtcccagctttcaattattttaggcatatatgtgggagtggaattgctgggtcatatggcacttctgtatgagtctacttaaatgaaaattctygaatgagtaactagagacagaaagtatataagaggttgtcagggggtaggaggttgaaggagtgaagagttattgcataatggtgatgaagtttgagttg

SEQ ID NO: 56231 - DNA, 201 bp, Homo sapiens
atggtgttaaaagatacgttgttgccgggcgcggtggctcacgcctgtaatcccagcactttgggaggccgaggcgggcggatcaggaagtcaggagatcragaccatcctggctaacactgtgaaaccccgtctctactaaaaatacaaaaaattagccgggcgtggtggcgggcgcctggagtcccagctactcaggag

SEQ ID NO: 56232 - DNA, 201 bp, Homo sapiens
ttttttgaggagtgaacacttggataaggtcatggtgttaaaagatacgttgttgccgggcgcggtggctcacgcctgtaatcccagcactttgggaggcygaggcgggcggatcaggaagtcaggagatcgagaccatcctggctaacactgtgaaaccccgtctctactaaaaatacaaaaaattagccgggcgtggtg

SEQ ID NO: 56233 - DNA, 201 bp, Homo sapiens
attcattatttagttcacttgaaataaaataaacttaaggacttaattaatggagttttacttttttgtaacttgaaatgcctttttgggaaaaaaaaaaaggcttggttgatacctttattttatgtctctacttgtattgttttttgaggagtgaacacttggataaggtcatggtgttaaaagatacgttgttgccgg

SEQ ID NO: 56234 - DNA, 201 bp, Homo sapiens
aataatgttttcttaaattgttggtacagataattactataaaagcagtatccatgtgattattttcaaaaatctatatatatgaggttttttaaaaaagmaaactagttaaaagcattacatcttttttgaaactcagttaaaaaaaattaaaaaacctaatcagattcaaatgatctcatcagtgttcataagacccag

SEQ ID NO: 56235 - DNA, 201 bp, Homo sapiens
tcatctcactagggagtgccagacagtgggcgcaggtcagtgggtgcgcgcaccgtgtgcgagccgaagcagggccaggcattgcctcacttgggaagcamaaggggtcagggagttccctttctgagtcaaagaaaggggtgacggactcacctggaaaatcgggtcactcccaccggaatactgcacttttccgaccgg

SEQ ID NO: 56236 - DNA, 201 bp, Homo sapiens
atcatttaagtggcaatgattttaaattgacagaccttaaaacagaatctctccacgcataaattacctctttggagaaaggtaggacatttcatgagaayggattaaccctagagtgcttttcagagtgtttagttccatgcaacaagagattttgactcattgtgtctccactaattgtaataataataattttttgtc

SEQ ID NO: 56237 - DNA, 201 bp, Homo sapiens
cagggctagagagagagagagagagagagagagagagagagagagagtaaaaagaaaacaaattccctttgttttaatgaacccactaatgcaataacggyattgattaatttcattttgccctcatggcctaatcagctttcattaggccctactcccccacactgttgcattgggaattaagtttccaaaagatgtttt

SEQ ID NO: 56238 - DNA, 201 bp, Homo sapiens
gaaataaggagtgaaggcagatgaaaaagtaccatggtgtctccagtgaaatgtgttgaaaaattaccaaaagtgaaaacgtcctttgttgttgaaaattwcaaataaacttataaacaatatgacaaagagcagagacttcttttttctttcgagacagagtcctgctctgtcacctaggctggagtgcagcagtataat

SEQ ID NO: 56239 - DNA, 201 bp, Homo sapiens
tttttttttttttttcttttttttttgagatggagtctggctctgtctcccaggctgagtgcagtggcgcaacctaggctcactgcaagctccgcctcccrggttcacaccattctcctgcctcagcctcccaaatagctgggactacaggcacccaccaccacgcctggctaattttttttgtgtttttagtaaagacag

SEQ ID NO: 56240 - DNA, 201 bp, Homo sapiens
cataacggcttttgatttcctttctattatcctaagggtttaaattaccacttgattttttaaaattaatacacctttcacactattaccctcatttccaygagtattttttttccagggttgctatgacaaatctccacaaacgtattaacttaaaacaacagaaattcactgccttacagttctggaggacagaagtat

SEQ ID NO: 56241 - DNA, 201 bp, Homo sapiens
aaaaactttctttatgaaagctgaaatttcatatagttttcatgtgtcacaaaatattgtccttttatttttcaacatttaaaatgtacaattattcttayatcatgtaccatataaaaataggcagcaaggaggtctatgggaggtctatacccacaggcacagatttccccaccatcattcgaaggcattgttacaaaa

SEQ ID NO: 56242 - DNA, 201 bp, Homo sapiens
gacacacctgtgcaactttagggctatacattgtaattggtgtctgactttttgcttttttgtatctctaaaaaatgttttcatatggtaccaatccttcytccactgtttgctttaattttagttaccatatcatagaagggtctatgtgataaaagaaggcaaaagcagtcttgaataatcagaccacttctgccagat

SEQ ID NO: 56243 - DNA, 201 bp, Homo sapiens
agtacatagaaagattttggcttttatataatacagagtttaaaataactttacagggaactaaatttcttcaatctgaagttcagctatcttttttttttgttaactttccatgctctctatccaaactgaacaatattttctgttacacaaatttacatgagaaaatatccaatgtacaaatgaagggacctgagcagg

SEQ ID NO: 56244 - DNA, 201 bp, Homo sapiens
tttagtgagatgctggctatttcatgataacaaggatttaaatcaagtttggttgagagtctctgtgtaatacaagctgaatttttaaaaggttaaaaaaaggtgtttatataagatttttaaaagagaatgctagcactagaaattatagaaattgctaatcaatcttaccttctcaataaatgaggaaactaagacaca

SEQ ID NO: 56245 - DNA, 201 bp, Homo sapiens
actatgcatctatttggggacagttgtagaaattggggggaagagctagatctaaaacacagtgaagtcaatgcactaactataactgaattaggcaatarcagtttgaaattttaggaaaaatattcttcaaatacttatttacaatttctagcatgtatgtgtgtataattgcagagaaaataatcagtgccagaattg

SEQ ID NO: 56246 - DNA, 201 bp, Homo sapiens
ctttatagaagttattctctaaaaggtatttgtatagttttaaacaaagttatgcagtagcaaagtgagaaatgtatttgcataacataattggtaaaaaattaatattttttcggttttttattttcttcaatttgtgactaaaatagaaccacatggttgttcatgttaagttatccttaaaatacagcaaagcaaaca

SEQ ID NO: 56247 - DNA, 201 bp, Homo sapiens
ttaaaataagagtgatgtttaaaagcatatttttggattaccacgtgatgtagtgttgagagaaaacagaagcctggactcaagtcttaatggagaattakaatgggtgtaagttctgaaagcatctaataagagagaaaaatagtccatgaggttgtttgtttgtgtgtgtgtgtgtgtgtgtgtgtatgtgtgtgtgtg

SEQ ID NO: 56248 - DNA, 201 bp, Homo sapiens
tcatagtgaccacactatgattatcttaagatagatgagtttatgtaagggttttaagtaagagttagacttagctataatgaagcactaaaaaaaaaaaatctaattgaatcactttttactaattaaaattacatttaacctttggcagttaagccaatactgtatcttgtaaaaggctgatcaaactgggaactttgg

SEQ ID NO: 56249 - DNA, 201 bp, Homo sapiens
ttttaaaaatactaatgtccagtgaaatgtactaatgtacagtgaaaaacaaattcgctgtagactattttaatcacaactttgagataggagtttctggmatcagtattttataaaaagttttccaagttaattttactgcactgtcaggagagaaaatctttgttttacgatgaaattaaataattattcttatttcta

SEQ ID NO: 56250 - DNA, 201 bp, Homo sapiens
aaaatttttcgtttaaatcataaaacttcaatataattttggttgttcattcaaatggtgtgttcactcttgtctttatgatgtttttctttggtcactaycagtatatattctctttaaattatgtatttaaacatgttcctacttcttaaatgaaatatgttagatgatgatactgtcacatgcttcagcacttcctta

SEQ ID NO: 56251 - DNA, 201 bp, Homo sapiens
tgatggatgaaatacaagctccgagagacacttttgcatggattcagggattattttactgaagctatttatttttattttccacattgagcctttctgtrgcgatatgtgaatattttttaatatcaaatttctgtacttttcatgcataaattttctattttcagtctagcaacatacctgaaacacttttaaacagca

SEQ ID NO: 56252 - DNA, 201 bp, Homo sapiens
tagatgatgatactgtcacatgcttcagcacttccttactaatttatactctctaaagaatatctgtggacattattttctaagttctttttttttaattwttttttccctttaagtgttcatgtatttgctctctgatagaaacataaattgggggagtacagagatatgtccttcaagttttttttttcacctagtatg

SEQ ID NO: 56253 - DNA, 201 bp, Homo sapiens
gggtccctccattctatcttcattcctttcttctaattattgggttaaaaaaataaaaataaaaacacttttcagagtaggcagcgcaatgagtccactgkttccacgtctgccatacgaagcagatttttgcacaaggataaggttaccgctgccagcccaggactccagcggtgtggccgatcaggcgctggcctcctc

SEQ ID NO: 56254 - DNA, 201 bp, Homo sapiens
cctagtatggaagtttatacattatccccagcaatttcattctaacagaccagtctggttctattttgtgatccatcagtctgatgcttttagggttggayttactgcctacattaacacataacggaaagaagatttttattagaattgatggaatcccaaactgaagagttaccatagtcctatgagatgaatttttct

SEQ ID NO: 56255 - DNA, 201 bp, Homo sapiens
ctcacacctgtaattccagcactttgggaggccaagacaggtggatcacgaggtcaagagatcgagaccatcctggccaacatggtgaaaccctgtctctrctaaaaatacaaaaattacctggacgtggtggcgggtgcctgtagtctctgctactcagaaggctaaggcaggagaatcgtttgaacctgggaggtggag

SEQ ID NO: 56256 - DNA, 201 bp, Homo sapiens
aactcaaatttccagaaactgatagataaactgcggcatgtccataaaagggaatgttacttgaaaagaggaatgaagtactaacacatggtacaacgtgsatcaatcttgaagacattatgataaatgaaagaagccaattgaaaaaggccacatgttgtatggttgaatttaggtgaaatgcccaatttttacaagggg

SEQ ID NO: 56257 - DNA, 201 bp, Homo sapiens
acacataacggaaagaagatttttattagaattgatggaatcccaaactgaagagttaccatagtcctatgagatgaatttttctaactaaaaagaaaacwctagaatgaaaagagaaaaagcttgtagtaataattgtagtatttaatgcataattcatttttatatgcagtgaaacaaaacaccaacaaacaggtgata

SEQ ID NO: 56258 - DNA, 201 bp, Homo sapiens
gtttaattggcttatggttgtgcaggctgtacaggaagcatagtggcatctgcttcttggaaggcctcagggagcttccagtggaaggcaaagagggcacrggcatcctatgtgctgggagcaggagcaggagggggtgaagaaggtgccacatgcttttaaacaatcaaatctcctgagaaggcactcactatcaggagg

SEQ ID NO: 56259 - DNA, 201 bp, Homo sapiens
atgaatttttctaactaaaaagaaaactctagaatgaaaagagaaaaagcttgtagtaataattgtagtatttaatgcataattcatttttatatgcagtraaacaaaacaccaacaaacaggtgatagcactgatactccagatccatgctgtaaaattatgacaagaaattgtgtacagaaaaccggctgcatatgttt

SEQ ID NO: 56260 - DNA, 201 bp, Homo sapiens
ttaggaattacactcaaatctattatattctttgaaatgatccatatcatcattaataaacctagatataagaaatgcataaaaaactttgctggccgggmgcggtggctcacgcctgtaatcccagcactttgggaggccgaggcgggcggatcacgatgtcaggagatcgagaccatcctggctaacacggtgaaaccc

SEQ ID NO: 56261 - DNA, 201 bp, Homo sapiens
tgagtataggttaaatataagaccatgccaaatcaaacaaaagacatggggatgtttagctaattctatcattttttaaggaaagatttagttattaacgtaaatggaatgttagaagtggtgaaataaagaacggttacaaggagagatgaatgtttccagtagttgtgcagattgtgggccaagagatacataatggag

SEQ ID NO: 56262 - DNA, 201 bp, Homo sapiens
aaaacataagataagtcaaattttaaaatagtaaatatctattcaactcaaaaaaggcagtaatggaagaataacgtaatattaatacaaaggcagaaaaygtagaaaacaaatagcaaaataataaataaaaacaactcaaatttccagaaactgatagataaactgcggcatgtccataaaagggaatgttacttgaaa

SEQ ID NO: 56263 - DNA, 201 bp, Homo sapiens
tatgattatgagaaattttgtatacatatatttaccaaaattaacagtattactatgttctacatgtatacaaattggtcactcattcccatatgttataratacttattttaaaatttttcgtttaaatcataaaacttcaatataattttggttgttcattcaaatggtgtgttcactcttgtctttatgatgtttttc

SEQ ID NO: 56264 - DNA, 201 bp, Homo sapiens
aattataaaactgtgttgataggctcatagtatgtaaagatgtaatttatacaacaataatagctacaaggtgggaggagggattagagctacataagatmacatttttgtgtaggattgacatgaagttagtattaatttgaaaaaggttgtaataaagtaataataattctaagagtaaccactaacgaaacctataag

SEQ ID NO: 56265 - DNA, 201 bp, Homo sapiens
cattccttggcttgtgacttcatgactccaatctctgttcccttcttaactggccttttttctgtgtgtcttattctcttctgtctcttgtaagaacactygccattggatttagggaccacctaggcaatccaggtggatcccatttccttaatttaatagcatttggcaagacttttttttcttttccaagtaaggtaa

SEQ ID NO: 56266 - DNA, 201 bp, Homo sapiens
acgtgtgtctattcataagtttcacatgtaattatgggagacaaaaatatccttctccctgaatatgtaaactgcatgtcattgtgttccctcattgccaygtgataacactgtcttaggcttgctatacagctttgtcttacaattttttcattgagtttccccaaaaatacttccttgagtagcaggggataaatataa

SEQ ID NO: 56267 - DNA, 201 bp, Homo sapiens
cattaaaataaatttaaattatcaaatatagctagccgtgctgattcttagaaacaaaacatattgtaacttcatttgaaagtaagtaataatttgttgaraattccttaatagataataattcagaaaattatttccgttattagacagcttttacttcacttggtatacaggatcaaatcaaagtcagttatgatccag

SEQ ID NO: 56268 - DNA, 201 bp, Homo sapiens
gtaataatttgttgaaaattccttaatagataataattcagaaaattatttccgttattagacagcttttacttcacttggtatacaggatcaaatcaaartcagttatgatccagaagcaaagaaaataagcaaaacaaacaatagtatattggagcagataatgggcattcagtctactttttacttggttattcttaa

SEQ ID NO: 56269 - DNA, 201 bp, Homo sapiens
gttagacaattatacgtaaacagtcataagtaccacatatcaatatgtgtgtgaagcatacatatttgaaaacaaggcattaaaattagattgtcaatggktacattaatattcattttcttttttttatttgactactctgaatcctataaaactgtaatttagaaacagttctcatgattaaagtaggtgtcttgtaga

SEQ ID NO: 56270 - DNA, 201 bp, Homo sapiens
ttttcatatattttggacaaatgaatattaatatattattctaaaaatgaaactttgtagtaaaaagctcatactttttttgaagcagaatatattttaawttttttatcacctcaagcatttatcattagaaagcacatacataaattctaagattatttaaacctatctttttaccacatatcatttcactcatttaat

SEQ ID NO: 56271 - DNA, 201 bp, Homo sapiens
gagtggccacattttgcaagggccttgttgcagtgtcataccatggtggaaggacaaggagcagacttgaaagagcaagacatcaaattcacagcctcagttttttttttttttttttagacagagttttgcttttatttcccaggctggagcacaatcgtgcaatctcggctcactgcaagttctgcctcccgggttcaa

SEQ ID NO: 56272 - DNA, 201 bp, Homo sapiens
ggaccatttaaatgtaatttcctctagggacccttccctgtttagaaatatgatacgattattaaagaaggaacagagaggtgtaagtgtggataacacartggctgtgagattaacgagatttggaaattcatagaggtttctattaatctctgaaattaatctgtgtgaaagctataataataatactttctccatgat

SEQ ID NO: 56273 - DNA, 201 bp, Homo sapiens
gggcacattccattctgactgcttgttttatggcgagtacttacgatgtgaatataatgtgtagttttttcatagctttaattagtcttgacttgtgataygtaatctcaatgaaaatgctacttggtcttcatgaggtgaggatgggcagataaatcatcttcaaaatgccatttatggcaatttaatgagcctttcaac

SEQ ID NO: 56274 - DNA, 201 bp, Homo sapiens
tgttctcttcgtgagtcatacaggctgaaacataaaacagtaaaactcagtgaaaaaagatatggctactgtaacactgaagcttggtcactatcattaartctgtgtgcaaacaacatgcttgagaaatgcaataaagtattttgttgactgggatactattcataggtggagtttattataggatctgaggctatactt

SEQ ID NO: 56275 - DNA, 201 bp, Homo sapiens
attatggttactagttaaggttatcgactctagagccaaactcctgggttcagaaacaatcactaccacttacttggtggatgactttaggaacattaccttttttttttttttggctttaagttcttcatttataaaatgggaatattgctagcctctatccagtgatatttctaaagtttaagtgagttcaattgggat

SEQ ID NO: 56276 - DNA, 201 bp, Homo sapiens
tatcaatctctgcattaaaactaagaattcattatttgattacactcttagcaacagagtttttgacaatatttccaattgtggtttatcctgagtcacartattaacatgtttttcatatgttatttaacataacattaatatactatttaccatctattatctatatagtcataaatagtatttatttgtagtgttatt

SEQ ID NO: 56277 - DNA, 201 bp, Homo sapiens
attccttttgcttaaatatgaaatttgaaagatgtcctttgaagttttaatgtatatattattattagcatattgattccacctcaagagattacccataraatttatacattttttatctttgggttgaggtacaatgaatgtctaataatagatagttataggaatgatattgagaaaatcattactaatgatgtcatc

SEQ ID NO: 56278 - DNA, 201 bp, Homo sapiens
gatctgtttcaggttcaaagggttatttataactgctctcgatatcataccaatttctatttccagctgatgaaaataaaaactgattttgtttggcaaaytcatctttagatgtagtttataatgttaagagagattattagcttagataaattaatattcattatctttaacttcatgaataatatttatggaaaggat

SEQ ID NO: 56279 - DNA, 201 bp, Homo sapiens
tttattttttacttgaaaaagtacatatttcacatggtaaaaaacttgtttataaacatgaattcaacatatatttacatttgtatatgtgtataggtgtmcacacacacactcacacacactacaaatgtgtacttagatcaccgtatggaactgaagattgacaaatagcacataagggttgggcatggtggctcacgc

SEQ ID NO: 56280 - DNA, 201 bp, Homo sapiens
gaaagtgaatttgacaatttcattgtggtctttttgtctgagatttaacagggcaggatgattgtttattcttatacaaaagagaatgtaactaaattcayataaatttgactctgaggattagtaattttctccttattagaagattattattaagcatatctacacttaaaactgcatgtgcttgtatgaaaataactt

SEQ ID NO: 56281 - DNA, 201 bp, Homo sapiens
gacactttattcttaactgaaaagccatataaccatgttctatttctaactttacattcatttaatcaaaattatcaatattatggttacaaattaaaccrtagtgttttaaatatataaatttacttagaagccttaaaaataaagcaacattaatcattactattttcaactccgtattttcaaaactaaactaggtct

SEQ ID NO: 56282 - DNA, 201 bp, Homo sapiens
gttaaaggtaaaacacaggtaattattagcgttcctatacaaactggtatctaacatcttcatgtttataatatgtttatctgaaaaatatacatttagtytagtgatttataaggagatttacttttaactggtgttatttaagcaaaagatgtagatgatttagataattcaatgttatatactcctaaaaaccatgta

SEQ ID NO: 56283 - DNA, 201 bp, Homo sapiens
aatcattactattttcaactccgtattttcaaaactaaactaggtctgtgactagttataggattctctaattcatacctactctgtttttgttttggggttttttttttgttattatttagggacctcctggcttacctggtctcaaaggtgaccctggctccaagggtgaaaaggtgagaataaaagaatgtgttatta

SEQ ID NO: 56284 - DNA, 201 bp, Homo sapiens
tttcttatgcactttggatgaaaaaatatttccactctgaatgaaatgccactaatgatccagccagtgtttttcctagtctggatagttccctaaaacgyttgcagttacacttattttcctggcatttcactttaaaaagtatgctggcaccagcatagagtgattctttgacgaaacaaattgttctcttcgtgagtc

SEQ ID NO: 56285 - DNA, 201 bp, Homo sapiens
tcattgctcaaaaattatttgctttactgtaagattcctttgtaaagtttttgttgccctggtgttttgggaaaaaaatgcatattttatttatcaatttmaatgtaatgaacaaagtttcaagaaataattacttagaatgaaaaattgactcctactgcattttgagttaaaatggagcaaattttatagaggaatatt

SEQ ID NO: 56286 - DNA, 201 bp, Homo sapiens
tggagggcatgaagtagtagggtaacatattcatagttctggggggtagggggaaagacttcatctaaaaattttatagccagcaaaactgactctcaaaygcaaaggaaacagccaggtgcagtggcatgcacttatagacccagctaattaggaggctgaagtcggaagatagctggagtccaggatttcaataccagc

SEQ ID NO: 56287 - DNA, 201 bp, Homo sapiens
agaaaaccaaattttaaaatttcaatgatgtgaaatgtttatatataacctatgtatatgtatatataggtgtgtatttgaatatagacatatacacataktaaagacacaaaattatttacaatatttgtagatgtcctccatatggtggaacttaagggtgatatttcctttgttttcttattgtatttctaaaattta

SEQ ID NO: 56288 - DNA, 201 bp, Homo sapiens
caagaataaatctataattaaacacatgtctttttccctgatctccactgtgagattccttgagtaatattttgtcccctgtagtcatagcacatttctakctggctctttccaacaccttttttctttcattatttttgttgatttctacaaacatattaattaaaaaaaactaatagctttatcgaagtgtaatttaaa

SEQ ID NO: 56289 - DNA, 201 bp, Homo sapiens
tttcctccaaataatatatttaaaagttatttaaatggttattacttatgaattgaagccagtgactcaggataagaatttcattcatagtatatgtacamgttaaagctttttaaaattatttttatctttttaatattttttttttctctataagggaccacaaggaaaaccaggacttgctggacttcctggtgctga

SEQ ID NO: 56290 - DNA, 201 bp, Homo sapiens
ctgataacatataaaggattctcatttagattaatagctgattccctaccatatactgtggagggcatgaagtagtagggtaacatattcatagttctggrgggtagggggaaagacttcatctaaaaattttatagccagcaaaactgactctcaaacgcaaaggaaacagccaggtgcagtggcatgcacttatagacc

SEQ ID NO: 56291 - DNA, 201 bp, Homo sapiens
atgaggttagtaataaaaataaattgagccagtaattaaacattgatctctctaaaatacctttcatcatatcacttccatattgcaaaatctttaatgarctcacggtggcttttgtggaaactcatttggcactccaagccagaacctccccagaatctcatattttttttcatttcctccttaaccattagctccagg

SEQ ID NO: 56292 - DNA, 201 bp, Homo sapiens
cagatttctttagtcacctgagttatgctgatttaatataaattacttagaagtagaaaatatttaagtcaaaatcaccaaaatatatccatatttaatayaatcatcagcaaaataagtttctgaacaatttagcttaaaataattaaatgtctgaaaacgatttaagatacttattttacataactcttttgtattgaa

SEQ ID NO: 56293 - DNA, 201 bp, Homo sapiens
aaaggatttttgtttggtatggatatggttacccactttctaaccaatataaatcacttctgtgataaaatttttatgcatcatgatgaatttatgcagcwtgtgtaaaaatatctgaaaacatgagtaaaaattgtaattcatcctcaatatttgtttatgtctttcctaagtctattaatctgaaaatatatcattatt

SEQ ID NO: 56294 - DNA, 201 bp, Homo sapiens
aatttcaatttatgttttttagtttaaagcttccactacttgtagacttataaaatatagaattacatttatgttttttaattagtttcattgaaattagwatatacacaagaaaatcaaaaggatagaccaggaaggaaatggaattcatataacatttttattcatagtattggttttctttttaaggaagaaggaaat

SEQ ID NO: 56295 - DNA, 201 bp, Homo sapiens
tttggtcatctcatatatataaatcacgttcatatagttattttgggtataaaaaagatatcttagactacttttaattttatatcagtaattttagaaaytagactatgttctctctttttaaaaaatattcccatggctaggaatacgtgcatatttttcatgtgtattatatatggagtaaatggtaataatataaac

SEQ ID NO: 56296 - DNA, 201 bp, Homo sapiens
ctattggctagaactttgtcatctatatgtttaaaaatgaatttattggctgggcgtggtggctcacgcctgtaatcccagcactttgggaggccgaggcsggcggatcacgaagtcaggagatcgagaccatcctttctaacacggtgaaaccccgtctctactaaaactacaaaaaattagccgggcttggtggcgggc

SEQ ID NO: 56297 - DNA, 201 bp, Homo sapiens
atactgaaggcatgcaagcagatgcagatgataatattcttgattactcggatggaatggaagaaatatttggttccctcaattccctgaaacaagacatygagcatatgaaatttccaatgggtactcagaccaatccagcccgaacttgtaaagacctgcaactcagccatcctgacttcccagatggtatgtaaataa

SEQ ID NO: 56298 - DNA, 201 bp, Homo sapiens
gggcggatcacgaagtcaggagatcgagaccatcctttctaacacggtgaaaccccgtctctactaaaactacaaaaaattagccgggcttggtggcgggygcctgtagtcccagctactctggaggctgaagcaggagaatggcgtgaacctgggaggcggagcttgcagtgagccgagatcgcgccactgcactccagc

SEQ ID NO: 56299 - DNA, 201 bp, Homo sapiens
gcggagcttgcagtgagccgagatcgcgccactgcactccagcctgggcgacagagcgagactccgtctcaaaaaaaaaaaaaaaaaaaaaaaaaaaaaaraagaatttattatgtttggttttgtgggtgatgattctgcctaatgtaaacaagttagtaaaccttatttgaaaactcaacaatggtgaaggaaagaggt

SEQ ID NO: 56300 - DNA, 201 bp, Homo sapiens
gcttgcagtgagccgagatcgcgccactgcactccagcctgggcgacagagcgagactccgtctcaaaaaaaaaaaaaaaaaaaaaaaaaaaaaaaaagawtttattatgtttggttttgtgggtgatgattctgcctaatgtaaacaagttagtaaaccttatttgaaaactcaacaatggtgaaggaaagaggtgatta

SEQ ID NO: 56301 - DNA, 201 bp, Homo sapiens
caaattcagacattttcttttacaaagtcctttgaaaaattctaatataaatgtatagatagaaagtacattgtaataataaaataaattataaatcctcytaaaatttctgtgtggtacaaaactgtgccttccaagtaaggtcattatgaaaacaaggtctgcatttaatttgagaatcactgaagagattatatacct

SEQ ID NO: 56302 - DNA, 201 bp, Homo sapiens; identical to SEQ ID NO: 10491

SEQ ID NO: 56303 - DNA, 201 bp, Homo sapiens
accttaatctacatggtcaagactctcaacaacttaatctgataaacttgtaaaatctacatccagatacatcataatcaaacatcaaaaaacaaagactrtgagagaatcttcaaaacttcaagagtgaagtgactgataacatataaaggattctcatttagattaatagctgattccctaccatatactgtggagggc

SEQ ID NO: 56304 - DNA, 201 bp, Homo sapiens
aaaagaatttattatgtttggttttgtgggtgatgattctgcctaatgtaaacaagttagtaaaccttatttgaaaactcaacaatggtgaaggaaagagrtgattatagtttgaataagacaggtctactaggataagagagaagaagctgtatttgagggaccttctcacgtgacacattcagataaaataactgatta

SEQ ID NO: 56305 - DNA, 201 bp, Homo sapiens
tgatgattctgcctaatgtaaacaagttagtaaaccttatttgaaaactcaacaatggtgaaggaaagaggtgattatagtttgaataagacaggtctacyaggataagagagaagaagctgtatttgagggaccttctcacgtgacacattcagataaaataactgattaagcatgggcactgaagaaaagtctggaatc

SEQ ID NO: 56306 - DNA, 201 bp, Homo sapiens
tcagtagggaagtcaatgccgatgcggcagaaatagcaagagaactagaattggaaatggagctcaaggatgtaactgaactgctgtaacctcatgataaracttgaacagatgagttgcttcttatggataaggaaataaagtgtttttttctgagatggaatctacttctggtgaagaggttgtgaatattgttaaatg

SEQ ID NO: 56307 - DNA, 201 bp, Homo sapiens
agggaactgaggctcagagagtttaagtaatttgcctaagttcgtatagttggaaagtgatagagatggggtttgaactcaggaagtcaggcttgcactgygctcttttgcaaatcatgtcgaattctgaattatgtattgtggttgtttcctttcacttatggagcagctaaatagaaattaatgcttattaaatttact

SEQ ID NO: 56308 - DNA, 201 bp, Homo sapiens
atttagttttattgattcctttaagaaagtaatgttaacaaactaattttcctggtaagggaactgaggctcagagagtttaagtaatttgcctaagttcrtatagttggaaagtgatagagatggggtttgaactcaggaagtcaggcttgcactgcgctcttttgcaaatcatgtcgaattctgaattatgtattgtgg

SEQ ID NO: 56309 - DNA, 201 bp, Homo sapiens
tggagaagcagagggaggccagatggtataacacattgtaggaggtcgtaagcactttggattctactctgagagaaacaggaagttactggaggcttttkgagcagaagaatgatctaatttgacttacgttttactaataatattaatattggagatcagaggaagcattatagagtgctgatatgtgccatgtactaa

SEQ ID NO: 56310 - DNA, 201 bp, Homo sapiens
catcagcatagagatggcaattgtggtgatggaggttgttgagataatccagggacacacatacacatatgcacacatgtatatatgtgtttaggtatctstgtatgtgtgtatgtaaatctgacaacagatttccaaaccaactggttgatgaaaaaattaagcgactaatatgcttataaaatgctaaataaattttat

SEQ ID NO: 56311 - DNA, 201 bp, Homo sapiens
acatcaagccaaatcccactaagaaagtgatatgtaaagaaggtaaagtgcatgccatgctgttcattaaaagactagtgttccaggagaagcaggaagcmaatacagtctctgattccagggtgtggccagtttgttccaagcaacatcaaggataccagcatggcaggagaagagtgggatgatgaggatggagaagca

SEQ ID NO: 56312 - DNA, 201 bp, Homo sapiens
tctgtttgaagaccacactggaaaacctgccccagaagactatcccctcttcagaactgttaacatcgctgacgggaagtaagtaacaaaataatacaatrttttagctatgccaaaatcattttttttattcagtcacttaacaaatatttatgaagtgtgataaggtttttctagaggctggtgataaataaatgagca

SEQ ID NO: 56313 - DNA, 201 bp, Homo sapiens
tgtattcaaataccaaatcgaaaaagtggaggaaggtttttagtctatgaattgatccagttttaaaagtgtaaaaatactcaactcaaaagtggtaactrtagacatatgataatattaattcaggaaaaacattttctaaaattcctattttaatatttgactattcctgtttgtgaaaataggatttttctttagagt

SEQ ID NO: 56314 - DNA, 201 bp, Homo sapiens
ctcatctccagggactttcagcctaaataatgaagtatggagtaatatccatgaagtgactggtaagttgagataataaaaatcgataaattacatatagrtagatacatacatacacctttgtgtgcatatataagtacctgtatataatttgtaaataactaactcaggaaagcactgaaaaaggcattgtattgtgct

SEQ ID NO: 56315 - DNA, 201 bp, Homo sapiens
tagtctatgaattgatccagttttaaaagtgtaaaaatactcaactcaaaagtggtaactatagacatatgataatattaattcaggaaaaacattttctraaattcctattttaatatttgactattcctgtttgtgaaaataggatttttctttagagttgaagcaaatacaaagaattttacattgcaatacattttc

SEQ ID NO: 56316 - DNA, 201 bp, Homo sapiens
ggaaaatataattgaacaaaacattgtgctgaattggatacatctgaattgcatacacatggtttgtgccagcagttggcaacatagagataattaaaatrttaaggtcatttaagaattgctttgaatatggacattttacttttttcatatatcatatttagccataaaattacttcttttaatctttgaacagttgca

SEQ ID NO: 56317 - DNA, 201 bp, Homo sapiens; identical to SEQ ID NO: 10482

SEQ ID NO: 56318 - DNA, 201 bp, Homo sapiens
ttctgtgattgaatcttacgcatgaatgataataaaacttcctaacagaatattgatcataatgttgtaagtggcagtgatactgagaaagaaaattctartggttattaaacaagtaggagaattacattatcattcatagtacatgtactttctgtcatgcatttgtaatacttgagaatgaatgtatatttccttaag

SEQ ID NO: 56319 - DNA, 201 bp, Homo sapiens
ttgtattcatgaattaataataacatgagaacggtggtgactatgcattgcttacaaagctattcacattcattttcatataatagaaaaatcaaccttakgtcagcccgatcgagcataatatgcagggttttctcttttaaaatatggcaacaataaattgaaactgaaaaccatttaacacaatatgttaaattgttt

SEQ ID NO: 56320 - DNA, 201 bp, Homo sapiens
tataatattgagtcattctagcatatgttctttaacattatgagatagtacattagttgagttccctttgatttttgataaattattttaaaataacctcrtaaaaattttagcactgttctatcctctctttttaaattacaatttatagaaagatgatgagctattttaatccattctagtcactttgtaaacaaaatt

SEQ ID NO: 56321 - DNA, 201 bp, Homo sapiens
attctgtgatattattccaatatttctgtttgagaccattttgtgcagttataacagaataccacagactgggtaatttataatgaacaaaaatatattgrctcatggtgctggtggatggaaagtccaagatagtggggccacatctggtaaagaacttcttggcacatcatcccatggtagatggagaaagacagggct

SEQ ID NO: 56322 - DNA, 201 bp, Homo sapiens
tttatcttttgtactgtatgtgtttcagcttttcaagtatgctaatttcacatttctaatattcagtgtaacaatagtgcatgtaatcagtttattatgcrtatgattatacaaaataaaacattcttctctatagcattatatctgagatttgttaaaaggcacatattatcataacacttcctgaccagttttgtttta

SEQ ID NO: 56323 - DNA, 201 bp, Homo sapiens
gcacagacattggacttccccaacaaagacattaaatgaacaattatggttatgttaaaaaaaacgtaaaaaacatgactaaataactaacagcaagtatracaatgttgtcttaccaaatagaaagtagcaataaagatatatactactaaaaatactaaattgtagtactgtagttgaaaagtataacatacaatgaaa

SEQ ID NO: 56324 - DNA, 201 bp, Homo sapiens
tgagaaatgtatttgcataacataattggtaaaaaattaatattttttcggttttttattttcttcaatttgtgactaaaatagaaccacatggttgttcrtgttaagttatccttaaaatacagcaaagcaaacatctcttttcaaatttatgggttggctttctagctaagaaaattgtataaagagtcacctttcttt

SEQ ID NO: 56325 - DNA, 201 bp, Homo sapiens
ggcagagcaggagaaatggttttgtgggccaggcccagggtcgccatgctgtgtgcagcttagggacttggtgctctgtgaaccagcagctccagctgtgsctgaaaggggtcaatgtagagattgggccttggcttcagagggtgcaagccccaagccttgacagcttctatgtggtattgagcctgtgagtgcacagag

SEQ ID NO: 56326 - DNA, 201 bp, Homo sapiens
aagaaagtaacaaataactgcctttacattgacctaatctataatctaggtgaacatcttaaccttttttttttcaaatttaagtgtatatgttacagctkaactcagatatttttattaccaaaaataagacaatttataaagatgatatgagacagttgctaataaattacaactgagactattttcctgctataattt

SEQ ID NO: 56327 - DNA, 201 bp, Homo sapiens
atctgtgctatattattgtatagataaagggtgagaaatcatctaacttattcacctacctcaatatctccaccaagttcatcatagaagaatctatgacrtttatatatttataaacttatcctatagcataaattttgtagctaatgaaaagctaaaccaactctaatttcttataacaaaaacataaccagtaataat

SEQ ID NO: 56328 - DNA, 201 bp, Homo sapiens
aatcatctgagagtcagtggggttctttgaaggaatttaaacatcagagtgacatgagacatggatttttggaagcttaatcaagctggtggaatgaagaytgatgggaaaaagtatggaacccagttaagtggctattttagtagcacattgggctctgatattctattctcccgtttaataaacctataggtattcaat

SEQ ID NO: 56329 - DNA, 201 bp, Homo sapiens
ttgcacttgtgttgactacaaagattagattgtagcatacaagtcaaacatctggtaatttcatccaaaaagggttctattgagggtaggaagtttatgtratttttattggcattatttgtgtgacatcatcatttaaatatgaacttctgtatcttttcaaatatgggagtatttaagtcaatgtgcttaattttctaa

SEQ ID NO: 56330 - DNA, 201 bp, Homo sapiens
aaagaatattgataaacgctaaaataattactaactatgcaaagcattattttagtagatctatttttatatcttgttttatgagatttttggaatacaayagagagaaatgtattaatatcacaggctgtgaatttacctttgtataaacaatcagtaaactgtttcaaagaatgtctaaatcatcatttacttcatcca

SEQ ID NO: 56331 - DNA, 201 bp, Homo sapiens
cctttcttcccacaatgtgatgatttcctttttgtggaatctaaaaagcaaaacttacatctcagtagcaggtctcattccagtgataacacagtataagmtattgagttgactgacttaattcacccccatattagggtgcatggtgtaactaaaatatttggctgctttttggctcatagagtgaaatgattatttctg

SEQ ID NO: 56332 - DNA, 201 bp, Homo sapiens
cctcccaagtagctggaactacagatgcccaccactacgtctggctagtttttgtatttttagtagagacagggttttaccatattggccagtctattctygaactcctgaccttgtgatccgcccgtctcagcctcccagagtgcgtaagcccccacacctggctggaatggctgcatttacccaatgcctgtactctta

SEQ ID NO: 56333 - DNA, 201 bp, Homo sapiens
gtttcatgtcttgttattggtaagtaagtattataaaatttttagattatttaaaaatttaggaaaatctctattacatatatttcatatgcactacaaawtttgtgagaaatttccacagactagcttctgattctgtttatttcaaatcttgtttctcctccactgcctatagattttatgttctgggaaccataaaac

SEQ ID NO: 56334 - DNA, 201 bp, Homo sapiens
tttcaatcatattattttggacaacaaatgtttttaaaatgtatcagatgaatttattttgggagggggatcaaactgtggtaacattttaaatgttaatyatttaaagaaacattgatatgaagaatccttttgtaatctgagaatcatctctaagtattttttagaattgtaatttaaatttttacataagagtttcct

SEQ ID NO: 56335 - DNA, 201 bp, Homo sapiens; identical to SEQ ID NO: 10490

SEQ ID NO: 56336 - DNA, 201 bp, Homo sapiens
ttgaaatgtataataggcattttacacaagacagaaataccttgcaatgcataacctaaaattgaaaatgaataatttttatttgagtaggagcaatgagmaaaacttgagtttttatttgtgacgaaaatgggagtagataacacacaagaataaacatttaattagagttgtgttaagtctttggctcatatttaatta

SEQ ID NO: 56337 - DNA, 201 bp, Homo sapiens
tagcagaagaaatttttttgacatttgaccttgtgtgttatagttgtgaacctgtatttaactttttctgtaagagaatttgactatgtatatcttaactrtaatggtaaagatgtattatttatactggaggggctgggtgtggtgtcttacccctgtaatcccagaactttgggcagccatggcgggcagatcacctga

SEQ ID NO: 56338 - DNA, 201 bp, Homo sapiens
aaagtgttcttctgcccaattaccacatcagagacctcacagctgcatattacacccaaaatatctaattttataaagaattaaacttttatatacaagtmttttctgcacttacatattttttaaatatttagtttctttaaacaaattctttaatttttacctaacattattaccagtacactgagttctgtcttcaaa

SEQ ID NO: 56339 - DNA, 201 bp, Homo sapiens
gttctatgttacctaatagaatctaacatgaactttttctgtcatctggtaattccatttctaagcacatatcctagatgacattttgcacatatccaccmaaagactcaaggaataatgttttgttatccttgttaataataactgtagacaatataagttaattgaagtatattaataaactaaaattttgtatgctaa

SEQ ID NO: 56340 - DNA, 201 bp, Homo sapiens
ttgagagtaattttttgacctccagtcataaattctgatcacacaggtgtaatcagaaaggaatagattgatgtatcaaatatatgaccattgaaatttcytatttatccaaaaatacttagaagacattggaacaaaaagatccgattaggagaaaatatttgtaacatacaggaaacatgcatagaataatttgttaga

SEQ ID NO: 56341 - DNA, 201 bp, Homo sapiens
actcagacacctcctattgggctctaccgccaagatttggaataaaatttcaacatgaggtttggaggggagaaatatccatattatagcaataatcaatrattattttttcatccaaaattaaagattacatgatattgtgaaattgtaagcaattggtaaatttttctttagatataaatgtcaaatacaattagaaaa

SEQ ID NO: 56342 - DNA, 201 bp, Homo sapiens
gactaacatatataacatatctacacaaatctgtgctatattattgtatagataaagggtgagaaatcatctaacttattcacctacctcaatatctccaycaagttcatcatagaagaatctatgacgtttatatatttataaacttatcctatagcataaattttgtagctaatgaaaagctaaaccaactctaatttc

SEQ ID NO: 56343 - DNA, 201 bp, Homo sapiens
atgtgtgtttttgagtcatttttgtgatgtaatgttgctcatttttgtggtgataatgagacattctagatgaagattaacaggtagttggcaataagaawttaaatgtcaaaatatggatcaaaaggggatcagcttaaaacactaaaaagaagatttaaaatgagatgcccaaaaggagacttgaaaggctcaaacatt

SEQ ID NO: 56344 - DNA, 201 bp, Homo sapiens
taatatatggagacaacattttatatctagcctatttctacttgtaattaggtagagcttattcatcgtgactggggtataggagggaatctttccccttwatgactttctaagttaatttaatgggcatttgaatgtaaacatacttagtgcatgttttcctaacattaaggtaaatgtttctgttgaaagagatacttt

SEQ ID NO: 56345 - DNA, 201 bp, Homo sapiens
agcttattcatcgtgactggggtataggagggaatctttccccttaatgactttctaagttaatttaatgggcatttgaatgtaaacatacttagtgcatrttttcctaacattaaggtaaatgtttctgttgaaagagatactttttctttgcaaataattttgcattattttttcatgccgctcttatctaaaatataa

SEQ ID NO: 56346 - DNA, 201 bp, Homo sapiens
tttaatttggggatactaaattagatgcactctatcctaaaagggtgtgaaaacctggacaaaaaataaggaatgtaattttaaatttatggtgtttttgraaacttaattatgtttaagttgcagtgtatgctatttaagaaaatggtgttaaagtgaaatatttatttaaactgtgttaaaatatacatgcatgtttaa

SEQ ID NO: 56347 - DNA, 201 bp, Homo sapiens
aaacatacttagtgcatgttttcctaacattaaggtaaatgtttctgttgaaagagatactttttctttgcaaataattttgcattattttttcatgccgytcttatctaaaatataagaaaagttagtcacatctcacagttatccctcctgaaactagagatttttttaaaatatcagctggcagtttttcataatggt

SEQ ID NO: 56348 - DNA, 201 bp, Homo sapiens
aagaaaaagagtctgccttcttgaatttaaaatcaagttagccaattacctaatagttctggctcataatgacatatgcttctttaataagaagcaatatrcagtgaaactgcattgtttgatattaagaactaatcgaaaactcttaagcttttaaagaaacaacagaaagaatacgtttgtaaattgggtcattacaat

SEQ ID NO: 56349 - DNA, 201 bp, Homo sapiens
ttagccaattacctaatagttctggctcataatgacatatgcttctttaataagaagcaatatgcagtgaaactgcattgtttgatattaagaactaatcraaaactcttaagcttttaaagaaacaacagaaagaatacgtttgtaaattgggtcattacaatgcctctttaaagtgggcatgtatggctacggactaga

SEQ ID NO: 56350 - DNA, 201 bp, Homo sapiens
ctggaataagggttttaatttctttatggccagctgttacacagaaaggtgggtgaaggttatgttaacagtggcaaatccatatggtatactaagggttrtaggagtgaaagtttattaaaaagttttagaacagaaatgaaagaaagtaaagtacacttggaagagggtcaagcggacgactggagggcttcaagtgca

SEQ ID NO: 56351 - DNA, 201 bp, Homo sapiens
gtgatttataaggagatttacttttaactggtgttatttaagcaaaagatgtagatgatttagataattcaatgttatatactcctaaaaaccatgtaagmtatatcaaaggtttacagtggttatctctacttggtaaaatcttagatgattttttttatttccttgtatttttttcctgggaattctaatttgtttcag

SEQ ID NO: 56352 - DNA, 201 bp, Homo sapiens
tatacaaactggtatctaacatcttcatgtttataatatgtttatctgaaaaatatacatttagtttagtgatttataaggagatttacttttaactggtrttatttaagcaaaagatgtagatgatttagataattcaatgttatatactcctaaaaaccatgtaagatatatcaaaggtttacagtggttatctctact

SEQ ID NO: 56353 - DNA, 201 bp, Homo sapiens
tgtatattgtaatatgattactaacttcatgttaatgtgaatacttacattaatatgattattattttagattaatatgaatatatggatatgtgtaaatrgcataactgatgtatatttgatctatcagtttggcaatgatttggtgaacagaatattaagaactgggatagcttggggcaaaaatgtatctttaattga

SEQ ID NO: 56354 - DNA, 201 bp, Homo sapiens
ttgtctgttaaatgggattttattaaattatgacaagatcatttttggatgattacagctaacacaaatgtactttgcttgtaataactatcacagaatgratactgtgtatacacacatgtgtatattgtaatatgattactaacttcatgttaatgtgaatacttacattaatatgattattattttagattaatatga

SEQ ID NO: 56355 - DNA, 201 bp, Homo sapiens
attaggacttcaacattacaaatttttgtgggatacaattcaacccatgacaatatgataactatttgatatagctctgctcgtaatgtaaattcaagtckggttgcattgattttaagtttgttaatttataatgatttaagtcacacatatttgaagcaaactaatgtgtacatattttttaaagtttaatgttttata

SEQ ID NO: 56356 - DNA, 201 bp, Homo sapiens
atttaagtaatcaaatctacatgccaagacttaaattttaattgatttcactcttcaaatataaataccttaattgtatattatagtcttgtttttattawtttttcaagagaatcatatactattttgtcacattaatgaaaccaacttattttatgccgtaaagatacatttttacttgactctaggaataatgacaaa

SEQ ID NO: 56357 - DNA, 201 bp, Homo sapiens
caaaagtgctgattttataggaaacattatatcatttaagtaatcaaatctacatgccaagacttaaattttaattgatttcactcttcaaatataaatamcttaattgtatattatagtcttgtttttattattttttcaagagaatcatatactattttgtcacattaatgaaaccaacttattttatgccgtaaagat

SEQ ID NO: 56358 - DNA, 201 bp, Homo sapiens
tctggaagctgccaatgatttctctgaacttataagatagacaaaaagcacattctgccaaaagtgctgattttataggaaacattatatcatttaagtawtcaaatctacatgccaagacttaaattttaattgatttcactcttcaaatataaataccttaattgtatattatagtcttgtttttattattttttcaag

SEQ ID NO: 56359 - DNA, 201 bp, Homo sapiens
ctgagtcactactgggtacataacgaaatgaaggcagaaataaagatattcttagaaaccaacaagaaaaaagacacaacataccagaatctctaggacayattcaaagcagtgtgtagagggaaatttatagcactaaaagcccacaagagaaagcaggaaagatccaaaattgacaccctaacatcacaattaaaagaa

SEQ ID NO: 56360 - DNA, 201 bp, Homo sapiens
atgtgaaaattccaaattttcatatattactacattctatctgtatagaaccctcagaattctgatattcactcagaagacagtatatagacaattttttsatgggccctttcctaatcatatttatctcattaaagacatctgatactttgaaaattttcaaatgcgaatcttacaacttgatgtctgatagcatagaaa

SEQ ID NO: 56361 - DNA, 201 bp, Homo sapiens
ttattactttggaatggataatgatcgacaattataattttagtgaataactcagactcctaggaagacctcccctcaattctggaattgagaaaatatcrtagaaaattcaatacatattcagatttagattatatatttgctctacaacaccgaagtagttttgagtaagagaaagtccatgtatttacattcttattc

SEQ ID NO: 56362 - DNA, 201 bp, Homo sapiens
ccattatatgggccagcaaatctcaaatatttttgccttaggacccttgcatactcggaaaggtttttaggagcccaaaaagcttttgtctatgtgggttrctatcatatgaatgaaagctgatatatttaaaatatttatgtattgatttatttataattaagaataataagcccaaagcacttttaataaaaactagct

SEQ ID NO: 56363 - DNA, 201 bp, Homo sapiens
acccaaaacttatatataaacctataactatcacataaaaatattatatgttaaaactattaaactgttgtgtgaagctattttgacataataatgttgaygctattgatattataaactttcaaaatattttcagtcatatttactaattttaaaatcatgataatataatgcagcaaatttttattctttattataaca

SEQ ID NO: 56364 - DNA, 201 bp, Homo sapiens
tgtatgcatgcacacatacatacactgagtatatttaatcagtaaacatttaaaataaattagtgattatgattaacattaacatgctaaaattagtcattatctatgttaaaaagtatctctcttgaagatagtatctattgtctattaaaatatagtatgtagttaagtattctacaaaataaatactatttatgtatc

SEQ ID NO: 56365 - DNA, 201 bp, Homo sapiens
ataatttcagcatagcagagtgagtatatgaattgatttggggatgacaaaaatccgattttgaatcccagcatatagcttaatattcaaccttctctatwtaattactctatatcagtttcaaatgggaaatataacagaatcttcctcataaggatttatagaaaaaaaatgagctgatgtatgtacagtctttaagat

SEQ ID NO: 56366 - DNA, 201 bp, Homo sapiens
gtatgcatgcacacatacatacactgagtatatttaatcagtaaacatttaaaataaattagtgattatgattaacattaacatgctaaaattagtcattatctatgttaaaaagtatctctcttgaagatagtatctattgtctattaaaatatagtatgtagttaagtattctacaaaataaatactatttatgtatct

SEQ ID NO: 56367 - DNA, 201 bp, Homo sapiens
tatgcatgcacacatacatacactgagtatatttaatcagtaaacatttaaaataaattagtgattatgattaacattaacatgctaaaattagtcattatctatgttaaaaagtatctctcttgaagatagtatctattgtctattaaaatatagtatgtagttaagtattctacaaaataaatactatttatgtatctg

SEQ ID NO: 56368 - DNA, 201 bp, Homo sapiens
taataccaatactacattacctctgcagttatatcattctataattttatatatttgtgaagttttctatttctgtgattaagtaaagtatgatgattgtraggccattatttataactctgctatagcacatgaaagagtaacataatgaaatagtctttcttgtatgattatgagaaattttgtatacatatatttacc

SEQ ID NO: 56369 - DNA, 201 bp, Homo sapiens
cagtgaaggagctagtttagaattggaagaatctgacttaaaaaaaagaaaacatgaattgttgaatattggttcaaataaaaggtacttagagtagagayaaggccatagcagaataaatggagaaaagggtcttattttcaatatggaatagaactggtaggtcttggggactgttaggatatgagaggtaatgggagg

SEQ ID NO: 56370 - DNA, 201 bp, Homo sapiens
atgcatgcacacatacatacactgagtatatttaatcagtaaacatttaaaataaattagtgattatgattaacattaacatgctaaaattagtcattatctatgttaaaaagtatctctcttgaagatagtatctattgtctattaaaatatagtatgtagttaagtattctacaaaataaatactatttatgtatctgt

SEQ ID NO: 56371 - DNA, 201 bp, Homo sapiens
acggagacaaggttggtattcattattcgtgttagtagatcctgtgaaaaagcttaatttttgtcaagaattctagataattctaatctttatgattaggygccaggtgaaaggttacctttttcaaagtttcacacacattttcatatgctcaaaagttttatttaagaggttcagaattagtatctgttccataaaata

SEQ ID NO: 56372 - DNA, 201 bp, Homo sapiens
agaagcagggaacccagggcctcctggggaagcaggtgtaggcgtaagtactgtgttattgttaacatagtgtattattggtttgggaatttcttttacarcattacaaacatgtaacaactcttagctgtggttcgaattttactttcccttcccaactcattaaggaaaatcacaaatacaaagccttgtttaataact

SEQ ID NO: 56373 - DNA, 201 bp, Homo sapiens
ctataccagcatcaaaaactacttaattgaattagtaagtagtgcttatattaattttaaactatatctattaatatgtcattatatgataacgcatatamataattcatcttcagaagttctacctatataaattaataatgcaatgttggttgccaatgaataaagaacataaagtgcaatatggagcatcagccatac

SEQ ID NO: 56374 - DNA, 201 bp, Homo sapiens
ataacaaaatgttaaataaaatatctgatagcattattttttaaacaataaaaacttaaaagataggatgggatactgaattagagtttatttctttaatsctacatttaagttatctgtagacaagggtgatatgggtagcattccacaatgattaaaaaggtttaaataaaaaagcatttgcttttcaccagattaaat

SEQ ID NO: 56375 - DNA, 201 bp, Homo sapiens
tttagtcttttctctgtctctaaatagttctcaacactgtaactcacacacatacacacacacatgcgcacacggacacacacatgcacatccaaacacayacacacacacacacacacacacacccctagagaaacaacaaaactgcatcttgtttttaggaatatgtataacagaagcaaaaatgaagaatcattggat

SEQ ID NO: 56376 - DNA, 201 bp, Homo sapiens
aaatctccaaaaatgtgttttaaatttatgtattgaaccatattcatacataactggacctatacatttcaaattagtattgttcaagggtcaactatttmtctcaatccctaaataggttagaattataaataggcaacaatgggatgctgatacaattgattttgctggaagtcacactttttcattaattacacttca

SEQ ID NO: 56377 - DNA, 201 bp, Homo sapiens
ggtttaacatgtaatttgtaggttgcctatacgaaaaataatgtctctgtttagaatttttcttgttaagaaatgtaagtaaaaatgcaaatgtttttctytggaattagtatccatcaaggatttttagaggggctaggcagtgtttaaaagaaaattgcctgactggggtggggatgttgttaactgctgaaacttgct

SEQ ID NO: 56378 - DNA, 201 bp, Homo sapiens
cattctaacatatacaaatagaggttgttatttaaatacaaaccaaacagtgtattaaaattttgtctattttttttcctgtggttatcaaagatctattractgttcaaaagtttattgagttttttcaaaaatgttactaaaaatatcataaacttttaaattcatgtaacataaaaatgtttgagtaactggatatat

SEQ ID NO: 56379 - DNA, 201 bp, Homo sapiens
gtgtgtttttgtgttttgttttgtttactttctctagcgacagggtgttcctctgtcacccatgcaggagtgcagtggtgtgatcttagctcaccgaagcytcaaactcatgggttcaagtgaccctcctcccttagcctctcaagtagctgggacagcaggtgcacaccaccaattattctagtttttgctttttttttt

SEQ ID NO: 56380 - DNA, 201 bp, Homo sapiens
gttttaaatattaataattttgtattcaaatttctctttgctttttttcatttataacaattcaggtatggttactcagtgttctgaattgttcagttggratttgagaaatactatcagtatattttaagaacttgtatttatttgctatgtgtctatttaaaattagtaggtattaggcaatattagagatgctcctac

SEQ ID NO: 56381 - DNA, 201 bp, Homo sapiens
tgacatatctaggttatcgtggccctaatttcataagtcacatataaatcatttttttagcatcagtttcacttccaacagcatctgttgcctgcgtagtktcacttgtataatttcacaaggactgtattttgtgttgtcttcaaaattgtagtacaacaatttggcttgttagtgtggtgtgtttttgtgttttgtttt

SEQ ID NO: 56382 - DNA, 201 bp, Homo sapiens
ccgaaagagaaaaatagaaaatatgtatagttagaataacatttttatatgcagagttgatgtttttgatctgtttcaggttcaaagggttatttataacygctctcgatatcataccaatttctatttccagctgatgaaaataaaaactgattttgtttggcaaactcatctttagatgtagtttataatgttaagaga

SEQ ID NO: 56383 - DNA, 201 bp, Homo sapiens
caaatcaagaatcattaaatgaatgaaataatgataaatatgttgaaaaccaatcaattttatattcttagtggaaagtaactaaatttgacctcattcaygcatgtgtgtcatcaataaaccttatgcaagttgttgactattaaagcaaatggaagagatcaacaagtacaattatacttagaaaagttagagtgttaa

SEQ ID NO: 56384 - DNA, 201 bp, Homo sapiens
aacaattagcactagtagcaccaaatcaagaatcattaaatgaatgaaataatgataaatatgttgaaaaccaatcaattttatattcttagtggaaagtwactaaatttgacctcattcatgcatgtgtgtcatcaataaaccttatgcaagttgttgactattaaagcaaatggaagagatcaacaagtacaattatac

SEQ ID NO: 56385 - DNA, 201 bp, Homo sapiens
ctttaggaacattaccttttttttttttttggctttaagttcttcatttataaaatgggaatattgctagcctctatccagtgatatttctaaagtttaartgagttcaattgggatatggatatcttctaccccatggggttcttaagttaattaaatgaattgcttgtaaatcacttttatatcaacaattagcactag

SEQ ID NO: 56386 - DNA, 201 bp, Homo sapiens
tcataactgcccagagtcagagcctggaaggaaaaaataccttgccttaatgtcactctaaaatttgccagagattttttcttgttatttcagattttccrgtaaatattttgacctttctgcagatgaaataaaaagcaccatgctggagatttccttcagctaatattaaaaataaaaccttctgacataccacctgat

SEQ ID NO: 56387 - DNA, 201 bp, Homo sapiens
tttaacaaagatgccacagcatctttggtatgcaaagcatacctaccaaatatttcataagttttaaagagattatttaaactttcactgaagaatttaamgatcacttatttagtaactagataaaagttatcaaattttggtagatttcaagcaggagatgatcagttctgcccattatctcatcagcttaggaaaagg

SEQ ID NO: 56388 - DNA, 201 bp, Homo sapiens
tgagcatctgtgttaaaaagatgccattttgaaaataacatttttattttaaaaaaattttgaatgaaggtgtctatgttagcattatttcataagttatmacgtggataattttgtgggaattctgtaaatataatgtaaaaaagatattcttcatatatttaagtatatcatttatttaataagttcatggtgaaacac

SEQ ID NO: 56389 - DNA, 201 bp, Homo sapiens
tttatctagtcatctggtttcaacaccatctgtacactgagtcattatggatttcttaaaatcccacctggaaactattttgattattaggaaaagaataygccagccaggcgcgatggctcacacctgtaatcccagcactttgggaggcagaggtgggcagattacctgaggtcaggagttcgagaccagcctggccaa

SEQ ID NO: 56390 - DNA, 201 bp, Homo sapiens
aattattgacattagcctttgtaagagccaggattcaggcctgagttttgttggtaattagtgatatcataactagagaagggaaaagggaatgccttgcytccccatcctctttcagttatcccagccaaggacaacaactccagcatgctcattccattttctattagccaaaattagctatttagaataactaagggg

SEQ ID NO: 56391 - DNA, 201 bp, Homo sapiens
ttgatatccattgcctctttctgctgtaagtccagctgctcataaaactgtgatgcatagctgtctattatactatttcagaccttttggaagaataactrtaaaaaacatccttgagaatgagttgaaatacttcttggaacaacaggaaatcattttttttatcttttttctggcctcagatggtgggatgctatataa

SEQ ID NO: 56392 - DNA, 201 bp, Homo sapiens
ttacctcccactgggtccctctcaggatacatggggattataggaactacaattcaagatgagatttgggtagggacacagccaaaccatatcagtatgtyatatacaacttggcatagaatgttagtgttgtacaaaaataaatttaaaagtaatagtattatgttttcacatatttatgtgatatgagcagaattatta

SEQ ID NO: 56393 - DNA, 201 bp, Homo sapiens
ttccatttattaaaatttagcacaattcattgtacccatgagttgtatgggtacaatgagtcaaggaaattttgttttcaccatttataaactgctaagcrttgtagaaaatacttggtagtgaattagggcacacagaccttgagtccatggtttttaacttaaaaatatacaagtcatacagcaataaaattatattgc

SEQ ID NO: 56394 - DNA, 201 bp, Homo sapiens
gtgaaataaagaacggttacaaggagagatgaatgtttccagtagttgtgcagattgtgggccaagagatacataatggaggaagagttatgtcatcttgrggaattataaatggctaatataaatttagagtgctgtagatctgttgaatttctcccaacatcacacagaccagggtcagaagaaatgaatggcaagtga

SEQ ID NO: 56395 - DNA, 201 bp, Homo sapiens
tatgcacttttttgaaagaattatcaaaaaaatttttgaattcccattaaaaatcaatcttacatggagtgtttcttatttgatgtaaattaataaacagwatttataatgaaaagtgtaatcatattatactaataaggttgtcacaatatatcaaattcagttatctatccattgtgttaaaaaattaaaatcactaat

SEQ ID NO: 56396 - DNA, 201 bp, Homo sapiens
tgtttatgcttctatttttctctctagtgggcggcatcttaactgaatgctgatgaggtgatttgtctatcactttcatttactttacaaatgctcctcaraatatgaaacatccagtgaaaataactgataaaacatttattttggtgttctcatctgtgtgagggattaggggaatactttctattctcattgctccag

SEQ ID NO: 56397 - DNA, 201 bp, Homo sapiens
atttttttctaccatgtttattatatgcatattgtttcaattaactttaaatagtatatgtagttagttaaatatgaaggcctatgtaatatttatagtgraactacatttgacctattattagctgtacacttttattttaaaacatgtatatcgatccccacgaaaagtatatattgacacattatggtgtactgctac

SEQ ID NO: 56398 - DNA, 201 bp, Homo sapiens
aagccttctatctttacaatcacatgtatattttatccctaggagttgtggaagttaacatgcagaaagtatatgagaggagccagatagctggtacagartatatgtccaatatttcaaaattgtgcggtatagcagtctttgctgttttcctgtgactcctattatgtgaccatccccccatgattctgactttatttt

SEQ ID NO: 56399 - DNA, 201 bp, Homo sapiens
acatccaacaaatgagagaaagtgaaagaaaggggattggaaagagaagagaaatggaatggatagttaagagtgtgttccatcaagggaaatgtaaaacyccaaggtttggggaataaaatgtgtaattatttcttttatttaaatgtaacctcatgtctacatatataattaataagtgataagggccgggcgcggtgg

SEQ ID NO: 56400 - DNA, 201 bp, Homo sapiens
tgcaaagtttgtatgtgtcccaattatgtagcttatgcactatatccttactatatgactctaatctgcaaaaagaacaaatataatatttaattctaatrtatccattcaagtgttctatctattcatttataagtatatttagcatctattctctttatttataatccatttagtctgaaacataggtcgttattatga

SEQ ID NO: 56401 - DNA, 201 bp, Homo sapiens
aatgttaattgaaatatgtatagttacatgtagaataacattaaatgtacttttatttatttggcttcaactgtgtatttgagaattattacttactttgwtatatgcaactgaacatcacagtagatattctttgagataaaataggataaacaattttgaaaagaaatacaccaaagactaaatagcactgtaagttgg

SEQ ID NO: 56402 - DNA, 201 bp, Homo sapiens
tagaagtacttataaaataagatttgatttcttataaattatattctatcattcatttattataaaacatatttaatttgtttataagtacttgatgagamttgaatttgtcaatgatacaaaaaacataagcataaaagcataaaacccataagcacaatcttatatattatgcatattgctttatttaatcaaaacatt

SEQ ID NO: 56403 - DNA, 201 bp, Homo sapiens
ccataaacagaaatggaattagactcttaactaaaatataaacatcatggaatgtaactaaatattttaggacctcacatctttcaaaaatacaattctgktcaatgtggtcatctaaaacttctgagacttgtgttcttttttcgttcccctctttacatgaaggcataaaaatactggtgttttactgaagatgcacct

SEQ ID NO: 56404 - DNA, 201 bp, Homo sapiens
aaatggaattagactcttaactaaaatataaacatcatggaatgtaactaaatattttaggacctcacatctttcaaaaatacaattctgttcaatgtggkcatctaaaacttctgagacttgtgttcttttttcgttcccctctttacatgaaggcataaaaatactggtgttttactgaagatgcaccttccttgaatt

SEQ ID NO: 56405 - DNA, 201 bp, Homo sapiens
ataatggagtcaaaatagagacggtacagaagataatgtttgataactattgtaaaaactttttgaacacaacttactatcaaaagtacctatgatatacwttaatattttctattatattttgttatagttaatatttttaaatactgggcaagacctgtgaaatttacctcataacctactcatggagcataacctaca

SEQ ID NO: 56406 - DNA, 201 bp, Homo sapiens
agacaaaagatttggtttaatgggaataatatagattgcaatactgaatatgcacccttttctttaaacagttatgtgaatctctgatcatttttgtctcrgtgatcgctgttcaattatggttaattctgtattccttactgttcaaattctggtgttcagatagttaagaaaacatcatgttttggataaatgtttaca

SEQ ID NO: 56407 - DNA, 201 bp, Homo sapiens
gtaaaaaaaaaataatatatacataatatatattatatattatatatacaaggtattatatttgaaaatttcatgcataaactgatctacttttttcagtrcatttaataaaataataaaagtattttctcatcactaatgtgctcccatattttactttctaacagggggaagcaggtgcagaaggtcctcctggaaaaa

SEQ ID NO: 56408 - DNA, 201 bp, Homo sapiens
aaaaggtgctaaggtaaaaaaaaaataatatatacataatatatattatatattatatatacaaggtattatatttgaaaatttcatgcataaactgatcwacttttttcagtgcatttaataaaataataaaagtattttctcatcactaatgtgctcccatattttactttctaacagggggaagcaggtgcagaaggt

SEQ ID NO: 56409 - DNA, 201 bp, Homo sapiens
tacataaaatgggttttgattttcgttattatgttttaaaccaaatagtgatagaaaactacaatttattcatctgttacaaactaaagtttagtgtttgwaaacaagtgctcattaacattacttttatatgtgatacatattttacaataaatcttatgtctatagggtcctcctggagctgcaggtgcagagggaaga

SEQ ID NO: 56410 - DNA, 201 bp, Homo sapiens
tgctttcttatattgatgtgaagtgattgttgtatacttaatttgtgctgtttttcagtattctaagaggaagtttgtacataaaatgggttttgattttygttattatgttttaaaccaaatagtgatagaaaactacaatttattcatctgttacaaactaaagtttagtgtttgtaaacaagtgctcattaacattac

SEQ ID NO: 56411 - DNA, 201 bp, Homo sapiens
tatcagtatttaacacactcagggtggcgattttaattcatcagcatttctttaaaaactttatttttactgctttcttatattgatgtgaagtgattgtwgtatacttaatttgtgctgtttttcagtattctaagaggaagtttgtacataaaatgggttttgattttcgttattatgttttaaaccaaatagtgatag

SEQ ID NO: 56412 - DNA, 201 bp, Homo sapiens
cttttggatggcatctaaagtgtaatttttttttcaattttacttctaatattaggatttaaaaagtgatatttgctttcattttacctatttatgtgaaytgcatagttctcaaaaatgaaaatactgtgtctgttgaccatcataatttaaaatattgtgtttctttagttgttatgtgatcctgtaagaatgcatgaa

SEQ ID NO: 56413 - DNA, 201 bp, Homo sapiens
agaagaaatttgtcttaaaatttaattctgaatttctttgcatatctaggtttacttactcattgagaaaagttaagtaactcatgatcccttgttttatrtttagactggggtaaatgaaataactgtatcaaaaagatttactctggttgaagggataaaatctaaatattgtgccagttacatcactaatttaaaata

SEQ ID NO: 56414 - DNA, 201 bp, Homo sapiens
tgtacttatgcttttggatggcatctaaagtgtaatttttttttcaattttacttctaatattaggatttaaaaagtgatatttgctttcattttacctayttatgtgaactgcatagttctcaaaaatgaaaatactgtgtctgttgaccatcataatttaaaatattgtgtttctttagttgttatgtgatcctgtaag

SEQ ID NO: 56415 - DNA, 201 bp, Homo sapiens
atgagatgatattggggatcagaatctgtggctggagttggaaaagggaggaggaagtttcacaactaccatgcacatttctcaaaaataattttccctcrttatcagcacataaatttttatagcaatattttaggttactccaaaggactgattaaactcctatttaattccttttataatgttttagggtgaagatgg

SEQ ID NO: 56416 - DNA, 201 bp, Homo sapiens
tggcctcagatggtgggatgctatataatgtggttagtagaacaatgcagtcacaatagctggctttcaacccagctacaccagttattacctgtattacrttgggcaaattgtgtattttctgtttctcagaggacctaacacccaccctagtgttgggttgaacataagataaatcatgtaacacaataaaaaaaaaaa

SEQ ID NO: 56417 - DNA, 201 bp, Homo sapiens
tttgttgttgttgatgttttttaatcaagaatagtataatttctaatagattacaaatttctaacatcagctttgattctggctgaatgtatacccatttytaattggaaaatttatttccagtcactgacaatgaagaataaaaaaaccagtatcttttagtcacattgcattttgtctaaatatatttaacctgttctt

SEQ ID NO: 56418 - DNA, 201 bp, Homo sapiens
agattggttgatgtaactgacttaaagggaaaaaggaatcctgcaagccacaaaggaatgaatcattcattttgttatattttgagttatattttcattaygaatactctgacctatccttgtcacttgtcaaaatatttggcatgaaccacaatatctgggctcagaatagctttttttttcttgtgaacatgatttcat

SEQ ID NO: 56419 - DNA, 201 bp, Homo sapiens
gctgtagtttgaaatttttacttcatttacatctattattttagaagtacttataaaataagatttgatttcttataaattatattctatcattcatttaytataaaacatatttaatttgtttataagtacttgatgagacttgaatttgtcaatgatacaaaaaacataagcataaaagcataaaacccataagcacaa

SEQ ID NO: 56420 - DNA, 201 bp, Homo sapiens
gggtttggatgattggaaatatttgcttctgctgctgtcaggaggtaaaaggagatatcttgcttcttacggttcccaaggaaataaatcctcattatgartaatagaagctcatagtcacggaatgcctggagaggctgtagtttgaaatttttacttcatttacatctattattttagaagtacttataaaataagatt

SEQ ID NO: 56421 - DNA, 201 bp, Homo sapiens
tcccagggtgcacctggactgaaaggaggggaaggtccccagggcccaccaggtccagttgtaagtatgatgataataaatagccagacaatcatggttgygaattacagctcttctttcattactctcatgctgtgattccacagtgtgtgggagagaaaataaacacatgtcaatcaaatcagtcaatgcctagttccc

SEQ ID NO: 56422 - DNA, 201 bp, Homo sapiens
aatatttaatgtgcgtttattgtactccaagatattgctcaacatttatataagaccgttagctccgttgaccataaaatctttaatatatatgtaacgtwaaatgtaggtagtgggtagttcattttaatgcatatggcattccacccaatattctcatcattaaataatattcacattttacttacagtagtttagagg

SEQ ID NO: 56423 - DNA, 201 bp, Homo sapiens
ggatctttgcttttctgtttctcttctataatgcaaatcctatttcaaactataccacatttgttcatggtgaaatgattcactgacattgtatactaatracatcttctttcttccttatataaagagcatgctggattttaaatttgatatattaatagtagcagttttacaaatttttttgcggagagtgagaggtac

SEQ ID NO: 56424 - DNA, 201 bp, Homo sapiens
tgagaaattacagcaattgtataattaaagaaatttaaacctagaaatgtatacccaaattgggacaggtgtataccttatccaagataaatagttaagamtatgttgcatttttaggaaaaaaatatttatacttcataagcaagtgcaggaacacattctcctgtttaacaaccttagcatctaaaaattttctctttg

SEQ ID NO: 56425 - DNA, 201 bp, Homo sapiens
ttattatttcaaagttacaggatctttgcttttctgtttctcttctataatgcaaatcctatttcaaactataccacatttgttcatggtgaaatgattcrctgacattgtatactaatgacatcttctttcttccttatataaagagcatgctggattttaaatttgatatattaatagtagcagttttacaaatttttt

SEQ ID NO: 56426 - DNA, 201 bp, Homo sapiens
cctgaggcaagggaaatacgatgttattttatagagtgtgtaaacatgactacttacttgtgctgaaggcttctttttaactgcttatcagttttagttaraacattatatatactttctcagtaattagaaagcttcctccaaaaatactttcatttttcctgtttaaaacaactttataactattttctgtgagaaaat

SEQ ID NO: 56427 - DNA, 201 bp, Homo sapiens
gccataaaagccctcagtagagagccaagagtttattgccttgttatgtttgaagatctattgttgctgcctttcactttaactcatcattccctcctttycttctatcttccttttgattatctatcttagtgttttcatgatacatccccagcatgcagaggaaaatgttgctagattgtctccaatgtggacatggaa

SEQ ID NO: 56428 - DNA, 201 bp, Homo sapiens
actatttctctctgttatccaagttttgatgcaccgggaattgaattaggaacaaatcaccaaaaagggggaaatactcatttgtgaagtgctaaagaagyaatatttttcacaaaaacgaaaatacaaacctttgcaaatattattttacaaatgattgatgcaaatgaaatatatttaaatgtaaaatattcagaaaag

SEQ ID NO: 56429 - DNA, 201 bp, Homo sapiens
tattagttatgttaggttctaaaggttatttttaatatttagatcagggagtttaatctgggtcactcatattttagattagtgcattaaaaatatactayatttattttgtattgcacttgacacatgcacctattaaattttctaccatgattttatcatgtatgtactagattattaagaggaatttgctcttaggaa

SEQ ID NO: 56430 - DNA, 201 bp, Homo sapiens
aaacctgaagaagtcactgagcaagccatgatgttgtgaagtagcataacggattttaattagagttgttaatttacagggcacccaggatgtcaatacasatgacttaagggagcaaagatggttctggcaccaccaagaacctttctcctgaagtaactagccaacctggaaaaagtctccctcagttggaagaaagct

SEQ ID NO: 56431 - DNA, 201 bp, Homo sapiens
ggacaggtgtataccttatccaagataaatagttaagactatgttgcatttttaggaaaaaaatatttatacttcataagcaagtgcaggaacacattctsctgtttaacaaccttagcatctaaaaattttctctttgtttaacttaaacccttcattttgctttttattaagatagagagcaactgatcaccatcctct

SEQ ID NO: 56432 - DNA, 201 bp, Homo sapiens
ggtaaattaagtcatctagttcactgaacctagaaatttgtgaacttgtagaaaagcctatgtaaattgaatttatataaaaaatttgtatctttattttwataaatatgattataaaattactgtgttgatattaaatatcttatgtgcataattacacaaattgcatcatgaacacaatataatgaattattactgtta

SEQ ID NO: 56433 - DNA, 201 bp, Homo sapiens
ttttatacaaatgaatcaataaaatgggtaacatttgtgcttaaaaaaaagtcacaatggtttattccagaggtatagaaattatagcatttaaaattgaracagagtttctagtttcttcttctacaaatggtaacctgtagtgtaaagaacttccagaagaaatggaaagagcaaaaacaatacaaactagatctcatg

SEQ ID NO: 56434 - DNA, 201 bp, Homo sapiens
agagtgctgtagatctgttgaatttctcccaacatcacacagaccagggtcagaagaaatgaatggcaagtgattcctggctagagattatgtgtactatmatgaaggcagaagagaatatatctgccttatttacaggaaaccttatacaaaaggattgacttttagagtttaaggctagcaagggaattcaaattaagg

SEQ ID NO: 56435 - DNA, 201 bp, Homo sapiens
aatagagtttacatacaactcatttattatgcaatataagaatattccctagattagtttttgaatatatacttactcacagctcaaaaatgccacttttrtttatataaagctcaaatttcacaatttccttaattatatttttggcaatgtctctccaaattatttctatcaactaactttaagatacccaataattac

SEQ ID NO: 56436 - DNA, 201 bp, Homo sapiens
tggcccatagagagtttgctccagatcagaaagctagtggttccagtgctagagagggaaagatcatacacttaattgacacacttatttatggcatactrtgtgccagtaactactcaaactgctggagatcattgaaaaaagaaaaaaaaagaaaaatcaaaaacctctacctttgtgaagttgatcattatctatttt

SEQ ID NO: 56437 - DNA, 201 bp, Homo sapiens
ttatacctgttgttttgatattcatttattaatgtattaaatatgccatataattttctggatcttagtttacttttctgtaaaattttacttctacaatkatttgagattttatatctatttttggaatatataactgttcacttacagtcctctaacatctattacatttatactttttgacaggcattgttcaaagaa

SEQ ID NO: 56438 - DNA, 201 bp, Homo sapiens
ggcctgagtgtaattctgaattaatatggtcatgacacacagatttatattaaattagtttcatgatgaaataaagtccagatggaagtagccacattacrtcaagagcagaatatttggatttttctcttgtttgcagtttccaaaagctcttgaaattaaaactctttaggtaattctattattaaatattactaatgt

SEQ ID NO: 56439 - DNA, 201 bp, Homo sapiens
tttatacctgttgttttgatattcatttattaatgtattaaatatgccatataattttctggatcttagtttacttttctgtaaaattttacttctacaaytatttgagattttatatctatttttggaatatataactgttcacttacagtcctctaacatctattacatttatactttttgacaggcattgttcaaaga

SEQ ID NO: 56440 - DNA, 201 bp, Homo sapiens
gagagaagatcatttttcaattataattgagcactgattcaacatctgcattaactgttttagttatatctaaatttcttctgccttttttgtgatcctaktaaggtccaaacacataatccatctacaagtcacattattcaatcagatggaattgaacaagacagtatcacaggctggtttttcattgctcattctcta

SEQ ID NO: 56441 - DNA, 201 bp, Homo sapiens
ctacccttcttttaacagggtattttatacctgttgttttgatattcatttattaatgtattaaatatgccatataattttctggatcttagtttactttyctgtaaaattttacttctacaattatttgagattttatatctatttttggaatatataactgttcacttacagtcctctaacatctattacatttatact

SEQ ID NO: 56442 - DNA, 201 bp, Homo sapiens
ttacctttttataaccttttaattaattaaatttatttgatgcaatagagccatattggtagttatgctttagtaagaatccttgtttaacattgataacmtagaaagtataagataaacgtacagttttttcatagtgttttatccaacttttggcattttctgtagtacttggtaagcagatgttgaattagaagtaca

SEQ ID NO: 56443 - DNA, 201 bp, Homo sapiens
gacaaaatttgggagatggactaacatttgttgaattcttgctagcatctaagcactctgctattttacataataaaaaactaaatcactaatacaacatrtaattactgaagctctgaaattgcaagatgtagtcatttgaatatttgaaatgtacagaacaagtggagtaaacaaattgaagttttaagaaaacaaatc

SEQ ID NO: 56444 - DNA, 201 bp, Homo sapiens
aacaaacattaggtaaaaatgtggtagacttgatattcaaaaacaatccaattccaaattcagtgtgacacacaaattcaatgcacattagtgtgaaaatytcaggggataccacacacccaggtaaattagagttttgtaacaaaaataatataaagcctcactgcattcacaaacatgttgaatttctttaatatagaa

SEQ ID NO: 56445 - DNA, 201 bp, Homo sapiens
gttatctgagtagcatcattattattatttcaaagttacaggatctttgcttttctgtttctcttctataatgcaaatcctatttcaaactataccacatwtgttcatggtgaaatgattcactgacattgtatactaatgacatcttctttcttccttatataaagagcatgctggattttaaatttgatatattaatag

SEQ ID NO: 56446 - DNA, 201 bp, Homo sapiens
tcatggtgctggtggatggaaagtccaagatagtggggccacatctggtaaagaacttcttggcacatcatcccatggtagatggagaaagacagggctagagagagagagagagagagagagagagagagagagagagtaaaaagaaaacaaattccctttgttttaatgaacccactaatgcaataacggtattgatta

SEQ ID NO: 56447 - DNA, 201 bp, Homo sapiens
cttccataaaatatgaacttaagcagaatgttggatgtgagtaggcacagatgataacataatatttattgtttaattgagaaataaaagatgaaggtaarggtatcatacagtatctaacaagtacaggtatggttgaatgaaaaagattataataatgatgaaatgatgataatttaagtatttgcattttaaaatcac

SEQ ID NO: 56448 - DNA, 201 bp, Homo sapiens
agccattgatcgtgcatgcattttgtctgtaagaggtatcagaagcataataaatgcctacacttgagaagcatgcattctagtaggagagacaagaaggrgtatttctttcactgataaacaaagtgatttttatactatgtttctctaacaagtgaaacattagagcatgaaataaaaataccccatttctctagtatg

SEQ ID NO: 56449 - DNA, 201 bp, Homo sapiens
attaagtctatcctgtaatttttgagctcataaataatacattcatttgaagtattttatggtcagtcattttaataagggacatttaaattaattaaaawggctaaataattaaatggagtagaacaatttaacaaaaattagcacaactgtgagttttgtttttagagcaccactgattctctcatgcatttggttttg

SEQ ID NO: 56450 - DNA, 201 bp, Homo sapiens
acttctagaattgagtataacgtattgtttcctttacttgaaaaaatttgagagataaaatgccattttttatgagtttgtatttattttgcattcttggtttttttttgtttgtttgttttgttttgttttttgttttttgagacggtctcgctcggagtgcagtggcgccatctcagctcactgcaacctccgcctccc

SEQ ID NO: 56451 - DNA, 201 bp, Homo sapiens
gcgatggccctcctggccctccaggtgaaagagtacgtatgatacagccacataatataaaatgaaaattagtatttctgcaagtatttagatttcagagraaagatatatgtctgctaatacatgtgcatgtctatccacaaaatctagtctgaatttaaaaacgcttattttttaatttattcctcttcaccaataaaa

SEQ ID NO: 56452 - DNA, 201 bp, Homo sapiens
aatttccacctcacaattgctgagaccactagtgtgactgattttgagtggaaacatggtaaatgaatgtattgttttacttaaatgattacttgaacaaratgttatatttttgtgcattttgaattgtggggcattagcaacagactttcatagctaaaccctactagttacagagatttatttattagtccactgggc

SEQ ID NO: 56453 - DNA, 201 bp, Homo sapiens
attcactgctttcaaattgggaatagggccaaatagttacctcctgtgagtaggtaatactctacacctggctattccaactgtacatgcctgagaatacwgcttcaagacttctaagatttcacagtacatgtgaccccgagaggttggtaaaaattcagattcctggacctcactgccagagagtctgtttcagtttca

SEQ ID NO: 56454 - DNA, 201 bp, Homo sapiens
aaacatacaggaaaacatgttataaaaaacagcttagcagtgcatccttcaggttattattttgactatcagctgccatagggcatcacatacaattttaytgacctgctttaatagcatcatgtaggaaatacaaattgctagcatcttaccttcctgataagtgtgtaatattcactgctttcaaattgggaatagggc

SEQ ID NO: 56455 - DNA, 201 bp, Homo sapiens
tcattgccacgtgataacactgtcttaggcttgctatacagctttgtcttacaattttttcattgagtttccccaaaaatacttccttgagtagcaggggmtaaatataatgcttttgaacccttctaaaataagatttacggcatctgtgatttaaaaataatacaggcataatttaaatattttctggctgtactcagg

SEQ ID NO: 56456 - DNA, 201 bp, Homo sapiens
gttactatgtaattttttgaattagtacttactaatattattgagggaaataatacaatctttacctctttaatgatatgaatcaatatatttctggcctrtattgctttcctttttgttctctaagcttcagtttattgtggtattcaaaaactaatttgctaatttaaaaaaagacctatctaagattataagcaggct

SEQ ID NO: 56457 - DNA, 201 bp, Homo sapiens
tcatcagttcatacatagaaagctactttattatgaacatttcaattactaggttgagaaaaatggaaaaattaattccattaagccttttattgaaatayatatatatatataaatacaaaaatagatacaagaaatatacttcaggaaataggatgttagttgatatgattgtttttattgtcaatagcagcattttaa

SEQ ID NO: 56458 - DNA, 201 bp, Homo sapiens
tggtattcaggcccaacttcaagagattttaattttaatctgggcttgacacaatatcaatatgttttaaaacatccccagataattatcatattcattgkttgagagacacggggcattatgtgttgcgtcaaaaagatttgcaaccattacatttatatttcaatataatattaggcaacattgaaatttgacttcatg

SEQ ID NO: 56459 - DNA, 201 bp, Homo sapiens
atcagttcatacatagaaagctactttattatgaacatttcaattactaggttgagaaaaatggaaaaattaattccattaagccttttattgaaatatayatatatatataaatacaaaaatagatacaagaaatatacttcaggaaataggatgttagttgatatgattgtttttattgtcaatagcagcattttaagg

SEQ ID NO: 56460 - DNA, 201 bp, Homo sapiens
tgccaatcaaatccagggcatgtcttctgatctcaggggatgtagtcactaaatggatgtcttgatgcacacacaaggcagaaagtagcaagagactgaayatcaagagagtaaggcagtgcagcatttttctgcatgatgaatataaactgggtaaatgttttctatgtatgtaaacagatatatgtaaatatatcatgc

SEQ ID NO: 56461 - DNA, 201 bp, Homo sapiens
tgtctatgatttaatctggagcttccacttctaacaaaaataattatatcacatataacattgagatttaaacatagaagaaaaacagcataatgtttctwgaatgaatgtttctgttttgtagcttttcacagataaaagccaggattatttctgaaaaaattatattcccgatttcacatccactttaagggaatagtg

SEQ ID NO: 56462 - DNA, 201 bp, Homo sapiens
tccagtaaatagaatagctatttagtaaattgatttttaattgatgtaagatgtagccaaatacatatgaacaagcatgccctttgtttggattttttggmaaaatataacatttttgtagccagatttttaaaaaagctatcctcctgatataagtttaagtattataatctgtattcctttaaaaaattagaatcattt

SEQ ID NO: 56463 - DNA, 201 bp, Homo sapiens
aatgcatatggcattccacccaatattctcatcattaaataatattcacattttacttacagtagtttagaggtaatcacaattttgtttgtagaaagatrtgtagaaattaatctgtcttgacgatgtttattatattctttagggtgatccaggtcctcaaggtatctcagggaaagatggaccagcaggattacgtgg

SEQ ID NO: 56464 - DNA, 201 bp, Homo sapiens
aatgatgtacatttttcatattgaatttagtgtatcaagataatttatttttcaaaaataaaaattgatttagtgtctttggatttgtctggcattagttygggttcatcttttgttctcatctgcagggtcctcgaggttcaagaggtgcaagaggtcccactgggaaacctgggccaaaggtatcacctgtactttttc

SEQ ID NO: 56465 - DNA, 201 bp, Homo sapiens
taaatgaatacgaatgaatgaatgaatgaatgatgttcttgcatgactactcagtctcagcaccaggctcataatttactgtgatatactgcatattgaamttgaactgtctttgctagggagtagctggcaaaccaggccctcggggtcagcgtggtccaacggtaggtgccttgatttaaaatgatgtacatttttcat

SEQ ID NO: 56466 - DNA, 201 bp, Homo sapiens
acagattccatagatttgtatatggatataaattttcaggagccaccattcaattcgctgcatcactcaaatctcatttttggctatttgaaatatacatrttttaagcataaaaaatatggttttcaaaatgcatatttacctcggtgtactaatttttctcaaacctatcataaaactttgttaaggatgcacttgatg

SEQ ID NO: 56467 - DNA, 201 bp, Homo sapiens
aatcatctaatgtgacagttcttatcgggtttcatactttgcaacttctacagtttcacactttgaaaaaacattgctaattgtaaattaatgagcaatgktatagtgatttggcagcaaaagaaaaagatcaggggaaaacaaggccttatggggcgtttaaaccctttcccttaaaatgctcaaggccagtggttaaaa

SEQ ID NO: 56468 - DNA, 201 bp, Homo sapiens
aagaaaatatatgatataggtattagatagagagtgtgaatagtcaaaaagaaaattcctcatgtccttatgaatcatctaatgtgacagttcttatcggktttcatactttgcaacttctacagtttcacactttgaaaaaacattgctaattgtaaattaatgagcaatgttatagtgatttggcagcaaaagaaaaag

SEQ ID NO: 56469 - DNA, 201 bp, Homo sapiens
atgaatgaagtgtgccacctctttgctcataatcttccagtggcatttcatttcatttgtaaagttattccaatagtctgcaggaccttatgtgacccatrccacaccctctgcctctcctgttagagtttatcagtgtctcctctccatgttgctacctgtggattgttggttcacaaggtgtccctcacttgaatatat

SEQ ID NO: 56470 - DNA, 201 bp, Homo sapiens
gtaattatgtttttctctagggaggaggtaatgaagacgttgtcaatagcaagttcagtggtcatttacagctcttaagcctctgccattgcccaatcacrttcagtacagagagcatcctgggcaggatggtgaaaatggcatgactttctcttgaaaaaaaaaaaaaaaattcctggcatgctagagttctttgagtat

SEQ ID NO: 56471 - DNA, 201 bp, Homo sapiens
cataactagaaaagcaagtctatttctttcaagtagcacctggccaaaagaacaaatgaatgaatgaagtgtgccacctctttgctcataatcttccagtrgcatttcatttcatttgtaaagttattccaatagtctgcaggaccttatgtgacccataccacaccctctgcctctcctgttagagtttatcagtgtctc

SEQ ID NO: 56472 - DNA, 201 bp, Homo sapiens
tcagggagaataaagggttgggaaagctgtaagatagcatatgttattcaaaagctaggtgttcacttaagttgattattctctgttgaaataaaataaayattatgtgtcaattgttgtgcttaagtaagggatatagaaacatagttgtaataaaagacttgtgttacataataaagacataaaaatattcaagggggg

SEQ ID NO: 56473 - DNA, 201 bp, Homo sapiens
gcctcacttctttttcaatttaaaagaacaatttccacctcacaattgctgagaccactagtgtgactgattttgagtggaaacatggtaaatgaatgtaytgttttacttaaatgattacttgaacaagatgttatatttttgtgcattttgaattgtggggcattagcaacagactttcatagctaaaccctactagtt

SEQ ID NO: 56474 - DNA, 201 bp, Homo sapiens
tttcatatattttggacaaatgaatattaatatattattctaaaaatgaaactttgtagtaaaaagctcatactttttttgaagcagaatatattttaaawtttttatcacctcaagcatttatcattagaaagcacatacataaattctaagattatttaaacctatctttttaccacatatcatttcactcatttaata

SEQ ID NO: 56475 - DNA, 201 bp, Homo sapiens
aagggggctctggtaggttccaaagtatccatttaaatgtcctattaataaatttccaagagaaaatgccttaatttggtcatctcatatatataaatcaygttcatatagttattttgggtataaaaaagatatcttagactacttttaattttatatcagtaattttagaaactagactatgttctctctttttaaaaa

SEQ ID NO: 56476 - DNA, 201 bp, Homo sapiens
gtaattttagaaactagactatgttctctctttttaaaaaatattcccatggctaggaatacgtgcatatttttcatgtgtattatatatggagtaaatgrtaataatataaacaatgaaattgggcaagaattactcaatattactgaactgcttatgtaaccccaattttattattacttattactttctggtaaccat

SEQ ID NO: 56477 - DNA, 201 bp, Homo sapiens
tgcaaaagtctgaaaagacatctcaaaaggctaatcttatgttctacgtagtgatgttatttacaggagtaattggggaagttataaacattgtaactttyggaacaatggctggtaattttttactatgactacattttagtggaattcacacccctctcataattctaaccttgtggctttgtattagtttttataaag

SEQ ID NO: 56478 - DNA, 201 bp, Homo sapiens
gatgggtttatcttgcctgctgcccagacagggcctatttatccagacaggggaattgcaaactctttctctatgcatacagttagctgaataggagactrgagttttattattactcaaattagcctccacaaaaatttggaggatagggttttttaaagatagtttggtgagcaggaggctaggaaatgagaactgctg

SEQ ID NO: 56479 - DNA, 201 bp, Homo sapiens
taggtctcatattcacaagtacccagtatttggtattttctggactttaatataccttgctaaactcacactgaggcatttagtaaatgtttattgaacaytgtggttactgaaggtccaaaacatgtttgacactggagactcacaggttaattaggcaggattcttgtgttcggccatttagcagaaggaaaacaacct

SEQ ID NO: 56480 - DNA, 201 bp, Homo sapiens
ttacgagatagaagaaaatggaaaatattttatatataatgatgttaattgttaaccaaaggtgatatagcaagttagtactctaattatgactaaaattmtctcttttttagccttagatttgtcgcttaagtctggagcaacacagctcaataaattaggtggcatagatgaattccacttttatacatcttctaaaac

SEQ ID NO: 56481 - DNA, 201 bp, Homo sapiens
attttttgttttctattgtcgacatgaagtaggattacaatataactttattaagatggaattaatgatacaaacaaaattattttaatcttttactagcrcaataaaatgtattttaaaaataagactattttatggatatttcttaaaaatttgtcctctttaaattctttatttgtagttggaatgatgcttttttac

SEQ ID NO: 56482 - DNA, 201 bp, Homo sapiens
gattataaatcatgctgctataaagacacatgcacacgtatgtttattgcagcactattcaaaatagcaaagacttggaaccaacccaaatgtccaacaaygatagactggattaagaaaaatgtggcacatatacaccatggaatactatgcagccataaaaaaatgatgagttcatgtcctttgtagggacatggatga

SEQ ID NO: 56483 - DNA, 201 bp, Homo sapiens
catccccccatgattctgactttattttcctctttatttattatttcttcttcttctcttgcttctctaagagttcacattctcttcctatcataattccyattcctcttatttttttttcttcatcctatttctgagaaccttcttttccttggcttttacttattcttccagcaagggaataaccaaggtttaaaagga

SEQ ID NO: 56484 - DNA, 201 bp, Homo sapiens
agttcacattctcttcctatcataattcctattcctcttatttttttttcttcatcctatttctgagaaccttcttttccttggcttttacttattcttcmagcaagggaataaccaaggtttaaaaggatgtcatgtaccgacatgccaagtcagactctatacattttaagataaagtccattttctccattgtgaccc

SEQ ID NO: 56485 - DNA, 201 bp, Homo sapiens
atgtcatgtaccgacatgccaagtcagactctatacattttaagataaagtccattttctccattgtgacccaggtagaccttagtggactatgattacawccaactagggatgagataaatgtagcaatagtgatggggaccagtgatcaaaatctgaggtatttgatttgactttgatcatcagagtctatgctttaaa

SEQ ID NO: 56486 - DNA, 201 bp, Homo sapiens
gatttatttattagtccactgggctagaaaaaaagccattcatatgtaaacagggagataataaaggctatcacatttatgtgtatactcaaatggagcawttttaattaacgtctaagtacctttacatatattataattattgtctttcctctaagttctttagattcctactaaacaaatcctataaaatatcaacat

SEQ ID NO: 56487 - DNA, 201 bp, Homo sapiens
agcagttattggattatgtatatttgttcaaatttttaagagttttctttttggccatgaatgtagtatatcttgaggaatgtccatgtgaactttagaaygataagtaatctgctgttattggttataggagtatatatatgaaaattatcttttttgattaatagtgtttttagttcaactttgtccttactaatttct

SEQ ID NO: 56488 - DNA, 201 bp, Homo sapiens
taagagcttagtaaatgccaaatgcattcatttgagaaaaaaagagatacagagagtaaaggtatgttgacaaaagtccaaaatatatctaagtttttacsttgaattactccattctctgtttcttccttctatctttgattggaaaattatgaaaaggaactctgatagcttcctgtgaatatagctaactaaaatatc

SEQ ID NO: 56489 - DNA, 201 bp, Homo sapiens
ctctctcctgccttttctgtcattgcaatcattcattttacttatacataagcatatatgcagtgaaatccattattgctattattattttgaaaaaactyataccttagatcaattaataataataaaaaatattttaccttcacttattcattctctgaatagtttatgtagatttaagcttctcacttatataatttt

SEQ ID NO: 56490 - DNA, 201 bp, Homo sapiens
caattgaaatttttaaaaatcatggagttttctatttcctgtacataatataactccatttattttggtcttgtttaatttttttttacaatgttttctarttttcagggtaaatgtcttggacatcttttatttaattttttcctaagtatttttttttagtgctagagtaaatgaatttgtttctaatgtcatatttga

SEQ ID NO: 56491 - DNA, 201 bp, Homo sapiens
caattcagttcttacttagtataatgatcttaagaattacccatgtttattgtatttaatattattattattattattattattattattttgctgagtargattttaacacatagctacaccaaaattttttcatccattcaccctattagtgggcatttgtgttacttccaggttatggcatctataaagccactataa

SEQ ID NO: 56492 - DNA, 201 bp, Homo sapiens
tttttagaaaatgtaatgagaattctcattaaatcttaacccttttatgaaatgtgtttagagcaacacttgaatgttcatcaagcatcttcataaagttmattgaaatactttgttttcatatttaaatatttgtggggacatagaacatactggggtcttttttgtttttgtttgtttgttttgcaacctcctcagttt

SEQ ID NO: 56493 - DNA, 201 bp, Homo sapiens
actttccttggacaaggcattgatggtgagatgtaaaagatgagaaggaattaactatgcaaagagttctcataggggcattccaggccagaggaaaaaartgtgctcaggcaatgtcacaggaatggacatggcatcagatttaagggactgagaaaaatgtctagaagggttggaatgcagagagcaagggttagggga

SEQ ID NO: 56494 - DNA, 201 bp, Homo sapiens
catagttttgacatgaaggtcaacttcttttttttttttttttatttcaagagggagtttcgctcttgtcgcccagtctggaatgcagtgacgcaatctcrcctcactgcaacctccgcctcctaggttcaagtgattctcctgtctcagcctcccgagtagctgggattgcaggcacccaccaccaacccggataatttt

SEQ ID NO: 56495 - DNA, 201 bp, Homo sapiens
cctgtaaatccatgggctggttcctagggaggctctagatctggcatctagcaacagactacagggcttagatataattattcctcaccatgaatttgctrtgtttccttctagaggcattcattgagacccagattatgcctagctgggcagtggccagaggaattcagaccacaaagtacagagagcataaggtggtaa

SEQ ID NO: 56496 - DNA, 201 bp, Homo sapiens
aaacagagactaatttctagccactcatgtattagaaaaactataaaatgaatgtcagactgcttagtcatttccttctcaaaataattgacctaaagttyagaaaagggcaagaaaggcaaacctttaggcacagtaagagagggattacatgcaaaagcaattttgttttaaacattttaagtatttctggtgtgtgca

SEQ ID NO: 56497 - DNA, 201 bp, Homo sapiens
gttccctgtgcaacttcttccagggattgtgcatatctatggttggtgacaatagggtatgttttcatgcttgctgttgtttccattaaaaaaatccttcycaattcagttttctgtacattttgatcaaaaggtctcagtaaaaaattttaaattgaataaataaaattaaaaatgtaattgagtcatatccaactatta

SEQ ID NO: 56498 - DNA, 201 bp, Homo sapiens
agtaagtagtatgttagtgtattatgaaatttggggtcagaagaattaacctaggtattttattaaaaataaaactttctgggactctgaacttaagactstaatgttgtagattcaggattggaaccagcgactgtaattttaatacgtgcaccaggttgattcctatggccaaagatatttgagaaacagtgccatatt

SEQ ID NO: 56499 - DNA, 201 bp, Homo sapiens
agataatatattatatttttctgacatttttgataaatataccaaatacatcctatgataaattgtgatatctcctaaatatttcctgtgatttaatttcygagttcactcatatattaattgcttagtagcaattgatgttacataactctctgagtccagtataaaataacaagacacaaaataaatattagttaaagg

SEQ ID NO: 56500 - DNA, 201 bp, Homo sapiens
ctgggacttttacaaatggaattatactgggtgcactcattttaacttaactcgttttaactcgttttttttcccttgttattaatagtatgtcgaattaygttgattggtttttcaaatatttaaaaacaacttttcaatctttagaggtctatagactgtactggtgatgtagtatgttgtcttatttatattacatac

SEQ ID NO: 56501 - DNA, 201 bp, Homo sapiens
ggtcctatacttttacttgagacagttaaaacgtgacatacttgttgagctcaactgccataataatttagatgcaaaaatattggtatttaagcacactstgatgtttttaaagaacaatcatgacattcatcatgagtgaacattcattccataagtatttatctattagccaccgcttggctggcagtctgtagagca

SEQ ID NO: 56502 - DNA, 201 bp, Homo sapiens
gctttttatgtttaatgctattttacctccatccccttcattaggctaactcctatttgcttttaacaaatcatcaagatttttccaagaaccgtttcatraaaatgttcattctcattgagatacctgtatgttgcaagttaatggagacaagaatgaactataagaaatttggaatctagatgattttatggaacaaaa

SEQ ID NO: 56503 - DNA, 201 bp, Homo sapiens
agtattaatttttttcatttgtatattccttcaataacaatttattaaatgcttactgtgtgctaggtaggtcctatacttttacttgagacagttaaaamgtgacatacttgttgagctcaactgccataataatttagatgcaaaaatattggtatttaagcacactctgatgtttttaaagaacaatcatgacattca

SEQ ID NO: 56504 - DNA, 201 bp, Homo sapiens
ttaaacagttatgtgaatctctgatcatttttgtctcggtgatcgctgttcaattatggttaattctgtattccttactgttcaaattctggtgttcagayagttaagaaaacatcatgttttggataaatgtttacacattaatgttaagttgagaaattacagcaattgtataattaaagaaatttaaacctagaaatg

SEQ ID NO: 56505 - DNA, 201 bp, Homo sapiens
cttccttactaatttatactctctaaagaatatctgtggacattattttctaagttctttttttttaatttttttttccctttaagtgttcatgtatttgytctctgatagaaacataaattgggggagtacagagatatgtccttcaagttttttttttcacctagtatggaagtttatacattatccccagcaatttca

SEQ ID NO: 56506 - DNA, 201 bp, Homo sapiens
aattgtgtacagaaaaccggctgcatatgtttgatgcagttagtattgactatacatttacaaaatgtattttggtatctgccttagtctgttttgtgttrctataaatgaatacccgaggctggataatttataaggaaaatagggttacttggcttacagttcagcaggttgtacaaagaagcctggggctggcatctg

SEQ ID NO: 56507 - DNA, 201 bp, Homo sapiens
gcctcccgagtagctgggattgcaggcacccaccaccaacccggataatttttgtatttttcgtagaaacggggtttcactatattggccaggctggtctygggcttctgacctcaggtgatccacccgcttcggcctcccaaagtgttgggattacaggcgtgagccaaggtgcctggctgaaggtcaactttttaaaaa

SEQ ID NO: 56508 - DNA, 201 bp, Homo sapiens
gttgaaactgttccagtagttggtgttgaaactgaaaacacacttttcattccattcagttgtcctagaaaacatttttcatcttgcttagtctcctatgkgagagcacttgtctctgaggatatcatcaggttagacaaaaggcaccaaggcacacaccttttcctcttctctttgcatcatctccttttggctctaatg

SEQ ID NO: 56509 - DNA, 201 bp, Homo sapiens
ttacacatcaatggaaagtggatagactattgaaaaaattctgctgggagaaatgattttctatatggaaaaagattaaatatacctcatctagctcattkaacagaattcagttctaattgatttataatcataaatgtcaaaggtaaactttgaaatattttaccaaaaattatttgagagtaattttttgacctccag

SEQ ID NO: 56510 - DNA, 201 bp, Homo sapiens
catagtggcgggcgcctgtagtcccagctacttgggaggctgaggcaggagaatggtgtgaacctgggaggcagagcttgcagtgagccgagatcgcgcckctgggctccagcctaggcgacagagctagactccgtctcaaaaaaaaaaaaaaaaaaaaaaaaaaaaatggagccatttagaaaaaataggtatttattt

SEQ ID NO: 56511 - DNA, 201 bp, Homo sapiens
actaaggtctttatacattgttaactcatttagttttattgattcctttaagaaagtaatgttaacaaactaattttcctggtaagggaactgaggctcaragagtttaagtaatttgcctaagttcgtatagttggaaagtgatagagatggggtttgaactcaggaagtcaggcttgcactgcgctcttttgcaaatca

SEQ ID NO: 56512 - DNA, 201 bp, Homo sapiens
actagcaggtagtgtttactatgaatgtatccttaaagtaaaacatgaaaaaataaaaataaaaaaatggagaatgttcaataaatatttttaattgattwtcaaacagaagttatatttacatatatcacagtagtaaaatattatcttgataatatgttgaatacagttaatacctagtagtattaatttttttcattt

SEQ ID NO: 56513 - DNA, 201 bp, Homo sapiens
ttttaaacctttaatctgacatagtatggtgccagtcaataatttgcttcagggattggcaaattgtcctccaaaattttgtagctaattaaaagagatgwgtaccaggcactgtgctaaattttaggagtatagtggggaaaaataggttaaagactttagcagttcacaatctaaatgggagattcaaacatgagaaaa

SEQ ID NO: 56514 - DNA, 201 bp, Homo sapiens
atatcctagtatatctggaagttttaacatggaagacatttgatgcataacggcttttgatttcctttctattatcctaagggtttaaattaccacttgaktttttaaaattaatacacctttcacactattaccctcatttccatgagtattttttttccagggttgctatgacaaatctccacaaacgtattaacttaa

SEQ ID NO: 56515 - DNA, 201 bp, Homo sapiens
tatacattccaaaagtcttctcttgttttcatctgttgtttcaaagtttatgagctgtgacaagatcatgagcaatattttaactacagaaaagtaatatmttctcgacactaattttaatgcagcttccacaagcaagatgacaatctgaaatttaatcttatgaatgctccaagggagaaattaaaacagttaagcttt

SEQ ID NO: 56516 - DNA, 201 bp, Homo sapiens
ttccaaaagtcttctcttgttttcatctgttgtttcaaagtttatgagctgtgacaagatcatgagcaatattttaactacagaaaagtaatatattctckacactaattttaatgcagcttccacaagcaagatgacaatctgaaatttaatcttatgaatgctccaagggagaaattaaaacagttaagcttttaaata

SEQ ID NO: 56517 - DNA, 201 bp, Homo sapiens
ggaagttctgcctagggcaatcaggcaggagaaggaaataaagggtattcaattaggaaaagaggaagtcaaattgtccctgtttgcagatgacatgattrtatatccagaaaaccccatcgtctcagcccaaaatctccttaagctgataagcaacctcagcaaagtctcaggatacaaaatcaatgtgcaaaaatcaca

SEQ ID NO: 56518 - DNA, 201 bp, Homo sapiens
gggatgagactcaaacttatatggcttatccttttagcaaatgtatttcataatgatgttctgtaagatttaaaaattaggcaaagctgccagggtgtggwggctcgcacatgtaatcccaacactttgggagaccaaggcgggtggatcacctcaggtcgggagttcgagaccagcctgatcaacatggagaaaacccgt

SEQ ID NO: 56519 - DNA, 201 bp, Homo sapiens
caaacaagacaacagtaacctctgcagacttaaatgtccctgtctgaaagcttttaagagagcagtggttctcccagcacgcagctggagatctgagaacrggcagactgcctcctcaagtgggtccctgacccctgacccccgagcagcctaactgggaggcaccccccagcaggggcacactgacacctcacacggcag

SEQ ID NO: 56520 - DNA, 201 bp, Homo sapiens
tgctaaggttttaatctatatttggtaaatgtagaaaatattttgaattcatcttattattcacaccttatttttccttaatcctgctttcctaactgaaraaaaaaaaacaaaaacatcaatttattgcagcccagcccacatcctattcaaaactagcaggtagtgtttactatgaatgtatccttaaagtaaaacatg

SEQ ID NO: 56521 - DNA, 201 bp, Homo sapiens
gagaatggaaccaagttggaaaacactctgcaggatattatccaggagaacttccccaatctagcaaggcaggccaatgttcagattcaggaaatacagasaatgccacaaagacactccacgagaagaacaactccaagacacataattgtcagattcaccaaagttgaaatgaaggaaaaaatgttaagggcagccaga

SEQ ID NO: 56522 - DNA, 201 bp, Homo sapiens
agcagctaaatagaaattaatgcttattaaatttactcaatattttatcactgaatccagacctctaaaaacagctttatccaaaatagcacatttggttrtagctataagaaggaagtagcagtgatcattgacactcattatatttttgtcaggaccacagagaaactctcaagtctcagttttactgagactttacaa

SEQ ID NO: 56523 - DNA, 201 bp, Homo sapiens
ttgatttataaaggccatgtagaaatttcaaaaataccacagtgatctaggaataaagtagaaattggaaattggaaatttctaactctttggccttttcytctcaggtggaactttcccagaagacttttcaatactatttacagtaaaaccaaaaaaaggaattcagtctttccttttatctatatataatgagcatgg

SEQ ID NO: 56524 - DNA, 201 bp, Homo sapiens
tcattgccattatatctcatatatgaatagcaaatgatgttcttgttaataactcaatgtctggatcaaaacaagaataaatctataattaaacacatgtmtttttccctgatctccactgtgagattccttgagtaatattttgtcccctgtagtcatagcacatttctatctggctctttccaacaccttttttctttc

SEQ ID NO: 56525 - DNA, 201 bp, Homo sapiens
aataggtgacaagctaatattaaaattatgatggagttgggattttcttatcaagtgaaattatcttcctatcttataaaaaattagatgttaaatctatrtgattccttttgatattctttcttaaaaaaggatgaaaacagaaaatgaagtgacaatcttttataaaggaatttacaaaacaattagcttttcaaaata

SEQ ID NO: 56526 - DNA, 201 bp, Homo sapiens
catgcctgtttaatgcttgccagatataaattagcactttttaataggacacagttttaaataaagagaatttgattcactttgttctaactataaataaktttaccatctaaatttaccagctctaactataaatatctagaggaagtttaggtatctgaaatagggctgagattttccaggaaatattgacatgtggaa

SEQ ID NO: 56527 - DNA, 201 bp, Homo sapiens
ttttttaagacggagtctggctccgttgcccaggctctggagtgcagtggcgcgatatcggctcactgcaagctccacctcccggattcacgctattctcstgcctcagcctcccgagtagctgggactatcacctaccacctgccaccacacccggctaattttttgtgtttttagtagagacgccaccacgcccagcta

SEQ ID NO: 56528 - DNA, 201 bp, Homo sapiens
tgcccaggctctggagtgcagtggcgcgatatcggctcactgcaagctccacctcccggattcacgctattctcctgcctcagcctcccgagtagctgggwctatcacctaccacctgccaccacacccggctaattttttgtgtttttagtagagacgccaccacgcccagctaatttattgtatttggtagagacaggg

SEQ ID NO: 56529 - DNA, 201 bp, Homo sapiens
caacagaaagaatacgtttgtaaattgggtcattacaatgcctctttaaagtgggcatgtatggctacggactagacaaagacaaaaaatacaaactttasgccaaaattagcacttaaataaatgttttaagagtggtggttatgtgtttgatatttactggtatcataatcctgttgcctaaaccaaatttaatttcac

SEQ ID NO: 56530 - DNA, 201 bp, Homo sapiens
ttttgactttttgatagttgccattcatactggagtggggtaatagctcattgcagttttgatttacatattcctaatgattaacgatgttgagcattttyttcatatacccgttagccatttgtatgtcttcttcaagatatgtttattcagacatcttgtccatttttaattggattacttgtttttttctattgagtt

SEQ ID NO: 56531 - DNA, 201 bp, Homo sapiens
tctatatggctgtattaatttacattttcaccaatagtatgaaacagttcctttttctctacatctgcaccaacacttatcttttgactttttgatagttrccattcatactggagtggggtaatagctcattgcagttttgatttacatattcctaatgattaacgatgttgagcatttttttcatatacccgttagcca

SEQ ID NO: 56532 - DNA, 201 bp, Homo sapiens
gcctgcctgcctctgtaggctccacctctggggggcagagcactgacaaacaagacaacagtaacctctgcagacttaaatgtccctgtctgaaagctttkaagagagcagtggttctcccagcacgcagctggagatctgagaacaggcagactgcctcctcaagtgggtccctgacccctgacccccgagcagcctaac

SEQ ID NO: 56533 - DNA, 201 bp, Homo sapiens; identical to SEQ ID NO: 10501

SEQ ID NO: 56534 - DNA, 201 bp, Homo sapiens
agtacagcacggctggggaagcctcgggaaacttacaatcatggtggaaggcaaaggggaagcaaggcaccttcttcacaagtaagcaggaagaagtgcckagcaaagggggaagagccccttataaaccatcagatcgcataagaactcactcattgtcaggagaacagcatgggggaaactgacctcatgattccattg

SEQ ID NO: 56535 - DNA, 201 bp, Homo sapiens
cacggctggggaagcctcgggaaacttacaatcatggtggaaggcaaaggggaagcaaggcaccttcttcacaagtaagcaggaagaagtgcctagcaaarggggaagagccccttataaaccatcagatcgcataagaactcactcattgtcaggagaacagcatgggggaaactgacctcatgattccattgtcttcac

SEQ ID NO: 56536 - DNA, 201 bp, Homo sapiens
ataagtatatttagcatctattctctttatttataatccatttagtctgaaacataggtcgttattatgacactccatagaagtggatttactgtactcakgtaggtctaggtgtatgtcattgacttatatttagagaaactttatttgtaaaacaaataaactaaaaaaatctgtttgaagatatgggatattgcttta

SEQ ID NO: 56537 - DNA, 201 bp, Homo sapiens
atatacattcttctcagcaccacaccacacctattccaaaattgaccacatatttggaagtaaagcactcctcagcaaatgtaaaagaacagaaattatamcaaactgtctctcagaccacagtgcaatcaaactagaacccaggattaagaaactcactcaaaaccgctcaactacatggaaactgaacaacctgctcct

SEQ ID NO: 56538 - DNA, 201 bp, Homo sapiens
ccatcagattaacagctgatctctcggcagaaactctacaagccagaagagagtgggggccaatattcaacattcttaaagaaaagaattttcagcccagratttcatttccagcgaatcaaagcttcataagtgaaggagaaataaaatactttacagacaagcaaatgctgagagattttgtcaccaccaggcctaccc

SEQ ID NO: 56539 - DNA, 201 bp, Homo sapiens
tattatccaggagaacttccccaatctagcaaggcagggccaacattcaaatttaggaaatacagagaaccccacaaagatagtccttgagaagagcaacwccaagaaacataattgtcagattcaccaaagttgaaatgaaggaaaaaatgttaagggcagccagagagaaaggtcgggttacccacaaagggaagccca

SEQ ID NO: 56540 - DNA, 201 bp, Homo sapiens
ggaaccaagttggaaaacactctgcaggatattatccaggagaacttccccaatctagcaaggcagggccaacattcaaatttaggaaatacagagaaccycacaaagatagtccttgagaagagcaactccaagaaacataattgtcagattcaccaaagttgaaatgaaggaaaaaatgttaagggcagccagagagaa

SEQ ID NO: 56541 - DNA, 201 bp, Homo sapiens
atgaagtgagaagagaagtttagagaaaaaagaataaaaagaaatgaacaaagcctccaagaaatatgggactatgtgaaaagaccaaatctacctctgaytggtgtacctgaaagtgacggggagaatggaaccaagttggaaaacactctgcaggatattatccaggagaacttccccaatctagcaaggcagggccaa

SEQ ID NO: 56542 - DNA, 201 bp, Homo sapiens
gaagttaaaaactttgaaaaaaaattagacgaatggataactagaataaccaatgcagagaagtccttaaaggacctgatggaactgaaaaccaaggcacragaactacgtgatgaatgcagaatcctcagtagccgatgcgatcaactggaagaaagggtatcagtgatggaagatgaaatgaatgaaatgaagtgagaa

SEQ ID NO: 56543 - DNA, 201 bp, Homo sapiens
acaggaggaagttcgaaccaatggcaaagaagttaaaaactttgaaaaaaaattagacgaatggataactagaataaccaatgcagagaagtccttaaagsacctgatggaactgaaaaccaaggcacgagaactacgtgatgaatgcagaatcctcagtagccgatgcgatcaactggaagaaagggtatcagtgatgga

SEQ ID NO: 56544 - DNA, 201 bp, Homo sapiens
gctggatggagaatgactttgacgagttgagagaagaaggcttcagacgatcaaactactccgagccacaggaggaagttcgaaccaatggcaaagaagtwaaaaactttgaaaaaaaattagacgaatggataactagaataaccaatgcagagaagtccttaaaggacctgatggaactgaaaaccaaggcacgagaac

SEQ ID NO: 56545 - DNA, 201 bp, Homo sapiens
ctcaccagcaatggaaaaaagctggatggagaatgactttgacgagttgagagaagaaggcttcagacgatcaaactactccgagccacaggaggaagttygaaccaatggcaaagaagttaaaaactttgaaaaaaaattagacgaatggataactagaataaccaatgcagagaagtccttaaaggacctgatggaact

SEQ ID NO: 56546 - DNA, 201 bp, Homo sapiens
acttttgttactactaaaactacttttagtatttctttactaattagtatttttatcaggttagataatgtgcaattatatggtaaaatgcaattctttcwtatatcagacaccaaataccttgtggtcaccaaagtaatgtaatgaaaataacaaaaaatttgataattgccagtcttaattcaacacaatcacatttct

SEQ ID NO: 56547 - DNA, 201 bp, Homo sapiens
tgacacctcacagggccaggtactcctctgagacaaaacttccagaggaacaatcaggccgcagcatttgtggttcaccaatatccactgttctgcagccwctgctgctgatacccaggcaaacagtgtctggagtggacctctagcaaactccaacagacctgcagctgacggacctgtctgttagaaggaaaactaaca

SEQ ID NO: 56548 - DNA, 201 bp, Homo sapiens
aatattttataaattataattgagatacatatgaatgtttataaatcatatataggaaactttaaattccagatgcacatatgcctatgtacacacacacrcacacacacacacacacacacacagacacagacacacacacacacacagacaccccttctgtgttgcttaaccataatttgattccagatttgagatatt

SEQ ID NO: 56549 - DNA, 201 bp, Homo sapiens
ttcaaggaatgtggaaatcatctgagagtcagtggggttctttgaaggaatttaaacatcagagtgacatgagacatggatttttggaagcttaatcaagytggtggaatgaagattgatgggaaaaagtatggaacccagttaagtggctattttagtagcacattgggctctgatattctattctcccgtttaataaac

SEQ ID NO: 56550 - DNA, 201 bp, Homo sapiens
taggattataggaatgattcaccgcgctgggtctttagacagtcttaattttatatttctagaatgaacatttcacagtgattataaaaattatttatatkttcaaatttgggtttcatttttttctaccatgtttattatatgcatattgtttcaattaactttaaatagtatatgtagttagttaaatatgaaggccta

SEQ ID NO: 56551 - DNA, 201 bp, Homo sapiens; identical to SEQ ID NO: 10503

SEQ ID NO: 56552 - DNA, 201 bp, Homo sapiens
atgccaggactaatagccacctgcaggagggttctgaataggatcgcattatagtccctttgcaaaaaagagcagcttgtgtaaaactcctcatcgtgttytaaaattccttggggtgtatgggaatatatacagattcttataactcactatgtactatagtgagctaataatttgctgttttaaaagcatattactgtg

SEQ ID NO: 56553 - DNA, 201 bp, Homo sapiens
ccatgtctccttgggcaagcatggctggtttccttgaactctttactctctttgtatctgtgctaccatatctgctgtttctttccttctcttcttcactraggaactcctatttatccctagggactcagcttaaaagggctaggtagtagatattttagttgttgtgagcacacagtctctgttgcagctacgcaactc

SEQ ID NO: 56554 - DNA, 201 bp, Homo sapiens
cataggtaacaaataggtgatatttactttttacatatacaaactgtttaaatttgagctgaatgtagaggactttaactatctttcatattacttatgarctatgtgttttaaaccatgctttaaactagtaaaaggctgtggaactatcctgagccaaagaatcatttcaccatcttttctatacttcttgagttttat

SEQ ID NO: 56555 - DNA, 201 bp, Homo sapiens
gtgtatggtctcagaagatgcaagtatgtatagaggaaaataagtaaaattttaaattgggaaccaaaagttctgggttattattctagtttttctagttrctttttctgagcctcatttgaagtctgtaaaataaagaaaattccctaaaaaaatttaaaggtatttttcagctatagcttttattctatctaatatacc

SEQ ID NO: 56556 - DNA, 201 bp, Homo sapiens
gaatcatgtattttatgtagagttgacttttgaccaacataagagtaagaggagccaactccctgtgcattgaaaatccatgtataacttttggctccccyaagacttcattactaatgcctaccattcatgggaagccttattgacaaaataaacagttgattaatacatattttgtatgttatatatattttatgctgt

SEQ ID NO: 56557 - DNA, 201 bp, Homo sapiens
actgttaggatatgagaggtaatgggagggaggaacttaatatttttggcctttagcacataggtaacaaataggtgatatttactttttacatatacaarctgtttaaatttgagctgaatgtagaggactttaactatctttcatattacttatgaactatgtgttttaaaccatgctttaaactagtaaaaggctgtg

SEQ ID NO: 56558 - DNA, 201 bp, Homo sapiens
gaaagcataaaatgaatggaaactatctgcaccttcctctcaatttttctgtaaacctaaaactggtctaaaaaaaaaagttgattcaagtcatccttctmccctaaccttccaatggtttttaaatctcatttagaataaaatccagtctccctgaacattccacaggacctatacagcttgttatcagtgtatcctcac

SEQ ID NO: 56559 - DNA, 201 bp, Homo sapiens
tccttaagtagaggaattaaacattaaggttttttttagaattctttttgtgacagtgaaggagctagtttagaattggaagaatctgacttaaaaaaaaraaaacatgaattgttgaatattggttcaaataaaaggtacttagagtagagataaggccatagcagaataaatggagaaaagggtcttattttcaatatg

SEQ ID NO: 56560 - DNA, 201 bp, Homo sapiens
tctaaaatcagaaattaatgtacaattttaacagaaataaactgtggacaacaaacattaggtaaaaatgtggtagacttgatattcaaaaacaatccaaktccaaattcagtgtgacacacaaattcaatgcacattagtgtgaaaatctcaggggataccacacacccaggtaaattagagttttgtaacaaaaataat

SEQ ID NO: 56561 - DNA, 201 bp, Homo sapiens
aattctattatctcacagttaagtctgaatcctccttgctctgtcttctctgtggaacttctttaattaagaaagaaaacaaaataagctatcactatttwaaaaaattaacattatatgttttctatctggattttaaaatataaaggtgtgttcactaattatttctctaaatactatctttgtaaatgtgtagaaggt

SEQ ID NO: 56562 - DNA, 201 bp, Homo sapiens
ttcagagtttatagttttcaacagcaagagagttgggctgtagcgggctcacacagtcataggagtattggctttcccaagatacgaacgtttgaaaagtrttcatttcttatgaaaaatgtataccagaggtgtccaatcgtttggctttcctgggccacattggaagagaagaattgtcttggggcacacataaaatac

SEQ ID NO: 56563 - DNA, 201 bp, Homo sapiens
gtttattgcattttgttcagagtttatagttttcaacagcaagagagttgggctgtagcgggctcacacagtcataggagtattggctttcccaagatacraacgtttgaaaagtgttcatttcttatgaaaaatgtataccagaggtgtccaatcgtttggctttcctgggccacattggaagagaagaattgtcttggg

SEQ ID NO: 56564 - DNA, 201 bp, Homo sapiens
tataatctgcataatttacagaattgtcagctagttgtttattgcattttgttcagagtttatagttttcaacagcaagagagttgggctgtagcgggctyacacagtcataggagtattggctttcccaagatacgaacgtttgaaaagtgttcatttcttatgaaaaatgtataccagaggtgtccaatcgtttggctt

SEQ ID NO: 56565 - DNA, 201 bp, Homo sapiens
ttccacccttgggacaaaaccttgataaaatatgaaacaaaaacaaaaacaaaacaaaataaaacacaagtaagttatacctgtaggctaatttctccaamttttgactctcttctataatctgcataatttacagaattgtcagctagttgtttattgcattttgttcagagtttatagttttcaacagcaagagagttg

SEQ ID NO: 56566 - DNA, 201 bp, Homo sapiens
tactggattccacccttgggacaaaaccttgataaaatatgaaacaaaaacaaaaacaaaacaaaataaaacacaagtaagttatacctgtaggctaattyctccaaattttgactctcttctataatctgcataatttacagaattgtcagctagttgtttattgcattttgttcagagtttatagttttcaacagcaag

SEQ ID NO: 56567 - DNA, 201 bp, Homo sapiens
taactggtgtgagatggtatctcattgtggttttgatttgcatttctctgatggccagtgatgatgagcattttttcatgtgttttttggctgcataaatrtcttcttttgagaactgtctgttcatatccttcacccactttttgatggggttgtttgtttttttcttgtaaatttgtttgagttcattgtagattctgg

SEQ ID NO: 56568 - DNA, 201 bp, Homo sapiens
ggtatctcattgtggttttgatttgcatttctctgatggccagtgatgatgagcattttttcatgtgttttttggctgcataaatatcttcttttgagaastgtctgttcatatccttcacccactttttgatggggttgtttgtttttttcttgtaaatttgtttgagttcattgtagattctggatattagccctttgt

SEQ ID NO: 56569 - DNA, 201 bp, Homo sapiens
aaaaatctagagctgaccaaaataatttaagcattataacctgaaaatgcacatattaaatggaaatttgaattcggctcatattgccaaagggaagttcwcaataaaaaattaaaatggtaactgttgttattaactggttataatgacagatgaagttttaacttattatgcacacacacatcatatatataatatagt

SEQ ID NO: 56570 - DNA, 201 bp, Homo sapiens
aagcattataacctgaaaatgcacatattaaatggaaatttgaattcggctcatattgccaaagggaagttcacaataaaaaattaaaatggtaactgttrttattaactggttataatgacagatgaagttttaacttattatgcacacacacatcatatatataatatagtatatatatatgtgtgtgtaccttgtata

SEQ ID NO: 56571 - DNA, 201 bp, Homo sapiens
ttaaaatggtaactgttgttattaactggttataatgacagatgaagttttaacttattatgcacacacacatcatatatataatatagtatatatatatrtgtgtgtaccttgtatatgcatgtactatgtgtgtgtatatatatatatgcacacacatataaagtattattatatatagtattaattcaaatttcaaat

SEQ ID NO: 56572 - DNA, 201 bp, Homo sapiens
ccttgttgcagtgtcataccatggtggaaggacaaggagcagacttgaaagagcaagacatcaaattcacagcctcagttttttttttttttttttagacwgagttttgcttttatttcccaggctggagcacaatcgtgcaatctcggctcactgcaagttctgcctcccgggttcaagcgattctcctgcctcagcctc

SEQ ID NO: 56573 - DNA, 201 bp, Homo sapiens
aaagtatatctgcttttgtcgtcatttttcttatttttttgtcatctggaaaacatataaggaataaataaaattgggaaaaatgagaaaaagaacagaayaaagtcatttaataaaatttttactatgacagatatttgttcacagaaggaagaaattatttagacaagaagccctttattttaatcacaacttagttgc

SEQ ID NO: 56574 - DNA, 201 bp, Homo sapiens
aaagtagttaggaaattgctaaattaagtgaaatatcttcactttttctctatagggggggcctggttcatctggggccaaaggtgagagtggtgatccargtcctcaggtaaaaaataaaaatttgactttttattcttgactggcttctttgatacagcataattccttcgagaatgcatcaatagttaattttttttt

SEQ ID NO: 56575 - DNA, 201 bp, Homo sapiens
tggggccaaaggtgagagtggtgatccaggtcctcaggtaaaaaataaaaatttgactttttattcttgactggcttctttgatacagcataattccttcsagaatgcatcaatagttaattttttttttgttcctgagtagtattccattgatgtatgagggtttattttgaaattaaaaaattcagagaaaactgatta

SEQ ID NO: 56576 - DNA, 201 bp, Homo sapiens
cctatggtgagtaagatcttttcagtcatttaaaaagtgagaatttctaaaacaaaattgtttattagctagaatttttgacattttagtttataaatagktttgtattttttctaatagtccaagaagtatattattttgtcttagaggaaagtaatcctaactgataggtatatggaaaataaaccacttgatcagaag

SEQ ID NO: 56577 - DNA, 201 bp, Homo sapiens
aggtgatttaaagtataaaggagaaggatgtgggtaggctataaataaatactatagccttttatatcaagaactggagcatccacagattttgatatagkaagttgggttggggtcctggaaccaatcacccctagataccaagagaagactgtatagtgtctcactgaattgacaaaggagcacagtggtgagtcaggt

SEQ ID NO: 56578 - DNA, 201 bp, Homo sapiens
atgcaaatgtttttctctggaattagtatccatcaaggatttttagaggggctaggcagtgtttaaaagaaaattgcctgactggggtggggatgttgttractgctgaaacttgctaggagagttgtaaagtgacagaggcaaataaaattataaatgactagatatatatgaggacaaagccatacaggaaaaaaaaat

SEQ ID NO: 56579 - DNA, 201 bp, Homo sapiens
ttaacaattgctcattgtttttagggtgtatggtctcagaagatgcaagtatgtatagaggaaaataagtaaaattttaaattgggaaccaaaagttctgkgttattattctagtttttctagttactttttctgagcctcatttgaagtctgtaaaataaagaaaattccctaaaaaaatttaaaggtatttttcagcta

SEQ ID NO: 56580 - DNA, 201 bp, Homo sapiens
gccgcagcttaatccagaacaaggccttaactctcttcaattctgtgaaagctcagagaagtgaggaagcttcagaagaaaagatcaaatctagcagaagycagttcatgatgtttaagaaaataagttgtcttcacaatataaagtgcaaagtgaaacagcaagtgctgatatagaagctgtagacaattatccagaaga

SEQ ID NO: 56581 - DNA, 201 bp, Homo sapiens
gtgaacatatgaatggtaaggaagcaaaacagtcttattgctgatatggagaaagtttgagtagtctaatagaagatcaaaccagccacaacattctcttmtgccgcagcttaatccagaacaaggccttaactctcttcaattctgtgaaagctcagagaagtgaggaagcttcagaagaaaagatcaaatctagcagaa

SEQ ID NO: 56582 - DNA, 201 bp, Homo sapiens
tgatttttgtttcttaagattaatatatgaggtcatgatctctattttgattatttgagatgaccaattgtttattgtcagcatttttttaagtcttaaarttctctttcagtggaaattattcaaatagaattttaaagtaatcatgtcattgattgattaattgtagctctggatagcattggtaggctgtcaactcct

SEQ ID NO: 56583 - DNA, 201 bp, Homo sapiens
gctatgtgttggtaaggtgaaacgggaaggactcattctatgattaggtctcagattttggtgagcctgagccctggactgtgaattttatcagtgcttcmcagtccctcaccccatgaccttaggtggaacaggatggctgaaggtggctggggttattttccttcttccacatggaagaccagagggagctgtagtagg

SEQ ID NO: 56584 - DNA, 201 bp, Homo sapiens
ttagcagggtcagtgcatacttcgatatcaacacataactaggttgtcccagttgattcctaccattggatcctctgacagtcagtgaactggggccatgytgttttttctggaatagccaaccctactgtcaaatcacttggggttctcaacagtaattagtacatttaagtcacactttatatggagctatggtcatgt

SEQ ID NO: 56585 - DNA, 201 bp, Homo sapiens
tagtttgaaaaattcctagaatgataattccaacctttctgccatatctgactctggtttgatgcttattcagtctctttaaactgtagtttcttttcctygcagtatgccttttaattttgtgttgaaaggtgaacatgatgcactgggtaaaagaaactatgttttgtttttttttaataagcccttagctatgtgttg

SEQ ID NO: 56586 - DNA, 201 bp, Homo sapiens
gagcattccaggaagtgatgtgaaggcctttatgaagggaggatgacaccataagggacttgaagaaaggacttgaaaaatggcagtatgtctggagaagmagcagtggggataaaacgtgagatggtgctggggaagaaggcgggggacacataacacaagatcataaagatagatttttctgcatagcatggaaacatg

SEQ ID NO: 56587 - DNA, 201 bp, Homo sapiens
ctctttgcttcatgcagatgctaaattgatcaaactgaattggccgctattattttcttaattgctcctggaattgagcaagcttttcaacatgttgtgaytaagggtattcacaacatgtttcttctgtgagaagaatcctctaaagtgaaaattgtatcatcgaaggatacaattagaattttactccctctgatgaat

SEQ ID NO: 56588 - DNA, 201 bp, Homo sapiens
gcctcccgggttcacaccattctcctgcctcagcctcccaaatagctgggactacaggcacccaccaccacgcctggctaattttttttgtgtttttagtraagacaggttttcaccgtgttagccacgatggtcttgatctcctgacctcgtgatccacccgcctcagcccccaaagtgctgggattacaggcatgagcc

SEQ ID NO: 56589 - DNA, 201 bp, Homo sapiens
ggatggtcttggtctcctgacctcgtgatcctcccgcctcggcctcccaaagtgctgggattataggcgtgagccaccgtgcccggccaattgctgttgtwgttaataaacaatctttattttagagtaggtgtaggttcacagcaaagttgagcagaaaggacggggagttcccatatactatttgccccaccccaacat

SEQ ID NO: 56590 - DNA, 201 bp, Homo sapiens
aaactcttcctgagagtttcaatgtccaccctatctcagggttggcatctgtttattgcctttgttgctattttttttgtttgtttgtttgtttgtttgcyttctttttttttttttttttttttttttgagacggagtctcgctcttctgtcgcccaggctggagtgtagtggcgcgatctgggctcattgcaagctccg

SEQ ID NO: 56591 - DNA, 201 bp, Homo sapiens
ttttgttttacttattggatttttgctatttttttatttaagaaatactttttataataattgtaaaatttgtaccaaaatgttatgatatatttcttgcyaatattgtatcattgtatgtatgtaatgcagaaacatttcaatctccttgtcatactgatctttgtggtacagttgtcatacttattagacctgtatata

SEQ ID NO: 56592 - DNA, 201 bp, Homo sapiens
aatgcccttaaaaagaaagtgcattgtgaaattgttcgatgcagacttttataaatgtcacttagatctttccttatatttcttatttttttgtctacttrttctatcagttgttgaggagtgttaaaattttctaccataattgtgtaattgggtatcttccttttcattttgccattttttgcggcatgtattgcattc

SEQ ID NO: 56593 - DNA, 201 bp, Homo sapiens
atatatatatatatttttcttatggtagagatttttgagtgtcattatccagtaatagttaagtgtggagtgattaatcaaaatggcaaatcatacatatrgcactcgtatgtgtggtgagtattagttaagtcctgctatatggtattttaaaatttattcaaatgccttttatcataaatatattaattatctcagaga

SEQ ID NO: 56594 - DNA, 201 bp, Homo sapiens
aaatagcacataagggttgggcatggtggctcacgcctgtaatcccagctactcgggaggctgaggtgggagaatagcttgaacctgggaggcggaggttkcagtaagccaagatcacaccattgcactccagcctgggtgactgagcgagactctgtttcaaaaataaaaaagataaatagcacatatggaagctaatca

SEQ ID NO: 56595 - DNA, 201 bp, Homo sapiens
gtaattgttttggattttagttttccttgactcctttaatccaaaaagagaaatgtgttatcaaaggaaggattattttcatttaaaaactaaaaaaaaawttgtactgttattgttggcccatgccttcagactggagttcagagtacagtcttctcattacaaagctacatactctttaacctgtagacaatctttttt

SEQ ID NO: 56596 - DNA, 201 bp, Homo sapiens
gccaattgagtgttttaaagagaagaatgaagatgtctaaattctaccctctgatacaaagtcaaaattaaaatgatttagtcacttttaaaactaaaatrtatttgattttttgaagtcagaattaacatctgtcttagctttaaggttttattttgttttgttttgtattcttttaagactctatttgttttaatgcag

SEQ ID NO: 56597 - DNA, 201 bp, Homo sapiens
ttcactgtttatacaatttttactatggagagcaaagccccagtaatggggagataactatatacttgaaagtgaatttgacaatttcattgtggtctttytgtctgagatttaacagggcaggatgattgtttattcttatacaaaagagaatgtaactaaattcatataaatttgactctgaggattagtaattttctc

SEQ ID NO: 56598 - DNA, 201 bp, Homo sapiens
gaagccttaaaaataaagcaacattaatcattactattttcaactccgtattttcaaaactaaactaggtctgtgactagttataggattctctaattcayacctactctgtttttgttttggggttttttttttgttattatttagggacctcctggcttacctggtctcaaaggtgaccctggctccaagggtgaaaag

SEQ ID NO: 56599 - DNA, 201 bp, Homo sapiens
acttcttgagttttatagtaaacacacagttaatgtgagattgttattagctaaaagaagtgtaataagaatattgatatagggaggagccaagatggccraatgggaacagctccagtctacagctcccagcgtgagcgatgcagaagacaggtgatttctgcatttccaactgaggtaccgggttcatctcactggggt

SEQ ID NO: 56600 - DNA, 201 bp, Homo sapiens
agagaatcatatactattttgtcacattaatgaaaccaacttattttatgccgtaaagatacatttttacttgactctaggaataatgacaaaaattcagrtgcttcacattttttcctagtgcattataaagatactaataaaaacaatagtaatagctaccactttattaatactaaaatgttctaggcttcacataac

SEQ ID NO: 56601 - DNA, 201 bp, Homo sapiens
cacacatatttgaagcaaactaatgtgtacatattttttaaagtttaatgttttataatataaattatcatcaaatataatacacagttgattagatagcrcaatagctttaaagtgctgttctaatcctcagagactttacaatctagttgtggagttagggcatataaatgatgactaattaataaacaagagactaac

SEQ ID NO: 56602 - DNA, 201 bp, Homo sapiens
aagtgcatggtttgacctttgacttggggttttctacattggcatgcttctgaggtttgcatctcttctcgcctgattcttcccttggggtgggctgcccmcaagtgcagtgggctgccagcacttgggaggggccacacacacattttgtttcctggagctgtgcgcatgctcacttgaggcgtcagtttagtgttccca

SEQ ID NO: 56603 - DNA, 201 bp, Homo sapiens
ggttttatagctggctttgcaaaaaaggggttctggtttctatgacccactttggggaggagggattctaatttccatgacttgcctcgagggagaatgasggatgagagacaggagggcagaggtcagagaaaaactgcctcagcggctttcactttggggtatcattttctgagtcccaacagaaggaagcaaagtaat

SEQ ID NO: 56604 - DNA, 201 bp, Homo sapiens
tcctgatggatccaccttaagaaccaaaacacctccatttaggccccacccccaacactgggaattaaatttcaacatgagttttagtggggacaaaccayatccaaacgatagcagtaaattactttagattccatttagatttcttaattataaataaatactatggatttaattagactaccttatacactcgacaga

SEQ ID NO: 56605 - DNA, 201 bp, Homo sapiens
gtctatctcagttaatgtaataatgcccttaaaaagaaagtgcattgtgaaattgttcgatgcagacttttataaatgtcacttagatctttccttatatwtcttatttttttgtctacttgttctatcagttgttgaggagtgttaaaattttctaccataattgtgtaattgggtatcttccttttcattttgccattt

SEQ ID NO: 56606 - DNA, 201 bp, Homo sapiens
tctttttttattttatttccagcccactaattatacagtgatgtttaatgtctagatacttgagcttttcttagagagcttattggtattggtgtctaatyctgttgtcttctgagaataaatttggtatgatctcaatccatttagatttattgaggtttgatatatggtctaacatgtagtctatctcagttaatgtaa

SEQ ID NO: 56607 - DNA, 201 bp, Homo sapiens
ctcttttctatttcataattattttttcctatcatagatttgaaaaagaaaaattgtttctctagcctctcaaagtatagggttattacttcgagatttgyttttttcccagtataaaaatttaaaattacacatttctctctaaacacagttttagctgcataacacaattttactatgtcatttttgatggttatttag

SEQ ID NO: 56608 - DNA, 201 bp, Homo sapiens
agttttctttttagaattgttttaacatattcaatttctttactcaatacaggttaattcggtttttctgtttcttcttgtgttgatcatgttaagttttwtttttcaagaaatttttctagttcaactaagttgttggatttgttcatataaagctgtttgtagcatttcattattttaaattttaatatctttaaaatt

SEQ ID NO: 56609 - DNA, 201 bp, Homo sapiens
acttttccttatatctccaggtgagccctaataccaaatacatgctcagtatgtacaaggttctgtcatatgcactttcatagagaatcttatttaattgwgacagttttcctggaagtaagctgatatcaaaatactgattttacccatgagataactgaaaaacagagaagtgaaagattttgcctaaagtcacacagc

SEQ ID NO: 56610 - DNA, 201 bp, Homo sapiens
tgtaaaaagttatataatctgaaagtagggaccattttgcaagttttctatctttatgctttttacttatttttcttacggcaatgaatgggatatacatygaatataacttttatatatattgaatatatcttgtgtaagcaggtattcttacttttttttctgacctcatgtggaaaataattcagtctttcagcatta

SEQ ID NO: 56611 - DNA, 201 bp, Homo sapiens
aagcttattaacttctacaagaagttgtggttttaatggggatttcatttaacctacagatcataatgaagacaattgaaatttttaaaaatcatggagtyttctatttcctgtacataatataactccatttattttggtcttgtttaatttttttttacaatgttttctaattttcagggtaaatgtcttggacatctt

SEQ ID NO: 56612 - DNA, 201 bp, Homo sapiens
ttcagcagtgtatgagagttccagtcattatgtctccttgccaacctctgatatgctcagtctttttcattttaggcattctaactagacgcattgtagtrttacattgtggttttaatttacgcttctcccttgactgatgatgtctgcattttgccaggttcttgtgggccatttatgcatattgttttgtgaggtgtc

SEQ ID NO: 56613 - DNA, 201 bp, Homo sapiens
aaccatcatcataatcaagaaaataaacattgccatctcacccaagagattccttatcatcttttttaattcattccttcttccatcctaaccccagacartcatgaagtagctttttatcactgtagcttttctgggacttttacaaatggaattatactgggtgcactcattttaacttaactcgttttaactcgtttt

SEQ ID NO: 56614 - DNA, 201 bp, Homo sapiens
ttatttatttcgtggaagcaatgagtagaatatgacatatgatggctatttgagtagaaaagctttgtgatggacattttgcatttttttaaactcctcaraaaatattttgaattcaattttctgtggagaaatcaatgaataataatttataacaactatgctatttgataactgtacaaggcctgaaaaaagtaagat

SEQ ID NO: 56615 - DNA, 201 bp, Homo sapiens
ctttggggagattatttatttcgtggaagcaatgagtagaatatgacatatgatggctatttgagtagaaaagctttgtgatggacattttgcattttttyaaactcctcagaaaatattttgaattcaattttctgtggagaaatcaatgaataataatttataacaactatgctatttgataactgtacaaggcctgaa

SEQ ID NO: 56616 - DNA, 201 bp, Homo sapiens
agttaagagtgtgttccatcaagggaaatgtaaaaccccaaggtttggggaataaaatgtgtaattatttcttttatttaaatgtaacctcatgtctacayatataattaataagtgataagggccgggcgcggtggctcacgcctgtaatcccagcattttgggaggccgagatgggtggatcacaaggtcaggagaccg

SEQ ID NO: 56617 - DNA, 201 bp, Homo sapiens
ggaaatgtaaaaccccaaggtttggggaataaaatgtgtaattatttcttttatttaaatgtaacctcatgtctacatatataattaataagtgataaggsccgggcgcggtggctcacgcctgtaatcccagcattttgggaggccgagatgggtggatcacaaggtcaggagaccgagaccatgctggtgaaaccccat

SEQ ID NO: 56618 - DNA, 201 bp, Homo sapiens
gtttggggaataaaatgtgtaattatttcttttatttaaatgtaacctcatgtctacatatataattaataagtgataagggccgggcgcggtggctcacscctgtaatcccagcattttgggaggccgagatgggtggatcacaaggtcaggagaccgagaccatgctggtgaaaccccatctctactaaaaatacaaaa

SEQ ID NO: 56619 - DNA, 201 bp, Homo sapiens
aatcccagcattttgggaggccgagatgggtggatcacaaggtcaggagaccgagaccatgctggtgaaaccccatctctactaaaaatacaaaaaattasccgggcatagtggcgggcgcctgtagtcccagctacttgggaggctgaggcaggagaatggtgtgaacctgggaggcagagcttgcagtgagccgagatc

SEQ ID NO: 56620 - DNA, 201 bp, Homo sapiens
agaactaagtaaaatctgttttaaggaagaaagtaacaaataactgcctttacattgacctaatctataatctaggtgaacatcttaaccttttttttttyaaatttaagtgtatatgttacagctgaactcagatatttttattaccaaaaataagacaatttataaagatgatatgagacagttgctaataaattacaa

SEQ ID NO: 56621 - DNA, 201 bp, Homo sapiens
atagtggcgggcgcctgtagtcccagctacttgggaggctgaggcaggagaatggtgtgaacctgggaggcagagcttgcagtgagccgagatcgcgccgytgggctccagcctaggcgacagagctagactccgtctcaaaaaaaaaaaaaaaaaaaaaaaaaaaaatggagccatttagaaaaaataggtatttatttg

SEQ ID NO: 56622 - DNA, 201 bp, Homo sapiens
tccttggttttcattgttccattattttaccaatttttttttcaaaaagatacagaaatatattgaaacatttcttggaaactaaagcattttttatagtstttactgtttaggaaactaagacttagagataaagtggttttttcaaagataagcagtggctacagtaacttaggtgggatacaattcataaaatcttgt

SEQ ID NO: 56623 - DNA, 201 bp, Homo sapiens
tgcggtgagtataagttctgcttgtctcccttcacagagatgataggcagcatgtcaccgtttcagtcggtccttagccagatttttctcatgaaatggaygtcagttgttattaacatttgttgcttaatcttgacatgttaaactatggtatgtgagaaaccagtaatgttaacacacacacagttatgcacatagaca

SEQ ID NO: 56624 - DNA, 201 bp, Homo sapiens
aggtatttatttgatatgaaccttttgtcttctgctttatctgaacttttacatggaaataattttcttgtgtttgaatgattaaggtaacgctaagaggrtattagtttctgaaaccatctctcttgatgctattgagtttattgatcaagaattctataatatggtttaattatgatgtcttgatatagggccctcgag

SEQ ID NO: 56625 - DNA, 201 bp, Homo sapiens
gcaaaacttcatctcaaaaaaaaaaaaagaaagaaaagaaaaagaatatatatatatatatatatatatatatatatatatatatgaggattcaataccawcatcaattttcatattaaattgtatttattatgaaactcaagactctttttaattacaaaatatatagcactatcatagttaagtaattacagctaagta

SEQ ID NO: 56626 - DNA, 201 bp, Homo sapiens
tgtccttttgggtacctagtactgttgggtaacgagtaagtagtcatctgttaactggctgcttaataaatgagcctacattttttgtatgattttagctyatttttataatttaaaatacacagcatttttatgtgaatactgctttggcaaccactgtttctttgaagcttacaaaagaattacttgtcttttttaggt

SEQ ID NO: 56627 - DNA, 201 bp, Homo sapiens
ggagtgaaccttagactgtgtgaggtagttggctttccttcctcactcagattttcacatagactccctgaaaggatgactgccagaaagagcagtagctkgctaataagaactctagtgcattttcatacttggtgctcttaggtagctctgcacagaaagaaaaaaatgtaaatattgaagtggtgtctgtctttcctt

SEQ ID NO: 56628 - DNA, 201 bp, Homo sapiens
ggtttttggaacaaggattttggatgaagaagtttttgaggtaaaaataaatccaactctaagctgaatattgacaaatcagatgaactgggttaacaacrgtaaaaatatcgctttatagcaatacgttataaagcaaagttgaaaactctaaagggtgacctagtttcttcctctgtgagtatagtggtgatgttttct

SEQ ID NO: 56629 - DNA, 201 bp, Homo sapiens
ctccctattcatagaacttgagtgcacagagtatcaggggaagcttccttcctctgtttgactggtaaactgacatccgggcttaaaggagtgaaccttaractgtgtgaggtagttggctttccttcctcactcagattttcacatagactccctgaaaggatgactgccagaaagagcagtagcttgctaataagaact

SEQ ID NO: 56630 - DNA, 201 bp, Homo sapiens
ttgggtacctagtactgttgggtaacgagtaagtagtcatctgttaactggctgcttaataaatgagcctacattttttgtatgattttagctcatttttrtaatttaaaatacacagcatttttatgtgaatactgctttggcaaccactgtttctttgaagcttacaaaagaattacttgtcttttttaggtggcatcg

SEQ ID NO: 56631 - DNA, 201 bp, Homo sapiens
gagaggcccacctggcccaatgggtctaactggaagaccaggtcctgtggtaggttaccccaacaaagataatatatgttaaaattttcaaattagcagtwccctgtgcaacttcttccagggattgtgcatatctatggttggtgacaatagggtatgttttcatgcttgctgttgtttccattaaaaaaatccttctca

SEQ ID NO: 56632 - DNA, 201 bp, Homo sapiens
aatacaattatttttggagtcttttaaacaggaaaatttccttattaaatagcaagttatagccattgctcaagttttcaaaacatcattatttctgtttyctaattttttaaaataatcaaaacagattattgcaggtctttcatattttttaacaaatagccatctttggggagattatttatttcgtggaagcaatga

SEQ ID NO: 56633 - DNA, 201 bp, Homo sapiens
gcaaaaaaaaaaaaaaaaaaaaaaaaaaagtcctaccaacacaaatcaacagccttgatttttttttcctgctaaataagattcaaagatgtgaggaaaaytaaattagaaaagttgtattgcttgtatttattgtcaatacaattatttttggagtcttttaaacaggaaaatttccttattaaatagcaagttatagcc

SEQ ID NO: 56634 - DNA, 201 bp, Homo sapiens
tatagactcataattcagattttataatttcagcatagcagagtgagtatatgaattgatttggggatgacaaaaatccgattttgaatcccagcatatarcttaatattcaaccttctctatataattactctatatcagtttcaaatgggaaatataacagaatcttcctcataaggatttatagaaaaaaaatgagct

SEQ ID NO: 56635 - DNA, 201 bp, Homo sapiens
ccatatcccaccctaatctctatcaaataccttcatcaggacacagtgagattaagcttttgttactacaacacaaagtgaagcaaaggatgggcacttcyttatcagcacagacagctaattctactgtgcattttatgctgcttgtgtccttttgggtacctagtactgttgggtaacgagtaagtagtcatctgttaa

SEQ ID NO: 56636 - DNA, 201 bp, Homo sapiens
ccagttgaatgttctagtggaaagaccaaagattaagtgtatatggaaatacacttggtcaccatgccaagtcacatgaaacagacattttacgagggctyctgcaactttttgggtattttattttatggatctagtcctagacacttctggaatattaatctagcacttttcatttggaaaaaaaataaaatataaacc

SEQ ID NO: 56637 - DNA, 201 bp, Homo sapiens
taatttagatgcaaaaatattggtatttaagcacactctgatgtttttaaagaacaatcatgacattcatcatgagtgaacattcattccataagtatttwtctattagccaccgcttggctggcagtctgtagagcacagcagttgtagcaatgaacaacccaggtgaagttcctccactcctggagcttaaatatgcga

SEQ ID NO: 56638 - DNA, 201 bp, Homo sapiens
ggagaatgttcaataaatatttttaattgattatcaaacagaagttatatttacatatatcacagtagtaaaatattatcttgataatatgttgaatacarttaatacctagtagtattaatttttttcatttgtatattccttcaataacaatttattaaatgcttactgtgtgctaggtaggtcctatacttttacttg

SEQ ID NO: 56639 - DNA, 201 bp, Homo sapiens
tgggaggggccacacacacattttgtttcctggagctgtgcgcatgctcacttgaggcgtcagtttagtgttcccagaggaaggttatttaccagttaaastccaaccatttgcatcttagtgcacatgcttgagcccagtagcccacctcctgagatcgtataaagaagctgctggtcaccagtttcaggtgttttctat

SEQ ID NO: 56640 - DNA, 201 bp, Homo sapiens
taagtgagtgtctttaaagtttgactatagcttggataaaaattgaagagaaaccttaatggaggacccctatttatttattaatctgtttactattcaamgttagttgatttataaaggccatgtagaaatttcaaaaataccacagtgatctaggaataaagtagaaattggaaattggaaatttctaactctttggcc

SEQ ID NO: 56641 - DNA, 201 bp, Homo sapiens
aataatgcttgttttatttatatgccagagtagtaagaggctcaaataagatatatttgtaaaactattttgaaaaataaaacccgcaacttaatatacaytgttttataaaaatataagtactcattacttaattatttgagatatacttagggtaattgtttaactgatatatttatataacagatgcttagtaaggac

SEQ ID NO: 56642 - DNA, 201 bp, Homo sapiens
atgtttttaatattaaccccttatcagatgtatagtttgcaaatattttctcctgttctaaaggttgtctcttcactttgttaattttttcttttgctttktaaatactttttagttaaatgtaatcctatttggatgtggtagggctgggatttgagccaaatgatctgacaagattcagaactttcaattgagatactg

SEQ ID NO: 56643 - DNA, 201 bp, Homo sapiens; identical to SEQ ID NO: 10492

SEQ ID NO: 56644 - DNA, 201 bp, Homo sapiens
attttttcccaaagtttgtgaactttttgctcaacactttctttttataaaatagatgaagctgaaaacatattgcagtaattgttttggattttagtttyccttgactcctttaatccaaaaagagaaatgtgttatcaaaggaaggattattttcatttaaaaactaaaaaaaaatttgtactgttattgttggcccat

SEQ ID NO: 56645 - DNA, 201 bp, Homo sapiens; identical to SEQ ID NO: 10523

SEQ ID NO: 56646 - DNA, 201 bp, Homo sapiens; identical to SEQ ID NO: 10494

SEQ ID NO: 56647 - DNA, 201 bp, Homo sapiens
ggtatgttattcatatgaatacaaagaacagtattgaccttgaaggcagggtaaatcatggacttaatgcacatgaaatttgatctaactttaagaaatamaactacaaacacaaggtacagaagtgactataatgagtaaagatattacaacaaattattaattttattaaaaagttaaaaaaacaggaaatctgggaaa

SEQ ID NO: 56648 - DNA, 201 bp, Homo sapiens
tgcccaccactacgtctggctagtttttgtatttttagtagagacagggttttaccatattggccagtctattctcgaactcctgaccttgtgatccgccygtctcagcctcccagagtgcgtaagcccccacacctggctggaatggctgcatttacccaatgcctgtactcttaccgtatctaggaagtaactaacttg

SEQ ID NO: 56649 - DNA, 201 bp, Homo sapiens
tagtttttgtatttttagtagagacagggttttaccatattggccagtctattctcgaactcctgaccttgtgatccgcccgtctcagcctcccagagtgygtaagcccccacacctggctggaatggctgcatttacccaatgcctgtactcttaccgtatctaggaagtaactaacttgcttttgattttacggactca

SEQ ID NO: 56650 - DNA, 201 bp, Homo sapiens
aattacacctttttcttaaattgctcagtctcgagtaggtcttcatcagcagcaggaagatgaactagtacaccctgattcctattctaaaattacctctrtatgtctatgcagaaataattaagtagcctttcttcccacaatgtgatgatttcctttttgtggaatctaaaaagcaaaacttacatctcagtagcaggt

SEQ ID NO: 56651 - DNA, 201 bp, Homo sapiens
cattcatgtgttcttaaactgagaatgataaaacttcagttaccatttaaacagcttccaaatgtggcattctcagctatgttaatttcaggaacataacrgtatgagtgaatattttctctttattttaggtctccttttctttctcattattttacaaaaaagtaattaagtttgcttgtgacaaaagatttgtaggaa

SEQ ID NO: 56652 - DNA, 201 bp, Homo sapiens
tgtatgtaaatttgaactcaaaagaaaaaaaagcattaaaatattgaactctacttaatatacatgctgaaatgtcttgggatgaagtgcaatgatgtccrcaatctgccttgaaatgcatcaagaggccgggcactgcggttcacacctgtaatcccagcactttgggaggctgaggcaggtggatcacctgaggtcagg

SEQ ID NO: 56653 - DNA, 201 bp, Homo sapiens
tgaatggcctcgggctaggggatattccactgtcgcctctgactacgggtggtcctgtggctgaggcgcagcgggccctgggagttgtagttcatcaagckgaccgaggaggcgaggctgcgctgagcatcctgggaatcgtagtgctcgctacacggtgccctctgcgcaggcgcacaccgagagccacttccggaacaa

SEQ ID NO: 56654 - DNA, 201 bp, Homo sapiens
cggtgactgccccctcctcctcttgcacagcacataggaaagggctgcggtgaggatgaagatgatggccaggaggcacaggaccggcactgtggctgatktcctggctgtgggaccagcatttttttccggctgcttctggttctccccagcctcaggcccaactgccagactgtggcccgcagtgtgaatggtggtttc

SEQ ID NO: 56655 - DNA, 201 bp, Homo sapiens
gggctcggtgagccgggaaggagttcaggctggaccagagagggtcctggaggcacctgcaaggaggggccgcccaggcgctgccctcgcagaggcaggtraaattacctcgtgtagtatagacaccgatggtaagctctcaggtgtttccggagacgattcatgaactgaaccgatggcggggagtcggaagaaattctt

SEQ ID NO: 56656 - DNA, 201 bp, Homo sapiens
ctagaatttccatgtacacagttgggacttgccaactgtgagtttcagtatgaggtgatctggccaactgactggttggagaacccctgacgttcacatcstaaggtcttttctcacttaccaaattccccagagaagagtcttccagtctcttacctggaaagtataagccttgtgctggagttctggaaactaccactc

SEQ ID NO: 56657 - DNA, 201 bp, Homo sapiens
tcagaatgcaggttcgggatgcgacaacctggacagcggggagcgaaagcgtgaccgggctgcactggcagcctgacctgggacttggagcagggttgggragggaatcctacgtgcgtgcgcagcgaaagggcgggactgagaggggctggcctagggagaggctacactggcagtctccgtgtgtccccgccctctctc

SEQ ID NO: 56658 - DNA, 201 bp, Homo sapiens
caacttttgtatatgtgtaaattttcataataaaatattggaaaagaaaaataggccaggtgtggtggctcacgcctgtaatcctagcacttttggaggcygaggcgggtggatcacaaggccaggagttcgagaccagcctggccaacatggtgaaaccctgtctctactaaaaatacaaaaattagccaggcttggtgg

SEQ ID NO: 56659 - DNA, 201 bp, Homo sapiens
agaccctgtctctacaaaaaaaattaaaaattagccagatgtggtagcacacatctatggtcctgactcttcagaaggctgaagtgagaggtcacttgagyatgggagtttaaggctgcagtgagccatgactgagccactgcattccagcctgggcagcagagtgagaccttgtctcaaaaaataaaatttttttaaaaa

SEQ ID NO: 56660 - DNA, 201 bp, Homo sapiens
tttttagtagagatggggttttaccatgttggtcaggctggtctcaaactcctgacctcaggtgatccaccggcctcaacctcccaaagagctaggattayaggagtgagccaccgtcctggcctctacttaagttttcaaaactagtttgtgcacacttaaaagtaattcatttcattgtatgtaaatttgaactcaaaa

SEQ ID NO: 56661 - DNA, 201 bp, Homo sapiens
cactccaggcaggcagaatcccttgctggactccacatgcgctgttcccgtcacagcaccatgctgttgcctatgccgtctcccttttccactacaagctytcatccacgtagttcacctttaagattcagctcacgcctgtaatcccagcactttgggaggccgaagagggtggatcgcttgaggtcgagttcgagacca

SEQ ID NO: 56662 - DNA, 201 bp, Homo sapiens
taacctcaagtagctgtgtaacctcaccccttgtccctaacctctccggaagtgatatcttccagctgtaaaatgaggataattgtagtaccaagggccakggttcctgggaggatgaaaggaaatcatagaggtctaggcagacttaaaggcagtatggatgacacagatcctacaaaactttagctaggacatggaaga

SEQ ID NO: 56663 - DNA, 201 bp, Homo sapiens
cctatgacctacttccacgtgaagttagagaattcctttatggccagctctcacagaaaaacagaaagagcagagtgagctacttacttctgctgttttcktaattaccaaggtgccatgttttggagtgtcatgttctgagctccaacagagggaagagtgagtcagggaggttatcacgctgaaggccagaagaggaag

SEQ ID NO: 56664 - DNA, 201 bp, Homo sapiens
ttggacaaaaaggatatgatctaatggcaataaatggggggtgggggaccagcaaggcctgtccagattcttcttggcctccaagtatagggcaggacccmtctgaaatgagagcctatgacctacttccacgtgaagttagagaattcctttatggccagctctcacagaaaaacagaaagagcagagtgagctacttac

SEQ ID NO: 56665 - DNA, 201 bp, Homo sapiens
tgcactaattcttttttttttttttttaaggtggagtttcactcttgttgtccaggctggagtacaatggcacgaccttggctcactgcaatctctgcctycccggttcaagcgattctcccacctcggcctcccaagtagctgggattacaggcgcccgccaccatgcctggctaatttttgtatttttagtagagacga

SEQ ID NO: 56666 - DNA, 201 bp, Homo sapiens
ttatgcttaggcttgctgtgaagaatggacagctgtatagacgtatgattggattggccgggcgcggtggttcacgcctgtaatcccagcactttgggagsctgaggtgggtggatcacctgaggtcgggagttcgagaccagtctgaccaacatggagaaacccagtctctactaaaaatacaaaattagccaggcatgg

SEQ ID NO: 56667 - DNA, 201 bp, Homo sapiens; identical to SEQ ID NO: 10652

SEQ ID NO: 56668 - DNA, 201 bp, Homo sapiens
agttcgagaccagcctggtcaacatggtgaaaccccgtctctactaaaaatacaaaaaattagccgggtgtggtggtgagcacctgtagtcccagctactyaggaggaggcaggagaatcgcttgaacctgggagatgggggttgcagtgagccgagatcatgccactgcactccagcctggatgacagagcgagactccg

SEQ ID NO: 56669 - DNA, 201 bp, Homo sapiens
cgagactccgtctcaaaacaaagcaaagcaaaacaaaacaaaatacacatagaatttgtccaagttattatcacccagtgtgaaaagcagattttatagtataaccgtttttaaatgaggggcctaagagagggcagtggctggttagtcctatgttagatattaacaaatacgtgtaggctggatgtggtaggtgacgcc

SEQ ID NO: 56670 - DNA, 201 bp, Homo sapiens
agacgattcatgaactgaaccgatggcggggagtcggaagaaattcttttaccacaataacaacttccagtgacgctgccctcgttgccattgcctgcgcrggacggaggtggtcggcacccattcccaggcccagggtccccactccgctgttccctggcatccaatccacagccccatgacagcctctcggtggaccca

SEQ ID NO: 56671 - DNA, 201 bp, Homo sapiens
tgggatgacaggcgtgagccaccgcgcccggccagtttttttattttttgtagagatggagtatcctcacgttgctcaggctacacctggcctactttcaycacctttagatgtttattttggcatttacctccctatctctaaacatgcttatttggcaacttcatgatttttgtttttgtttgttttttttgttttgag

SEQ ID NO: 56672 - DNA, 201 bp, Homo sapiens
cctcgttgccattgcctgcgcgggacggaggtggtcggcacccattcccaggcccagggtccccactccgctgttccctggcatccaatccacagccccakgacagcctctcggtggacccagggtcagagcgccaggctcaacccacacatcatcacgcccccgacaacatccataatcccgcccggagccaggcgtccc

SEQ ID NO: 56673 - DNA, 201 bp, Homo sapiens
tacctggagaggactgcggtgactgccccctcctcctcttgcacagcacataggaaagggctgcggtgaggatgaagatgatggccaggaggcacaggacyggcactgtggctgatgtcctggctgtgggaccagcatttttttccggctgcttctggttctccccagcctcaggcccaactgccagactgtggcccgcag

SEQ ID NO: 56674 - DNA, 201 bp, Homo sapiens
tggtgtctcaatggctttcgccggggaccggaggagacggcggccggagaggaggcgcgagccagctgcaccccccggccctgctgtgccccgaccgtgckctcagtactcggcccgcgccatgccagcctctggacgcagggaaagccgaggaggtggagctcccgcgccctgcgcccccgcactgggcccggctccgtc

SEQ ID NO: 56675 - DNA, 201 bp, Homo sapiens
ggtgtctcaatggctttcgccggggaccggaggagacggcggccggagaggaggcgcgagccagctgcaccccccggccctgctgtgccccgaccgtgcgytcagtactcggcccgcgccatgccagcctctggacgcagggaaagccgaggaggtggagctcccgcgccctgcgcccccgcactgggcccggctccgtcg

SEQ ID NO: 56676 - DNA, 201 bp, Homo sapiens
caggagttcaggactacaatgacctatgattgcgccactgcactctagcctgggtgacacagagaggccctatctcaagaaactaaaaaaaaaaaaaaaaagagtgaggtgccaagaagttgactagaatttccatgtacacagttgggacttgccaactgtgagtttcagtatgaggtgatctggccaactgactggttg

SEQ ID NO: 56677 - DNA, 201 bp, Homo sapiens
ggccttgaactcctgacctcaagtgatcctcccgcctcgacctccaaaagtgctgggattgcaggcataagccaccatgcccagccaaggatgctttttckgattcaatcatgttttatactatctcttacctaaaagcttcaacagttgtccccacctccccctttttattttggtttctgtctttcatgttagaaagtt

SEQ ID NO: 56678 - DNA, 201 bp, Homo sapiens
actccgctgttccctggcatccaatccacagccccatgacagcctctcggtggacccagggtcagagcgccaggctcaacccacacatcatcacgccccckacaacatccataatcccgcccggagccaggcgtccccgggcctctgtccccaaccccaggcggctggctggctttcctcttgtccccgctgccttcatcc

SEQ ID NO: 56679 - DNA, 201 bp, Homo sapiens
cctgggagttgtagttcatcaagcggaccgaggaggcgaggctgcgctgagcatcctgggaatcgtagtgctcgctacacggtgccctctgcgcaggcgcwcaccgagagccacttccggaacaagcgtcgcgtttctgaggagaaactcttggtgagaattcccagagtgataatggctacctacagcctggcgaacgag

SEQ ID NO: 56680 - DNA, 201 bp, Homo sapiens
gtatgagcaccaacataccctgctggtcaaagtaccctaggacaaaggggcaaatggtgggcatggaaaaactgaagcccgagcctgcccacagctatgcyttggcctctccagcagggtgctcctgctctgcactccagaaacaccctgacaggctcagagaggagatggaaactgacatacccaacccacttcctcaaa

SEQ ID NO: 56681 - DNA, 201 bp, Homo sapiens
acttttttgattattttattaatttgtttttttgagacagagtctcactctgtcgccaaggctggagtgcagtggcactgtgtcggctcactgcaacctcygtctgctaggttcaagcaattctcctgcctcagcctcccgagtagctgggattacaggtgtccaccaccatgcccagctagtttttatatttttagtaga

SEQ ID NO: 56682 - DNA, 201 bp, Homo sapiens
aacatggagaaacccagtctctactaaaaatacaaaattagccaggcatggtgtcatgtgcctgtaatcccagctacatgggaggctgaggcagaatcgcytgaacccaggaggtggaggttgcagtgagccaagattgcacaactgcactccagcctgggcaacaagagcgaaactccatctcaaaaaaaaaaaagtatg

SEQ ID NO: 56683 - DNA, 201 bp, Homo sapiens
cacttacgtctcttttttatttcctctcttctttggttttgttttgttttgttttttgagacagattttcgctcttgtcacccaggctggagtgcaatggygagatctcagctcactgtaacctccgcctcctgggttcaagtgattctccagcttcagcctcctgagtagcttggattacaggcacccaccaccataccc

SEQ ID NO: 56684 - DNA, 201 bp, Homo sapiens
ggtgtcatgtgcctgtaatcccagctacatgggaggctgaggcagaatcgcttgaacccaggaggtggaggttgcagtgagccaagattgcacaactgcaytccagcctgggcaacaagagcgaaactccatctcaaaaaaaaaaaagtatgattggacaaaaaggatatgatctaatggcaataaatggggggtggggga

SEQ ID NO: 56685 - DNA, 201 bp, Homo sapiens
cattaacaagagaaaagcctaacatttatttaatcacagttttacatgacataggaaccttcagaaacaaagacccgagaaaagtgcatttttatgcttargcttgctgtgaagaatggacagctgtatagacgtatgattggattggccgggcgcggtggttcacgcctgtaatcccagcactttgggaggctgaggtgg

SEQ ID NO: 56686 - DNA, 201 bp, Homo sapiens
acgctccaggaaaggagctggaacctgcggaggagagacctgggcttagctgcggcgccttctttccttccccggctccttcctcattccagaggcgtgamgttgccaccaagaaagagccctttctcctgggactgggaaactccccagtaggtgagacggagtcatgaagtttcggggaatgagagcaaacggaacccg

SEQ ID NO: 56687 - DNA, 201 bp, Homo sapiens
gcttcatctcccactagcttgctctagccatcttctccatgatgttgctccaagcactagtccttgtgcctgtggtggcttccttccctctccactgtctrcagtccccgactgactgtcctcagagggcccagagtcaaccttgtgcagacaaccttgatacttgtgtgccaaggccaggtttccagccacctgagagcc

SEQ ID NO: 56688 - DNA, 201 bp, Homo sapiens; identical to SEQ ID NO: 10653

SEQ ID NO: 56689 - DNA, 201 bp, Homo sapiens
ggatgaagtgcaatgatgtccacaatctgccttgaaatgcatcaagaggccgggcactgcggttcacacctgtaatcccagcactttgggaggctgaggcrggtggatcacctgaggtcaggagtttgagaccagcctgaccaacacggtgaaaccccatctctactaaaaaaatacaaaaattagctgggcatggtggcg

SEQ ID NO: 56690 - DNA, 201 bp, Homo sapiens
taatcccagcactttgggaggccgaagagggtggatcgcttgaggtcgagttcgagaccaacctggccaacatggtgaaaccccgtctctactaaaaatamaaaaatcagccgggcgtggtggcgggcgcctataatcccaggcacccgggaagctgaagcaggagaatcgcttgaacctgggaggtggaggttgcaggga

SEQ ID NO: 56691 - DNA, 201 bp, Homo sapiens
aaataaaatttttttaaaaaagcaactttctgttattttattagcatttagggaaggattaagtcaaatgccggacccatcaagttttttgttttttgagrcagggtcgcgttctgtcacccaggctggagtgcagtggcacaatccatggctcactgcagcctcgacctctcaggctcaagaaatcctcctatctcagcc

SEQ ID NO: 56692 - DNA, 201 bp, Homo sapiens
taaatgaggggcctaagagagggcagtggctggttagtcctatgttagatattaacaaatacgtgtaggctggatgtggtaggtgacgcctataatcctcrcaccttcagaggccaaggtgggaggatcacttgactcaggagttccataacagcctgggcaacatagagtccgtctctaaaaaacaaaaaacaaaaacaa

SEQ ID NO: 56693 - DNA, 201 bp, Homo sapiens
aaaacaaaaacaagtatgtatacagtgcctaccatgttgtcaggggtcagtctcctttattacactttttgtaagaataagccacagtttaccctcacaarcttccattcttggctcaggtattagagtcaggtgccacaggtatataatgaaccggcagatctggaaaggataaagaaattgagagatgagctctgagat

SEQ ID NO: 56694 - DNA, 201 bp, Homo sapiens
cagatgctggagaactaggccagggagatggacccagagctgagagggagaccatcacctgtgccatgggacagaacctgggaacatgtagggtggggagkatgagcaccaacataccctgctggtcaaagtaccctaggacaaaggggcaaatggtgggcatggaaaaactgaagcccgagcctgcccacagctatgcct

SEQ ID NO: 56695 - DNA, 201 bp, Homo sapiens
aaggctgtggcaggagaattgcttgaacctgggaggcggaggctgcagtgagctgagggcaccattgcactccagcctgggcgacagagcaagactccatwaaaaaaaaaaaaaaaaaaaaaaaagaaatgcatcaagaaataaggtgatggatgatggatagaagaatgaatagatggatacttaataaagcaaatatcg

SEQ ID NO: 56696 - DNA, 201 bp, Homo sapiens
tcctactgggagggtggggcgctgagtggactgcaaggtggacaggagcatctgggcaggggtgtggatatctgaagatgccccctctgaggcctgagaarttggggggctggtaggaagtaaatgcttctggtgggccacaatccccgagtaagcatgtccacattctggaaaggaaagaaatgaggaatcaggactatc

SEQ ID NO: 56697 - DNA, 201 bp, Homo sapiens
ggaggttgcagtgagccaagattgcacaactgcactccagcctgggcaacaagagcgaaactccatctcaaaaaaaaaaaagtatgattggacaaaaaggrtatgatctaatggcaataaatggggggtgggggaccagcaaggcctgtccagattcttcttggcctccaagtatagggcaggacccctctgaaatgagag

SEQ ID NO: 56698 - DNA, 201 bp, Homo sapiens
gaacccaggaggtggaggttgcagtgagccaagattgcagcactgcactccagcctgggtgacaaagcaagactgtctcaaaaaaaaaaaaaaaaaaaaaagccgggcttggtggtgagtaccggtaaccccagctacttggaaggctgaggcaggagaatcgcttgaacccaggaggcggaggttgttgtacttagccga

SEQ ID NO: 56699 - DNA, 201 bp, Homo sapiens
cgaactcctgacctcaggtgatccacccgcctcggcctcccaaagtgctgggattacaggtgtgagccaccaaacccagcctttattttttaaatataggrgatggggtctcactatattgcccaggctggtctcgaagtccttagttcaagtgatcctcccacctcagcctcccaaagagctgaaattacaggagtgagc

SEQ ID NO: 56700 - DNA, 201 bp, Homo sapiens
agtagagacgggggtttcaccatgttgcccaggctggtctcgaacttctgacctcaggtgatccacccgcctaggcctcccaaagtgctgggaatacaagygtgagccaccgcggccggcttaatctctgttttcaacgcagtacccttgccctcaactgtactcaggtgctctctaagctaaaaaacctgttttccattt

SEQ ID NO: 56701 - DNA, 201 bp, Homo sapiens
ctgctaagccctggaggcagagcctgaagagcagtggaaaagtctcacctttgagatcaagacagctcatcaattcctgaacccatgggtccttgttgccyccacacacgctccaggaaaggagctggaacctgcggaggagagacctgggcttagctgcggcgccttctttccttccccggctccttcctcattccagag

SEQ ID NO: 56702 - DNA, 201 bp, Homo sapiens
actcttcagaaggctgaagtgagaggtcacttgagcatgggagtttaaggctgcagtgagccatgactgagccactgcattccagcctgggcagcagagtragaccttgtctcaaaaaataaaatttttttaaaaaagcaactttctgttattttattagcatttagggaaggattaagtcaaatgccggacccatcaagt

SEQ ID NO: 56703 - DNA, 201 bp, Homo sapiens
aatcctggcactttgggaggccaaggcaggaggatcctttgagtccaggagttcaagaccagcataggcaacacaatgagaccctgtctctacaaaaaaaattaaaaattagccagatgtggtagcacacatctatggtcctgactcttcagaaggctgaagtgagaggtcacttgagcatgggagtttaaggctgcagtg

SEQ ID NO: 56704 - DNA, 201 bp, Homo sapiens
agagtcaggtgccacaggtatataatgaaccggcagatctggaaaggataaagaaattgagagatgagctctgagatcaaggacagtgtttgggggatgakagcttgaactagggaatcagatgaagacatcaacactatgacctggcccacagtaggtgctcagtgaaaatttgtgaattgaatgactggccctcacctc

SEQ ID NO: 56705 - DNA, 201 bp, Homo sapiens
ctgaagagatcctcccacctcagcctcccaagtaactgggactacaggtgcaagccaccatgcccagctagtttttttaacttttttgattattttattartttgtttttttgagacagagtctcactctgtcgccaaggctggagtgcagtggcactgtgtcggctcactgcaacctctgtctgctaggttcaagcaatt

SEQ ID NO: 56706 - DNA, 201 bp, Homo sapiens
acccaccgtggcttcccaaagtgttgggatgacaggcgtgagccaccgcgcccggccagtttttttattttttgtagagatggagtatcctcacgttgctyaggctacacctggcctactttcaccacctttagatgtttattttggcatttacctccctatctctaaacatgcttatttggcaacttcatgatttttgtt

SEQ ID NO: 56707 - DNA, 201 bp, Homo sapiens
tcctatgttagatattaacaaatacgtgtaggctggatgtggtaggtgacgcctataatcctcgcaccttcagaggccaaggtgggaggatcacttgactyaggagttccataacagcctgggcaacatagagtccgtctctaaaaaacaaaaaacaaaaacaagtatgtatacagtgcctaccatgttgtcaggggtcag

SEQ ID NO: 56708 - DNA, 201 bp, Homo sapiens
cccctgccccgcccccggctaacctggctgagtcaggtacaccagcaggagcagaagcaggagcaggagcacgcgggacccgggccgcaagtcccgtcccrtctcggggctccgcggactctgcggggatggagccacctcgctctgactcccagacatgctccggcgcgtgacgtccagctggtgtctcaatggctttcg

SEQ ID NO: 56709 - DNA, 201 bp, Homo sapiens
actctcctctacacttacgtctcttttttatttcctctcttctttggttttgttttgttttgttttttgagacagattttcgctcttgtcacccaggctgragtgcaatggcgagatctcagctcactgtaacctccgcctcctgggttcaagtgattctccagcttcagcctcctgagtagcttggattacaggcaccca

SEQ ID NO: 56710 - DNA, 201 bp, Homo sapiens
gacatgctccggcgcgtgacgtccagctggtgtctcaatggctttcgccggggaccggaggagacggcggccggagaggaggcgcgagccagctgcacccmccggccctgctgtgccccgaccgtgcgctcagtactcggcccgcgccatgccagcctctggacgcagggaaagccgaggaggtggagctcccgcgccctg

SEQ ID NO: 56711 - DNA, 201 bp, Homo sapiens
atccacccaccgtggcttcccaaagtgttgggatgacaggcgtgagccaccgcgcccggccagtttttttattttttgtagagatggagtatcctcacgtygctcaggctacacctggcctactttcaccacctttagatgtttattttggcatttacctccctatctctaaacatgcttatttggcaacttcatgatttt

SEQ ID NO: 56712 - DNA, 201 bp, Homo sapiens
gatggccaggaggcacaggaccggcactgtggctgatgtcctggctgtgggaccagcatttttttccggctgcttctggttctccccagcctcaggcccarctgccagactgtggcccgcagtgtgaatggtggtttcattgggacgagtgagctctttgtccgaggacagtgatcctactgggagggtggggcgctgagt

SEQ ID NO: 56713 - DNA, 201 bp, Homo sapiens
cctgacctcaggtgatccacctgcctcagcctcccaaagtgctgggattacaggtgtgaaccgcagtgcccggcctcttgatgcatttcaaggcagattgyggacatcattgcacttcatcccaagacatttcagcatgtatattaagtagagttcaatattttaatgcttttttttcttttgagttcaaatttacataca

SEQ ID NO: 56714 - DNA, 201 bp, Homo sapiens
ttgttccggaagtggctctcggtgtgcgcctgcgcagagggcaccgtgtagcgagcactacgattcccaggatgctcagcgcagcctcgcctcctcggtcmgcttgatgaactacaactcccagggcccgctgcgcctcagccacaggaccacccgtagtcagaggcgacagtggaatatcccctagcccgaggccattca

SEQ ID NO: 56715 - DNA, 201 bp, Homo sapiens
aagggcagtgaaatcaaggaactcatcccggtatccagacacaaactccatgtcttcagcggcacagggccccggcccagactgagcaaaagaagggatayatggtgagggacaggagagcaatgatggagtttggggctgggtcacaaattgagggagagggtaggtttgagagtcacttagggttggatccgtggatat

SEQ ID NO: 56716 - DNA, 201 bp, Homo sapiens; identical to SEQ ID NO: 10655

SEQ ID NO: 56717 - DNA, 201 bp, Homo sapiens
gttgggtctgttggagggtcgcggggtcttttgtgggttggggagattccgtgagctagatctaaagaggggtgtgctgggggatgtcgagacctcccatsggggcgacgagtagtggggacagagaaggcaggttgctgggctgggggcaggagggccccaggacagcagggactagggtagaggtgggccttcgaggat

SEQ ID NO: 56718 - DNA, 201 bp, Homo sapiens
agtgcagtggcgtgatcacgggacactacagcctcgacctcttggactcaaacgattctcccacctcagtctcccgagaattgtgaccacaagcgagtgcmccatgcctgactaattttttctattttttgtagagacagagtctatgttgcccaggctgatctcaaattcctgggctcaagttggcctcccaaagtgctg

SEQ ID NO: 56719 - DNA, 201 bp, Homo sapiens
gagtggtagtttccagaactccagcacaaggcttatactttccaggtaagagactggaagactcttctctggggaatttggtaagtgagaaaagaccttasgatgtgaacgtcaggggttctccaaccagtcagttggccagatcacctcatactgaaactcacagttggcaagtcccaactgtgtacatggaaattctag

SEQ ID NO: 56720 - DNA, 201 bp, Homo sapiens
ccaccaagcctggctaatttttgtatttttagtagagacagggtttcaccatgttggccaggctggtctcgaactcctggccttgtgatccacccgcctcrgcctccaaaagtgctaggattacaggcgtgagccaccacacctggcctatttttcttttccaatattttattatgaaaatttacacatatacaaaagttg

SEQ ID NO: 56721 - DNA, 201 bp, Homo sapiens
tttttaaaaaaattttattttttgagacaaggtctcactctgctgcccaggctggaatgcagtggctcagtcatggctcactgcagccttaaactcccatrctcaagtgacctctcacttcagccttctgaagagtcaggaccatagatgtgtgctaccacatctggctaatttttaattttttttgtagagacagggtct

SEQ ID NO: 56722 - DNA, 201 bp, Homo sapiens
ttttgagttcaaatttacatacaatgaaatgaattacttttaagtgtgcacaaactagttttgaaaacttaagtagaggccaggacggtggctcactcctrtaatcctagctctttgggaggttgaggccggtggatcacctgaggtcaggagtttgagaccagcctgaccaacatggtaaaaccccatctctactaaaaa

SEQ ID NO: 56723 - DNA, 201 bp, Homo sapiens
tcttccatgtcctagctaaagttttgtaggatctgtgtcatccatactgcctttaagtctgcctagacctctatgatttcctttcatcctcccaggaaccmtggcccttggtactacaattatcctcattttacagctggaagatatcacttccggagaggttagggacaaggggtgaggttacacagctacttgaggtta

SEQ ID NO: 56724 - DNA, 201 bp, Homo sapiens
cttcctcttctggccttcagcgtgataacctccctgactcactcttccctctgttggagctcagaacatgacactccaaaacatggcaccttggtaattamgaaaacagcagaagtaagtagctcactctgctctttctgtttttctgtgagagctggccataaaggaattctctaacttcacgtggaagtaggtcatagg

SEQ ID NO: 56725 - DNA, 201 bp, Homo sapiens
gtaagtagctcactctgctctttctgtttttctgtgagagctggccataaaggaattctctaacttcacgtggaagtaggtcataggctctcatttcagakgggtcctgccctatacttggaggccaagaagaatctggacaggccttgctggtcccccaccccccatttattgccattagatcatatcctttttgtccaa

SEQ ID NO: 56726 - DNA, 201 bp, Homo sapiens
ccatgcctggctaattttgtatttttagtagagactgggtttctccatgttggtcagactggtctcgaactcccgacctcaggtgatccacccacctcagsctcccaaagtgctgggattacaggcgtgaaccaccgcgcccggccaatccaatcatacgtctatacagctgtccattcttcacagcaagcctaagcataa

SEQ ID NO: 56727 - DNA, 201 bp, Homo sapiens; identical to SEQ ID NO: 10661

SEQ ID NO: 56728 - DNA, 201 bp, Homo sapiens; identical to SEQ ID NO: 10662

SEQ ID NO: 56729 - DNA, 201 bp, Homo sapiens; identical to SEQ ID NO: 10664

SEQ ID NO: 56730 - DNA, 201 bp, Homo sapiens
catcagggcagtcccgtctccctggagaagctggtaggggtctcctgagaggatgaaagaaggaggggcctggggtcagggagacccccacctgacccatytctttcttccttccaaaggggctgtattccctgagacagccgcagtaagaggaatgggggtttgcatagggatggggtttctgggtggagttggtagggg

SEQ ID NO: 56731 - DNA, 201 bp, Homo sapiens
ctgcgggccacagtctggcagttgggcctgaggctggggagaaccagaagcagccggaaaaaaatgctggtcccacagccaggacatcagccacagtgccrgtcctgtgcctcctggccatcatcttcatcctcaccgcagccctttcctatgtgctgtgcaagaggaggagggggcagtcaccgcagtcctctccaggta

SEQ ID NO: 56732 - DNA, 201 bp, Homo sapiens; identical to SEQ ID NO: 10669

SEQ ID NO: 56733 - DNA, 201 bp, Homo sapiens; identical to SEQ ID NO: 10671

SEQ ID NO: 56734 - DNA, 201 bp, Homo sapiens
ggaggggccaggcaggaggggagagaagttcccttttgcccccattgcccacctgtaaccggggcagagacctcagccacgtatccttgagagcaaacccrgagttaaatcctgcagacagagaggagggagaagctggctcccacggtgggcttctctcccaccttccccacatgcctaaccctgagacccaggctttta

SEQ ID NO: 56735 - DNA, 201 bp, Homo sapiens
ggatgaaggcagcggggacaagaggaaagccagccagccgcctggggttggggacagaggcccggggacgcctggctccgggcgggattatggatgttgtmgggggcgtgatgatgtgtgggttgagcctggcgctctgaccctgggtccaccgagaggctgtcatggggctgtggattggatgccagggaacagcggagt

SEQ ID NO: 56736 - DNA, 201 bp, Homo sapiens
gaggagttgaggtgctgggctagaaccccagacatttttttttttttgagacagagtcttgctctatcacccaagctagagtgcagtggcgtgatcacggracactacagcctcgacctcttggactcaaacgattctcccacctcagtctcccgagaattgtgaccacaagcgagtgcaccatgcctgactaattttttc

SEQ ID NO: 56737 - DNA, 201 bp, Homo sapiens
aatcggtgactcacatcatctgggcaccgctgccagtcagcccggagacaagcctctccacaatacaagacagcactacactgggggctggggacacagcrggtggtgggcacctagtgttaacctctgtaggtcctgtctgctgttcaactgcccagcagctgcccatatgtcactcggtctgtttgtcttacaccctct

SEQ ID NO: 56738 - DNA, 201 bp, Homo sapiens
ccacctcagcctcccaaagtgctgggattacaggcgtgaaccaccgcgcccggccaatccaatcatacgtctatacagctgtccattcttcacagcaagcytaagcataaaaatgcacttttctcgggtctttgtttctgaaggttcctatgtcatgtaaaactgtgattaaataaatgttaggcttttctcttgttaatg

SEQ ID NO: 56739 - DNA, 201 bp, Homo sapiens
cgggttccgtttgctctcattccccgaaacttcatgactccgtctcacctactggggagtttcccagtcccaggagaaagggctctttcttggtggcaacktcacgcctctggaatgaggaaggagccggggaaggaaagaaggcgccgcagctaagcccaggtctctcctccgcaggttccagctcctttcctggagcgt

SEQ ID NO: 56740 - DNA, 201 bp, Homo sapiens
ggctctcaggtggctggaaacctggccttggcacacaagtatcaaggttgtctgcacaaggttgactctgggccctctgaggacagtcagtcggggactgyagacagtggagagggaaggaagccaccacaggcacaaggactagtgcttggagcaacatcatggagaagatggctagagcaagctagtgggagatgaagc

SEQ ID NO: 56741 - DNA, 201 bp, Homo sapiens; identical to SEQ ID NO: 10656

SEQ ID NO: 56742 - DNA, 201 bp, Homo sapiens
cgccaccatgcccagctaatttttgtatttttttagtagagatggggtttcaccgtgttggtcaggctggtctcaaactcctgacctcaggtgatccaccygcctcagcctcccaaagtgctgggattacaggtgtgaaccgcagtgcccggcctcttgatgcatttcaaggcagattgtggacatcattgcacttcatcc

SEQ ID NO: 56743 - DNA, 201 bp, Homo sapiens
tccctgcaacctccacctcccaggttcaagcgattctcctgcttcagcttcccgggtgcctgggattataggcgcccgccaccacgcccggctgatttttktatttttagtagagacggggtttcaccatgttggccaggttggtctcgaactcgacctcaagcgatccaccctcttcggcctcccaaagtgctgggatta

SEQ ID NO: 56744 - DNA, 201 bp, Homo sapiens
ggctgagataggaggatttcttgagcctgagaggtcgaggctgcagtgagccatggattgtgccactgcactccagcctgggtgacagaacgcgaccctgyctcaaaaaacaaaaaacttgatgggtccggcatttgacttaatccttccctaaatgctaataaaataacagaaagttgcttttttaaaaaaattttattt

SEQ ID NO: 56745 - DNA, 201 bp, Homo sapiens
ttgtttttgttttttgttttttagagacggactctatgttgcccaggctgttatggaactcctgagtcaagtgatcctcccaccttggcctctgaaggtgygaggattataggcgtcacctaccacatccagcctacacgtatttgttaatatctaacataggactaaccagccactgccctctcttaggcccctcattta

SEQ ID NO: 56746 - DNA, 201 bp, Homo sapiens
atctcagagctcatctctcaatttctttatcctttccagatctgccggttcattatatacctgtggcacctgactctaatacctgagccaagaatggaagyttgtgagggtaaactgtggcttattcttacaaaaagtgtaataaaggagactgacccctgacaacatggtaggcactgtatacatacttgtttttgtttt

SEQ ID NO: 56747 - DNA, 201 bp, Homo sapiens
ctctcatttcagaggggtcctgccctatacttggaggccaagaagaatctggacaggccttgctggtcccccaccccccatttattgccattagatcataycctttttgtccaatcatacttttttttttttgagatggagtttcgctcttgttgcccaggctggagtgcagttgtgcaatcttggctcactgcaacctcc

SEQ ID NO: 56748 - DNA, 201 bp, Homo sapiens
gcctgtaacagtctgtattgtttcctctgcatcttctcatgtccctgcctctccttctgtctgctaggcgccccccaccaccctgccttccttctatttgyctattggggtcttcctctcccccagctttggggctgctcaccaaggtgtcagcttcgcttcaaagctgtgcctgtgacacacatggcaggttcgagcacg

SEQ ID NO: 56749 - DNA, 201 bp, Homo sapiens
tcggctaagtacaacaacctccgcctcctgggttcaagcgattctcctgcctcagccttccaagtagctggggttaccggtactcaccaccaagcccggcttttttttttttttttttttttgagacagtcttgctttgtcacccaggctggagtgcagtgctgcaatcttggctcactgcaacctccacctcctgggttc

SEQ ID NO: 56750 - DNA, 201 bp, Homo sapiens
gcttcaagaagtaaagtggtttgtttaaggtcacactgcagttagtggtggagctgggaagcaagtaagtgtttgaatccctgtcccccaatccctgcackctctcagggacccagacactcaggcctcggcttcagagaccctgtctccagccccaaacacccagcccctgcccttgttccagggatctaggctctagcc

SEQ ID NO: 56751 - DNA, 201 bp, Homo sapiens
gctcactcctgtaatttcagctctttgggaggctgaggtgggaggatcacttgaactaaggacttcgagaccagcctgggcaatatagtgagaccccatcycctatatttaaaaaataaaggctgggtttggtggctcacacctgtaatcccagcactttgggaggccgaggcgggtggatcacctgaggtcaggagttcg

SEQ ID NO: 56752 - DNA, 201 bp, Homo sapiens
ggcaccaagccaagataatccttgtaacaattccatgggccttctccgtatccctcatgaggacacggaagcttcaagaagtaaagtggtttgtttaaggycacactgcagttagtggtggagctgggaagcaagtaagtgtttgaatccctgtcccccaatccctgcacgctctcagggacccagacactcaggcctcgg

SEQ ID NO: 56753 - DNA, 201 bp, Homo sapiens
acttgatgggtccggcatttgacttaatccttccctaaatgctaataaaataacagaaagttgcttttttaaaaaaattttattttttgagacaaggtctyactctgctgcccaggctggaatgcagtggctcagtcatggctcactgcagccttaaactcccatgctcaagtgacctctcacttcagccttctgaagagt

SEQ ID NO: 56754 - DNA, 201 bp, Homo sapiens
cagggcagtcccgtctccctggagaagctggtaggggtctcctgagaggatgaaagaaggaggggcctggggtcagggagacccccacctgacccatctcyttcttccttccaaaggggctgtattccctgagacagccgcagtaagaggaatgggggtttgcatagggatggggtttctgggtggagttggtaggggtga

SEQ ID NO: 56755 - DNA, 201 bp, Homo sapiens
ctctggaatgaggaaggagccggggaaggaaagaaggcgccgcagctaagcccaggtctctcctccgcaggttccagctcctttcctggagcgtgtgtggrggcaacaaggacccatgggttcaggaattgatgagctgtcttgatctcaaaggtgagacttttccactgctcttcaggctctgcctccagggcttagcag

SEQ ID NO: 56756 - DNA, 201 bp, Homo sapiens
accaaaaacaccccggggtggatgtgggggcacaggaggcatcagggcagtcccgtctccctggagaagctggtaggggtctcctgagaggatgaaagaargaggggcctggggtcagggagacccccacctgacccatctctttcttccttccaaaggggctgtattccctgagacagccgcagtaagaggaatgggggt

SEQ ID NO: 56757 - DNA, 201 bp, Homo sapiens
cactgcagccttaaactcccatgctcaagtgacctctcacttcagccttctgaagagtcaggaccatagatgtgtgctaccacatctggctaatttttaattttttttgtagagacagggtctcattgtgttgcctatgctggtcttgaactcctggactcaaaggatcctcctgccttggcctcccaaagtgccaggatt

SEQ ID NO: 56758 - DNA, 201 bp, Homo sapiens
gccttcaactgcaggaccctgttcccagacatctaattcccagtctcaaagacctggtcccagtttcccccaaccattctgacctccttatggtacctgcrgtgtaggtaaaaggcagggttgccagttctcctgcccgctccatgaaggctgcaagccttgggcaccaaaatcggtgactcacatcatctgggcaccgct

SEQ ID NO: 56759 - DNA, 201 bp, Homo sapiens
tgccttccttctatttgcctattggggtcttcctctcccccagctttggggctgctcaccaaggtgtcagcttcgcttcaaagctgtgcctgtgacacacrtggcaggttcgagcacgaagggaagcaaaggtgaagcctggccggggaccccatgtccgcattggggttttggctaacttcacacctagccttgggacca

SEQ ID NO: 56760 - DNA, 201 bp, Homo sapiens
aagaatttcttccgactccccgccatcggttcagttcatgaatcgtctccggaaacacctgagagcttaccatcggtgtctatactacacgaggtaatttyacctgcctctgcgagggcagcgcctgggcggcccctccttgcaggtgcctccaggaccctctctggtccagcctgaactccttcccggctcaccgagccc

SEQ ID NO: 56761 - DNA, 201 bp, Homo sapiens
gagagagggcggggacacacggagactgccagtgtagcctctccctaggccagcccctctcagtcccgccctttcgctgcgcacgcacgtaggattccctycccaaccctgctccaagtcccaggtcaggctgccagtgcagcccggtcacgctttcgctccccgctgtccaggttgtcgcatcccgaacctgcattctga

SEQ ID NO: 56762 - DNA, 201 bp, Homo sapiens
tggtctcgaactcgacctcaagcgatccaccctcttcggcctcccaaagtgctgggattacaggcgtgagctgaatcttaaaggtgaactacgtggatgaragcttgtagtggaaaagggagacggcataggcaacagcatggtgctgtgacgggaacagcgcatgtggagtccagcaagggattctgcctgcctggagtg

SEQ ID NO: 56763 - DNA, 201 bp, Homo sapiens
taaattaaaaaaaaaaaccccactgtgggtcaataaaaacaccttttcaggccagattggcctgaaggccagcactcagaactagtggcaggggagggctyccgaagggaggatggctgggcaaggggtagggcagggccagccctgggttcttaccactcctctgtcccttcctcttctggggtcttgtttcgttctcca

SEQ ID NO: 56764 - DNA, 201 bp, Homo sapiens
tgggtccaccgagaggctgtcatggggctgtggattggatgccagggaacagcggagtggggaccctgggcctgggaatgggtgccgaccacctccgtccygcgcaggcaatggcaacgagggcagcgtcactggaagttgttattgtggtaaaagaatttcttccgactccccgccatcggttcagttcatgaatcgtct

SEQ ID NO: 56765 - DNA, 201 bp, Homo sapiens
gggacgcctggctccgggcgggattatggatgttgtcgggggcgtgatgatgtgtgggttgagcctggcgctctgaccctgggtccaccgagaggctgtcmtggggctgtggattggatgccagggaacagcggagtggggaccctgggcctgggaatgggtgccgaccacctccgtcccgcgcaggcaatggcaacgagg

SEQ ID NO: 56766 - DNA, 201 bp, Homo sapiens
ttgtttcctggggggactccctgctggtaggggctagctcccggtcctcctctggttccaccttctctgtgctgcctgcacccccgtcctctctcttctcytcttcttcatcttcctcctcttcctcctccccttcctccccatcctctaggctgacaaagctgatgtaggggctcaggtctcgcaggtggagtggagggt

SEQ ID NO: 56767 - DNA, 201 bp, Homo sapiens
caaccagtcagttggccagatcacctcatactgaaactcacagttggcaagtcccaactgtgtacatggaaattctagtcaacttcttggcacctcactctttttttttttttttttagtttcttgagatagggcctctctgtgtcacccaggctagagtgcagtggcgcaatcataggtcattgtagtcctgaactcctg

SEQ ID NO: 56768 - DNA, 201 bp, Homo sapiens
aactttctaacatgaaagacagaaaccaaaataaaaagggggaggtggggacaactgttgaagcttttaggtaagagatagtataaaacatgattgaatcmgaaaaagcatccttggctgggcatggtggcttatgcctgcaatcccagcacttttggaggtcgaggcgggaggatcacttgaggtcaggagttcaaggcc

SEQ ID NO: 56769 - DNA, 201 bp, Homo sapiens
tggccctggtgctgttggtaggggtcagtgtgtatgtggagggatcatctgggacccagacaacttcttcccagtccttccctctaggccaaggggcccaygcctggagagaccccacgcaccaccgcgaagaaggctgagggatggcgtgttgcctcgggggtgtctggagaagcccgggcctggaatcagcatgctgag

SEQ ID NO: 56770 - DNA, 201 bp, Homo sapiens
ctcgttcgccaggctgtaggtagccattatcactctgggaattctcaccaagagtttctcctcagaaacgcgacgcttgttccggaagtggctctcggtgwgcgcctgcgcagagggcaccgtgtagcgagcactacgattcccaggatgctcagcgcagcctcgcctcctcggtccgcttgatgaactacaactcccagg

SEQ ID NO: 56771 - DNA, 201 bp, Homo sapiens; identical to SEQ ID NO: 10654

SEQ ID NO: 56772 - DNA, 201 bp, Homo sapiens
catacttttttttttttgagatggagtttcgctcttgttgcccaggctggagtgcagttgtgcaatcttggctcactgcaacctccacctcctgggttcargcgattctgcctcagcctcccatgtagctgggattacaggcacatgacaccatgcctggctaattttgtatttttagtagagactgggtttctccatgtt

SEQ ID NO: 56773 - DNA, 201 bp, Homo sapiens
tcccccaccccccatttattgccattagatcatatcctttttgtccaatcatacttttttttttttgagatggagtttcgctcttgttgcccaggctggartgcagttgtgcaatcttggctcactgcaacctccacctcctgggttcaagcgattctgcctcagcctcccatgtagctgggattacaggcacatgacacc

SEQ ID NO: 56774 - DNA, 201 bp, Homo sapiens
gagatggtatttggggcttaaaattggagagttcacaccctcaaaagcagagtttaaattaaggctagagaggagagagggctaatcctatcgggaacggyttggtggggagggaagcattttggatgcgtctgtggggtatgggagtgggagcgagggggttccctgggctcggatctgcgtggcgggcagccccggtag

SEQ ID NO: 56775 - DNA, 201 bp, Homo sapiens
tatgggggagtccaagctgaggccccgccatgtgtagtaatcctgccatgagcctggcaggagagggttgctagaggacctggccctggacccccaccccytctagtctaacaaacctcttcttcacagccacccaggctctggttctccagtccctggccctacccctagcttccacagggcccctccagctcaccaaaa

SEQ ID NO: 56776 - DNA, 201 bp, Homo sapiens; identical to SEQ ID NO: 10659

SEQ ID NO: 56777 - DNA, 201 bp, Homo sapiens
cgatatttgctttattaagtatccatctattcattcttctatccatcatccatcaccttatttcttgatgcatttcttttttttttttttttttttttttwatggagtcttgctctgtcgcccaggctggagtgcaatggtgccctcagctcactgcagcctccgcctcccaggttcaagcaattctcctgccacagcctt

SEQ ID NO: 56778 - DNA, 201 bp, Homo sapiens
gatagtcctgattcctcatttctttcctttccagaatgtggacatgcttactcggggattgtggcccaccagaagcatttacttcctaccagccccccaayttctcaggcctcagagggggcatcttcagatatccacacccctgcccagatgctcctgtccaccttgcagtccactcagcgccccaccctcccagtagga

SEQ ID NO: 56779 - DNA, 201 bp, Homo sapiens
aaatggaaaacaggttttttagcttagagagcacctgagtacagttgagggcaagggtactgcgttgaaaacagagattaagccggccgcggtggctcacrcttgtattcccagcactttgggaggcctaggcgggtggatcacctgaggtcagaagttcgagaccagcctgggcaacatggtgaaacccccgtctctact

SEQ ID NO: 56780 - DNA, 201 bp, Homo sapiens
agcacggctatgggggagtccaagctgaggccccgccatgtgtagtaatcctgccatgagcctggcaggagagggttgctagaggacctggccctggaccsccaccccctctagtctaacaaacctcttcttcacagccacccaggctctggttctccagtccctggccctacccctagcttccacagggcccctccagct

SEQ ID NO: 56781 - DNA, 201 bp, Homo sapiens
cgcaccaccgcgaagaaggctgagggatggcgtgttgcctcgggggtgtctggagaagcccgggcctggaatcagcatgctgagctgggtccaatagccaygagtgaggccccgagaggccaggaaggcctctttgttgaaggtttcactggtcacctctggagaaggagaaggggaggagttgaggtgctgggctagaac

SEQ ID NO: 56782 - DNA, 201 bp, Homo sapiens
gaggtgagggccagtcattcaattcacaaattttcactgagcacctactgtgggccaggtcatagtgttgatgtcttcatctgattccctagttcaagctmtcatcccccaaacactgtccttgatctcagagctcatctctcaatttctttatcctttccagatctgccggttcattatatacctgtggcacctgactct

SEQ ID NO: 56783 - DNA, 201 bp, Homo sapiens
ctgacccctgacaacatggtaggcactgtatacatacttgtttttgttttttgttttttagagacggactctatgttgcccaggctgttatggaactcctragtcaagtgatcctcccaccttggcctctgaaggtgcgaggattataggcgtcacctaccacatccagcctacacgtatttgttaatatctaacatagga

SEQ ID NO: 56784 - DNA, 201 bp, Homo sapiens
cgaaagccattgagacaccagctggacgtcacgcgccggagcatgtctgggagtcagagcgaggtggctccatccccgcagagtccgcggagccccgagaygggacgggacttgcggcccgggtcccgcgtgctcctgctcctgcttctgctcctgctggtgtacctgactcagccaggttagccgggggcggggcagggg

SEQ ID NO: 56785 - DNA, 201 bp, Homo sapiens; identical to SEQ ID NO: 10668

SEQ ID NO: 56786 - DNA, 201 bp, Homo sapiens
agggggacccgtgggcactccccaggtttgtggagcaggtgatggtgaagaggaggagagcccagagactttcagaaaaggagatggggaggggccaggcmggaggggagagaagttcccttttgcccccattgcccacctgtaaccggggcagagacctcagccacgtatccttgagagcaaacccggagttaaatcctg

SEQ ID NO: 56787 - DNA, 201 bp, Homo sapiens; identical to SEQ ID NO: 10670

SEQ ID NO: 56788 - DNA, 201 bp, Homo sapiens; identical to SEQ ID NO: 10697

SEQ ID NO: 56789 - DNA, 201 bp, Homo sapiens
accacccagcacccagcaggtgcctcacagacatatgcattctgaacaaggtgtggggtctcttccagcagctgtcagctgtcccttttcccctttctctstagttcacagtacagagccagttgtccaggagaatggggacgaagctggggaggggagagaggctaaagattgtgaccccggctctccaaggaggtgtga

SEQ ID NO: 56790 - DNA, 201 bp, Homo sapiens
acgtaacacatagctgcaggccaggcgcagtggctcacacctgtaatcccagcactttgggaggccaaggcaggcagatcactgaggccaggagttcaacrccaacctggccaatgtggtaaaatcctgtctctacaaaaaaatatacaaaaattagccaggcatagtggcgcacacctgtagtccagctacttgggaggc

SEQ ID NO: 56791 - DNA, 201 bp, Homo sapiens
ggtgcagatacactcgaacttaccctaacctgggagtcagggcaaccttccccaagcatgtgatgtttaagctcatgctgttttaatggatgagttggtgytgctgggcaggaataagcaaagatggtgtttctgccagaatgtcttggaaaaatatgctccttcagaacctacaaatattcttgttttcttttattctct

SEQ ID NO: 56792 - DNA, 201 bp, Homo sapiens
cctttctctctagttcacagtacagagccagttgtccaggagaatggggacgaagctggggaggggagagaggctaaagattgtgaccccggctctccaasgaggtgtgacatcatcatcatctctggccggaaagaaaagtgtgaggctgccaaggaagctctggaggtatgtgtccatgtgcccccctccaccccccgc

SEQ ID NO: 56793 - DNA, 201 bp, Homo sapiens
aaaaaaaaaaaaaaaagaaagaaagaaataggccgggcgcggtggcttatgcctgtaattccagcactttgggagacaggcgggtggatcacggtgtcagragtttgagaccagcctggccaacaatgtgaaaccctgtgtctactaagaatacaaaaatcagccaggtgtggtggcgcacgcctgtagtcccagctactc

SEQ ID NO: 56794 - DNA, 201 bp, Homo sapiens
caaattgggttcaaatgatccttctgcctcagtctcctgagtaactaggattacaggcacaggctaattgtttttattttttatttttttaagaaatgagktctcactttgttgcccaggctggtctcaaacttttggcctcaagtgatccttctgccttggcctcccaaagtgctaggattataggcatgagtcaccatg

SEQ ID NO: 56795 - DNA, 201 bp, Homo sapiens
cgttttttttctgaatgtcatttttagacatgtccctttattcatggtgggtattttcttagaacaaggacattctcttacataattctagcacatttatyggaatcggatttaacattatataacagtagtatctaatatgttgtcggtattcaaatttgccagtttttctccttcagaaacacctacttccccatccta

SEQ ID NO: 56796 - DNA, 201 bp, Homo sapiens
gtgcctctttcttagccagtaacaccaagtgctaattaccattgctttgtagtatgctttgctaattttagttgaatcccagcttttttttttttttttttgcaaaattttctagcctggttttatgtttaggtgaatttttaggagaatccttgttagagttaaaaaaatatcctactgggatgttgtgttactttccca

SEQ ID NO: 56797 - DNA, 201 bp, Homo sapiens
ctttggtttaagggaattttgagactggtttaatcttctagccagaccactcaaactttctccttatcagcgataaggctgtttcgctctcttaccatttrtgtgttcactggagtagcacttttccttcagccttttttctttgcattcacagcttggctatttggtgcaagaggcctagcttttggcgtgtcttagctt

SEQ ID NO: 56798 - DNA, 201 bp, Homo sapiens
tctgtctggtctcctgctcatttatttacatcacacacctcctgggttctgtcttagtgataattattgttgtgtctgttttgtgacacttattgttgtgstgtctattttggtacacacgcggtgtcccagtgtggcctgtaggagcccctccagctgtcttctgtgtcctgttcacacgcctcttcacttctggggctc

SEQ ID NO: 56799 - DNA, 201 bp, Homo sapiens
gaatggtcagtgttatctgccatccctctcctatattgatgtttatttccaaattagggtgtttagttttcctttctttttttttttttttttttttttttgagacggagccaggctggagttcagtggtgccatcttggctcactgcaacctctgcctcctgggttcaagtagtgattctcctgcctcagcctcccgagt

SEQ ID NO: 56800 - DNA, 201 bp, Homo sapiens
aatttgggttttgactttgaactggaatggtcagtgttatctgccatccctctcctatattgatgtttatttccaaattagggtgtttagttttcctttcyttttttttttttttttttttttttgagacggagccaggctggagttcagtggtgccatcttggctcactgcaacctctgcctcctgggttcaagtagtga

SEQ ID NO: 56801 - DNA, 201 bp, Homo sapiens
ataagcctgtatattcaaataatcactgtagataaacacataaagcaaggactaggaaaaatacaaacttaaaaaaaaaaattcaagtgagaaactttaayagagttctctgagaaccggacagattcagtaaacacagtatgtgcaaggacagagaagaactgagtaatacaacaaatacatctgatttagcagacatag

SEQ ID NO: 56802 - DNA, 201 bp, Homo sapiens
aactcctgggctcaaatgatccttttgcctccgcctcctgagtagctgggaagcatactacaggcactgtacctggctaattaaattttttttttttttttgtagagatgggagttgtggggggtctcactctgttttgctatattgcccaagctgatcttgaacttccgacctcaagcagtcctcccacctcggcctccc

SEQ ID NO: 56803 - DNA, 201 bp, Homo sapiens
gattgtgaccccggctctccaaggaggtgtgacatcatcatcatctctggccggaaagaaaagtgtgaggctgccaaggaagctctggaggtatgtgtccrtgtgcccccctccaccccccgccaaggcccagtcagcaggcacctggggagacgcgtggcctggatgggatggacggttgcccaagcggcagtggcagtg

SEQ ID NO: 56804 - DNA, 201 bp, Homo sapiens
tcacaactcattgcagcttctaactcctgagctcaagtaatcctcctgcttctgccgagtagctaggactatagggtgcctggctaatttttattttttttgtcaaaatggaggtttgctatgttgcccaggctggtcttgtactcctggactcaagtccttctgcttcagcctcccaaagtgcaaagtgctgggattaca

SEQ ID NO: 56805 - DNA, 201 bp, Homo sapiens
ttcagtctttctgcttttggccatagacaatacagttaaatacctgtttttctgtccttggctggctgattctaacactgtcatttctgggtggttttctrttttcttttcctcgttatgggttttccccctattctttgcatttctggtgtttcttaatgagggtgtttttgtattcctctgaatattattttgtgtttg

SEQ ID NO: 56806 - DNA, 201 bp, Homo sapiens
agcaggttaagtgctgcctctctcctgttgcttgttttctgtaatatgtcacctttcttggcatgattcctttgtccagtcttccagcgtcctgttgtatrgtgtgggtgggctggggactgcataaatgagttggagcagtgatgttcttggccttgctctgtcctgtgagagaggaccctgcaccatctggggctcctg

SEQ ID NO: 56807 - DNA, 201 bp, Homo sapiens; identical to SEQ ID NO: 10691

SEQ ID NO: 56808 - DNA, 201 bp, Homo sapiens
aaaaccacatattctttttgacacttaagttccacttgtagaactccaaggacatcaatacagatgagcacagatccattttttagcaagcagacggccamactgggattgctgcggggtagcaagttagccaggggaagcttcatgtggctccccagcacagggcagaactgcacgtcacattatgatccagcgtggaaa

SEQ ID NO: 56809 - DNA, 201 bp, Homo sapiens
ggcttatgcctgtaatacatacacatgcactttgtaatcccagcattctgggaagctgaggcagggggatcactggagcctaggagtttgagaccagcctrggcaacaaagtgagacccccatctctacaaaatatagaaaaaagttagctggacctggtggtgtgcctttgtggtcccagctactcaggagactgaggtg

SEQ ID NO: 56810 - DNA, 201 bp, Homo sapiens
atggcgtgaacccgggaggcggaactttgcagtgagccgagatcacgccactgcactccagcctgggcgacagagcgagactccatctcaaaaaaaaaaamaaaaacaaataaacaactttgtattcattgcttcctatatactagtcatcacgctatttatttctagcagtggttatcaccagggtgatttttgttaccc

SEQ ID NO: 56811 - DNA, 201 bp, Homo sapiens
accataaaagagcttacttccctcttttcagaattgtttccctcctctgtaactggtgtccccagtccaaagattctacttccctttgcagacagaaaagygatacctttttgccaggataggagagggactgtgcaggttggctctgtgtggctgtgcagagttgtggggtgcatcttagggatcttcgtgccttttaaa

SEQ ID NO: 56812 - DNA, 201 bp, Homo sapiens
gagaaactatttgtcttaaactgacatttcaactttgctttgactttaccaagtttctcctgccatcttttttttttcctgtttttttttttctgaaacawaacttggatccacaatgttttctctcataatttattaactaatgtgaaatggaaggtgaaagaggaattatgaacctctgaagcacatggttttcagtga

SEQ ID NO: 56813 - DNA, 201 bp, Homo sapiens
ctctttggtcctgtttatttgcaactcatgttcttcaacgctgggcatttttttgatttattgctttgatttcttcctatttgctttctctctctctctctagaattctactcttggactttctggattggcactcataattttcttaaggtttctttttcccccctctaaaatttttgtttttgtttttatcttttaaat

SEQ ID NO: 56814 - DNA, 201 bp, Homo sapiens
tacccgcagacagggcctagtcgctctcccctcgcttatccacggcatccagccgatgggcttggaggtttgggggctggccagtcctccacgcctcaggraggaaatggcaccgttagaaagacaagatggccacacaagctctaagtgtttgtcgggcctaaacctgtatcctccctccaagcaccaaacctcccgacc

SEQ ID NO: 56815 - DNA, 201 bp, Homo sapiens
ggcggcctccaaccctataccctaccccctgctgcctgtccgtgcctcgctggtgcagaccttcgtcgcctctcctcgccgaaggtacccgcagacagggyctagtcgctctcccctcgcttatccacggcatccagccgatgggcttggaggtttgggggctggccagtcctccacgcctcagggaggaaatggcaccgt

SEQ ID NO: 56816 - DNA, 201 bp, Homo sapiens
gatttcatcgcacaatcattgggcagaagggtgaacggatccgtgaaattcgtgacaaattcccagaggtaaagtttcccagagacattctgtaactctayaggagtgatccaagtcacacttcaggaatatttgatatttgggatatatgtccttcctcatacttgaacttagtctccccatgatttgttctaggtcatc

SEQ ID NO: 56817 - DNA, 201 bp, Homo sapiens
aaaaaagtccaagtcctacacgctctctttttgcagcttgatcattttcatttaatgtacagtagtctgtgctttttccagactgatacgtgagccgttgsattcttgttggtaacagcgccttactgtgtggtgtccttgtcccacttagtatgactgccttcgtgctgacgcacactcgtgttcttccagttctttgcc

SEQ ID NO: 56818 - DNA, 201 bp, Homo sapiens
ggtctagtgtgagagacttatttgtagaagagtaattacattatggtgtgataagtgcaatgatagaaatatgtgtaaggtgtggacataggaaataggcwgtggttacctgttggaaagtcttcctacagaatgtggtccttgaactgcggtttaaaagacgagtaagagtttttccaggtggtgctgagtggacaggaa

SEQ ID NO: 56819 - DNA, 201 bp, Homo sapiens
acactcgaacttaccctaacctgggagtcagggcaaccttccccaagcatgtgatgtttaagctcatgctgttttaatggatgagttggtgctgctgggcrggaataagcaaagatggtgtttctgccagaatgtcttggaaaaatatgctccttcagaacctacaaatattcttgttttcttttattctcttcttgctat

SEQ ID NO: 56820 - DNA, 201 bp, Homo sapiens
taaccagagaggattgtatgttcttaggtttcataagtatcttaagaaacatgtcatttagtaattatggtgaaataacttcatgatactttggcgggccrggtgcggtggctcatgaggtcaggagatcgagaccatcctggctaacatggtgaaaccccgactctactaaaaatacaaaaaattagccgggcttggtgg

SEQ ID NO: 56821 - DNA, 201 bp, Homo sapiens
tcgccatattggccaggctggtctcgaactcttgacctcaggtatctgcctgcctcagcctcccaaagtgctgggattacaggcacgagccaccgtgcccrgcctatttgaatcttttgaaatgatcaaattatctttgcccctcatgctgttaatgtggcgagtaactttactctgtttttctaatattgtaccccccca

SEQ ID NO: 56822 - DNA, 201 bp, Homo sapiens
tccatggttcttagctctttcattcgttccatctctcgattttttttctaaaatgtcacctttatgtctcttatgcttttttattgtctcaatcttagttytgtctcccgaagttcttgagtctaatcctacttctaatccatccttccttctttttgagctttgggcttttagcctctctaccatttgtgctgatctgtg

SEQ ID NO: 56823 - DNA, 201 bp, Homo sapiens
ccttgtccctcctcagttcttctccataaagcaacgggagggaccctgcaccatcaagcagaatgcctcctgctgaaaagcctgtgttgacttttactacrgggtgggatgggtgatcctcttcactgtccccctctggtgtgtgcaccaggctccgcccccatccacctcctccgctttcctgcctgtacacccttagtt

SEQ ID NO: 56824 - DNA, 201 bp, Homo sapiens
cgttacgttattgggcagaaaggaagtgggatccgcaagatgatggatgagtttgaggtagacccctttcccgggaggccatgtcacaggagtggcctgtygcatcctctcccgagtgccagtgtcctttctcaacttcctgttgactctgcctcctcctgctcggactgggcactgacttcccttcacggcgggtggcct

SEQ ID NO: 56825 - DNA, 201 bp, Homo sapiens
ggtacacacgcggtgtcccagtgtggcctgtaggagcccctccagctgtcttctgtgtcctgttcacacgcctcttcacttctggggctctcgctttctgrcataaggagctggcacaggtttaccttggccttgccctttctgtctcccctagacctctcaccccccttcccactgcctctcctgggtggggctgcgtgc

SEQ ID NO: 56826 - DNA, 201 bp, Homo sapiens
gtagggaccaaactagaaaacaggtcctacataaatcaaatcatttttattttccccaaatgagtatgttatttagtccatttctaactggaatccctaayggtgtggcttttttcttaaaggattggataaaatgagctttaagttcacatggaaagattaaatgccaatgctgaggatagaaaagagcaggcacttacc

SEQ ID NO: 56827 - DNA, 201 bp, Homo sapiens; identical to SEQ ID NO: 10715

SEQ ID NO: 56828 - DNA, 201 bp, Homo sapiens
aagccgtcctgatcccaagggacagggcagggaaggtgagtagtggtccgagagtcccttgtggcacctcatgggcatcggtcaaagccgtcatgaccccraggatgtgccaggagtcagggcctctcctcctacgtgggcctgaaggggctgctgtaattcaggagggtaggcttgggatgaagggtctggaatttctgt

SEQ ID NO: 56829 - DNA, 201 bp, Homo sapiens
caaaaagaacctgtccccaaaaaagggcagcaagaggaagagggatgtgactcagtgtccggaggtagagcagccactgacaaggatagggagagggctgsggggagggccgagactgggctgtacagttcacctcattctcagccagtgcctgcttagccaggtagtactcccgcttcactttgatctccacagactctg

SEQ ID NO: 56830 - DNA, 201 bp, Homo sapiens
gtgctgcagacaggagcaggggttctggaacttggagcagactgtgctggggtgctggtttgctaagggggttggctttccactcctcccgtgagcacgtygagtctggtgaatggggtggagctcgtgaacctcacatggtgtcagtgtacccctgcgtggactctgggttgtctcctgcagccaggtcatacctgtagc

SEQ ID NO: 56831 - DNA, 201 bp, Homo sapiens
aaattttttttcttttttttttttttgagacagagtcccgctctgtcgcccaggctggagtgcagtggtgcgatctcggctcactgcacgctccgcctccygggttcacgccattctcctgcctcagcctcccgagtagctgggactacaggtgcccgccaccacgcccggctaatttttgtatttttagtagagacgggg

SEQ ID NO: 56832 - DNA, 201 bp, Homo sapiens
tctcaccccccttcccactgcctctcctgggtggggctgcgtgctggccgccttccctgatgagccctgcctcacagtcaagcctcacttgtgcagtgggyctgccctgtgttcctcccatgaactaactcatctgatctcactgaagcctctgctgtagttagttgctgttagcttcatcttcaaggtgaagaagggaga

SEQ ID NO: 56833 - DNA, 201 bp, Homo sapiens
actctttggtcctgtttatttgcaactcatgttcttcaacgctgggcatttttttgatttattgctttgatttcttcctatttgctttctctctctctctctagaattctactcttggactttctggattggcactcataattttcttaaggtttctttttcccccctctaaaatttttgtttttgtttttatcttttaaa

SEQ ID NO: 56834 - DNA, 201 bp, Homo sapiens
gtttaccttggccttgccctttctgtctcccctagacctctcaccccccttcccactgcctctcctgggtggggctgcgtgctggccgccttccctgatgrgccctgcctcacagtcaagcctcacttgtgcagtgggtctgccctgtgttcctcccatgaactaactcatctgatctcactgaagcctctgctgtagtta

SEQ ID NO: 56835 - DNA, 201 bp, Homo sapiens
tgttttcatccatcgtcttgcctactctttggtcctgtttatttgcaactcatgttcttcaacgctgggcatttttttgatttattgctttgatttcttcytatttgctttctctctctctctctagaattctactcttggactttctggattggcactcataattttcttaaggtttctttttcccccctctaaaatttt

SEQ ID NO: 56836 - DNA, 201 bp, Homo sapiens
aaataagaaagctgaggccaggcgcagtggctcacgcctgtagtcccagcactttgggaggctgaggcgggcagatcacctgaggtcaggagttcgagacyggcctgaccaacatggagaagccccgtctctactaaaaatacaaaactagccgggcgtggtggctcatgcctgtaatcccagctgtgggaggctgaggca

SEQ ID NO: 56837 - DNA, 201 bp, Homo sapiens
ctttagcgctgtcctgcccagttatgtcattggcagaatgttgttggtctgtgtcctaaatgtgtttccttttgtgttcctaagtaaacagaatcaaagaycagtacaaggtgtccgtgcgcatccctcctgacagtgagaagagcaatttgatccgcatcgagggggacccacagggcgtgcagcaggccaagcgagagc

SEQ ID NO: 56838 - DNA, 201 bp, Homo sapiens
ttgggcatgggcggtcatctctcgatgacatcccacatgtccgggcacagacacccagggcatcctagctgggtgagtaataggttctgaaacaaccagargctggtcgaagtcctggaataatcgtgggtggaggaaacttcatcttgaagaaggcatctttcaggggagatgcaggggcagtctccaacaattcctgac

SEQ ID NO: 56839 - DNA, 201 bp, Homo sapiens; identical to SEQ ID NO: 10702

SEQ ID NO: 56840 - DNA, 201 bp, Homo sapiens
actttgtatagcttcatataaggaccagtctgccttccttaactccttacctggaggataataaaccaggaactctggcagccttgtctatgtcaagcaarttactttaccaccttggtacagctatacgagttttaaaattccatccgtgctctgtctcattctttatgcaactcaagaggaccaggccttgtaaaagtt

SEQ ID NO: 56841 - DNA, 201 bp, Homo sapiens
ttacatcctcctgcctgctggaagaggccacttttccttttccctttggtgcagtggttggattagagctgcttggccagtgggtgaattgtcacttttgraaatccatctaagccctccccaaataacccacagaggccatgttgaaggcatgcccaagggcagcattctctatatttccgtcagacctgctaggttagc

SEQ ID NO: 56842 - DNA, 201 bp, Homo sapiens
cctggccagtatggcgaaaccccatctctactaaaaatacaaaaaaattagccaggcgtggcggtgggtgcttgcaatctcagctacttgggaggctgagrcaggagaatcacttgaacccgggaggcagaggttgcagtgagccaagatcatgccattgcactccagcctgtgcaacaggagcaaaactctgtctcaaaa

SEQ ID NO: 56843 - DNA, 201 bp, Homo sapiens
ggcagcattctctatatttccgtcagacctgctaggttagccaatcagtgttggtagtactcatgccttctgaacgtggaaactgctgatctggaactcaytgaagagtaaaaacattctagatttgtgcccaagtaaaacaacatggggagggatacttttttgagacagggtctcactctgtcacccaggctggagtgc

SEQ ID NO: 56844 - DNA, 201 bp, Homo sapiens
tctgtgcgtatccatcagatccctgtttgacaaatgaggagagcggggccccaagctcgtgactcactgcctagctctgtcagttcctgagcacgatcctygcaagtggtcccaagccctcttttgaaggatttatagacctccttgtggagcagccaagttccctggttctcattattagcagataatggaaggtggcag

SEQ ID NO: 56845 - DNA, 201 bp, Homo sapiens
ctggtatttcctgtgttaatgataatggtttcatgtttaatgtctaggaccactgttaacacctccaccctgcactattctttttcagggttttcttgttyatttttgttggttctgtgttacaacctttataatcaactgtttgaaattgtattaatattttaaagttaattgggatgatcgccatctacttaaaccttc

SEQ ID NO: 56846 - DNA, 201 bp, Homo sapiens
tgtatttcttgtcttttttgttgttgttattagattgatgtttttgtctttgtgtttaaccagccttgcgtttctggggtaatccctgcttggtttggtargttgtctttggccatattgctagattgcatttgcctaattgattgcctaatgtttgactaatgctgctatttgtggatgtctttgaaaagtagcagagtc

SEQ ID NO: 56847 - DNA, 201 bp, Homo sapiens
gtggcacctcgtgggcattagccaaagccgtcctgatcccaagggacagggcagggaaggtgagtagtggtccgagagtcccttgtggcacctcatgggcrtcggtcaaagccgtcatgaccccgaggatgtgccaggagtcagggcctctcctcctacgtgggcctgaaggggctgctgtaattcaggagggtaggcttg

SEQ ID NO: 56848 - DNA, 201 bp, Homo sapiens
caggggcggcgaggaccacaaagcccacctgcctgaggagaactgtcgtgtccaggggcctggggaggccaccgagggacagggtcccttgggtgcagggrccccttgggcttatgtctgggagcaggaaacaaagagggccttgtgagctgacggtccctccctgccggggatggagtgacaggcgctctgaggagagaa

SEQ ID NO: 56849 - DNA, 201 bp, Homo sapiens
ctcgactccctttatacccttaaaagaaacagtggcagttatcacttagtaaacacaatggatgcagaagtgacaagtccttcccggagggtggagacccygagagtagggattccgttccgcccagtcctgcgtatccaccgtgggctcagaggccacacaccggttcttttgcgtgtatacatctatgtagagatggag

SEQ ID NO: 56850 - DNA, 201 bp, Homo sapiens
aaaaaaaagaaaaaagattatgatgtttgcatttaattacagttgtgattatatatgttatatatcacatatttatatttattacatatgtttaacaaacrcggttaaataacttactgtaatttttttcctcaattgtggtaaaatatacatagcagaatgtatcattttaatcgttttttaatggttaattcaactgag

SEQ ID NO: 56851 - DNA, 201 bp, Homo sapiens
cacttcccttcaccaaggctcggggttctatagcccctttctgggacagctgcatgggatccggcctctcaggcccacggtgggtgcgggggctgtggaarggtctcagctgcagggggatgaatgtgacctccagttgcaacgtctccccccgcgtgagtggggttatcaggcctagctcaccttgtgtgcagtcagtgt

SEQ ID NO: 56852 - DNA, 201 bp, Homo sapiens
cagaagtgctcactgaattgctttggtgattactgctatcatgatagcacttttggttgaagggtcctacagcgagttccttaattggactttgttcaggraagtgacgtgcagcccatgttgcggagtgtagcgatgcttggtgagagcactcattatgcgctgtgcacactcttaacagctggttgctcccggggtgct

SEQ ID NO: 56853 - DNA, 201 bp, Homo sapiens
cgcagtcatagctcactgcagccttgaactcatgggtcaagtgatccgctcgtctcagcttcccaagtagctggcactacaggcgccccaggctagttttygtggaggcagagtcttactagttgcccaggttgatctcgaactcgtgggatcaagtagtcctcctacctcagcctcccaaaatattgaggttatgggtgt

SEQ ID NO: 56854 - DNA, 201 bp, Homo sapiens
actgcattccagccttggcgacagagcgagactctgtctcaaaaaaaaaaaaaaaatactttgaagagcagaacttgtatacaaattgtattaagtgtgartttaaagcgttctcagtttaccaaaggagattgtagcccccaggaaacatgaacaaaaaagaaataccagagaatccaaccatcatatttaattcctgtt

SEQ ID NO: 56855 - DNA, 201 bp, Homo sapiens
ctgtgttaatgataatggtttcatgtttaatgtctaggaccactgttaacacctccaccctgcactattctttttcagggttttcttgttcatttttgttkgttctgtgttacaacctttataatcaactgtttgaaattgtattaatattttaaagttaattgggatgatcgccatctacttaaaccttctgttagctat

SEQ ID NO: 56856 - DNA, 201 bp, Homo sapiens
agttaattgggatgatcgccatctacttaaaccttctgttagctattttaaggagtgttttctaatttcgaatgcacatactccaccttgtgttgggcttrtgtcttgctattttcttgtccttttttcttttttccttttttctattagaaacacatcttttggccaggcgcagtggctcacacctgcaatcccagcact

SEQ ID NO: 56857 - DNA, 201 bp, Homo sapiens
tctttttcagggttttcttgttcatttttgttggttctgtgttacaacctttataatcaactgtttgaaattgtattaatattttaaagttaattgggatratcgccatctacttaaaccttctgttagctattttaaggagtgttttctaatttcgaatgcacatactccaccttgtgttgggcttatgtcttgctattt

SEQ ID NO: 56858 - DNA, 201 bp, Homo sapiens
gcacagtgctcctaagaggcaggtgaacaagtagcaaatcctcaagaaatgctacaagcaagcacgccgccctcaggccaggcatcacggtgggtgaaatrgaacgcaggcgaggatgttcagaaagaggccttttctgtggagtaagtttggcagtactcatcaaagcacattaaaaccacatattctttttgtgtgtgt

SEQ ID NO: 56859 - DNA, 201 bp, Homo sapiens
atcaactgtttgaaattgtattaatattttaaagttaattgggatgatcgccatctacttaaaccttctgttagctattttaaggagtgttttctaatttygaatgcacatactccaccttgtgttgggcttatgtcttgctattttcttgtccttttttcttttttccttttttctattagaaacacatcttttggccag

SEQ ID NO: 56860 - DNA, 201 bp, Homo sapiens
tggggtgtctgcttcctaggcgtgtccagcacagctttgcccacagtgggagactagcaagccttggtggccacagttgtgctggtttccagaaacagcaraccccctggcagcagagcccctccacgcccctcgctcccactgtggatgtgccgcccagggttttccgctgcttccccttccccttccccttcttcctcc

SEQ ID NO: 56861 - DNA, 201 bp, Homo sapiens
tttccccagaaatgtttgagcctgccacgtgtgccatgtttgtgtttgtggtagaggagatgctttcatgattgagaagaagacgcattttatactctttycccctaatgtaaatttattcattaaacacaaaagatttgtaataaaatattttttccttaagattgttatataaagtttactaatgagaaaaactccctt

SEQ ID NO: 56862 - DNA, 201 bp, Homo sapiens
ttatcatgtcctaaatgtttatattaacttagctctgtttctgggttttcagttcagaccagcaggtctttccgtatactggtatttcctgtgttaatgawaatggtttcatgtttaatgtctaggaccactgttaacacctccaccctgcactattctttttcagggttttcttgttcatttttgttggttctgtgttac

SEQ ID NO: 56863 - DNA, 201 bp, Homo sapiens; identical to SEQ ID NO: 10688

SEQ ID NO: 56864 - DNA, 201 bp, Homo sapiens
gtggctgcttttatcatgtcctaaatgtttatattaacttagctctgtttctgggttttcagttcagaccagcaggtctttccgtatactggtatttcctrtgttaatgataatggtttcatgtttaatgtctaggaccactgttaacacctccaccctgcactattctttttcagggttttcttgttcatttttgttggt

SEQ ID NO: 56865 - DNA, 201 bp, Homo sapiens; identical to SEQ ID NO: 10689

SEQ ID NO: 56866 - DNA, 201 bp, Homo sapiens
tccctgccggaagagcccttccatggaggcagggcacagtgctcctaagaggcaggtgaacaagtagcaaatcctcaagaaatgctacaagcaagcacgcygccctcaggccaggcatcacggtgggtgaaatagaacgcaggcgaggatgttcagaaagaggccttttctgtggagtaagtttggcagtactcatcaaag

SEQ ID NO: 56867 - DNA, 201 bp, Homo sapiens
tcgtggccctggggctcctgtggagacacccacaatgtccacaccacaacccagggatgaggccaggcagggaaaacgcaggtgcagagaagagctctgayttgaccaagatgacacagcaggaagtgacggcaccgacccctcaccacgtgctcgaattaggcaaagcacagggtcggggcctcatgccatggatgggag

SEQ ID NO: 56868 - DNA, 201 bp, Homo sapiens
tgtcccccccgccccccaaaaaagaaacaaaaatgaaaggatggtgtctttgactgtactgggagtcaggagacctcacttcaattttgggcttttcctckttttttttttttttttgaataggttcagagctactccctggacctgttcttatcagccttatgacttggggacttgggatacttttttttttttttttaa

SEQ ID NO: 56869 - DNA, 201 bp, Homo sapiens
ggaagttgggcaaggatcaaaaggacacatgtaattgctgcagaatgcaagtaaagcggcactgtcagaggctgcctgtagtggctagggggaaagcagascctgattcaagaaacagaagaatccagaggacccagataactgggaatggagggaggggttcaacagacctttgctgtggcctgggacacagagctgcag

SEQ ID NO: 56870 - DNA, 201 bp, Homo sapiens
tgcaggggccccttgggcttatgtctgggagcaggaaacaaagagggccttgtgagctgacggtccctccctgccggggatggagtgacaggcgctctgargagagaagccggcgctggggggaagcaggcaatgtgcccagagatgaggcacaacagcagccagcggttcacacagccgctgcctgagggaagaggaaaa

SEQ ID NO: 56871 - DNA, 201 bp, Homo sapiens
aagagaatagaagagaatcatatgcctgtcacccagctttcacagttgtcagcattttactatagccctgcccactcccaatattttatatttttcatttsagtattttaaagcaaatctcagacttttagtcacctctaaatactttagcatgtattttttaggaaacggctttaaaaaacataaccacaataccttcat

SEQ ID NO: 56872 - DNA, 201 bp, Homo sapiens
tggttatttaaaactttgattttgatagaatttcacagaatagtataaagacacatcctgtggcaccagtttcttttctcaacttctccccttttacacaygttttttttctgaatgtcatttttagacatgtccctttattcatggtgggtattttcttagaacaaggacattctcttacataattctagcacatttatc

SEQ ID NO: 56873 - DNA, 201 bp, Homo sapiens
ggcatcatctccatgattcaggcttctcgtgtatatgtgtgtgtgtaaaatttttgttttgccaacttgccaagcttgccttcactgttactagagcttcrttataatagagaggttttctaaacaggtcatctgcagacagtggtatttgtctccttgcttcattctgtctctttagatggcctattggacagtctttga

SEQ ID NO: 56874 - DNA, 201 bp, Homo sapiens
ggtgttttgagtaggaaactaataaactcatactgcactccgtctatgttttacacttcagtggttatttaaaactttgattttgatagaatttcacagartagtataaagacacatcctgtggcaccagtttcttttctcaacttctccccttttacacacgttttttttctgaatgtcatttttagacatgtcccttta

SEQ ID NO: 56875 - DNA, 201 bp, Homo sapiens
gagcagactgtgctggggtgctggtttgctaagggggttggctttccactcctcccgtgagcacgttgagtctggtgaatggggtggagctcgtgaacctyacatggtgtcagtgtacccctgcgtggactctgggttgtctcctgcagccaggtcatacctgtagcctttggccatgggtgttcaggggctgtggctgcc

SEQ ID NO: 56876 - DNA, 201 bp, Homo sapiens; identical to SEQ ID NO: 10711

SEQ ID NO: 56877 - DNA, 201 bp, Homo sapiens
acaccacaccggtttattgtgtgccagctcgggttaagtgctgtctatgtatatgctcatggtaacacaaaaggcattaatatcaactttttataggagargagacaggcccaggaaatcaagatctgtaattatttcttctttttgttatcttggcccttaacttttagaagttcacacatttaaacattccatcttgac

SEQ ID NO: 56878 - DNA, 201 bp, Homo sapiens
atgaacctctgaagcacatggttttcagtgagaaagccttgatccagcaacacaaactgccaagcactgtgattaacttaaacactgggtgcaaattggaycaaaaatgtagtcaaatgaaaattttgttccttcagatcgtgtttattccacatgccagaagttgtttaaagttctttaatcttgacccacagcttattt

SEQ ID NO: 56879 - DNA, 201 bp, Homo sapiens
ctctaaaaagccctgtctgtccccagtttgttttcaaaggcctgttctcatcagatcatcccttcctttccaggacaaacgtgctgtggagaggctagaartagaaaaggcattccaccccttcatcgctgggccgtataatagactggttggcgagatcatgcaggagacaggcacgcgcatcaacatccccccacccag

SEQ ID NO: 56880 - DNA, 201 bp, Homo sapiens
tttgtcttgttttctgtctttctgtttctgatattgctttgttgacctttgtactgtggatgcccttgaaaactggtgtatttttctgaattaactggcckgtttgacatggtcaacttccgtgttagcttaaagaacagcagaataaatgtctgtagatgtctgtaccatccttctggcctttaaccagagaggattgta

SEQ ID NO: 56881 - DNA, 201 bp, Homo sapiens
gctgttgtactagataggcttatttaggaatgggggttcttcccatctgctactgagtctccttgatcttgtgggagctggatctggagcaccctggagcrtggtgattggacgatggggatttgatgggagagggcctgaggggtaggagtgcagggtgtagccaggaggcgaggcagaggagtgccacctaatgcaggt

SEQ ID NO: 56882 - DNA, 201 bp, Homo sapiens
cactcgaacttaccctaacctgggagtcagggcaaccttccccaagcatgtgatgtttaagctcatgctgttttaatggatgagttggtgctgctgggcargaataagcaaagatggtgtttctgccagaatgtcttggaaaaatatgctccttcagaacctacaaatattcttgttttcttttattctcttcttgctata

SEQ ID NO: 56883 - DNA, 201 bp, Homo sapiens
tggtcatggtggaaaattactatctcgctgccagtgtcttccctgaattttaggctcataaacagttgcatcccaatccttccattttcacctgtctgctmtcttgttaatggttttgttaaatgtaccactgtctacttggtgactgtggtctcacaccagggtagttgatccctcttgcttccaccttgtccctcctca

SEQ ID NO: 56884 - DNA, 201 bp, Homo sapiens
gtgctgggattacaggtgtgagccaccacgcccggcctccacggcaatcatttttaaccttgtatgttacagtggaaaatcagagtttgcttcaaaggcarttctcacaggtggtgctgggtaggaccattgttttgcaaatgcaggggtctgctctgtgcctggcattgccatagttgtgatttttttaagtgtgttatt

SEQ ID NO: 56885 - DNA, 201 bp, Homo sapiens
tccatttgaatgccagattttcatccaaaatccttgatctgtgtttagatgttataaaatcttcatttgaaagagcagattgttctactccaggttgttcraaacacacttaaaagttttccaataactaaattgagtattagttcttaaaattaattaaaatataaaattaacttttccttagtcacactagccacattt

SEQ ID NO: 56886 - DNA, 201 bp, Homo sapiens
gtctaatacactgtcatttcaacatctctaatgtaaaaaaaagggggggaaccattgatatttgagattatttctcttcgaagtctgatgtgtatttacarcggtgggacatttccttccatttgaatgccagattttcatccaaaatccttgatctgtgtttagatgttataaaatcttcatttgaaagagcagattgtt

SEQ ID NO: 56887 - DNA, 201 bp, Homo sapiens
ttgcagagagagaccgctggctttttgtagcaactgtcatgatgcattttgtaagcattaagaggtgtgtggtgagcaaattgacagaataaccaaggtcrctgttaggagaacgatcctggtgttgatctatgcctggagcctgggtcaggcaggtggcaggttccatggtccccccacccctgcggttaggggtggtgt

SEQ ID NO: 56888 - DNA, 201 bp, Homo sapiens
gcatgccaccacagccaattaatttttgtatttttagaagagacggggtttcaccatgttggccaggcttgtctcaaattcctgggctcaggtgatctgcycaccttggcctcccaaggtgctgggattaaaagtgtgagccaccacacccagcagggggattctgttgaagaggcagtgatatgtcagccaaggtcgcta

SEQ ID NO: 56889 - DNA, 201 bp, Homo sapiens
agcgaaagcacacgtggaatggctgagctccccatctgtgtaaagtttccaaggttcccgccccgggccgtgtgtgctgtccgccatgctccggccggtgstgtccagccccagggcgctgtgagcctgcatccctgccggaagagcccttccatggaggcagggcacagtgctcctaagaggcaggtgaacaagtagcaa

SEQ ID NO: 56890 - DNA, 201 bp, Homo sapiens
tgcactgttttcgcattgctgtgcgtgcaggggcgactggccaggcatgaggaaatgaatcaagtacagtgagatttaacatgtgggcagctttctggaargccagcgaatttgaccattggtaattaatgcagtccttttcaaaactgctttttcctaattgtggtaaactaaaatctgggctctgaagcatcccagagc

SEQ ID NO: 56891 - DNA, 201 bp, Homo sapiens
gcatgagcacaggaatttgagaccagcctgggcaacatggtcagaccccatctctacaaaaaatagtggtggcgtgctcacctgtaatcccagctacttakaagtctgaggagaaaggattgtttgagcctgggatgtggaggcttctgtgagcagtgtttgcaccaccacagcccagcctgggtgacagagtcccagaaa

SEQ ID NO: 56892 - DNA, 201 bp, Homo sapiens
ggggggagattaagttgattgccaaggaatcgggtggggatagtttataaaagtgagggacataaggaataggcacgcaggaatgagggaatgaaagcccyggagccgcctgggagcctcactgcgctgtaggacctcgtgccagtgtggccatccgtttacgatgtggtgggcatcctttgaggtttttcttctgatttt

SEQ ID NO: 56893 - DNA, 201 bp, Homo sapiens
taaatatgcaacccacagtaaagcacacaactgcaaaatgaccctaagccaaacacgaagcagcccagcagccaggaggggctgagatggatgctcggcayggatggagctcgcgcaatgtcccacggcagacgccaaatgcaaagtccccagttccatctctgcttggtggctaaggtggtggctactctggatgggaaa

SEQ ID NO: 56894 - DNA, 201 bp, Homo sapiens
ctcctgaagccgtgtcctctctctgcacaggctcctgacatgagcagctctgaggaatttcccagctttggggctcaggtggctcccaagaccctcccttkgggccccaaacgataatgatcaaaaagaacagaaccctctccagcctgctgacccaaacccaaccacacaatggtttgtctcaatctgacccagcggctg

SEQ ID NO: 56895 - DNA, 201 bp, Homo sapiens
aggcgggtggacacttgaggtcaggagttcgagaccagcctgaccaacatggtgaaaccctgtctctactaaaaatacaaaaattagcctggcatggtggygcgcgcctgtaatcccagctgctcaagaggctgaggcatgagaatcgcttgaacccaggaggcggaggttgcagtgagccgagattgtagcactgcactc

SEQ ID NO: 56896 - DNA, 201 bp, Homo sapiens
catcctctgctggaaaggcgagaccctttaatccagtctactggatgctcccccattgccatgaaccgccttctcagctccggacccatgtgtcgtaaggrcaagattattgtcacggtacgagtagtcttctccagttgagtggggtgttcctgttactgtcattgcttttcccattttagacacatgcctcactcctgt

SEQ ID NO: 56897 - DNA, 201 bp, Homo sapiens
cactctaaattcagaagaggagagcgaccctccaacctacaaggatgccttccctccacttcctgagaaagctgcttgcctggaaagtgcccaggaaccckctggagcctgggggaacaagatccgacccatcaaggcttctgtcatcactcaggtagaaacaccattctttcttttaaaaattttatcatgtaacatgtc

SEQ ID NO: 56898 - DNA, 201 bp, Homo sapiens
tacctgcagcagacacaggactcagtgcgcgcagccagggctgagtgttggctgggcaggtgcctctggaattagcctatctcccctttttccaccatttygctctctcatcccatgttcctggcctggctcttcatcgagggtgcctgaaatgggaattcttcccaaacaggatactctgacaatacctttaactggtgg

SEQ ID NO: 56899 - DNA, 201 bp, Homo sapiens; identical to SEQ ID NO: 10686

SEQ ID NO: 56900 - DNA, 201 bp, Homo sapiens
tgggtgacagagcgagactccatctcaaaaaaaaaaaaatgccgaacatgtttatccctgacccagcagttctgttgggccctaaatatgcaacccacagyaaagcacacaactgcaaaatgaccctaagccaaacacgaagcagcccagcagccaggaggggctgagatggatgctcggcatggatggagctcgcgcaat

SEQ ID NO: 56901 - DNA, 201 bp, Homo sapiens; identical to SEQ ID NO: 10687

SEQ ID NO: 56902 - DNA, 201 bp, Homo sapiens
ttggcggggccggccctcccctcccccgctccggcgggggcgccgtgtgcggccagggtgggggtccctgggaggccagcggggtccttccccccaggtgkcggcggggcgggggtctgggcgcagaccgggcggcggggcccccgcagcacctccacctgccgcgcggggcccgcgtcagtctacgtgttcgggggtggg

SEQ ID NO: 56903 - DNA, 201 bp, Homo sapiens
tctacctatcttctggtaagtgtagcccttttggggatcatgactttatggaataggagggtatctcttctcacctcctaccttgagcagacccaaacttytcccccgtccctttgagggctgaaaactcaaatgtcacagacagacgttcacacttcatttggtctgaatattgctagccatggaatttctaaaatttgc

SEQ ID NO: 56904 - DNA, 201 bp, Homo sapiens
ctttttttgatctacctatcttctggtaagtgtagcccttttggggatcatgactttatggaataggagggtatctcttctcacctcctaccttgagcagwcccaaacttctcccccgtccctttgagggctgaaaactcaaatgtcacagacagacgttcacacttcatttggtctgaatattgctagccatggaatttc

SEQ ID NO: 56905 - DNA, 201 bp, Homo sapiens
catggtaaagatgtgacattccattttctaatataaagttacatgttgcactccatgaaaactattaccagggtcaactttgtaggaaaataaaaaaaacmaaaaaccaaatattgcaagttaaaaatatagccattggaaaaaaaatccctcaaatgaatggaataaacttttaagtggccagacacagcagaagagaga

SEQ ID NO: 56906 - DNA, 201 bp, Homo sapiens
cacctccacgggggaggccagtggggaagggctgtcacctcttccccatctgcatgagttctggaactctgtcctgttggctgcttgcttccagctccccscaatctccatcgcagcgggttcctcctgtcttttctacagtgtcataaaacatcctgcccctaccctctcccaaaggtcaattttaattctcaccaagtt

SEQ ID NO: 56907 - DNA, 201 bp, Homo sapiens
ttatcctgctagacaccttctctgtcttttttgggatgagggaagaatgttgtatcattaaatcttagaattttctcagctattttaaaaaatgtttcttytctgttctttggattttttcttttctctttttgttttggaactccagttatagacatatgttagagtttctcattccatggttcttagctctttcattcg

SEQ ID NO: 56908 - DNA, 201 bp, Homo sapiens
ccagtggggaagggctgtcacctcttccccatctgcatgagttctggaactctgtcctgttggctgcttgcttccagctccccccaatctccatcgcagcrggttcctcctgtcttttctacagtgtcataaaacatcctgcccctaccctctcccaaaggtcaattttaattctcaccaagttttgcacatctctgtatg

SEQ ID NO: 56909 - DNA, 201 bp, Homo sapiens
gaaaaggacgctgctcgcagggctcaggaggggccactcccctaaggaccaccagatgtccttccaggcgtcactgctgcagctggctggccttgggaacygtgaagggtgtccagtgggagctgagctggggagagggttgggggcagggacaagtcagactagggccaggagcaggccatggccacgaggcacagtggg

SEQ ID NO: 56910 - DNA, 201 bp, Homo sapiens
gaatctagggaagttcttcaggatcccagcatcccagcgacatctggctggaggtgagatgcaggcagtgccaggacgcagtcagcatccaggggtcttgmtgtggaactagccaagagcatggcacctttctctttttcataaaaaagtgacaaagttggacttccgtgtaaatttgcagtttctctcaaaaccaaatca

SEQ ID NO: 56911 - DNA, 201 bp, Homo sapiens
tggatgggggtaggttcgctgtcagagactgggagtctctggcctcctctagctctcacactcagggtgctgggcctggtgacctcctggggccttttccyatcactatgaattagaagagaggggtggggggagttgtccttggagcatttgatggttcttgtttgtctgtttttaagcactaaaacccttaaaagtgtt

SEQ ID NO: 56912 - DNA, 201 bp, Homo sapiens
cacatctgaggcaggcaatgtcagtgtctgtggtgtctgcgttgggcccactctgctgctcccttgttctctgtgtctgtccccggcactagcaccacagyctgaattactgacactggagagagcaagccctcctccacgttgttttcttcagagttatattagctgttcttggtccttgatcttttgtataaattttgt

SEQ ID NO: 56913 - DNA, 201 bp, Homo sapiens
gactctagaggacttaaaaattgacgtagcaaggcttgctttcaagggactcaccccgttaggggagtggggctcacaatgtctgagctgatgtttaccarggaggccatgtggatgggggtaggttcgctgtcagagactgggagtctctggcctcctctagctctcacactcagggtgctgggcctggtgacctcctgg

SEQ ID NO: 56914 - DNA, 201 bp, Homo sapiens
acatctctgctcccacagccttggagatgacccctggtccgctgctcctcctaaccccttcagcatggctccactgcagcgggttcctgtcaggtgataasttaaagcaaagagaggagtaggctgcataaattgtatacctctgtttatccatgttatccactgacaattaggttcttaaaaatttgttgactattacta

SEQ ID NO: 56915 - DNA, 201 bp, Homo sapiens
cccaacagtgacaatcttagatcccagtgtctctaatatgtttacttccttgattattcaccctgtatggaacgaggctcctcttgttgaccttcctgctyggatgcccgctgcctcctcatctcactcagctgctgtcatcctgcacctccacccaccatgagcatcttcctcactccacttgggctctgataccctagc

SEQ ID NO: 56916 - DNA, 201 bp, Homo sapiens
gtaatatatattagcagtaaatacatgtgagccaaagaaaagttgttccttattagaatatgctacaagtcaaattaaactgagtataaataagcttaatyataaaattagtttgtgctaataaaaatgtaatatgagccacatataattttaaattttcagctttcaaatgggatggaaacatttctttgacctgacttt

SEQ ID NO: 56917 - DNA, 201 bp, Homo sapiens; identical to SEQ ID NO: 10673

SEQ ID NO: 56918 - DNA, 201 bp, Homo sapiens
ggtggggacgttgtgcttgtattcgtgcagtttaatgttgaattagctctttgtggagacagttatataagtaagcgtttctagggagtctttatatccaraagtgaggcttaatctctgaagagtagactgataggaagagagtacttggagagatgatgcagtcccaccttctcatgagacaaaggaggaagcaggcca

SEQ ID NO: 56919 - DNA, 201 bp, Homo sapiens
gccatactcaccccacgttgatgcctaatgtcttcttgaggtttcctttagagggcactccttacctttggtgccagccattctgctattctgatcctacytcccctcattactgatcttccttctctgccatcctgaccccttcctgtccttggatgcctttggagttgcagagaagctgtctttatcttcctggtgtga

SEQ ID NO: 56920 - DNA, 201 bp, Homo sapiens
cccacctcggcctcccaaagtgctgggattacaggcatgagccactgtgcccaaccaagaatgtttttttacacctctttgtttaactgtatggctatackcacacactcgcgtgttctgaaaacaagtgcacacgtcgcgtgtgttacctttgggtggaaggtgagaaggcaagcacgtcctccattcctggatagttca

SEQ ID NO: 56921 - DNA, 201 bp, Homo sapiens
tagaccccaaataccatcccaagattatcgggagaaagggggcagtaattacccaaatccggttggagcatgacgtgaacatccagtttcctgataaggaygatgggaaccaggtgagagcctcggttggagcgtgtcgggggcagaggtgcttgttgacctttcctgtgacttgggagcagtaaccagatgtgcctagat

SEQ ID NO: 56922 - DNA, 201 bp, Homo sapiens
tggtttggctccagtttgtgccttcagctacttcactgcttccctaacctggccttgtcagtcagcctcagtctaccatctacccaggtctgcataccccscaaaacagtatacactttgacgcttttctgcaagcacaattaccttttgggggagcccttctcttaaagcagagtaggttaatgtttgtgaatgaaacgg

SEQ ID NO: 56923 - DNA, 201 bp, Homo sapiens
gttacgttattgggcagaaaggaagtgggatccgcaagatgatggatgagtttgaggtagacccctttcccgggaggccatgtcacaggagtggcctgtcrcatcctctcccgagtgccagtgtcctttctcaacttcctgttgactctgcctcctcctgctcggactgggcactgacttcccttcacggcgggtggcctt

SEQ ID NO: 56924 - DNA, 201 bp, Homo sapiens
ctctcatgtccaccctgtatgctagcactcagtaggacaggcacgtggtcgttttgcaggcagtgtttgtcagatgaatgggtcctgttttctgttctctrttcattatcctgctttctcgaagaggttaaccagtttcctggttttctttggcttcagtagcccttctctctgctacctgaatttgagatgttagtgagt

SEQ ID NO: 56925 - DNA, 201 bp, Homo sapiens
catttgtccctgtcctctagtcctgttgcgtgatgatggttccgtgttgtgatttgtccctgtcctctagtcctgttgcgtgatggttgtgatttgtcccygtcctctagtcctgttgcatggtggtttttgtgttgtggacatgttgttttcgccgattgtgggctacaggtgttttgttaccacgtttccttctctatg

SEQ ID NO: 56926 - DNA, 201 bp, Homo sapiens
tctgttttagctatctctttggttttggtgtggtaggttcacatcgagttcacagagggcgaagacaagatcaccctggagggccctacagaggatgtcartgtggcccaggaacagatagaaggcatggtcaaagatttggtaaggtaccccttggaatgttgtgtgtgctggtgacaagggaggctctgagttgggcat

SEQ ID NO: 56927 - DNA, 201 bp, Homo sapiens
tctgctctcagctcccacggcctaaccatgaccatcctccctgcaggcattggttcctgtcaccattgaagtagaggtgccctttgaccttcaccgttacrttattgggcagaaaggaagtgggatccgcaagatgatggatgagtttgaggtagacccctttcccgggaggccatgtcacaggagtggcctgtcgcatcc

SEQ ID NO: 56928 - DNA, 201 bp, Homo sapiens
aaagtgatgttacgatttatggatacaataaataataaaatcaagttaacataattcatcacttcaaatactttaagttttttgtggtgaaagcatatgarattactgtcagcacttttgaaatcgacattattatttactatattcaccgtgctgtacaatatatctcataaaagaaaaccacattcctcctgtctaatt

SEQ ID NO: 56929 - DNA, 201 bp, Homo sapiens
agtttaaattatcctgctagacaccttctctgtcttttttgggatgagggaagaatgttgtatcattaaatcttagaattttctcagctattttaaaaaaygtttcttctctgttctttggattttttcttttctctttttgttttggaactccagttatagacatatgttagagtttctcattccatggttcttagctct

SEQ ID NO: 56930 - DNA, 201 bp, Homo sapiens
atgttacgatttatggatacaataaataataaaatcaagttaacataattcatcacttcaaatactttaagttttttgtggtgaaagcatatgagattacygtcagcacttttgaaatcgacattattatttactatattcaccgtgctgtacaatatatctcataaaagaaaaccacattcctcctgtctaattgatgtt

SEQ ID NO: 56931 - DNA, 201 bp, Homo sapiens
ccatggtaaagatgtgacattccattttctaatataaagttacatgttgcactccatgaaaactattaccagggtcaactttgtaggaaaataaaaaaaamaaaaaaccaaatattgcaagttaaaaatatagccattggaaaaaaaatccctcaaatgaatggaataaacttttaagtggccagacacagcagaagagag

SEQ ID NO: 56932 - DNA, 201 bp, Homo sapiens
tgaggcaggaatatcacttgagcccaggaagtcaaggctgcagtgagctgtgattgtatcgtgccactgcattttagcctgggtgacagagcaagaccctrtctcaaaacacatatatatggaagtacagtagtgtaaatctaacattaatttctggtttctgcccccgagaaattgcagaatgtagcttagtcagtcatg

SEQ ID NO: 56933 - DNA, 201 bp, Homo sapiens
ctattctaaaaatggtgtatataaataattttttttacaattcagtgtttgcaatgcaacattataaaaattacatatagaaaacttgtataaataaaaaytgtataaaatctggttgtaaaattccatacacacacataccttttgggatttaagttacatttgcattgaatttctagtctaattaggggagaattacta

SEQ ID NO: 56934 - DNA, 201 bp, Homo sapiens
ttttcttctcatgcagttcctaactcttgtcttctttcgtaatctaaaaaaacctgctgcccagctcccatgtcctctgcttctcttgtcttgtgttgctycacctggcacagctgcatgtccatgttcccccctcagtgcatcgcctcgttgctgcctctgcgtgtgcatgtgtttgggatggacgcacaaaaagccctc

SEQ ID NO: 56935 - DNA, 201 bp, Homo sapiens
actattactagcagtgcagtgagatgagcattcttgtacatatttccttttgcccaggaaagctttttcctgaagtacgtctccagaagtgggatcgttcrctcgtggagtatttgcttcttaagccttaataggccttgcaaatggtgtcaaataaggacctagtttttccctcctactgtagataaccagttttcccag

SEQ ID NO: 56936 - DNA, 201 bp, Homo sapiens
tggacttgggcatgagcctgtctgattccagagatcatccccctgttctctgtcacatccattcatggtgtttttcactgggccttgctattgccaagacrccatgctcagtcctggggatttgggttatccaaaacagtcacacccttgatttcatggagattgtggctaatggcacaaacacatgaacaaatagggcac

SEQ ID NO: 56937 - DNA, 201 bp, Homo sapiens
catttatgtgttcactggagtagcacttttccttcagccttttttctttgcattcacagcttggctatttggtgcaagaggcctagcttttggcgtgtctyagcttttaacaactcttcttcacgtgccttcttaatcatttctagcttttgatttaatatgagagacgtgcagctcttcctttcacttgaacacttagaa

SEQ ID NO: 56938 - DNA, 201 bp, Homo sapiens
tgggacgagcggcgcgtcccccgcagctcctcgggagggccggcccacaacttgtgcggggtacaccggcgagacactcacccgccaaacagcccgagaayaggcgccgaccgaccgcgccgcggacccgcccagcgctcgcggtccgctcacagcccgccccagcccgccccgccccgcccagcgcgcaggcggattgcg

SEQ ID NO: 56939 - DNA, 201 bp, Homo sapiens
tagtgctttgtgttctgccaccctttgtttacccagtcccggactgaaccaatgcaaatgtttaatcttctgactctacaaaaatgctacagtgcacatcrggcacactgcagagacactgcaggtttgtgataccaccacaagaaagcctgacatcccaataaagcacatcacatgagttttacgtttcccagtgcatat

SEQ ID NO: 56940 - DNA, 201 bp, Homo sapiens
gaggacgcgcacccgtgacccagcctcaggaggtcctgatgacgtgtgcccaaggtgggcagagcacagtctggctttatacattgtagggagacatgagwcatcagtcagcatatacaggacgaacattggttcggtctggagaggcaggatggctcgaagcaaaggcaggaagactccaagtggggaggggacttccaa

SEQ ID NO: 56941 - DNA, 201 bp, Homo sapiens
agggtcagacttgacatggtgtttggacgccatgtaaaatcgaaggaagtcgacttgggctttgcttattaaacagtgcctattatggtgaaattaaacgkctgaaggaatgtggatgagtcgtaatcttaaggaacatgacgatttgcccctcagttttgcgttttatgtcctcagattcatagctacctataccctaag

SEQ ID NO: 56942 - DNA, 201 bp, Homo sapiens
tgtggtggcgcacgcctgtagtcccagctactcgggaggctgaggcaagagaatcgcttgaacccaggaggcggaggtttcggtgagccaagatcacgccwctgcactccagcctgggcagtagagtgagactctgtctcaaaacaacaacaacaaactgcctcttcttgttcactgacactgggtgtatggttaaagccc

SEQ ID NO: 56943 - DNA, 201 bp, Homo sapiens
caggctgggagtgcagtagcgtgattataactcactcactgtaaccttgaactcctgggctcaagggatcctcctgcctcagcctctcagtagctgggacyacaggtgtgtgccatcatgcatggcttttcttattttattttattgtattttttatttttttgtggagatggggtcttgctttgttgtccaagctggtct

SEQ ID NO: 56944 - DNA, 201 bp, Homo sapiens
tgtgcttctacggatgacttcagtctacttacacggtgaaaatccgccgattgctgacctctgtgagatcagcagttcacctgctcagagactgtccctgyccagcagagccctccctccctatcataagctacattcagcttcacttgctatttcagactttgacatcttcctgtgtctctgtcccatggtaaagatgtg

SEQ ID NO: 56945 - DNA, 201 bp, Homo sapiens
gcatccaggaagcatgtcacacacagccattcaagcccctttgttttcctgagaatacagggtgttttgagtaggaaactaataaactcatactgcactcygtctatgttttacacttcagtggttatttaaaactttgattttgatagaatttcacagaatagtataaagacacatcctgtggcaccagtttcttttctc

SEQ ID NO: 56946 - DNA, 201 bp, Homo sapiens
tgtcttgtgttgcttcacctggcacagctgcatgtccatgttcccccctcagtgcatcgcctcgttgctgcctctgcgtgtgcatgtgtttgggatggacscacaaaaagccctcctcgtggtccttccagcaagctgggcttccctttactgcacagtgggcaagattcctgccttgtttcctgatgatacggcttctcc

SEQ ID NO: 56947 - DNA, 201 bp, Homo sapiens
gtgcctcgtgcccctgcctacctgcttgtgcagacctcactccctcatgggttgccgtgtccagtgtggacttcaaggcataatgtggtgggggtggaggkcttgactccaactctaaaaagccctgtctgtccccagtttgttttcaaaggcctgttctcatcagatcatcccttcctttccaggacaaacgtgctgtgg

SEQ ID NO: 56948 - DNA, 201 bp, Homo sapiens
cagtcccagtgattctcatgacatcgtttggatcgcatgagccccgtcgtagagcttcctcctccacatctcccatcactgtggggtgtcccctgtgaggsaggcagctgcagcctctggctggccagagggcaccatccaagtggccggcagttctaggagggcattcagttccccgtaccatgcttgcccccagctctg

SEQ ID NO: 56949 - DNA, 201 bp, Homo sapiens
ggctggagtgcagtggtgcagtcatggctcactacagccttggctttccagactcaagcagtcctcccaccttagccttccaagtagctgggaccacaggygcatgctaccgcaccaggctaatttttttcttcttttagttagtagagatgaggtcttgttatgttgtccaggctggtctcaaactcctcaagtgatcct

SEQ ID NO: 56950 - DNA, 201 bp, Homo sapiens
agcctctggctggccagagggcaccatccaagtggccggcagttctaggagggcattcagttccccgtaccatgcttgcccccagctctgctcatgcacckggtggtggggaggcgacctgtgggatgcgggtcggttgcctctctctcacttgctctgcatttgtgaaacaaaaggtatgccctccactctgtgttatca

SEQ ID NO: 56951 - DNA, 201 bp, Homo sapiens
tcttttcattaactgtgtaccccgaagactatgcatagtagtgtatggaggctttccttctaccttttatgctatgtgttgcttcactgcatggacacaamgtggtttcttcagcccatctgcatattgaagttgtgttactttccagattttttttttttagctttttatgtctcgctatctctgctgttgcccttctga

SEQ ID NO: 56952 - DNA, 201 bp, Homo sapiens
tttcctcccctgcagagtatctacttcagccttagtagatttccttgatctttgcctccaactctaaagagcatatttgcttgacgtctgtatttgtgtcycctacccctgtttcatgtgatgtctcttcgcttgacactgagaataggtaggaagttcctagctttctttcaccctctgccttctcagtgcaaacggatc

SEQ ID NO: 56953 - DNA, 201 bp, Homo sapiens
aggctgccaaggaagctctggaggtatgtgtccatgtgcccccctccaccccccgccaaggcccagtcagcaggcacctggggagacgcgtggcctggatkggatggacggttgcccaagcggcagtggcagtggaggtagccctcttgctcctaccgtgtgcgcacgggctgtgcttctcggctggacacagagtttggg

SEQ ID NO: 56954 - DNA, 201 bp, Homo sapiens
cccagtgtctctaatatgtttacttccttgattattcaccctgtatggaacgaggctcctcttgttgaccttcctgctcggatgcccgctgcctcctcatytcactcagctgctgtcatcctgcacctccacccaccatgagcatcttcctcactccacttgggctctgataccctagctatgtagatattctcttatgtg

SEQ ID NO: 56955 - DNA, 201 bp, Homo sapiens
catggccacgaggcacagtgggcggctgggcagggccctgtgacctcagggagtgcacggggcaggggcctggctgctcccagacttgcctctgagccctygggctgctcatcctttgttccgttcgttccaaaaagaacctgtccccaaaaaagggcagcaagaggaagagggatgtgactcagtgtccggaggtagagc

SEQ ID NO: 56956 - DNA, 201 bp, Homo sapiens
gaaggcctgcttcccttttatggcagttggctctcagagaaacagggtctaggcaccagctaggttgctggagtgttactatacccaggccctctcagtcracagagtatgtgtatacatacatatacaaaacatacctacagctacatgcgtgtgtatttttaacacagtctcattttttaatatctccatgtattgaaa

SEQ ID NO: 56957 - DNA, 201 bp, Homo sapiens
cggtcttgaactcctgacctcaggtgatccacccgccttggcctcccaaagtgctgggattactgtctgtgtccttctgatatgtcctcattattctctgkctctttctcttctcttctctttctttcttgtaccacaggatattctgggctcttcatgtaccttccctgccccagacctggattctgccttttcttcaag

SEQ ID NO: 56958 - DNA, 201 bp, Homo sapiens
ctggcacagctgcatgtccatgttcccccctcagtgcatcgcctcgttgctgcctctgcgtgtgcatgtgtttgggatggacgcacaaaaagccctcctcrtggtccttccagcaagctgggcttccctttactgcacagtgggcaagattcctgccttgtttcctgatgatacggcttctccagagtttggggggcctgg

SEQ ID NO: 56959 - DNA, 201 bp, Homo sapiens
tagcgagctctcggctcactgcaacctctgcctcctgggttcaagtgattctcccgcctcagcctccccggtagctgggactgcagatgtgtgccaccacscccggctaatttttttatttttagtagagagaaggtttcaccatgttggccggtcttgaactcctgacctcaggtgatccacccgccttggcctcccaaa

SEQ ID NO: 56960 - DNA, 201 bp, Homo sapiens
tttgatccgcatcgagggggacccacagggcgtgcagcaggccaagcgagagctgctggagcttgcatctcgcatggtaagtgccatggctgggccctctrgaaaggcactggccttgcgtctcttggccccctctaaggagtagcgtgttgtggtgtgcggccttagagaatggaagtcgacaaatcccacgttgcactg

SEQ ID NO: 56961 - DNA, 201 bp, Homo sapiens
gcagcctcctgcttctgcctcccaaagtgctaggattacaggcatgagccaccatgcctggcccttttttttttttttttttttttttttttttttttgaracagggtctcactctgtccaggcctggagtgcagtagcgagctctcggctcactgcaacctctgcctcctgggttcaagtgattctcccgcctcagcctc

SEQ ID NO: 56962 - DNA, 201 bp, Homo sapiens
ggagaggcgatggtgaaggactccagcactgtgagctgctgtcacatcactgccgtgagtgcagaattgcccagagcgtaggggtccgtgctgtctccatrtgtgttctgagccccttccttaaccagctctgatcctggcatgggacatgaactctctcttagccaaaaagtagacttgcatcgattgactgtaatttgc

SEQ ID NO: 56963 - DNA, 201 bp, Homo sapiens
tgttcgacttaacagatctaactactgttactcttttagtgctattgtaaatggcactttttttccatttccagttgttagcacatggaagtgcctgtggyttttgtatgttgaccttcacgaggctgctaaataaagctcatgtatattagcgccagtcactgttttgtggatttttttttttttttttttttttttttt

SEQ ID NO: 56964 - DNA, 201 bp, Homo sapiens
ccttttgccatgactttatttgatgttcatcatctcaggtttgcccctgagagcccctcaagctcctgtgtcctttatttatttatctatttatttttttyattattattattttttcagactgagtctcactctgtcgcccaggcaggagtgcaatggcgccatctcggctgactgcaaactccacctcccgggttcaag

SEQ ID NO: 56965 - DNA, 201 bp, Homo sapiens
ccaagaatgtttttttacacctctttgtttaactgtatggctatactcacacactcgcgtgttctgaaaacaagtgcacacgtcgcgtgtgttacctttgkgtggaaggtgagaaggcaagcacgtcctccattcctggatagttcagtggatgaaggagcctttcccaggtagtgggacaccgacctgcataacatgact

SEQ ID NO: 56966 - DNA, 201 bp, Homo sapiens
ttgcttatttatgtcaatattggctcatggtttccccagttaattcggttgattgttacccttttgccatgactttatttgatgttcatcatctcaggttygcccctgagagcccctcaagctcctgtgtcctttatttatttatctatttatttttttcattattattattttttcagactgagtctcactctgtcgccc

SEQ ID NO: 56967 - DNA, 201 bp, Homo sapiens
ggcttgaataggttcatgtaaagtcatcaccacttcctcaaaaggaaattaacaaaaaaaaattttaattcagacgtcttgcagataacgtggcaattgtratgagaatagcacagcagagaaaataaattttgtgactctgtttttcactgatttgtagtacctggtgatacttaagtgtcctcttttccctctccaggt

SEQ ID NO: 56968 - DNA, 201 bp, Homo sapiens
cttcaagtagttgagactgcaggcatgcaccatcaggcccggctttttttttgtttgttttttggcagatgcgggttttcaccatgttgcccactctggtytcaaacccctaggctcaaatgatccactcatttcagcctaccaaagtgttggaattacaggtgtgagccaccacgcccagccaatcctccccttttttaa

SEQ ID NO: 56969 - DNA, 201 bp, Homo sapiens
attctcattccactgaaaggatctagttcagaaccacagttcattgtcagatctctttagtctctttcaaactggaatggttcctctgcctgagcttgacrcttttaatgattaccagcagttattttgtggggtcccttattgtgggtttgtttggtgtttccttttgattagatctaggttttgcgcctctggctggaa

SEQ ID NO: 56970 - DNA, 201 bp, Homo sapiens
agcttctgttttgtaatcaacactgtaggggaaagggccacttcactgaatatatggatcagaatgaagacattgacccctgacactctcctactcctcarttatcttcagacaaatcccagatacattattgtgccttagttcagatcttcccgttttcatgtatacatatatatagtcattgtgctcctaactcatgta

SEQ ID NO: 56971 - DNA, 201 bp, Homo sapiens
ttatacctttttaacccagtctctgtttggactttcctcatcatctccaagatgtttctttcagttggtcttttcaagtcagtgtccaaacaaggtcacawtgttgcatttgattatagagtcctgtctctcattctttaacagtgcttactccctcctacccccttttttttttttttttttgagacaggatctcacttt

SEQ ID NO: 56972 - DNA, 201 bp, Homo sapiens
tgtttagttttcctttctttttttttttttttttttttttttgagacggagccaggctggagttcagtggtgccatcttggctcactgcaacctctgcctmctgggttcaagtagtgattctcctgcctcagcctcccgagtagctggtactacagatgcacgccaccatgcctggctaatttttgtatttttagtagaga

SEQ ID NO: 56973 - DNA, 201 bp, Homo sapiens
gctgtctccatgtgtgttctgagccccttccttaaccagctctgatcctggcatgggacatgaactctctcttagccaaaaagtagacttgcatcgattgmctgtaatttgcaacgtaagttagttgttggacaaatgatctatctcacttaccctcatgacaaacctctgaaggtttgtttgcaaataccagtgctctgt

SEQ ID NO: 56974 - DNA, 201 bp, Homo sapiens
ggggtccttccccccaggtggcggcggggcgggggtctgggcgcagaccgggcggcggggcccccgcagcacctccacctgccgcgcggggcccgcgtcastctacgtgttcgggggtggggaaagctgctcttcttgggcctggagtgcaacttggacgtgccccagggtcgtggatgaaaaatacattacggaaaagta

SEQ ID NO: 56975 - DNA, 201 bp, Homo sapiens
aatcgtgacaatatgctttgctacataaagtttgggtgcaatgtgcattcattttgtagttgaactcgtgattaaacagatatagtcaaaatttgtttttkgtttgtttgtttgagacggaatctcgctctgtcccccaggctggagtgcagtggtgggatctcggctcactgcaagctctgcctcctgggttcacgctgt

SEQ ID NO: 56976 - DNA, 201 bp, Homo sapiens
agattgctgaagagtatggcggggtgatggtcagcttcccacgctctggcacacagagcgacaaagtcaccctcaagggcgccaaggactgtgtggaggcrgccaagaaacgcattcaggagatcattgaggacctggtaggcacttgggtgctcggggaggggttctcaccccccagtggccactcaccgaagccgtgta

SEQ ID NO: 56977 - DNA, 201 bp, Homo sapiens
cgtgcccagcctatttgaatcttttgaaatgatcaaattatctttgcccctcatgctgttaatgtggcgagtaactttactctgtttttctaatattgtayccccccacattactggattaaacttcatcgtgataatatttgtttttctatttctgggtcagtttgcaagattgtttcaggctttggcttttaaatacct

SEQ ID NO: 56978 - DNA, 201 bp, Homo sapiens; identical to SEQ ID NO: 10708

SEQ ID NO: 56979 - DNA, 201 bp, Homo sapiens
agaaattgacacataattttaacccttttcctcgcttggagtcccctcatctgacgttgtacaccccttccaggtggacattcgcttcccacagagcggasccccagaccccaactgcgtcactgtgacggggctcccagagaatgtggaggaagccatcgaccacatcctcaatctggaggaggaatacgtgagtctctg

SEQ ID NO: 56980 - DNA, 201 bp, Homo sapiens
gcaaacagggcaggaaggggcgggtgggtccagaggacacgagggagaacggccctgcgctctgaaacattcgaaggtcaccaggtgtaagaggagagggygatgtggccaggggcggcgaggaccacaaagcccacctgcctgaggagaactgtcgtgtccaggggcctggggaggccaccgagggacagggtcccttgg

SEQ ID NO: 56981 - DNA, 201 bp, Homo sapiens
ctgcagcagtacttgctgtcttaggtacagaaggcaggatattgattatttctccctgactcaacaaagagttgagatgtttatccaggttaggatgacastgcccccctgtcccccccgccccccaaaaaagaaacaaaaatgaaaggatggtgtctttgactgtactgggagtcaggagacctcacttcaattttgggc

SEQ ID NO: 56982 - DNA, 201 bp, Homo sapiens
ggctgatgtcaaagtcaacagtcagcaagtggcgtgagcagtctcgatgaattctttcaaataagcgtttttcagatccactctagggcttgccttttccytctgttgtagtctcagaagttcttgaggtagaccttgtgagacctgcagcagtacttgctgtcttaggtacagaaggcaggatattgattatttctccct

SEQ ID NO: 56983 - DNA, 201 bp, Homo sapiens
tgagtcaccatgtccagccataatttttttaaggcaacttgtttttcttgaaatttcagtgtggtaaatttaatatccatagataaatttctcttcactcyttcattattttgaattatttctaaatgtagttacattaactagtgaaactggcataaacaggtttgagagcaagtaaaactgagtcttactaagcacaca

SEQ ID NO: 56984 - DNA, 201 bp, Homo sapiens
tccacatctcccatcactgtggggtgtcccctgtgaggcaggcagctgcagcctctggctggccagagggcaccatccaagtggccggcagttctaggagrgcattcagttccccgtaccatgcttgcccccagctctgctcatgcacctggtggtggggaggcgacctgtgggatgcgggtcggttgcctctctctcact

SEQ ID NO: 56985 - DNA, 201 bp, Homo sapiens
gccgacgatgcttaagcatcttttattccctttctagatggaggcatctttgaaaagtaaagcgcctcgtgtgatacagagcttcccctcctgcagataastctcacaaacacttagcatgtgtctgtccagagtttcctgttaaaacacactttcagaggcgtgtagtgtatgaataagtgccattttcatggcacatat

SEQ ID NO: 56986 - DNA, 201 bp, Homo sapiens
tccctctcctatattgatgtttatttccaaattagggtgtttagttttcctttctttttttttttttttttttttttttgagacggagccaggctggagtwcagtggtgccatcttggctcactgcaacctctgcctcctgggttcaagtagtgattctcctgcctcagcctcccgagtagctggtactacagatgcacgc

SEQ ID NO: 56987 - DNA, 201 bp, Homo sapiens
gagcgacaaagtcaccctcaagggcgccaaggactgtgtggaggcagccaagaaacgcattcaggagatcattgaggacctggtaggcacttgggtgctcrgggaggggttctcaccccccagtggccactcaccgaagccgtgtatgagtgttcgctccaccctgtagggaggtgactccctcatacagccctggaaggc

SEQ ID NO: 56988 - DNA, 201 bp, Homo sapiens
ccagcaggacgcagctcttcctggcccttctgtcggcctctaaacacagtgcaggctgactttcttatcacagctcgtttggctggctggaccaaatgctrcttgtttctttctggagtggggaaataacttcaaccaggtgcagtcagtgtgtattcttatctcagctgcaaaagctgttctaaatgcccttctagggaa

SEQ ID NO: 56989 - DNA, 201 bp, Homo sapiens
ttccctaacctggccttgtcagtcagcctcagtctaccatctacccaggtctgcataccccgcaaaacagtatacactttgacgcttttctgcaagcacarttaccttttgggggagcccttctcttaaagcagagtaggttaatgtttgtgaatgaaacggaactttggcaggctgaggtgtctcaggtcatcagcttac

SEQ ID NO: 56990 - DNA, 201 bp, Homo sapiens
ggggcgggtgggtccagaggacacgagggagaacggccctgcgctctgaaacattcgaaggtcaccaggtgtaagaggagagggcgatgtggccaggggcrgcgaggaccacaaagcccacctgcctgaggagaactgtcgtgtccaggggcctggggaggccaccgagggacagggtcccttgggtgcaggggccccttg

SEQ ID NO: 56991 - DNA, 201 bp, Homo sapiens
ctccatggccagaaaggggaaagaagttgtagattttgtcataacttgaggtggagcgtttacagccatgcaggggtggacccgggccctgagaaggccaygaatttcctgtccctggtggtattaagaaatgggattagattaatatctgaggttcctttcaatcctgatttggacagtactgttagatccagtgagaat

SEQ ID NO: 56992 - DNA, 201 bp, Homo sapiens
ccaggtttgtctgggccagtaggccaggtcacagttgggactccactgagaccacggaagccacaggtttgctcctcatccccgggccaactcggcggccyccaaccctataccctaccccctgctgcctgtccgtgcctcgctggtgcagaccttcgtcgcctctcctcgccgaaggtacccgcagacagggcctagtcg

SEQ ID NO: 56993 - DNA, 201 bp, Homo sapiens
gaacaaaaaagaaataccagagaatccaaccatcatatttaattcctgttttatttaaactttgtttccaattaatgttacagtcctttttaaaaattaawttttttttattttattccttttttttagtgacaaagcctcactctgtcacccaggctggggtgcagtagcgcagtcatagctcactgcagccttgaactc

SEQ ID NO: 56994 - DNA, 201 bp, Homo sapiens
tatgttgaccttcacgaggctgctaaataaagctcatgtatattagcgccagtcactgttttgtggattttttttttttttttttttttttttttttttttgagacggagtcttgctctgtcgcccaggctggagtgtagtggcgcaatctcgcctcactgcaagctccgcctcctgggttcacgccattctcctgcctca

SEQ ID NO: 56995 - DNA, 201 bp, Homo sapiens
ttccttctgtctgaaggaaaccactcaacatctctcgtagtgtgtatccggtaatgacttctttcacattctgtatgtctgcaagtatttttttccttcaytttcgaaaagctgtttctgctgcataaaggtttctaggttggcagtttttttcctttccagacttggcttcattgccgtctcctgttgtttctgatgaga

SEQ ID NO: 56996 - DNA, 201 bp, Homo sapiens
cgctgctgcactccagcctgggccatagagccagaccttgtctcaaaaaaaaaaaaaagaaaaaagattatgatgtttgcatttaattacagttgtgattrtatatgttatatatcacatatttatatttattacatatgtttaacaaacgcggttaaataacttactgtaatttttttcctcaattgtggtaaaatatac

SEQ ID NO: 56997 - DNA, 201 bp, Homo sapiens
tggtttgttcttttttatttcaggataatattgcactgtagggatagatcatctgtttctttgtgtgtacttggtaattagtgtctttcaaggggttttctattttctccaaggtgtcaaatgtattaacatgaagttttttagaatagtcctgcattatccttttgctgtcaatactgacgtcacctctctttcacagta

SEQ ID NO: 56998 - DNA, 201 bp, Homo sapiens
cccattgggctaaactggaccctccccaccccccaggtggcagatgctttattttctagtagatgtgacagtccagtacgtctgtgcttctacggatgacwtcagtctacttacacggtgaaaatccgccgattgctgacctctgtgagatcagcagttcacctgctcagagactgtccctgtccagcagagccctccctc

SEQ ID NO: 56999 - DNA, 201 bp, Homo sapiens
gctgtgtgcctcacctgtgccaggttgcaggtgtagcacagttacaggatgctgttagaagtgtgtcgtgggcattctgctgcaggtccaaggatgttttstgttgtttgtttgttttttgggacggagtctcgctctgtcaccaggctggagtgcagtggcgtgatctcagttcactgcaacgtccacctcccaggttca

SEQ ID NO: 57000 - DNA, 201 bp, Homo sapiens
gttgtcccccattgggctaaactggaccctccccaccccccaggtggcagatgctttattttctagtagatgtgacagtccagtacgtctgtgcttctacrgatgacttcagtctacttacacggtgaaaatccgccgattgctgacctctgtgagatcagcagttcacctgctcagagactgtccctgtccagcagagcc

SEQ ID NO: 57001 - DNA, 201 bp, Homo sapiens
tctttgtggagacagttatataagtaagcgtttctagggagtctttatatccaaaagtgaggcttaatctctgaagagtagactgataggaagagagtacytggagagatgatgcagtcccaccttctcatgagacaaaggaggaagcaggccaagtgaagagggtgatgtgccaagcagtgtcagcagcagatcgcacat

SEQ ID NO: 57002 - DNA, 201 bp, Homo sapiens
caccacagccaattaatttttgtatttttagaagagacggggtttcaccatgttggccaggcttgtctcaaattcctgggctcaggtgatctgcccaccttggcctcccaaggtgctgggattaaaagtgtgagccaccacacccagcagggggattctgttgaagaggcagtgatatgtcagccaaggtcgctatatgcc

SEQ ID NO: 57003 - DNA, 201 bp, Homo sapiens
agtaaccaagttctgaaagaagcatatcatgcggctttcccaattgccaagttatgatgacacaaagtccaaaatgcgtgtaaaggtttttgaccaagtasaaaagcagagaaccccaaccagtataatgtgtcagaatgctttttctcttcaattgtaaaagcaccacaacgttcaacatctggaaaccaagaaaataat

SEQ ID NO: 57004 - DNA, 201 bp, Homo sapiens
tgggacacagagctgcagggtccgagagctggggcatgtgggtgatgtccctgcgcaaacagggcaggaaggggcgggtgggtccagaggacacgagggaraacggccctgcgctctgaaacattcgaaggtcaccaggtgtaagaggagagggcgatgtggccaggggcggcgaggaccacaaagcccacctgcctgagg

SEQ ID NO: 57005 - DNA, 201 bp, Homo sapiens
tgttttttttttgtttttttttttttgagatggagttttgctctgttgcccaggctggagtgcagtggcgcaatctcggctcacagcaacctccgcctccygggttcaagcaattctcgtgcctcagccccgggagtagctgggattacaggcgtgcaccaccacgcccggctaatattgtatttttagtagaggcggggt

SEQ ID NO: 57006 - DNA, 201 bp, Homo sapiens
ccaggagctgggagagggagggaagttgggcaaggatcaaaaggacacatgtaattgctgcagaatgcaagtaaagcggcactgtcagaggctgcctgtastggctagggggaaagcagagcctgattcaagaaacagaagaatccagaggacccagataactgggaatggagggaggggttcaacagacctttgctgtgg

SEQ ID NO: 57007 - DNA, 201 bp, Homo sapiens
acacagagctgcagggtccgagagctggggcatgtgggtgatgtccctgcgcaaacagggcaggaaggggcgggtgggtccagaggacacgagggagaacrgccctgcgctctgaaacattcgaaggtcaccaggtgtaagaggagagggcgatgtggccaggggcggcgaggaccacaaagcccacctgcctgaggagaa

SEQ ID NO: 57008 - DNA, 201 bp, Homo sapiens; identical to SEQ ID NO: 10682

SEQ ID NO: 57009 - DNA, 201 bp, Homo sapiens
ttttcctaggtgctaattcaggaaagcatgctcactcttagtgatccttttcttcatgttgagatgaaatgtgtcttcagaattgttcttagttgttcttrgttgtgcaggcaactggacagaactcagtccccctttaaatgctctccacatggtaaagacagctcttatgtatcttgttctcagtttccaaggcttgaa

SEQ ID NO: 57010 - DNA, 201 bp, Homo sapiens
gtcaccggaatccccactcccgcgcccgggcctgcccgtgtcggagccactgtcgccggcactaggaccgcccgggacgggggagcccacgataagtgccraagagcctgggctcggccgcccctcccccacaccgccccgccggcaccccagagccagccgaccaccgcccgagagtatgggacgagcggcgcgtccccc

SEQ ID NO: 57011 - DNA, 201 bp, Homo sapiens
gtaggccaggtcacagttgggactccactgagaccacggaagccacaggtttgctcctcatccccgggccaactcggcggcctccaaccctataccctacmccctgctgcctgtccgtgcctcgctggtgcagaccttcgtcgcctctcctcgccgaaggtacccgcagacagggcctagtcgctctcccctcgcttatcc

SEQ ID NO: 57012 - DNA, 201 bp, Homo sapiens
tggggggcctggaactcttaacttgggggtactgggttctatccagagaggttgacagcaggagggtttgcaacagcacttgtcttgcagacacagtgaartgctcagtgtgaatctgagccaacagtagatggggtctctgggcagcagcatgggccccacaaggctcttaggcgtcagtgagtgcttttgtgtggagtt

SEQ ID NO: 57013 - DNA, 201 bp, Homo sapiens
agtgggtttttcatttttcatttttttttttaaacagatgcctcagaacctgggtaactcagtttatcagaaattcagttttcaagtttggaaggataacrcttggagctggtagtcactcataaaacatctgattttgtgatcacgtttaagaatccatgaatgatataaaaatcctcacctattaaaactttttggccg

SEQ ID NO: 57014 - DNA, 201 bp, Homo sapiens
caaatgatattactgatttaattatatttactttttaaacatttgctgataagtagacgattaggtggtcttatagcattggtttaaatcagtatgtgtgyggccgggtgcagtggctcatgcctgtaatcccagcactttgggaggcctaggtgggcagatcacgaggtcaggagatcgagaccatcctggctaacacga

SEQ ID NO: 57015 - DNA, 201 bp, Homo sapiens
tgtcagtgttccacgaaaaaaaaaaaaacacgtctgatcctgccttctgctgcttgcagcccccacccagctcccaccatcctcaacagcacccgtggccyggctgcaggctgtgcggacctgaccccattccctgggtaaggctgggtgtgcccctacctcttcccctgtgtgggacggtcttgtccccagatacctgta

SEQ ID NO: 57016 - DNA, 201 bp, Homo sapiens
tatagcagccggggcccgggcgccgcgcctcggagcgtcccggcttctcccgcgcggggggcgagtaagccagcggcaggaccagcgggcgggggcccacragtgagcgcgcaacacggggctgggaggcctgggcgggcgggcggacggggcgggcgggctgccgggcgggggggtggggggtggctgctgacgtggagg

SEQ ID NO: 57017 - DNA, 201 bp, Homo sapiens; identical to SEQ ID NO: 10674

SEQ ID NO: 57018 - DNA, 201 bp, Homo sapiens
tggcagatgcgggttttcaccatgttgcccactctggtctcaaacccctaggctcaaatgatccactcatttcagcctaccaaagtgttggaattacaggygtgagccaccacgcccagccaatcctccccttttttaatgccattgattagtggggaccgtaggtttttggttctgctattgactgattatttttggtga

SEQ ID NO: 57019 - DNA, 201 bp, Homo sapiens
tcatggcagccttgacctcctgggctcaagtgatcctcctgactcagcccttcaagtagttgagactgcaggcatgcaccatcaggcccggctttttttttgtttgttttttggcagatgcgggttttcaccatgttgcccactctggtctcaaacccctaggctcaaatgatccactcatttcagcctaccaaagtgttg

SEQ ID NO: 57020 - DNA, 201 bp, Homo sapiens
tgtccaaacaaggtcacaatgttgcatttgattatagagtcctgtctctcattctttaacagtgcttactccctcctacccccttttttttttttttttttgagacaggatctcactttgttgcccaggctggagtgcagtggtgcagacacagctcatggcagccttgacctcctgggctcaagtgatcctcctgactca

SEQ ID NO: 57021 - DNA, 201 bp, Homo sapiens
tttttagtggaaaaactcactaaactaataatagaactgggacacttaccatttttgctctttgagtgaatgaacttgaaagtaataataattttttttttaagagacagagtctcaccttgttgtctaggctcttgtgcagtggctattcacaagtgtggttatagtacactgtggcctcaaactcctgggctcaggcaa

SEQ ID NO: 57022 - DNA, 201 bp, Homo sapiens
gtcgcctgtggtctctcctagatttcgatcttgtgatctctgagtggatcaggattttattttcccattctgaactttggtttgtggtcttgagtaattttagttttggaagaggagaagtctgggtttcagccggaggcttttttggtgccctccatacccggtcctgtctggtgctttaaagcacttgcgggtctcatt

SEQ ID NO: 57023 - DNA, 201 bp, Homo sapiens
gagttatattagctgttcttggtccttgatcttttgtataaattttgttgtgtaaatatgattgtatttgtaactattctaaaaatggtgtatataaatawttttttttacaattcagtgtttgcaatgcaacattataaaaattacatatagaaaacttgtataaataaaaattgtataaaatctggttgtaaaattcca

SEQ ID NO: 57024 - DNA, 201 bp, Homo sapiens
ggcacagaggtttatttaatcaccagtcatttgatacagggtgaagacctatttgaaatgggactggctggattctacatgttttctttttttttttttttggaaacagggtcttgctgtgttgtccaggctggagtgcagtggtgccatcatggctcactgctcaacccctggggctcaggtgatcctcccacctcagct

SEQ ID NO: 57025 - DNA, 201 bp, Homo sapiens
ctgagtccggtatctccattgtctaactttgcatagaggaacatacctgtgctttggtggggacgttgtgcttgtattcgtgcagtttaatgttgaattarctctttgtggagacagttatataagtaagcgtttctagggagtctttatatccaaaagtgaggcttaatctctgaagagtagactgataggaagagagta

SEQ ID NO: 57026 - DNA, 201 bp, Homo sapiens
cagtgaattttcactaactgaactcactcatataaccagcattgagataaagaagtggaacgttttatttttagagtttagagtctgatttttttttttttcctttgagacagagttttgttcttgttgcccaggctggagtgcaatggcgcgatctcggctcaccacaacctccgcctcttgggttcaagcatttctcct

SEQ ID NO: 57027 - DNA, 201 bp, Homo sapiens
taaccttgaactcctgggctcaagggatcctcctgcctcagcctctcagtagctgggactacaggtgtgtgccatcatgcatggcttttcttattttattktattgtattttttatttttttgtggagatggggtcttgctttgttgtccaagctggtctcaaactcctgggcttaagtgatcctaaagtgctgagattac

SEQ ID NO: 57028 - DNA, 201 bp, Homo sapiens
ctaggccccaaggaacagaggtaaaaacagcaagaggggccctgggccaggggccaggagctgggagagggagggaagttgggcaaggatcaaaaggacayatgtaattgctgcagaatgcaagtaaagcggcactgtcagaggctgcctgtagtggctagggggaaagcagagcctgattcaagaaacagaagaatccag

SEQ ID NO: 57029 - DNA, 201 bp, Homo sapiens
ttcaagaaacagaagaatccagaggacccagataactgggaatggagggaggggttcaacagacctttgctgtggcctgggacacagagctgcagggtccragagctggggcatgtgggtgatgtccctgcgcaaacagggcaggaaggggcgggtgggtccagaggacacgagggagaacggccctgcgctctgaaacat

SEQ ID NO: 57030 - DNA, 201 bp, Homo sapiens
tgcagagaagagctctgatttgaccaagatgacacagcaggaagtgacggcaccgacccctcaccacgtgctcgaattaggcaaagcacagggtcggggcstcatgccatggatgggagaaccagcaggtgcctcggctacctcaaacacaatgacgaaggccaggcggatggcaagaagattccagtaggtctgggaata

SEQ ID NO: 57031 - DNA, 201 bp, Homo sapiens
tggtattggggataaaaaggggccctgaattacatttatgaatgatagagggaaaccctggcccctttccctaggtcaccttgctagtttaagagccagtsagaatgtaaatctgatctaattaaaacgctcttgttctttattcctggctgtggcactggtgagagaaatcaaggtggaagttgaggaaaaaaaatcagg

SEQ ID NO: 57032 - DNA, 201 bp, Homo sapiens
ccaggtgcagtggctcacgcctataatcctagcactttgggaggctgaggcgggcagatcacctcaggtcaggagtttgagaccagcctggccagtatggygaaaccccatctctactaaaaatacaaaaaaattagccaggcgtggcggtgggtgcttgcaatctcagctacttgggaggctgaggcaggagaatcactt

SEQ ID NO: 57033 - DNA, 201 bp, Homo sapiens
tgcccaggtttggggagagcgtgcctctgagccccaggtgagcagcctggctttcactgtgacacgaccttgagctctgcaaacccatggctgttctcccrttttcttaggccaatagcttcaccgtctcctctgtcgccgccccttcctggcttcaccgtttcatcattggcaagaaagggcagaacctggccaaaatca

SEQ ID NO: 57034 - DNA, 201 bp, Homo sapiens
ggctgaggcgggcagatcacctcaggtcaggagtttgagaccagcctggccagtatggcgaaaccccatctctactaaaaatacaaaaaaattagccaggygtggcggtgggtgcttgcaatctcagctacttgggaggctgaggcaggagaatcacttgaacccgggaggcagaggttgcagtgagccaagatcatgcca

SEQ ID NO: 57035 - DNA, 201 bp, Homo sapiens
ggaggcgcaaacattaaaaaggtgataacttgtccgctgcatcttgcttcttcttgccttgtcctctgtagccctgcaccattttggttttagactaggarggactcttccttacttctagccctgtgctcaactgtgtctcaactctgggagagctctagtcagcttctcatggtgatctctctccctgtagattcgtga

SEQ ID NO: 57036 - DNA, 201 bp, Homo sapiens
tgttaatttggtaagaatacattgactacatactctcccttactactttttattagcattcatattaatcttatttcaaatcaaggttacagcttcatgtmatttgtagagtcagataatcctagaaaggcttgtaagaaagaagtgccaacatccttcccctaatcatgtttcctcccctgcagagtatctacttcagcc

SEQ ID NO: 57037 - DNA, 201 bp, Homo sapiens
ggatctcttgaggtcaggacgagtatgagaccagcctggccaacatggtgaaacctcgtctctactaataatacaaaacttagctgggcatggtggcgggygcctgtaatcccagctactccggagactgaggcaggagaattgcttgaacccaagagccagaggttgcggtgagccaagatcgcgccaccgcactccagc

SEQ ID NO: 57038 - DNA, 201 bp, Homo sapiens
tctgagctctttagttaggcatgattctctactagagggaatgtcaggagagtgatgctggattgctaaatataaggtcctctgttttcctccctggaggrggagaaaggagcaattctctagacatgccaatataacatttccttttatttttaagtagtgtatttctttttcttttcttttctttcttttttttttttt

SEQ ID NO: 57039 - DNA, 201 bp, Homo sapiens
tgtatttctaatacagaaaatagagggaaatggaaaatacagaaaacggaagaaatagaagtgccccattattgcactgcccagattttaacaaataaaartaatagcaagaaaatccaagccatacagagaatggtaccaaatgaaaaataattgttccttcatttctcccttcccatgcccccagcagggaggagttac

SEQ ID NO: 57040 - DNA, 201 bp, Homo sapiens
tttaaagagaatgaacgcagccgaagttgaatcgaggcagtgatttcactcagtgcgttgggtctttccactcacctggccctccagaaccccagggccttgagtgcatgggctggtacaagagcccagtttttggctggggaggcacttcctatgggagggggacgcctgtctcagtgctgaggcaaccaccaccgagga

SEQ ID NO: 57041 - DNA, 201 bp, Homo sapiens
atagaagtgccccattattgcactgcccagattttaacaaataaaaataatagcaagaaaatccaagccatacagagaatggtaccaaatgaaaaataatkgttccttcatttctcccttcccatgcccccagcagggaggagttactattaagtttcttatgtgcacattttaaatttgtatgtttccccctcttactta

SEQ ID NO: 57042 - DNA, 201 bp, Homo sapiens
gattgattaaaaaaaaaaatttcgcagctgggcgcaggtggctcacgcctgtaatcctagcactttgggaggccgagacaggtggatcacctgaggtcagragttcaacacaagcctggccaacatggagaaaccctgtctaccaaaaatacaaaaattagccggacatgatggtgggtgcctgtaatcccacctacttgg

SEQ ID NO: 57043 - DNA, 201 bp, Homo sapiens
gacatgccaatataacatttccttttatttttaagtagtgtatttctttttcttttcttttctttcttttttttttttttttttgaggaagaatctcactstgtcacccaggctggagtccgttggtgccatctcggctcactgcaacctccacctccccagttcaagtgattcttcttcctcagcctcccgagtagctgg

SEQ ID NO: 57044 - DNA, 201 bp, Homo sapiens
caaggggaggcaccggggagtgaccgttgtccggagccaccacggtgttttggtgagtgcaggagcgagaggagggagggccttagggaggctggtgctasccctcgtggttgaccctggtgttgagaccagttctgactgccatgctgttcccgaggctgagtctagcgtctccctggtgccaaccccagggctgactgt

SEQ ID NO: 57045 - DNA, 201 bp, Homo sapiens
gtgttttggtgagtgcaggagcgagaggagggagggccttagggaggctggtgctagccctcgtggttgaccctggtgttgagaccagttctgactgccaygctgttcccgaggctgagtctagcgtctccctggtgccaaccccagggctgactgtagctctgaccaccctgataccagggctgacctaggtattccctg

SEQ ID NO: 57046 - DNA, 201 bp, Homo sapiens; identical to SEQ ID NO: 10740

SEQ ID NO: 57047 - DNA, 201 bp, Homo sapiens
ccccagggctgactgtagctctgaccaccctgataccagggctgacctaggtattccctgtgacccagcacactcctgcaggtgtcggcctcggccttgaygccaacactgactcctacacccggtgaggggtgggccagctcttcctgtgccccctgcctggttgagccactgagttctggaatgggggtgagaatgtgg

SEQ ID NO: 57048 - DNA, 201 bp, Homo sapiens
cccccttctctgggtctttcgggaggattgtgaaccctcccaattctaatacaggtcagagaataaagtctctcctggagctcggtcatccttctggcaawgctctcttcttcatttactctcccctgcttagagacagcatcttcacctcaagccacggctccaggagaaaggcatccaaggtcatggtggtgctcaccg

SEQ ID NO: 57049 - DNA, 201 bp, Homo sapiens
taggcttgggcgagctcgcagcttccagcgctttggggtcacggtcaggctgggccggtccttgggcactcggccgccgggacacctccgccgccgcctcwccgggctgccggggaagtcggggtcgtcgggatcgtcaggatcgtcggactgcgaggggtcgccgatgctggcgtcgctgctgccgctgctgttgaagaa

SEQ ID NO: 57050 - DNA, 201 bp, Homo sapiens
ggttgcagtgagccaagatcatgccattgcactccagcctgggcgacagagtgagactccatctcaaaaaaaagaaaaaaaaaaaaaagaaagaaagaaakaaaccctgagaacaggacaggttagagctgggtgaaggcaagatgtgagcttcaagtcagtgaccagttaaaaagattgttaaacatttaaatacaaaat

SEQ ID NO: 57051 - DNA, 201 bp, Homo sapiens
tgcacagcctggggtggggagaagccagggttgtcgatgggggcttttctgtaagcagcttatccagaccctgttctatttgcaaatgctcctcttctctycatgctctgtcatcccagagagggctcatttccccatggtggtcacagcttactggccaaatagtggtgggagagccacaggaaacacaccaaggagggt

SEQ ID NO: 57052 - DNA, 201 bp, Homo sapiens
cttttggccctttttaaagcggtgggaatggaggagagaggtttccgttgcctcctgatgtttgctcttccggcttgatctagttctctccagcctgtctrttccccttggcacaatgcggcccttgggaacactggcctcctgatgctctctccggacggcctcttgaagccctctctcttgacaagagtcctggcctgt

SEQ ID NO: 57053 - DNA, 201 bp, Homo sapiens
cccagagagggctcatttccccatggtggtcacagcttactggccaaatagtggtgggagagccacaggaaacacaccaaggagggttcctggaggaccgyggtgccaagctgagtcctgccagacaaatgggagtagctggcctagggcacaggggaggcagagaggggccctgcaggcagagggaacagcatgtgcaga

SEQ ID NO: 57054 - DNA, 201 bp, Homo sapiens
agaagtggcagtggtatagatgctgcagacctctgacacatcagtcacaattttcttcttgtggaaactgaaggaagccctggttttggtccaaaagcagrcattctgtaaaggagtcaggtcctgggtggggaacgaatcttttcccagcttttggccctttttaaagcggtgggaatggaggagagaggtttccgttgc

SEQ ID NO: 57055 - DNA, 201 bp, Homo sapiens
gattcctgtaaaagagcgattttattttaattaattaatttatttatttattttgagacggagtcttgctctgtcgcccagtctggagtgcagcggtgcartctcggctcactgcaacaaaagggtggccatattgatgacaggaggtcgcttttttctgtgtgctcaaacatccagttgttcccctgaatacagaccagg

SEQ ID NO: 57056 - DNA, 201 bp, Homo sapiens
catttcaacaaatatttcagtttccatttggaaacaaaattcttgtttgaaaagctgactggaaacctgtgagaatgggagttccaccctcctgtggggayggaggttgaaacagcaccagaggcttcaagaccagtctcctctcatttcggggcagtaagatacatttagcttacttaaacagactgtgctggcagagca

SEQ ID NO: 57057 - DNA, 201 bp, Homo sapiens
tgtcacccaggctggagtatagtggcgtgatctcagccctctgcaaactccccctaccgggttcaagcaattctctgtctcagcctcccgagtagctgggrttacaggcacctgccaccacacccggctactttttgtatttttagtagagacggggtttcaccatcttggccaggctggtcttgaactcctgacctcagg

SEQ ID NO: 57058 - DNA, 201 bp, Homo sapiens
ggccttgagtgcatgggctggtacaagagcccagtttttggctggggaggcacttcctatgggagggggacgcctgtctcagtgctgaggcaaccaccacygaggaccctgggctggaagctgggctgagatgtctggtggtaggttctgaggcaggacaggggaccgactcaaatggatgatacgaacggcaggctggat

SEQ ID NO: 57059 - DNA, 201 bp, Homo sapiens
agcacacggtgtgttcacagccacaccacccttgccccaggttacgctgtggccgtgctgcacaagacctgcagcctctcctacgtcgcgggggctccacrgtacaaacatcatggggccgtgtttgagctccagaaggagggcagagaggccagcttcctgccagtgctggagggagagcaggtacctgctggggaaagc

SEQ ID NO: 57060 - DNA, 201 bp, Homo sapiens
ggtcttgctatgttgaccaggctagatatgaactcttgggctcaagcgatcctcctgcctcagcctcccgagtagctgggactacaggcgcacgccactgygcccggctagtttacttctttcagaacatttgttatcagcaaatttaaacatttcaacaaatatttcagtttccatttggaaacaaaattcttgtttgaa

SEQ ID NO: 57061 - DNA, 201 bp, Homo sapiens
gcaggcggatcacctgaggtcaggagttcgagaccagcctgaccaacgtggagaaaccccgtccctaataaaaatacaaaattagccaggcatggtggcgygtgcctgtaatcccagctactcaggaggctgagacgggagaattgcttgaacctgggaggtggaggttgcagtgagccgagatcgtgccattgcactcca

SEQ ID NO: 57062 - DNA, 201 bp, Homo sapiens
actcaggtatttaaaggcagttctttatcagtcacacctctttccacagtgactacagagtctcaagtataaaaaccagagttctagaaacagagtgaagrcaagttaaccatgggaaaagattaggagtaaattcccgaagtcctgttcagaaggactctcaatcactcagctcttaaagcaacctgtcagttttcctcc

SEQ ID NO: 57063 - DNA, 201 bp, Homo sapiens
ctcagctgactgtgaggtttggggtggagttgatgaggctccgtgtagaagatcgaggtggggggactgcggctggctgcagatggctctgaggcacagtsctcccacgaggccccgctgggtgttctgggcggggtgtcgggacccctgcatctagccccacttcttcagctcctggtatcagtgtgggcaaatcatgcc

SEQ ID NO: 57064 - DNA, 201 bp, Homo sapiens
ggtgctcaggctggatggcggctgggcggggcagcggcatcgctctccgcacccactttcttacccaagggtgatcgttgatgataatatctctaatatcyctttttttgtggttgttgtttttgagatggagttttgctctcgttgcccaggctgcaatgcaatggcaggatcttggctcaccgcaacctctgcctccgg

SEQ ID NO: 57065 - DNA, 201 bp, Homo sapiens
ggtatcagtgtgggcaaatcatgccccatgggcctcggtttcctaaattgggaatcgtggtacttattgtactgtgagaatgtgagttgaaattgcccggwgtgctgggggagacagagggttgaggggagacagtggtggctgacaggatggagggggatctcggtctgactcagcaggcctccgtggctggggacagct

SEQ ID NO: 57066 - DNA, 201 bp, Homo sapiens
ccctgcccatggaactagaggggggcgggctctgactcctgaacttccaggtaggaggaccccagctttcccctggtgctcactgtatggccttgggaagktccctggccagtgagcgtgcatcctgggtggcaacggagtgggcacccaccagcccagcgagcgtgcatcctgggtggcaacggagtgggcacccaccgg

SEQ ID NO: 57067 - DNA, 201 bp, Homo sapiens
taacatgttggcagctcgcactttttaattctcctctaggcagtttgctgacgtcctgttttttccccagagtgactgaccaggaggcacagggctcaacrtgacgtgggccccggggccggagcccagactccctgctgggcatcctttatctcagttctggattcgtgggggagcagcgggaacagtacggccttcttc

SEQ ID NO: 57068 - DNA, 201 bp, Homo sapiens
agtgggtggatcacttgaggtcaggagttcgagaccagcctggctaacatggtgaaaccctgtttctattaaaaatacaaaaaattagccgggcgtggtgktgggcacctataatcccagctacttgggagactgaggcaggagaattgcttgaacccgggaggtggaggttgcagtgagccgagatcgcgccacttcact

SEQ ID NO: 57069 - DNA, 201 bp, Homo sapiens
tctactaaaaatacaaaaaaaattagctgggcgcgatggcgggtgcctgtagtcccagctactcgggaggctgaggcaggagaatggcgtgaacccgggargcggagcttgcagtgagccgagattgcgccactacactccagcctgggccacagagcaagagtctgtctcaaaagaaaaaacaagaaagaaaactttgct

SEQ ID NO: 57070 - DNA, 201 bp, Homo sapiens
cctaccgagggtgggccaccatgccaggccctgagataatgtggcgatcgaggcagatgcagtgtgtgcccccttggactcactggtggcagggggcagtyactggcaatagggaaacaaggaaggccaagcacagtggctcactcctgtaatcccagcacttagggaggccaagactggaggatcacttgagcccaggaa

SEQ ID NO: 57071 - DNA, 201 bp, Homo sapiens
cgagattgcgccactacactccagcctgggccacagagcaagagtctgtctcaaaagaaaaaacaagaaagaaaactttgctgtttgaagtagttacgtcrgtaattatgaacccctatccctcttgcctggagagtgtaagtcattttgaccaagagaagagtctgtttccacctgaggtagagagcttcagatacagtg

SEQ ID NO: 57072 - DNA, 201 bp, Homo sapiens
atctgaactccacccttccctggagtcctttaataaccgccttttccattgttcagtgatacacacaatagtgtagtttttggatgggtgcagtggcccawgcctgtaatcccagcactttgggaggccgaggcgggcggatcacctgaggtcaggagttcgagaccagcctggccaacatggcaaaaccccgtctctact

SEQ ID NO: 57073 - DNA, 201 bp, Homo sapiens
ctccagcctcctcctggtccaaccaacagatggttaataactagataaatccccgccagtccagctccatgcctcccgaggcaccatattctgctgcagtrccaccctccctatgtgcggccctttcttcaccagggttctgagagagaagtgagtctaatgccctaagacactgagaaagtaaaaattagcttagactgg

SEQ ID NO: 57074 - DNA, 201 bp, Homo sapiens
ggaagtttaacgtcaggtttcagttctgtggcgagcacactctaagcagttgtgaggattttgccccacttcctgcagttatttcacctctttttcttttktgtgtgtgtgtgtgtgtgtttgtttgagacggagtcttgctctatcaccaggctggagtgcagtggtgcgatctcggctcactgcaacctccgcctccca

SEQ ID NO: 57075 - DNA, 201 bp, Homo sapiens
tctgttttttttggagatgaagtcttgctcttgtcgcccaggctggagtgcaatggcgcagtctcggctcactgcaccctccgcctcccaggttcaagcarttctcccaccatagcctcccgaagctgggactacaggcacacgctgccacgcctggctaattttttgtgtttttagtaaagacagggtttcaccatgttg

SEQ ID NO: 57076 - DNA, 201 bp, Homo sapiens
tgagacaggagaatcgcttgaacccgggacacagaagttgtagtgagccaagattgcaccactgcactccagcctgggcgacagagcaagaccccatctcaaaaaaaaaaaagaaattaataaaaataaattgctgacttaagtataattcaactctaaacatttcagcatacatatcaacaaaatgtgtttgtgcttctt

SEQ ID NO: 57077 - DNA, 201 bp, Homo sapiens
caccgtggctcacgcctgtaatctcaacacttagggaggctgaagctggaggatttcttgaggccaggagttcaagaccaccctgggcaacatagtgagacccccccaactcaaaaaaaaccaaaaactgtctgggcatggtggtgcctgcctgtagtctcagctacttgggaggctgaggcaggaggaccacttgggccc

SEQ ID NO: 57078 - DNA, 201 bp, Homo sapiens
ctgaggcgggcggatctcttgaggtcaggacgagtatgagaccagcctggccaacatggtgaaacctcgtctctactaataatacaaaacttagctgggcrtggtggcgggcgcctgtaatcccagctactccggagactgaggcaggagaattgcttgaacccaagagccagaggttgcggtgagccaagatcgcgccac

SEQ ID NO: 57079 - DNA, 201 bp, Homo sapiens
cgtcttggggtcacggttaggcttgggcgagctcgcagcttccagcgctttggggtcacggtcaggctgggccggtccttgggcactcggccgccgggacrcctccgccgccgcctcaccgggctgccggggaagtcggggtcgtcgggatcgtcaggatcgtcggactgcgaggggtcgccgatgctggcgtcgctgctg

SEQ ID NO: 57080 - DNA, 201 bp, Homo sapiens
taatacaaaacttagctgggcatggtggcgggcgcctgtaatcccagctactccggagactgaggcaggagaattgcttgaacccaagagccagaggttgmggtgagccaagatcgcgccaccgcactccagcttgggcgacagagtgagactccatctcaaaaaaataaaaataaaaaataaagtcatagcaaaagttac

SEQ ID NO: 57081 - DNA, 201 bp, Homo sapiens
aaactgttacatagtaagtaaatgggtgagtgtgtcttcccgtgagagtgcgatgtcaaatgtcattccttatatcgtgtttactcagtgtatttagagaygaaaaagtcactaaaccaaaaaaaggagtgttgccaagaagttgtatagcttttcaagagtgtttatggcaaaagtcgttaattgaacagtaattgaaca

SEQ ID NO: 57082 - DNA, 201 bp, Homo sapiens
gatggcgggtgcctgtagtcccagctactcgggaggctgaggcaggagaatggcgtgaacccgggaggcggagcttgcagtgagccgagattgcgccactrcactccagcctgggccacagagcaagagtctgtctcaaaagaaaaaacaagaaagaaaactttgctgtttgaagtagttacgtcagtaattatgaacccc

SEQ ID NO: 57083 - DNA, 201 bp, Homo sapiens
atctcagtcaggataagctcacagatgtggccatcggggcccccctggaaggttttggggcagatgatggtgccagcttcggcagtgtgtatatctacaayggacactgggacggcctctccgccagcccctcgcaggtgacccatggggccctctccttcctctcctctggggctctgacctctctcagatatgatgacc

SEQ ID NO: 57084 - DNA, 201 bp, Homo sapiens
gcaggtctcgggggttgggaatgcccagtgaaagaaagaagtcccccaggctagggggagcttccagaccagggcctcacctcagccccttcaggttgggrggaggttccagaccagggcttcacctcggccccttcaggttcgggggaggttgtggcggtacctgtctccttccctggcctataccccctccttccaccc

SEQ ID NO: 57085 - DNA, 201 bp, Homo sapiens
atttaaaaaaaaattagaggccaggcacggtggctcacgcctgtaattccagcactttaggaggccgaggcgggcggatcacaaggtcaggagttcaagaycagcctgaccaacatggcaaaaccccgtctctactaaaaatacaaaaattagtccggtgtggtggcaggtgcctgtaatcccagctacttgggaggctta

SEQ ID NO: 57086 - DNA, 201 bp, Homo sapiens
ccccaggctagggggagcttccagaccagggcctcacctcagccccttcaggttggggggaggttccagaccagggcttcacctcggccccttcaggttcrggggaggttgtggcggtacctgtctccttccctggcctataccccctccttccacccacctgcctcgggtccctgcttcctctctttctgtccctcgctc

SEQ ID NO: 57087 - DNA, 201 bp, Homo sapiens
gacccctaggcagggaagaaggctgtactgttcctgctgctcccccacgaatccagagctgagataagggatgcccagtagggagtctgggctccggcccyagggcccacgtgagacaggagaatcacttgaactgaggaggtgggggttgcggtgagccaagatcacaccattgcagtccagcctgggtgacagagtgag

SEQ ID NO: 57088 - DNA, 201 bp, Homo sapiens
atccccaagccccacatcaagcctccttgtaccccaatcccctgtggtccaccccgtccctggccctggctgcttctcagaaggccctgctctttccccaygcctcactctttcccttactctcccctgtcaagtcccacctgccctacgaggctccatccaaatgccacttcctctgggaaagcttgctccctctttcct

SEQ ID NO: 57089 - DNA, 201 bp, Homo sapiens
agtttgtggtggttcagagtcctgattctggaggaaacaggcctgtttggagtcccagctctgctccttactagctatgtggcctctcagaggcagcatcyttatctgagaaatcgggttgaccttgtaggtggctgagaggctcagatgagggctcgcatgtgaggccttggcactgagcagggcactcctactgagtgt

SEQ ID NO: 57090 - DNA, 201 bp, Homo sapiens
tgtcatttcactcccaaaaaacatggacattttcatttctaaagaacatgaagggccgggcgtggtggctcacacctgtaatcccagcactttgggaggcygaggctggtggatcacctgaggtcaggagtttgaaatcagcctggccaacatggcgaaaccccatctctactaaaagtacaaaaattagccaggcatgtt

SEQ ID NO: 57091 - DNA, 201 bp, Homo sapiens
tccaccccgtccctggccctggctgcttctcagaaggccctgctctttccccatgcctcactctttcccttactctcccctgtcaagtcccacctgccctwcgaggctccatccaaatgccacttcctctgggaaagcttgctccctctttcctggttctagactcggggctccctggggctggatggtgcctgcgatgct

SEQ ID NO: 57092 - DNA, 201 bp, Homo sapiens
cgcttggataaatacatactggatggatgcaggatgagtccgcattctagaagtgtgcagaggtacagaagtggccctgctccctgtccagcacccagtcrtcagctttccctggcttcccgaggcaccctgacgttcacactccaaacacaaagtcttctctcaggaatctcgagtgagctgcagtctgggttctagccc

SEQ ID NO: 57093 - DNA, 201 bp, Homo sapiens
tactcaggaggctgaggcaggagaatcacttgaatccgggagacagaggttgtagtgagctgagatcgcaccactgcactccagcctgggcaacagagtamgactcagtctcaataataaagaacgtggacattttcttaaatagccacaatgttcttaccacctaactaaattaattctttggtatcatctaataccaaa

SEQ ID NO: 57094 - DNA, 201 bp, Homo sapiens
tagtgagctgagatcgcaccactgcactccagcctgggcaacagagtacgactcagtctcaataataaagaacgtggacattttcttaaatagccacaatrttcttaccacctaactaaattaattctttggtatcatctaataccaaatacttagtccatatacaaatctctctgtctcaaaatgtcttttttttttttt

SEQ ID NO: 57095 - DNA, 201 bp, Homo sapiens
cgcctgaaatcccagcatttgagaggccaagtgggggcagattacttgagatcaggagttcaagaccagcctggccaacagagtgaaactccatctctacmaaaaatacaaaattgatctgggtgtggtggcacatgcctgcaatcccagctacaggggaggttgaggcaggagaatcgcttgaacctgggaggcagaggt

SEQ ID NO: 57096 - DNA, 201 bp, Homo sapiens
ggcatgagccactgcacccggccgtattatgctttttataattccctggatttgatttactggaattttgtgcagcatttttgtatttatgttcgagagaracggttgtttcaattttcctttcatttattgtgcttgctggattttaatatcaatgttatactggcttcataaaatgactgaaaaatgttttctcatttt

SEQ ID NO: 57097 - DNA, 201 bp, Homo sapiens
ttgactaggacgtggagagctctgagaagtaaaccgtgtacctggttgtaatgggagggcttttctggccctcctctgcctgcctcacacctgcctgttaycccagccccggctgctctgcctttgggtagtttctagggcttggttggagcagcccattcacctctcatggagccccgtaccttgccagtgttacatcac

SEQ ID NO: 57098 - DNA, 201 bp, Homo sapiens
gcgatctcggctcactgcaagctccgcctcccgggttcacgccattctcctgcctcagcctcccgagtagctgggactacaggcgcccgccaccacgcccrgctaattttttgtattttcagtagagacggggtttcaccgtgttagccaggacggtctcgatctcctggcctcgtgatccgcccgcctcggcctcccaaa

SEQ ID NO: 57099 - DNA, 201 bp, Homo sapiens
gatctcggctcactgcaagctccgcctcccgggttcacgccattctcctgcctcagcctcccgagtagctgggactacaggcgcccgccaccacgcccggmtaattttttgtattttcagtagagacggggtttcaccgtgttagccaggacggtctcgatctcctggcctcgtgatccgcccgcctcggcctcccaaagt

SEQ ID NO: 57100 - DNA, 201 bp, Homo sapiens
tgttagccaggacggtctcgatctcctggcctcgtgatccgcccgcctcggcctcccaaagttctgggattacaggagtcagccacctcgcctggcccctytattttttaaatgtcttaggatctattatgatgtcccccctttttattttttattcatgttggtaatttgtgtgttctctttttttttttcttgttcagt

SEQ ID NO: 57101 - DNA, 201 bp, Homo sapiens
aactggaatgtggggtggggggaggcacttctgctgcctggggggtcccattttagcctttaactgtcccatggaagcctctgggcaagccaagccatgartcctttcgggggccccctgtgatgagacagcacggtcaggtgagcccctggaggctgctaagattaagccggaggccagggtggtcctgcctagtgatct

SEQ ID NO: 57102 - DNA, 201 bp, Homo sapiens
gcatctgaggtgggctctgaaggacggggaggtccttggcaagtacaggctgggggtgagcagaggggccttctgtgcaggggggataggagggaccaagccctggggtgtgaagagtctggtttgtaggaagatggaggcgaagtgtgagtgggagcaggagattgtctcctctggtgttgctttcccttccagccccgc

SEQ ID NO: 57103 - DNA, 201 bp, Homo sapiens
tctactaaaaatacaaaaatgagccaggcatggtggtgcgcacctgtaattccagctacttgggaggctgaggcaggagaattgcttgaacccaggaggcrgaggttgcagtgagctgagatcacaccactgcactccagcctggaagacagagagagacaccgtctcaaaaaaaaaaaaaaggccaggcgcagtggctca

SEQ ID NO: 57104 - DNA, 201 bp, Homo sapiens
cagtggtgcgatctcggctcactgcaacctccgcctcccaggttcaagcgagtctcctgcctcagcctcccaagcagctaggactacaggcatgcgccacyacgcccagctaatttttgtatttttagtagagatagggtttcactgtgttggctgggctggtcttgaactcctgacctcaggtgatccacccatgtcggc

SEQ ID NO: 57105 - DNA, 201 bp, Homo sapiens
gaggttgcagtgagctgagatcacaccactgcactccagcctggaagacagagagagacaccgtctcaaaaaaaaaaaaaaggccaggcgcagtggctcamgcctgtaatcccagcactttaggaggccaaggtgggcagatcatgaggtcaggagatcgagaccatcctggctaacacagtgaaactccgtctctactaa

SEQ ID NO: 57106 - DNA, 201 bp, Homo sapiens
ggaaactttcattttattaattaattaatttatttatttatttgagatagagtcttgctctttctcccaggctggagtgcagtagcatgatctcggctcaytgcaacctccgcctcccaggttcaatcgattctcatgcctcagcttcctgagtagctgggactgcaggtgcatgccaccacaccaaactaatttttgtat

SEQ ID NO: 57107 - DNA, 201 bp, Homo sapiens
agtcttgctctttctcccaggctggagtgcagtagcatgatctcggctcactgcaacctccgcctcccaggttcaatcgattctcatgcctcagcttcctragtagctgggactgcaggtgcatgccaccacaccaaactaatttttgtatttttagtagagactgggtttcaccatgttgaccaggctggtcttgaactc

SEQ ID NO: 57108 - DNA, 201 bp, Homo sapiens
tcttgctctttctcccaggctggagtgcagtagcatgatctcggctcactgcaacctccgcctcccaggttcaatcgattctcatgcctcagcttcctgaktagctgggactgcaggtgcatgccaccacaccaaactaatttttgtatttttagtagagactgggtttcaccatgttgaccaggctggtcttgaactccc

SEQ ID NO: 57109 - DNA, 201 bp, Homo sapiens
acttttacttttggagactggggtctcaccttgttacccaggctggacttgaactcctgagctcaagtgatctgcagtagctgggactaagggcatgtgcyactgtgcctggcttagggaaacttaatcacttcaggaagcatcgtcgtcctaatagcagagttcaggaggatgcacctaaattgacaattcccaacttcg

SEQ ID NO: 57110 - DNA, 201 bp, Homo sapiens
gcctcggcctcccaaagttctgggattacaggagtcagccacctcgcctggcccctctattttttaaatgtcttaggatctattatgatgtcccccctttytattttttattcatgttggtaatttgtgtgttctctttttttttttcttgttcagtattgctagtgatttatcattttaaaaatctttaaaaaaaacttc

SEQ ID NO: 57111 - DNA, 201 bp, Homo sapiens
atcacactactgcactccagcctggacaacagagcaagacactacctaaaaaacaaacaaaccccacaaaataacaggaggctattaccatcaacaaggcmggacgatgatggaaggagcatctggagaagagttgctttctagaaataatttggagagtcgggcacggtggctcatgcttgtaattccagcactttggga

SEQ ID NO: 57112 - DNA, 201 bp, Homo sapiens
atctttccaaacccatattctgagccgggcactttgggaggccgaggtgggtggatcacctgaggtcaggagttcgagaccagcttgcccaacatggtgamaccctgtctctactaaaaatgcaaaaattagcctggcgttgtggcaggcgcctgtaatcccacctccttgggaggctgaggcaggagaatcgcttgaaca

SEQ ID NO: 57113 - DNA, 201 bp, Homo sapiens
tgttcagtattgctagtgatttatcattttaaaaatctttaaaaaaaacttcagcatcattagttttctctactgtaagttggtttgctgtttcattgatrcgtgttcatatctttattccttcccgtacttcctttaggtctgatttgctattccactgtaattttatctttcaccctgggttatttagaaatgcattgc

SEQ ID NO: 57114 - DNA, 201 bp, Homo sapiens
ttcagtattgctagtgatttatcattttaaaaatctttaaaaaaaacttcagcatcattagttttctctactgtaagttggtttgctgtttcattgatacrtgttcatatctttattccttcccgtacttcctttaggtctgatttgctattccactgtaattttatctttcaccctgggttatttagaaatgcattgctt

SEQ ID NO: 57115 - DNA, 201 bp, Homo sapiens
ctgatttgctattccactgtaattttatctttcaccctgggttatttagaaatgcattgcttaattttcacgaggttcagatttttctagttttccttccktccttccttccttccttccttccttccttccttccttccttccttccttccttcctccttccttccttccttcctttctttcttctttcccaagtctcac

SEQ ID NO: 57116 - DNA, 201 bp, Homo sapiens
gaatataaaaatacagtttccgtataaaatgtattgtcatgaaggtttattggcctcattaaaaggagaagacaagatttgacagtgggggctaggcgcgrtggctcacgcctgtaatcccagcactttgggaggctgaggcgggcggatctcttgaggtcaggacgagtatgagaccagcctggccaacatggtgaaacc

SEQ ID NO: 57117 - DNA, 201 bp, Homo sapiens
ccaggttcaagcgattctcccttgtcagcctcccgagtagctgggattataggcacccgccaccatgcccggctaatttttgtatttttagtagagacagkgtttcaccacattggtcaggctggtctcaaactcctgacctcaggtgatccaccgcctcagcctcccaaaatgttgggattataggcatgagccaccgca

SEQ ID NO: 57118 - DNA, 201 bp, Homo sapiens
tgggaaaaaagtaaagttgtatccctatttcactccaaatgtaaaaataaaatccagatggacaaaaggttcgaacataagaaattaaagaagagaccggrccttggctcacgcctgtaatcccagcactttgggaggctgaggcgggcggatcacctgaggtcaggagttcaagaccatcctggccaacgtggtgaaacc

SEQ ID NO: 57119 - DNA, 201 bp, Homo sapiens
gtctccactaaacaaaatacaaaaaattagccaggtgtggtggcgggcgcctgtagtcccagctacgggggaggctgaggcaggagaatggtgtgaacccrggaggcggagcttgcagtgagccaagatcgcgccgctgcactccagcctgggtgacagcgagactctgtctcaaaggaaaaaaaaaaagaaaaaagaaaa

SEQ ID NO: 57120 - DNA, 201 bp, Homo sapiens
tactaaaatacaatattagccgggcatgatggcgggtgcctgtaatcccagctatttgggaggcttaagaggctcagatgggagaatcccttgaacccggsagatggtggttgcagtgagccgagatagcgccactgcactccagcctgggcggctcagcgagactttatctcaaaaaaaaaagaaagaaagaaaaaagaa

SEQ ID NO: 57121 - DNA, 201 bp, Homo sapiens
tgtctctccctagctgagctggttctgttctgtacagtaagagaggcggccccgggatctccacggtgcttccagctgtgccgtcctggggtttttctcckcagagtccctctttccctctccattctctttgttgtctctcttcctccttattttcttcttcaatctcgatccccttcccgagccctccttccctaaaga

SEQ ID NO: 57122 - DNA, 201 bp, Homo sapiens
ctgacgcctataatcccagcacttggggaggctgagatggcaggattacttgagcccaggagttggagaccagcctgggcaacatagtgagacaccatctytacaaaaaattttttaaaaattagccaggcctgctggtgcgcatctgtggtcccagctacttgagaggctgaggcgggaggatggattgagccctggagg

SEQ ID NO: 57123 - DNA, 201 bp, Homo sapiens
tcactctgaggaggtgtttgagactgaaatgctccagatttgattatccagttgctcacgggcatcgcccctagaagagataatagcatctttgcataacrtgtccatgtccaaaatagatcttttggtgcaaaaaaccaaccctctgtcccaacccgttccttagctaccctcaggagggagatatactccagttacagt

SEQ ID NO: 57124 - DNA, 201 bp, Homo sapiens
gttggcaggtgcagtggctcacctgtaatcctagcactttgggaggtcaaggcgggtggatcacatgagcccaggagttcgagaccagcctgggtaacacrgtgagaccctgtctacaaaaaatataaaaaaatcagccggatatggtggtttaagcctgtagtccgtcccagctattgggaggctgaagtgagagacctg

SEQ ID NO: 57125 - DNA, 201 bp, Homo sapiens
tgaggcaggagaatggcgtgaacccgggaggcggagcttgcagtgagccgagattgcgccactgcactccagcctgggcgacagagcgagactccgtctcaaaaaaaaaaaaaaaatatatatatatatatatatatatttagtttccagcacacagtagtgctcaaggcctgttggcctttcttgttattagggagatga

SEQ ID NO: 57126 - DNA, 201 bp, Homo sapiens
cgtgaacccgggaggcggagcttgcagtgagccgagattgcgccactgcactccagcctgggcgacagagcgagactccgtctcaaaaaaaaaaaaaaaawatatatatatatatatatatatttagtttccagcacacagtagtgctcaaggcctgttggcctttcttgttattagggagatgaagggtgagggagagag

SEQ ID NO: 57127 - DNA, 201 bp, Homo sapiens
aacccgggaggcggagcttgcagtgagccgagattgcgccactgcactccagcctgggcgacagagcgagactccgtctcaaaaaaaaaaaaaaaatatawatatatatatatatatatttagtttccagcacacagtagtgctcaaggcctgttggcctttcttgttattagggagatgaagggtgagggagagagatgg

SEQ ID NO: 57128 - DNA, 201 bp, Homo sapiens
tctagctttttgctttactgtcatcagctttgatcaatacacgggttgttgccaagtcctcgtattttgctccttaaaataacatgtaggattttttcctygtttgcttcacctgatttattgggcgatctctttgtcttgtctagatcactgtcgtcttcctgaaagatgagaagtaccattctttgcctatcatcatta

SEQ ID NO: 57129 - DNA, 201 bp, Homo sapiens
gcgagtccagtctgaggaaacaagctgagccaggcctggcagacctgggcaccagctggctctcagggaaagcccagcaaatacagcgaactaccccaccacacacacacacacacacacacacacacacacacacacggatgcacacacacacacacggatgcacacacatggatgcacacacacacggatgcacacaca

SEQ ID NO: 57130 - DNA, 201 bp, Homo sapiens
ccctattccatgaaagtgtgggtcaaagtgtgggtggtagagtggggctgacagtggcccctaagctcctagggtccagcccacaactgaggaagccacayggctggttgtgtacgagccggagtgtctctgtttggttgaaagtgccggtctgtgggtccttgctggtgtgtgtgcttctgtccccgcctcctggcctcc

SEQ ID NO: 57131 - DNA, 201 bp, Homo sapiens
gtccagtctgaggaaacaagctgagccaggcctggcagacctgggcaccagctggctctcagggaaagcccagcaaatacagcgaactaccccaccacacacacacacacacacacacacacacacacacacacggatgcacacacacacacacggatgcacacacatggatgcacacacacacggatgcacacacacagg

SEQ ID NO: 57132 - DNA, 201 bp, Homo sapiens
aagtttaacgtcaggtttcagttctgtggcgagcacactctaagcagttgtgaggattttgccccacttcctgcagttatttcacctctttttcttttgtktgtgtgtgtgtgtgtgtttgtttgagacggagtcttgctctatcaccaggctggagtgcagtggtgcgatctcggctcactgcaacctccgcctcccagg

SEQ ID NO: 57133 - DNA, 201 bp, Homo sapiens
cgtcctggggtttttctcctcagagtccctctttccctctccattctctttgttgtctctcttcctccttattttcttcttcaatctcgatccccttcccragccctccttccctaaagaaggctgactcagtcctgggaatgtgctgctccgggtttggggcgggagcactcagagaccctggtcaggtgtcagaagacg

SEQ ID NO: 57134 - DNA, 201 bp, Homo sapiens
aatataaaaaaatcagccggatatggtggtttaagcctgtagtccgtcccagctattgggaggctgaagtgagagacctgcctgagcccgggggcgggtgrgtcgaggctgcagtgagccgcgattgtgccactgcacttcagcctgggtgacagaacgagaccctgtctcaaaaaaaaaagaagcaagtaagtaaaatat

SEQ ID NO: 57135 - DNA, 201 bp, Homo sapiens
aggcgcccgccaccacgcccagctaattttttgtatttttagtagaaacagggtttcgccacgttggccaggatggtcttgaactcctgacctcaaatgayctgcccacttcggcctcccaaagtgctgggattacaggcatgagccaccgcacctggccccaaaatgacttctagtgctgtgttgttttaaagccagatc

SEQ ID NO: 57136 - DNA, 201 bp, Homo sapiens
tttataataaaccagtaaatgtcggtaagtgcttctctgagttctctgagccactctagcaaattaagcccaaggaaagggtcccagaaaccctgatatgkttgtttggtcgaaagcacaggtgaaataaccggcggctggtgatgggcctcggaagttaggagcagtcttgtgggactgagacctcgacctgtgagggct

SEQ ID NO: 57137 - DNA, 201 bp, Homo sapiens
gtctttgtcccccaagctggagttcagtggcacagttaagggctcactgcagcctcctactcctaggctcaggtgatcctcccatcttagtctcctgagtractgggactgttactcaggtgcatgccaccacacccagctaattttttaattttaattttgtggagatgaggtctccctatattgcccaggctggtctca

SEQ ID NO: 57138 - DNA, 201 bp, Homo sapiens
tgggcgtggtggcgcgcacctgtagtcccagctgcttgggaggctgaggcaggagaatggcatgaacgcgggaggcggagcttgcagtgagccgagatcgygccactgcactccagcctgggcgacagtgagactccgtctcaaaaaaaaaaaaaaaagtctgctcaccattagatttaagtggtaaggatggggccaatt

SEQ ID NO: 57139 - DNA, 201 bp, Homo sapiens
cttggcctcccgaagtggtggggttacaggcataagcacctgaccttgcttttttctcccaacaagtcaaactattccctaaataggttcgtgcctctgcmtacgcgtaggctgcttttcttgtcaggaatgccctccatgactgctcacttcactcactgtcttccctgaaagcggtctagagactcctgagtcctctgt

SEQ ID NO: 57140 - DNA, 201 bp, Homo sapiens
gcgtgatctcggctcactgcaacctctgcctcccaagttcaagcaattctcctgcctcagcctcccgagtagctgggattacaggcatgtatcaccatgcycggctaatttttgtacttttagtagagacggggtttcactatgttggccaggctggtcttgaacacctgacctcaggtgatctaccctcctcggcctccc

SEQ ID NO: 57141 - DNA, 201 bp, Homo sapiens
ggggacgtccgaggtacgggggggcgcatcgaggcaggtgtgttcatcagcgtctactaggatttgcagggtgactgggaattagcatgagaaggaacggkaaggggatggcaggcacagagaacagcttgatcagaagcctggaggccggctgagtaaggtcaggaaactgagaaaatcacgtgtggctaaagctgacag

SEQ ID NO: 57142 - DNA, 201 bp, Homo sapiens
gacgtccgaggtacgggggggcgcatcgaggcaggtgtgttcatcagcgtctactaggatttgcagggtgactgggaattagcatgagaaggaacgggaargggatggcaggcacagagaacagcttgatcagaagcctggaggccggctgagtaaggtcaggaaactgagaaaatcacgtgtggctaaagctgacagtga

SEQ ID NO: 57143 - DNA, 201 bp, Homo sapiens
aagtgctgggattacaggcatgagccaaatccgggcccggccaaactgtttttaaatcactctttagttgattctttgggatttttctaaggagacaattytatttgcaaataatggcaatttggagtctttctgatatttctacttttggctacccttacttctttgactaggacgtggagagctctgagaagtaaaccg

SEQ ID NO: 57144 - DNA, 201 bp, Homo sapiens
gtcttagaatgccccccaggccgggcgcggtggctcatgcctgtaatcccagcactttgggaggcagaggtaggcggatcatgaggtcaggagtttgagasaagcctggtcaacatggtaaaaccccgtctctactaaaaatacaaaaattagctgggcatggtggtgggcgcctgtaatcacagctactgggcaggctga

SEQ ID NO: 57145 - DNA, 201 bp, Homo sapiens
gccaacatggtgaaaccccgtctccactaaaaatataaaaattagccgggtgtggtggtgggcgcttgtaatcccagctacttaggagaggcaggagaatygcttgaacccgggaggcggaggttacagtgagccaagaccgcagcattgcactccagcctgggcaacaagaatgaaactctgtctctccaaaaaaaaaaa

SEQ ID NO: 57146 - DNA, 201 bp, Homo sapiens
ggatccttgctctcctttccggggagcatcaggggtgtgggctagatagcaggaaagaagtaggggtttgtaaacaagagatccaagcccctggacccttrgtcccagcacccagtgcagccctcgccctcccagccccttccttagaaaggacaagaaaatccactccttgttctctccctgtcccatcacccccgcagt

SEQ ID NO: 57147 - DNA, 201 bp, Homo sapiens
gcgcggtggctcatgcctgtaatcccagcactttgggaggcagaggtaggcggatcatgaggtcaggagtttgagacaagcctggtcaacatggtaaaacyccgtctctactaaaaatacaaaaattagctgggcatggtggtgggcgcctgtaatcacagctactgggcaggctgaggcaggagaatcgctcaaactcgg

SEQ ID NO: 57148 - DNA, 201 bp, Homo sapiens
gtaatcccagctacttaggagaggcaggagaatcgcttgaacccgggaggcggaggttacagtgagccaagaccgcagcattgcactccagcctgggcaayaagaatgaaactctgtctctccaaaaaaaaaaaaaaaaagaagagaaaaatgcacacctcataagcatgcagcgcagtgaacatccgcagagtgaagcac

SEQ ID NO: 57149 - DNA, 201 bp, Homo sapiens
aatggcgcagtctcggctcactgcaccctccgcctcccaggttcaagcagttctcccaccatagcctcccgaagctgggactacaggcacacgctgccacrcctggctaattttttgtgtttttagtaaagacagggtttcaccatgttgcccaggctggtctcaaactcctgaactcaggcgatccgcctacctcggctt

SEQ ID NO: 57150 - DNA, 201 bp, Homo sapiens
attgtgattctgttggccagctggctggagttgccgtatatggggaagaacgcagttccccaagtcctggtcagccctttcatagacatttgcaggaccarttgaagactttcaaatgctctggaatccaggctaacaagcaggcacagctgtttccagcagggaattaattacagccaagaaccaacctcccagccagct

SEQ ID NO: 57151 - DNA, 201 bp, Homo sapiens
ttcctatcctctctgaaccatgaaccatttgaggattatttgtatacatcatgctcgtttatccgtaagatgttttagtgaacatttcccaagaacagggrcagcctctcacatgcccatggtacagttctcaaattcaggaaatgtgtaatattctctgatcagcccaggagttgctaatttgtagttcctgtttcaaat

SEQ ID NO: 57152 - DNA, 201 bp, Homo sapiens
atgcatgtcagaagctaaatgctgctgctaaatgctgggggtcaggtgggggaatagagggaagggtatcatcttgggctaacataatctttggggaattmatcacaatttgtaaagaagcccttttagctttttccaagagtggaattaaaaactttttgtaattgctctgcagtgccgaagtgctttccagaaagaccg

SEQ ID NO: 57153 - DNA, 201 bp, Homo sapiens
ctcgcctggttttgcatttagtatcaacgaggcatacggtgtgtgccccgctacgtcgggctcctctctctccacataaggcctgtgaatttcatccatcstgttgccccaggcggtacttcttctggttgccagggttacattgtgtcgacagtactgatgattggcatttgggctgttttcttgggctgtgatgaatag

SEQ ID NO: 57154 - DNA, 201 bp, Homo sapiens
cacagtgctcccacgaggccccgctgggtgttctgggcggggtgtcgggacccctgcatctagccccacttcttcagctcctggtatcagtgtgggcaaakcatgccccatgggcctcggtttcctaaattgggaatcgtggtacttattgtactgtgagaatgtgagttgaaattgcccggagtgctgggggagacagag

SEQ ID NO: 57155 - DNA, 201 bp, Homo sapiens
aaaatacgaaaattagctggtcatggtggcgggcgcctgtaatcgcagcactttgggaggccaaggcaggagaatcgcctgaacccaggaggtggaggttrcagtgagccgagatcgtgccattgcactccagcctgggcgacaagagtgaaactccatctcaaaaaaagaaaaaaaaaaaaaagaatttggagagagaac

SEQ ID NO: 57156 - DNA, 201 bp, Homo sapiens
taggcagtttgctgacgtcctgttttttccccagagtgactgaccaggaggcacagggctcaacgtgacgtgggccccggggccggagcccagactccctrctgggcatcctttatctcagttctggattcgtgggggagcagcgggaacagtacggccttcttccctgcctaggggtcttgatctggaacctttgagagt

SEQ ID NO: 57157 - DNA, 201 bp, Homo sapiens
tttgctgacgtcctgttttttccccagagtgactgaccaggaggcacagggctcaacgtgacgtgggccccggggccggagcccagactccctgctgggcrtcctttatctcagttctggattcgtgggggagcagcgggaacagtacggccttcttccctgcctaggggtcttgatctggaacctttgagagtctatgta

SEQ ID NO: 57158 - DNA, 201 bp, Homo sapiens
tactaggatttgcagggtgactgggaattagcatgagaaggaacgggaaggggatggcaggcacagagaacagcttgatcagaagcctggaggccggctgwgtaaggtcaggaaactgagaaaatcacgtgtggctaaagctgacagtgatgaaaagtaagctgggagagtgtggtggtgcctcgtcacccaggcactgag

SEQ ID NO: 57159 - DNA, 201 bp, Homo sapiens
tttgttcctgggagtagttagggaaatgctgcttcaaaaagccaattttaagtagttgtgaggcatccgagtggaatttggctgcactatccataaaactwgagagtataggcggtatttcacctaccaaggtcagtaccctgcctcaggattcttactgttcatttgagcaattccggggccctctctggatgaccaggt

SEQ ID NO: 57160 - DNA, 201 bp, Homo sapiens
gggaaggggatggcaggcacagagaacagcttgatcagaagcctggaggccggctgagtaaggtcaggaaactgagaaaatcacgtgtggctaaagctgasagtgatgaaaagtaagctgggagagtgtggtggtgcctcgtcacccaggcactgagggtttggaggaactagagggtctgaagccgggaggggtggtgag

SEQ ID NO: 57161 - DNA, 201 bp, Homo sapiens
taatcccagctactcgggaggctgaggcaggagaatagcatgaacccaggagacggagcttgcagtgagctgagatcgcaccactgcactccacgctgggygacagagcgagactccgtctcagaaaaaaaaaaaagactcagaaaaaggcagccatttctccatgcccacgtgtgtgcgtgtgtgcgggggcttctgaga

SEQ ID NO: 57162 - DNA, 201 bp, Homo sapiens
taggcaggagaatcgcttgaacccaggaggcggaggttgcaatgagccgagatcgtgccattgcactccagcctgggcgacaatagcaagactccatctcaaaaaaaaaaaaaaaaaaaaaggatgaagaggaagccaggagacaggctgaggacagagcacttcaatcaggcaaggggaggattttgtacacatgtgcac

SEQ ID NO: 57163 - DNA, 201 bp, Homo sapiens
gtttaacgtcaggtttcagttctgtggcgagcacactctaagcagttgtgaggattttgccccacttcctgcagttatttcacctctttttcttttgtgtgtgtgtgtgtgtgtgtttgtttgagacggagtcttgctctatcaccaggctggagtgcagtggtgcgatctcggctcactgcaacctccgcctcccaggtt

SEQ ID NO: 57164 - DNA, 201 bp, Homo sapiens
gagaggcccactcctagggatgctaagattgactagtgggctcaggtggtgtcagcctaattgtaaagttagtctatcagactctcatttagaagctttacctgttgatgatcctggcctgaattaattattgtatttcattagggctcacaaaatagtttggttctattattcttcctacatttattagtaataatttat

SEQ ID NO: 57165 - DNA, 201 bp, Homo sapiens
ccctggcctcgtggccacttttttctcctccttcaactgcacacccccatttagacaaatgagtaaaacagtatctgtctgaaaagagaaaactctgagtwataaagagtgattttatatatatttctttggtacctccctattctcaaggcccagaacttaatactgttatgttcggttacctgtgagttcaatagggcc

SEQ ID NO: 57166 - DNA, 201 bp, Homo sapiens
ttttaaagagaatgaacgcagccgaagttgaatcgaggcagtgatttcactcagtgcgttgggtctttccactcacctggccctccagaaccccagggccwtgagtgcatgggctggtacaagagcccagtttttggctggggaggcacttcctatgggagggggacgcctgtctcagtgctgaggcaaccaccaccgagg

SEQ ID NO: 57167 - DNA, 201 bp, Homo sapiens
gaccactgtgactctccccagtgcccttggagcgcagaatgaagtgaggggaggaggagggtcacgagccctggagcgctgggaagacaggctgtaggccrcaggccccgatcctgcctgggacgaggttcaacagaagtaggatggtttcatcatgacctggcaggaaaaccaccagacctggaattttgcttttacaac

SEQ ID NO: 57168 - DNA, 201 bp, Homo sapiens
ttcaacagaagtaggatggtttcatcatgacctggcaggaaaaccaccagacctggaattttgcttttacaactgtttaacttctgtttcatacaggatgraaaccggtgaattgtaatctcacataaccgagcaagatctagtagtcataagcactttgtcagagcaaagcagacaaggcaaagtgttggaaatgtcatc

SEQ ID NO: 57169 - DNA, 201 bp, Homo sapiens
gaatgctgggatgcatcacaggtatgctggaagatgtatagaattttacttctgttattctggtaactcagagtcctgttcagtcagtttccacgtcaggwtgctgtcctggttttaaagagaatgaacgcagccgaagttgaatcgaggcagtgatttcactcagtgcgttgggtctttccactcacctggccctccaga

SEQ ID NO: 57170 - DNA, 201 bp, Homo sapiens
agtagctgggattacaggctttcaccactatgcccagctaatgtttgtatttttagtagagacggggtttcaccctgttggccaggctggtcttgaactcytgacctcaggtgatccgcctgcctcggcctcccaaagtgctgggatgacaggtgtgagacactgagcccagctgcaagtttattatcttgtagttttgga

SEQ ID NO: 57171 - DNA, 201 bp, Homo sapiens
tagatttgtccccggtcatcttaggctatttgggctaggacagtatccattatatgaatgaagcaatctcctaggccgggcaccgtggctcacggctgtamtcccatcactttgggaggctgaagtgggtggatcacttgaggtcaggagttcgagaccagcctggctaacatggtgaaaccctgtttctattaaaaatac

SEQ ID NO: 57172 - DNA, 201 bp, Homo sapiens
cattatagtcccagctacttgggaggctaaggcaggaggattgcttgaacccgggaggcggaggctgcagtaagctgagatcccaccactgccctccagcytgggcaacagagtgaagctctgtctcaaaaaaaaaaaaaaaaaaaaaaaaaaagcttccctcttgggagcttctccaacttcttccctgaactgagctgg

SEQ ID NO: 57173 - DNA, 201 bp, Homo sapiens
gccatgatcacaccactgcactccagcctgggtgacagagtgagacgccgtctctaaaaaagaaagaaaaataatagcacttgcctgatagattttgtgayggttggatggcttaaaatatacagtgtttacaacagtgcctggcacatgataagtgccatgtgagtattatctatcgttttaatatcatgagtcttcctg

SEQ ID NO: 57174 - DNA, 201 bp, Homo sapiens
tgacaggcagaaaaattagtgaatgtttgctgaattgctgtgaggaaaccacgtttttgttttgttttgtttggctctttaagagaatgtcatctgctctkttaacagcctccctctccaaacattcagtgtgatgaccctcagccggttgcttctgtcctgatcatgaactgcaggattggtcaccccgtcctcaagagg

SEQ ID NO: 57175 - DNA, 201 bp, Homo sapiens
ctccctgatgagggcggggcctggaggctccctgggcgagggtggggcctgagggctacgtgggcgagggcggggcctacctgggcgagggtggggcctgrgggctacctgggtgagggcggggcctggaggctacctgggcgagggtggggcctgggggctacctgggtgagggcggggcatggaggccacgtgggcgag

SEQ ID NO: 57176 - DNA, 201 bp, Homo sapiens
attcagtgtgatgaccctcagccggttgcttctgtcctgatcatgaactgcaggattggtcaccccgtcctcaagaggtcatctgtgagtcggtttggacygattcgctcttctcaccaccctgcagttggcgtcttctgcatcttggtctcatctcaatctctcggttccagctttgcgcttcgcttgactgcagtgtgt

SEQ ID NO: 57177 - DNA, 201 bp, Homo sapiens
tgagggcggggcctggaggctccctgggcgagggtggggcctgagggctacgtgggcgagggcggggcctacctgggcgagggtggggcctgggggctacstgggtgagggcggggcctggaggctacctgggcgagggtggggcctgggggctacctgggtgagggcggggcatggaggccacgtgggcgagggtggggc

SEQ ID NO: 57178 - DNA, 201 bp, Homo sapiens
tcacacacaaagtaaaactgtggtacagcctggtggaatgagccctggagttctggttctcgttcactcagctttggaatagcttgggatagctatgttayctgcaagacctctgtgttggggggtaaggtggggaacgctgctgggaagagttctcaaagggaggtgattctgcccaccagaggctgtgcctgttttgat

SEQ ID NO: 57179 - DNA, 201 bp, Homo sapiens
gcggggcctggaggctccctgggcgagggtggggcctgagggctacgtgggcgagggcggggcctacctgggcgagggtggggcctgggggctacctgggygagggcggggcctggaggctacctgggcgagggtggggcctgggggctacctgggtgagggcggggcatggaggccacgtgggcgagggtggggcctggg

SEQ ID NO: 57180 - DNA, 201 bp, Homo sapiens
tgagacggtccctaggcctcagattaggcaacgctgttaatattctgatgacactgaggtctcacgcctgagctctaagatgtgtgtccagctgacatgtyagcatctctgctttgttatcctatatgcacctcttgtcatgtccccgattgaacgcatcttcttccacccttgggtcttcctcccatgttacctccctca

SEQ ID NO: 57181 - DNA, 201 bp, Homo sapiens
tgggcgagggtggggcctgggggctacctgggtgagggcggggcctggaggctacctgggcgagggtggggcctgggggctacctgggtgagggcggggcmtggaggccacgtgggcgagggtggggcctgggggctacctgggagagggcggggcctggaagttacgtgaggagggtggggcctggagaccacctgggtg

SEQ ID NO: 57182 - DNA, 201 bp, Homo sapiens
ttgtttgaaatacttagagtgtttaaggggcttagcaaatacatagaggaggagtgccaagaggacggagcaccacttgttctgttcatgacaggccggtytgaacattctgataggagggatccagagagagaagtggcagtggtatagatgctgcagacctctgacacatcagtcacaattttcttcttgtggaaactg

SEQ ID NO: 57183 - DNA, 201 bp, Homo sapiens
tcccttcccatgcccccagcagggaggagttactattaagtttcttatgtgcacattttaaatttgtatgtttccccctcttacttactgatacttttatytctatagcatggattccccaaaattcctttctttaaatccaatatcctaagcaaagtgttaagtagttcctgacaataagcccctgacttacagtgactc

SEQ ID NO: 57184 - DNA, 201 bp, Homo sapiens
ggtggggcctgggggctacctgggtgagggcggggcctggaggctacctgggcgagggtggggcctgggggctacctgggtgagggcggggcatggaggcyacgtgggcgagggtggggcctgggggctacctgggagagggcggggcctggaagttacgtgaggagggtggggcctggagaccacctgggtgagggcggg

SEQ ID NO: 57185 - DNA, 201 bp, Homo sapiens
acattttaaatttgtatgtttccccctcttacttactgatacttttatttctatagcatggattccccaaaattcctttctttaaatccaatatcctaagyaaagtgttaagtagttcctgacaataagcccctgacttacagtgactctatgagtataaacaaactgtatccaaatgcatttcagccacaagaaagggaa

SEQ ID NO: 57186 - DNA, 201 bp, Homo sapiens
ggggcctgggggctacctgggtgagggcggggcctggaggctacctgggcgagggtggggcctgggggctacctgggtgagggcggggcatggaggccacstgggcgagggtggggcctgggggctacctgggagagggcggggcctggaagttacgtgaggagggtggggcctggagaccacctgggtgagggcggggcc

SEQ ID NO: 57187 - DNA, 201 bp, Homo sapiens
ctggggcgatggcctggcttctttggtccttgtactctgccgtgtgggggacgcattccttcatggccagcacaaagttgccacatctccaaatgctgtaytttcacatggcaggatacaaaacaggaagcaagaagtcagtagcaaaaggatgttggatttttcttcatgtgccttcccttttcagggatgaaacagttt

SEQ ID NO: 57188 - DNA, 201 bp, Homo sapiens
ctggaggctacctgggcgagggtggggcctgggggctacctgggtgagggcggggcatggaggccacgtgggcgagggtggggcctgggggctacctgggwgagggcggggcctggaagttacgtgaggagggtggggcctggagaccacctgggtgagggcggggcctagaggccacctgggcgagggcggggccgagat

SEQ ID NO: 57189 - DNA, 201 bp, Homo sapiens
tttgggaggctgaggtgggcggatcacctgaggtcaggagttcaagaccagcctggccaacatggggaaaccctgtctctaataaaaatacaaaacttagscgggtgtggtggcacatgcctgtaatcccagctacttgggaggctgaggcaggagaatcgcttgaaccagggaggcggaggttgtagtgagccgagatca

SEQ ID NO: 57190 - DNA, 201 bp, Homo sapiens
cgcgatctcggctcactgcaagctccgcctcccgggttcacgccattctcctgcctcagcctcccgagtagctgggactacaggcgcccgccaccacgccyggctaattttttgtattttcagtagagacggggtttcaccgtgttagccaggacggtctcgatctcctggcctcgtgatccgcccgcctcggcctcccaa

SEQ ID NO: 57191 - DNA, 201 bp, Homo sapiens
atggcacgatctcggctcactgcaacctccacctccctggttcaagtgattctcctgtctcagcctcccaagtggttgggattacaggtggctgtcagcaygcctgcctgatttttgtgtttttagtagagatggggcttcaccatgttggccagggtggttttgaactcctgacctcaagtgatccgcctgcctcggcct

SEQ ID NO: 57192 - DNA, 201 bp, Homo sapiens
agattgtctcctctggtgttgctttcccttccagccccgccccaaatcgggacatgctgggccctggaggtgcgggcagaggcgaggccacccctatcccrgcccctgtgtgaagagaaggcaggttgtgcacacagtagcctccccggccccggcagggtgtcacagcacgggggtagggaaggggcactccaggcagag

SEQ ID NO: 57193 - DNA, 201 bp, Homo sapiens
catggaggccacgtgggcgagggtggggcctgggggctacctgggagagggcggggcctggaagttacgtgaggagggtggggcctggagaccacctgggwgagggcggggcctagaggccacctgggcgagggcggggccgagatggggacaccgaggctgcgcattaggctgcacttgaggtttccggatgggggcggg

SEQ ID NO: 57194 - DNA, 201 bp, Homo sapiens
tatttatttattttttgagacgagtctcgctctgtcgcccaggctggagtgctgtggcgtgatctcggctcactgcaacctctgcctccaggttcaagcarttctctgcctcagcctcccgagtagctgggattacaggcgcccgccaccacgcccagctaatttttgtagttttagtagagatggggtttcaccatcttg

SEQ ID NO: 57195 - DNA, 201 bp, Homo sapiens
atcgagaccatcctggctaacatggtgaaacgccgtctccactaaacaaaatacaaaaaattagccaggtgtggtggcgggcgcctgtagtcccagctacrggggaggctgaggcaggagaatggtgtgaacccgggaggcggagcttgcagtgagccaagatcgcgccgctgcactccagcctgggtgacagcgagactc

SEQ ID NO: 57196 - DNA, 201 bp, Homo sapiens
ccaaggcggggggatcacttgaggtcaggagttcgagaccagccgggccaacacggtgaaaccctgtctccactaaaaacacaaaaattagccgggcgtgrtggcgggtgcctgtaatcccagctactcgggaggctgaggcaggagaatcgctggaatccaggggagggaggttgcagtgagccgaaatcatgccactgt

SEQ ID NO: 57197 - DNA, 201 bp, Homo sapiens
agtcactaaaccaaaaaaaggagtgttgccaagaagttgtatagcttttcaagagtgtttatggcaaaagtcgttaattgaacagtaattgaacaggtaartctgtaaactggacttcaccttgcttttttcccatgtaaatgtagattagagatgggagcagtggctcacacctgtaatcccagcacgttgaacggctga

SEQ ID NO: 57198 - DNA, 201 bp, Homo sapiens
tcgcttgaacccgggaggcggaggttgcagtgagccgagatcacgccactgcactccagcctgggcaacagagcaagactccatctcaaaaaaaaaaaaaragaaaaaaagaaaaagaaaaaaaaagcattattgttgtcatcttctcccccacatccaactctaaccctgccttccgtggtgaccccacagctctgtgag

SEQ ID NO: 57199 - DNA, 201 bp, Homo sapiens
gcttgaacccgggaggcggaggttgcagtgagccgagatcacgccactgcactccagcctgggcaacagagcaagactccatctcaaaaaaaaaaaaaaaraaaaaaagaaaaagaaaaaaaaagcattattgttgtcatcttctcccccacatccaactctaaccctgccttccgtggtgaccccacagctctgtgagga

SEQ ID NO: 57200 - DNA, 201 bp, Homo sapiens
acccgggaggcggaggttgcagtgagccgagatcacgccactgcactccagcctgggcaacagagcaagactccatctcaaaaaaaaaaaaaaagaaaaaragaaaaagaaaaaaaaagcattattgttgtcatcttctcccccacatccaactctaaccctgccttccgtggtgaccccacagctctgtgaggaggactg

SEQ ID NO: 57201 - DNA, 201 bp, Homo sapiens
aaaaaggagtgttgccaagaagttgtatagcttttcaagagtgtttatggcaaaagtcgttaattgaacagtaattgaacaggtaagtctgtaaactggamttcaccttgcttttttcccatgtaaatgtagattagagatgggagcagtggctcacacctgtaatcccagcacgttgaacggctgaatcacctgaggtca

SEQ ID NO: 57202 - DNA, 201 bp, Homo sapiens
ggcggaggttgcagtgagccgagatcacgccactgcactccagcctgggcaacagagcaagactccatctcaaaaaaaaaaaaaaagaaaaaaagaaaaaraaaaaaaaagcattattgttgtcatcttctcccccacatccaactctaaccctgccttccgtggtgaccccacagctctgtgaggaggactgcttctcca

SEQ ID NO: 57203 - DNA, 201 bp, Homo sapiens
tgtatagcttttcaagagtgtttatggcaaaagtcgttaattgaacagtaattgaacaggtaagtctgtaaactggacttcaccttgcttttttcccatgyaaatgtagattagagatgggagcagtggctcacacctgtaatcccagcacgttgaacggctgaatcacctgaggtcaggagttcgagaccagcctggcca

SEQ ID NO: 57204 - DNA, 201 bp, Homo sapiens
accatgttggccaggctggtcttgaactcttggcctcaagtgatccacctgcctcacctcccaaagtgctgggattacaggcgtgagccaccgtgtccagscatccactactgtttccttatttcaggcatgtatcatctctcgggtggagacagcaggctctgtctctgcttcctgtctctccctccagtcaatccagcc

SEQ ID NO: 57205 - DNA, 201 bp, Homo sapiens
ttcattgtagtgttttgtatttttccttttaattcagtcaatttttgcttttatattttgaaatgatgttattggataaatacagatttaaaattgtcacrtcttcttagtgaatcaaaaacaacatatttgtgtgcatatatctccttcccttccttatacagaagctagtgtcgtttatacacttgtccttcatgtagt

SEQ ID NO: 57206 - DNA, 201 bp, Homo sapiens
gtagtgttttgtatttttccttttaattcagtcaatttttgcttttatattttgaaatgatgttattggataaatacagatttaaaattgtcacgtcttcytagtgaatcaaaaacaacatatttgtgtgcatatatctccttcccttccttatacagaagctagtgtcgtttatacacttgtccttcatgtagtgatttt

SEQ ID NO: 57207 - DNA, 201 bp, Homo sapiens
gactacagccttgactgtctgtctctgatggggctcagttagagccagaggttagagagtggcagctcctccaggaaaggagtcttgctcggtgggtcagrgccccaggcttgttgggaagggcggctgaggcttcgtgttgccagttctgtcagccagggcctttggactccagggctctgccattctgttcctcctcca

SEQ ID NO: 57208 - DNA, 201 bp, Homo sapiens
ttgcttttttcccatgtaaatgtagattagagatgggagcagtggctcacacctgtaatcccagcacgttgaacggctgaatcacctgaggtcaggagttygagaccagcctggccaacacggtgaaaacctatctctactaaaaatacaaaaattagctgggggtggtggtgtgtacctgtaatcccggctacttgggag

SEQ ID NO: 57209 - DNA, 201 bp, Homo sapiens
caaggttttataattttcttcaaaggggtcttaatttataaagacttacttccagctgcatttttatttgtttatttattttgggggggtctcactgtgtygcccaggctggagggcagtgatgcggtcataggttgctgcagccttgaacttttgggttcaagccgtcctctgcctcagcctcctgtgtagctgggacta

SEQ ID NO: 57210 - DNA, 201 bp, Homo sapiens
cttataataagcagtaaattagaagttaaaccatgtttttcttttacgaactgaaagaagagaatgcttttgatactgagaatcgcacactgtgtccaggmagattgttcttgcataaccagacccacaataaatatctacaacttttcttacatgtttataaaataaatcttagaagaaaaatattgtagcttttttttt

SEQ ID NO: 57211 - DNA, 201 bp, Homo sapiens
aggttttggggcagatgatggtgccagcttcggcagtgtgtatatctacaatggacactgggacggcctctccgccagcccctcgcaggtgacccatgggrccctctccttcctctcctctggggctctgacctctctcagatatgatgacccaagccccaagtcggcttcagtcctaagtgctgggcaggtctcgggggt

SEQ ID NO: 57212 - DNA, 201 bp, Homo sapiens
cttacgatgctctgtgtccgaagtgttaaaaagatttcagactttccgcacggaaaggaattgtgttcactagacctcgcttttccagcatgtggaagaakggcattcagtgagctgtgtcatcgcttcagataaagaaaatgtcaccgtggctgcagagatctcctgggatcactctgaggaggtgtttgagactgaaat

SEQ ID NO: 57213 - DNA, 201 bp, Homo sapiens
cacccccatttagacaaatgagtaaaacagtatctgtctgaaaagagaaaactctgagtaataaagagtgattttatatatatttctttggtacctccctrttctcaaggcccagaacttaatactgttatgttcggttacctgtgagttcaatagggcctggaaggtcaaccctaggccagcatttataacttacttgga

SEQ ID NO: 57214 - DNA, 201 bp, Homo sapiens
ggtcaccagccccagaaccaagaggacaccagggcccctccatcgatgttcccttgtccaggatgaaatcctttgccatcctgtaggtaagtcagccccamctccagggaatgctccccaggaccccctttctagcaaaatccccctcatctaaactcaaaccattccaaccccagccctgcctcatccagcccgttcacc

SEQ ID NO: 57215 - DNA, 201 bp, Homo sapiens
tgaggcaggagtatcgtttgagcccaggaatttgaagcttcagtgagctatgattgagccactccattccggcccgggtaacagagtgagaccttgtctcaaaaaaaaaaaaaaaaaaaaaaaaaaaggaaaaatctcttacgttaaataaaatgaataagctgggtgtggtggctcatgcctgtaatctcagcactgtgg

SEQ ID NO: 57216 - DNA, 201 bp, Homo sapiens
tggactgtagatttgtccccggtcatcttaggctatttgggctaggacagtatccattatatgaatgaagcaatctcctaggccgggcaccgtggctcacrgctgtaatcccatcactttgggaggctgaagtgggtggatcacttgaggtcaggagttcgagaccagcctggctaacatggtgaaaccctgtttctatta

SEQ ID NO: 57217 - DNA, 201 bp, Homo sapiens
aaaaaaggaaaaatctcttacgttaaataaaatgaataagctgggtgtggtggctcatgcctgtaatctcagcactgtgggaggctaaggtgggtggattrcttgagcccaggagtttgagaccagcctgggcaacatggtaaaaccccatctctacaaaaaatacaaaaattagcccagtgtggtggggtgcacctgtgg

SEQ ID NO: 57218 - DNA, 201 bp, Homo sapiens
ccgcctcccgggttcaagtgattctccttcctcagcctcctgagtagctgggattacaggcgtgcagcactacacccggctaatttttaaaatatttttgrtagagatggggtttcaccatgttggccaggctggtctcaaactcctgtcctcaagtgatccacctgcctcgacctcccaaagtgctgggatgacaggcat

SEQ ID NO: 57219 - DNA, 201 bp, Homo sapiens
agaacttaatactgttatgttcggttacctgtgagttcaatagggcctggaaggtcaaccctaggccagcatttataacttacttggaagaggccttaacrgtaaggccttaaaacagatgtgactgttgttcccctgttgaaatcttttccttgccttcccgtcttaatgtgcaaactcttctactgctatttaagatcc

SEQ ID NO: 57220 - DNA, 201 bp, Homo sapiens
tctcttcttgttaccagagataatgaaaatgttcttttgttcacacacaaagtaaaactgtggtacagcctggtggaatgagccctggagttctggttctygttcactcagctttggaatagcttgggatagctatgttatctgcaagacctctgtgttggggggtaaggtggggaacgctgctgggaagagttctcaaag

SEQ ID NO: 57221 - DNA, 201 bp, Homo sapiens
aggagaatcgcttgaacctgggaggcagaggttgcggtgagccgagatcgtgccactgcactccagcctgggcaacaagagcgaaactccatcttaaaaaaataataataattttggaacaagatgatgatatactcttaaaacaaggatgaaaatgtcttcacagtcagtccaggcaacactgggggagataaaccttct

SEQ ID NO: 57222 - DNA, 201 bp, Homo sapiens
tgagccctggagttctggttctcgttcactcagctttggaatagcttgggatagctatgttatctgcaagacctctgtgttggggggtaaggtggggaacrctgctgggaagagttctcaaagggaggtgattctgcccaccagaggctgtgcctgttttgattgccatgacttggggaggggggtgttcagtaggacatc

SEQ ID NO: 57223 - DNA, 201 bp, Homo sapiens
atatcaggccgggcgcggtggctcacgcgtgtaatcccagcactttgggaggccaaggcgggcggatcacctgaggagttcaataccagcctgggcaatayggtgaaaccccacctctactaaaaatacaaaaattatccaggtgtggtggtgcgtgcctataatcccagctactcaggaggccgaggcaggagaatcgct

SEQ ID NO: 57224 - DNA, 201 bp, Homo sapiens
ggagaatcgcttgaacctgggaggcagaggttgcggtgagccgagatcgtgccactgcactccagcctgggcaacaagagcgaaactccatcttaaaaaaataataataattttggaacaagatgatgatatactcttaaaacaaggatgaaaatgtcttcacagtcagtccaggcaacactgggggagataaaccttctc

SEQ ID NO: 57225 - DNA, 201 bp, Homo sapiens
tcttggctcaccataacttctgcctcccaggttcaagcagttctcctgcctcagcctcccgagtagctgggattacaggcgcctgccaccacgcctggctratttttgtatttttagtagagacagggtctcaccatattggtcaggctggtctcctgccctcaggtgatcgacctgcctcggcctcccaaagtgttggga

SEQ ID NO: 57226 - DNA, 201 bp, Homo sapiens
gagaatcgcttgaacctgggaggcagaggttgcggtgagccgagatcgtgccactgcactccagcctgggcaacaagagcgaaactccatcttaaaaaaataataataattttggaacaagatgatgatatactcttaaaacaaggatgaaaatgtcttcacagtcagtccaggcaacactgggggagataaaccttctcc

SEQ ID NO: 57227 - DNA, 201 bp, Homo sapiens
gcactccagcctgggcaacagagcaagactccacctcaaaaaaaaaaaaaaaaaaaaagggatgagtgtagtggctcatgcctgtcatcccaacactttcscaggctgaggtggaggatcacttgagcctgggaggttgaggctacactgagccatgattgttccactgtgctctagcctgggcaacagagtgagaccctg

SEQ ID NO: 57228 - DNA, 201 bp, Homo sapiens
aatgtgtagggtaccagcaaggaacacgtttttggacagattttaatattttatatttcattttattttattttattttttgagacagagtcttgctctgytgcccaggctggagcccaggctggatcttggctcaccataacttctgcctcccaggttcaagcagttctcctgcctcagcctcccgagtagctgggatta

SEQ ID NO: 57229 - DNA, 201 bp, Homo sapiens
tggactctccaggagagattcagagtaagttaggagaagggagtagtaagtatgagaagcagaggaatataggggctatttaggcaacagccagaatgccrgttttctgaaacagatggctatctttggcctgtaactggacttttccttcctttgtttcagtgtggcttttttaaaagaaaatatcaacaactgaacttg

SEQ ID NO: 57230 - DNA, 201 bp, Homo sapiens
acgcccggctaattttgtatttttagtagagatggggtttcatcgtgttggtcaggctggtcttgaactcctgacctcagatgatctacccacctcagccwcccgaagtgctgggattacaggcatgagccaccacacccggccacacgtgttattttcttagagaggccttccctgatcacttattctaaagtgggaact

SEQ ID NO: 57231 - DNA, 201 bp, Homo sapiens
atctctgtgctgtgggaaatctctgaagtggcttcttcacctgtaaaaggggaatgaggccgcctgccttgcttactccatatttgtatttgaggcttaamtgaaataacggggccaggcgcggtggctcatgcctgtaatcccagcactttgggagaccgaggtgggtggatcatttgaggtcaggagttcgagaccagc

SEQ ID NO: 57232 - DNA, 201 bp, Homo sapiens
aaaaaaaagaattgtgagtgtggtggctcacatctgtcatcccaacactttgggaggctgaggcgggaggattgcttgaggccaggagttcaagatcagcmtgggcagcatagtgaaaccccatttcttaaaaataaataaatacataaattagccacgcatggtggctcatgcctgtagtcccagctacttgggaggctg

SEQ ID NO: 57233 - DNA, 201 bp, Homo sapiens
gaaagtgccggtctgtgggtccttgctggtgtgtgtgcttctgtccccgcctcctggcctcctggctgaggggaagctgagtgggccacggcccatgtgtygcactcgcctcggctcccacacagccgcctctgctccagcaaggatgtggctcttccacactctgctctgcatagccagtaagtcctctcacccgctgct

SEQ ID NO: 57234 - DNA, 201 bp, Homo sapiens
aaaagaattgtgagtgtggtggctcacatctgtcatcccaacactttgggaggctgaggcgggaggattgcttgaggccaggagttcaagatcagcctggrcagcatagtgaaaccccatttcttaaaaataaataaatacataaattagccacgcatggtggctcatgcctgtagtcccagctacttgggaggctgaggc

SEQ ID NO: 57235 - DNA, 201 bp, Homo sapiens
gacaggggaccgactcaaatggatgatacgaacggcaggctggattcacgttgctcctgcacctccagcatctgctgaggacacctagaactgtggccctrgccaaacctcagctccctattccatgaaagtgtgggtcaaagtgtgggtggtagagtggggctgacagtggcccctaagctcctagggtccagcccacaa

SEQ ID NO: 57236 - DNA, 201 bp, Homo sapiens
tctgtcatcccaacactttgggaggctgaggcgggaggattgcttgaggccaggagttcaagatcagcctgggcagcatagtgaaaccccatttcttaaarataaataaatacataaattagccacgcatggtggctcatgcctgtagtcccagctacttgggaggctgaggcaggagtatcgtttgagcccaggaatttg

SEQ ID NO: 57237 - DNA, 201 bp, Homo sapiens
tgaacgcagccgaagttgaatcgaggcagtgatttcactcagtgcgttgggtctttccactcacctggccctccagaaccccagggccttgagtgcatggrctggtacaagagcccagtttttggctggggaggcacttcctatgggagggggacgcctgtctcagtgctgaggcaaccaccaccgaggaccctgggctgg

SEQ ID NO: 57238 - DNA, 201 bp, Homo sapiens
caccttggtaattcaaacacctatcaagatatagaatattttcatcattccagaaagttccttctagtcccttcccagttagtcccatcctctcaagcatttttttttttttactataggttagttttgctggttctagaacctcatataaatggagttatacaatatgatttttattgccttagcttaacaaatctgctg

SEQ ID NO: 57239 - DNA, 201 bp, Homo sapiens
acaaaataacatggatttttatctagtaatgaagtcaacaccattgtccaccctgggttaacacattcacatctcaaagcgaatggggctgcagacactcrtgttagagagccttggaatgtcctgcctttttacgtttaattaaaattaaataaaatatacaaaattcagttcatcagttgttctagtggcattttaagg

SEQ ID NO: 57240 - DNA, 201 bp, Homo sapiens
cagcagtgcttacagtggctaagctggctctgaaagtagggggtgatggggacgagagctttccagtacacagccctaggtgaactgcctgctcacctccrtgaagcagagtgaagttgtgggtagtatggagggcgtgtcagacaaaaagtttttttgtttgtttgtttttgagatggagtttcattctgtcacccaggc

SEQ ID NO: 57241 - DNA, 201 bp, Homo sapiens
aggggccacaaggaacctcaggcaggctgggggccttctgtctgcggctggctcatccccacctcatcgggaaggtctggtcttcattcccaggcctccgygaggcacttctcaacttcacgctggatgtggatgtggggaagcagaggagacggctgcagtgttcagacgtaagaagctgtctgggctgcctgagggagt

SEQ ID NO: 57242 - DNA, 201 bp, Homo sapiens
ggacttcaccttgcttttttcccatgtaaatgtagattagagatgggagcagtggctcacacctgtaatcccagcacgttgaacggctgaatcacctgagrtcaggagttcgagaccagcctggccaacacggtgaaaacctatctctactaaaaatacaaaaattagctgggggtggtggtgtgtacctgtaatcccggc

SEQ ID NO: 57243 - DNA, 201 bp, Homo sapiens
gtttcaccatgtcggccaggctggtcttgaactcccgacttcaagtgatccgctcacctcggcttcccaaagtgctgggattccaggcgtgagttgccacrcccggcctcctgctgtcttaaataatctgcactactgcattattctgtgcacatctctaatacatttacaaggaggggtttttggttaagattttctggg

SEQ ID NO: 57244 - DNA, 201 bp, Homo sapiens
gggtcttaatttataaagacttacttccagctgcatttttatttgtttatttattttgggggggtctcactgtgtcgcccaggctggagggcagtgatgcrgtcataggttgctgcagccttgaacttttgggttcaagccgtcctctgcctcagcctcctgtgtagctgggactacaggtgcaagccactatgcccggct

SEQ ID NO: 57245 - DNA, 201 bp, Homo sapiens
cctcaggtgatctgcccgccttgacctcccaaagtgctgggattacaggcatgagccaccatgtccggctaagtagtgtatttctaatacagaaaatagarggaaatggaaaatacagaaaacggaagaaatagaagtgccccattattgcactgcccagattttaacaaataaaaataatagcaagaaaatccaagccat

SEQ ID NO: 57246 - DNA, 201 bp, Homo sapiens
tgcccagctcgtcgccgtccctgggctggccgcacacgctgaggtccgggctgaggcggccggagtcgcggctggggaagggcggaagtcggagcgggccrcagggtgtgctgcacttctgcgggggccgagctcgcagccccaggcgtcttggggtcacggttaggcttgggcgagctcgcagcttccagcgctttgggg

SEQ ID NO: 57247 - DNA, 201 bp, Homo sapiens
ttgtcgcccaggctggagtgcaatggcgcagtctcggctcactgcaccctccgcctcccaggttcaagcagttctcccaccatagcctcccgaagctgggrctacaggcacacgctgccacgcctggctaattttttgtgtttttagtaaagacagggtttcaccatgttgcccaggctggtctcaaactcctgaactcag

SEQ ID NO: 57248 - DNA, 201 bp, Homo sapiens
gcaaggcagctgtaatcgggggactacatcaggaactacttaatgaggaggaagacacttttaagtgcgacatggttagattttacaaattcatatgctayggcttgggccaaggtctgtggcatacacctgtagtcccagctactcaggaggctgaggcatgagaatcgcttgaacccagaaggcagagtttgcagtgag

SEQ ID NO: 57249 - DNA, 201 bp, Homo sapiens
gagactgaaatgctccagatttgattatccagttgctcacgggcatcgcccctagaagagataatagcatctttgcataacatgtccatgtccaaaatagrtcttttggtgcaaaaaaccaaccctctgtcccaacccgttccttagctaccctcaggagggagatatactccagttacagtacaaggaactcgagggatt

SEQ ID NO: 57250 - DNA, 201 bp, Homo sapiens
tgaggcaggagaattgcttgaccccgggagacagtggttgcagtgaaccgagatcgtgccactgcactccagcctgagtgacagagaaagactccgtctcaaaaaaaaaaaaaaaaaccacaaaccttcaatatatatttcctaaaaacaaaggcattgtcttaacatagtacaataatcaaaatcaggaaattcacattg

SEQ ID NO: 57251 - DNA, 201 bp, Homo sapiens
ggtttggtggaccatcctggtgtccttggctcctcctgtcgcttcctcctgggagcaggggagagatgctcggtccagggagacttctgggaggtggaggycgctcgggacggctgaggctgcaaccagacaggcggaggtgccgatcgagatgacactgtcccttggcgttggggacccggggcagggcgaggccagaga

SEQ ID NO: 57252 - DNA, 201 bp, Homo sapiens
ccaattcctaggctggtggcctccaagggtgaggggtgcctcagtctgagagatggggagcagtggctggactttacagacctgacctgtaccagctccayccactctttcttataagtggggaaactgaggctcagagagtggtagtgatgggaatggctcacacagcacacaaagcctgaccaggttctagctctcttt

SEQ ID NO: 57253 - DNA, 201 bp, Homo sapiens
cgggctctggagaaggaggaggaggaagacaaggaggaggaggaagacgaggaggaggaggaagctggtgagaagaggcagatctgggttgctctgagtcyatcagagccaattcctaggctggtggcctccaagggtgaggggtgcctcagtctgagagatggggagcagtggctggactttacagacctgacctgtacc

SEQ ID NO: 57254 - DNA, 201 bp, Homo sapiens
ggcagagcttgcagtgagccaagatcacgccattgcactccagcctgggcaaaagagcaagactgtctcaaaaaaaaaattatcgattgtatcctttcagrtaattcttaagtatcaatttttcagatttccagaagaaactctttggggttttaatttaaacatacaggttaagtttgggagcattgatatctttataga

SEQ ID NO: 57255 - DNA, 201 bp, Homo sapiens
tggctcaggaagcattgatcccccagactttcagagagccaaagacttcatctccaacatgatgaggaacttctatgaaaagtgttttgaggtgggcttcyctaagagctggttaacacttatctattgctgagaatcaccctacctcagaacaacaatcaccacatttgctcacaattctatgggtcacatacttgggct

SEQ ID NO: 57256 - DNA, 201 bp, Homo sapiens
atacagacacagatactaggaaacagtctgtttcccgaggacaccctgtggctgacaagtatcactgcactgagaaattttattctctaaaatcacagatsagaaaactttgggccgggaacggtggctcacacctgtaatcccagcactttgggaggccgagacgggcggatcacgaggtcaggagatcgagaccatcct

SEQ ID NO: 57257 - DNA, 201 bp, Homo sapiens
gagcaagactgtctcaaaaaaaaaattatcgattgtatcctttcagataattcttaagtatcaatttttcagatttccagaagaaactctttggggttttaatttaaacatacaggttaagtttgggagcattgatatctttatagatttcctttctactccgcttgctgcgatttattttttattttttattttacttta

SEQ ID NO: 57258 - DNA, 201 bp, Homo sapiens
tgtagtcccagctacttgggaggctgaggcaggagtatcgtttgagcccaggaatttgaagcttcagtgagctatgattgagccactccattccggcccgrgtaacagagtgagaccttgtctcaaaaaaaaaaaaaaaaaaaaaaaaaaaggaaaaatctcttacgttaaataaaatgaataagctgggtgtggtggctc

SEQ ID NO: 57259 - DNA, 201 bp, Homo sapiens
gagtgttgggtggcagctgatgctgaagttttcaatggggtggtcacggagggtgacactttggcacacactggaggaggtaggggaacgagctatgtggwtgggtgtctaagggaagagcagctgcaggtaccctgggttggaagcctgcctggtgggtggggggcagggtgaggagctagtggctgcagtggagtgggg

SEQ ID NO: 57260 - DNA, 201 bp, Homo sapiens
cctccctggaggaggagaaaggagcaattctctagacatgccaatataacatttccttttatttttaagtagtgtatttctttttcttttcttttctttcytttttttttttttttttgaggaagaatctcactgtgtcacccaggctggagtccgttggtgccatctcggctcactgcaacctccacctccccagttcaa

SEQ ID NO: 57261 - DNA, 201 bp, Homo sapiens
tttcaccatgttggccaggctggtctcgaacttctgacctcaggtgatctgcccgccttgacctcccaaagtgctgggattacaggcatgagccaccatgyccggctaagtagtgtatttctaatacagaaaatagagggaaatggaaaatacagaaaacggaagaaatagaagtgccccattattgcactgcccagattt

SEQ ID NO: 57262 - DNA, 201 bp, Homo sapiens
atactgttatgttcggttacctgtgagttcaatagggcctggaaggtcaaccctaggccagcatttataacttacttggaagaggccttaacggtaaggcsttaaaacagatgtgactgttgttcccctgttgaaatcttttccttgccttcccgtcttaatgtgcaaactcttctactgctatttaagatcctctcctct

SEQ ID NO: 57263 - DNA, 201 bp, Homo sapiens
actggagagaaccaggcacgatcagagggttgggactttcagccccacacccctcttctgggagagaagggctgaaggtttagttgatcaccagcggccartgattcaatgagtcatgcctatgtaatgaggcctccataaaactcaaaaggacagggtttggggagcttctgggtagcagaacatgtggaagtttctgga

SEQ ID NO: 57264 - DNA, 201 bp, Homo sapiens
accaggcacgatcagagggttgggactttcagccccacacccctcttctgggagagaagggctgaaggtttagttgatcaccagcggccagtgattcaatsagtcatgcctatgtaatgaggcctccataaaactcaaaaggacagggtttggggagcttctgggtagcagaacatgtggaagtttctggagggtggcccc

SEQ ID NO: 57265 - DNA, 201 bp, Homo sapiens
gaggctgaggcaggagaatggcgtgaacccgggaggcggagcttgcagtgaaccgagatggcgccactgcactccagcctgggcgacagagcgagactccrtctcaaaaaaaaaaaaaaaagacaattttaaaataaagcatattaaggctcttttgttccttatggaagtaacacatgttcaatatagaacatttggaaa

SEQ ID NO: 57266 - DNA, 201 bp, Homo sapiens
cccttaagtgttgcttttttttctttttttttttgagacggagttccgctctttcgcccaggcttgagtgcggtggtgcgatctcggctcactgcaacctycccgtccccccgccctgaccccgggttcaagagattctcctgcctcagcctcctgagtagctgggattacaggaatgtgccaccatgcctggctaattgt

SEQ ID NO: 57267 - DNA, 201 bp, Homo sapiens
gggcagatcatgaggtcaggagatcgagaccatcctggctaacacagtgaaactccgtctctactaaaaacacaaaaaattagctgggcatggtggcgggygcctgtagtcccagctactcgggaggctgaggcaggagaatggcgtgaacccgggaggcggagcttgcagtgagccgagattgcgccactgcactccagc

SEQ ID NO: 57268 - DNA, 201 bp, Homo sapiens
taagtgttgcttttttttctttttttttttgagacggagttccgctctttcgcccaggcttgagtgcggtggtgcgatctcggctcactgcaacctccccktccccccgccctgaccccgggttcaagagattctcctgcctcagcctcctgagtagctgggattacaggaatgtgccaccatgcctggctaattgttttg

SEQ ID NO: 57269 - DNA, 201 bp, Homo sapiens
cgcccgccaccacacccagctaatttttgagttttttagtagagacgatgtttcaccaagttggccaggctggtctcgaacccctgacctcaggtgatcckcccgcctcggcctcccaagtgctgggattacaggcgtgagccaccgcactcggccaacagtattttaatttttctcatagccttgccaatacatagtatc

SEQ ID NO: 57270 - DNA, 201 bp, Homo sapiens
gcttttttttctttttttttttgagacggagttccgctctttcgcccaggcttgagtgcggtggtgcgatctcggctcactgcaacctccccgtccccccrccctgaccccgggttcaagagattctcctgcctcagcctcctgagtagctgggattacaggaatgtgccaccatgcctggctaattgttttgtattttta

SEQ ID NO: 57271 - DNA, 201 bp, Homo sapiens
tactctgattttaatttgcaggtacatggggagaacctctttggagcagaataccagttgcaaatttgcgtcccaaccaaattacgaggtctccaggttgyagcagtgaagaagctgacgaggactcaggtatttaaaggcagttctttatcagtcacacctctttccacagtgactacagagtctcaagtataaaaacca

SEQ ID NO: 57272 - DNA, 201 bp, Homo sapiens
tgaacctgggaggcagaggttgcagtgagctgagatcacaccattgcactccatcctgggtgacagagcgagactccctctcaaaaaaaaaaaaaaaaaaraaaaaggaagggaaaggaaacatgctgtgttagaaaaatgtgaggaatgtgaaaatctgaggaatcgtctcctaggtctgttccacgagtagctagcggt

SEQ ID NO: 57273 - DNA, 201 bp, Homo sapiens
gcctttaatctggaaatacagtattacttaggatttgcagtacattttgcctgatagggcaagttttcattcttatttttaaaaaatgatagattgtggcygggcatgatggctcacgcctgtaatcccagcactttgagaggctgaggcaggcagatcacgaggtcaagagatcgagaccatcctggccaacatggtgaa

SEQ ID NO: 57274 - DNA, 201 bp, Homo sapiens
aggcagaggttgcagtgagccgagatcacaccactccactccagcctcagtgatagagtgagactcagtctcaaaaaataaataaataaataaaaaatgarttacctaagtgagaaattgttttttgtatccagtaactgtcttagtgtgctgtatcagtgtttagttatagtattaaacagtactcaggaatgcataaat

SEQ ID NO: 57275 - DNA, 201 bp, Homo sapiens
agtacattttgcctgatagggcaagttttcattcttatttttaaaaaatgatagattgtggctgggcatgatggctcacgcctgtaatcccagcactttgrgaggctgaggcaggcagatcacgaggtcaagagatcgagaccatcctggccaacatggtgaaaccccatctctactaaaaatacaaaaattagctgggca

SEQ ID NO: 57276 - DNA, 201 bp, Homo sapiens
aagtgctgggattacaggcatgagccaccatgtccggctaagtagtgtatttctaatacagaaaatagagggaaatggaaaatacagaaaacggaagaaayagaagtgccccattattgcactgcccagattttaacaaataaaaataatagcaagaaaatccaagccatacagagaatggtaccaaatgaaaaataattg

SEQ ID NO: 57277 - DNA, 201 bp, Homo sapiens
tgatagattgtggctgggcatgatggctcacgcctgtaatcccagcactttgagaggctgaggcaggcagatcacgaggtcaagagatcgagaccatcctrgccaacatggtgaaaccccatctctactaaaaatacaaaaattagctgggcatggtggcgggcgcctgtagtcccagctactcaggaggctgaggcagga

SEQ ID NO: 57278 - DNA, 201 bp, Homo sapiens
tttctttacctattatttatttattggagacagagtcttgctctgtcacccaggctggagtgcagtggtgtaatctcagctcactgcaacctccgcctccygggttcaagtgattctcctgcctcagcctcctgagtagctgggattacaggcgcccgccaccacgcccagctaattttttgtatttttagtagaaacagg

SEQ ID NO: 57279 - DNA, 201 bp, Homo sapiens
ttttcctactagatgatgagcttgatgtaggaagctgtacttgatctccttctgtcttcagcatcataggctatactgagtatttttgcataaataagatkagatccagtacagccgaaattatcatgctttgcaaaataagttaaaaaggttcaactgctcgggagagcagggttcagaggaaggtggagtcagttctga

SEQ ID NO: 57280 - DNA, 201 bp, Homo sapiens
ggggtgtcgggacccctgcatctagccccacttcttcagctcctggtatcagtgtgggcaaatcatgccccatgggcctcggtttcctaaattgggaatcrtggtacttattgtactgtgagaatgtgagttgaaattgcccggagtgctgggggagacagagggttgaggggagacagtggtggctgacaggatggaggg

SEQ ID NO: 57281 - DNA, 201 bp, Homo sapiens
caagtgatcaagtttaatgttttacagtgatccaggtgacatttgtgaggtctcaactgaagaagtagcaatgggggtggaaaagaaagggacagatacargaaataatttaaaaaaaaagaattgtgagtgtggtggctcacatctgtcatcccaacactttgggaggctgaggcgggaggattgcttgaggccaggagt

SEQ ID NO: 57282 - DNA, 201 bp, Homo sapiens
tttccctcattcctttccccatcttctagttactaaaagatgtaactgaactgcagatccttggtgaaatatctttcaacaaatctctatatgagggactkaatgcagagaaccacagaactaaggtaattcctggctggcttctgagtagtgcccaaggaaaattgtgcctaacctttgagcacctccacagacattctg

SEQ ID NO: 57283 - DNA, 201 bp, Homo sapiens
tgggcaggcagagaagtcttgttggctctctggccccacctaagtcctgggaacttcctctggccacaacttggaagggccatacctgggtctcaggaagsacatctcctgaactttctagctgagccctgccagaagagagattagactcccgaaattgggagagcctttggaaaacaaaacctgaggatgacttctaat

SEQ ID NO: 57284 - DNA, 201 bp, Homo sapiens
ggtctcactgtgtcgcccaggctggagggcagtgatgcggtcataggttgctgcagccttgaacttttgggttcaagccgtcctctgcctcagcctcctgygtagctgggactacaggtgcaagccactatgcccggctcattttttaatttttcttttgtagagatgggatctagctatgttgaccaagctgatttcaaa

SEQ ID NO: 57285 - DNA, 201 bp, Homo sapiens
gggacgcctgtctcagtgctgaggcaaccaccaccgaggaccctgggctggaagctgggctgagatgtctggtggtaggttctgaggcaggacaggggacygactcaaatggatgatacgaacggcaggctggattcacgttgctcctgcacctccagcatctgctgaggacacctagaactgtggccctggccaaacctc

SEQ ID NO: 57286 - DNA, 201 bp, Homo sapiens
tccttctgtcttcagcatcataggctatactgagtatttttgcataaataagattagatccagtacagccgaaattatcatgctttgcaaaataagttaawaaggttcaactgctcgggagagcagggttcagaggaaggtggagtcagttctgattgagggatgagcaccagaggtcttgaaggattggactctccagga

SEQ ID NO: 57287 - DNA, 201 bp, Homo sapiens
taaagagaatgaacgcagccgaagttgaatcgaggcagtgatttcactcagtgcgttgggtctttccactcacctggccctccagaaccccagggccttgagtgcatgggctggtacaagagcccagtttttggctggggaggcacttcctatgggagggggacgcctgtctcagtgctgaggcaaccaccaccgaggacc

SEQ ID NO: 57288 - DNA, 201 bp, Homo sapiens
cagatggtatcatgagagaaacaggttattcgaatctgcactcactatcctgtaccagggcaaaggagaacagaaagcacatggggtactttcccagccgrtctttcttctacaagctgccttttaggtgctaggcctttctcatttccttttcaccctctgcctgggacaggaaatggtagagcttgcatagatccaaga

SEQ ID NO: 57289 - DNA, 201 bp, Homo sapiens
tccatgacttctactgccctctgcagaaagaccttggacttggttcactgttaaccaccaagcccctcgtcccctccccaccatcccctatgacaaccccyggagctcactgtctgtctcaggacagcccagttctcctgggtaacgtggatggtgagaatgttgaggctgtccctggaatctgccgtctccctggactgg

SEQ ID NO: 57290 - DNA, 201 bp, Homo sapiens
tttgcccagagtatgggtagaacagggagcagggaaaggaggagaaaggaaggaaggagacaggtaatggagggccccagaggccagatggaggggctcasctctctccctgggcctggggaatccacgcagcgctgactcgctgacccaggctgtctgtgcaggtgggagaagaatttaagagtgctaggactgcgaggg

SEQ ID NO: 57291 - DNA, 201 bp, Homo sapiens
gaaaggaggagaaaggaaggaaggagacaggtaatggagggccccagaggccagatggaggggctcagctctctccctgggcctggggaatccacgcagcrctgactcgctgacccaggctgtctgtgcaggtgggagaagaatttaagagtgctaggactgcgagggaactgaacctgatcgcctcagacccggatgaga

SEQ ID NO: 57292 - DNA, 201 bp, Homo sapiens
gggacaccgaggctgcgcattaggctgcacttgaggtttccggatgggggcgggacctggtcagtcacatgggccgaggggcgggtcctggttagggaccstgaggctgagtactacagcctcctgggtaggtacaaggcctgtcaggtacaccaggcacagcagccacccaggggagggcggggcctctccattaataat

SEQ ID NO: 57293 - DNA, 201 bp, Homo sapiens
agagaggccaggtgggagcacacggtgtgttcacagccacaccacccttgccccaggttacgctgtggccgtgctgcacaagacctgcagcctctcctacrtcgcgggggctccacggtacaaacatcatggggccgtgtttgagctccagaaggagggcagagaggccagcttcctgccagtgctggagggagagcaggt

SEQ ID NO: 57294 - DNA, 201 bp, Homo sapiens
agtgagactccatctcaaaaagaaaaaaacaaaataggcggggtgcggtggctcacgcctgtaatcccagcactctgagaggctgaggcaggtggatcacraggtcaggagatggagaccatcctggctaacacggtgaaaccccgtctctactaaaaataaaaaaaattagccgggtgcggtggcaggtgcctgtagtcc

SEQ ID NO: 57295 - DNA, 201 bp, Homo sapiens
ccccgtctctactaaaaataaaaaaaattagccgggtgcggtggcaggtgcctgtagtcccagctactcgggaggctgaggcaggagaatggcgtgaaccygggaggcagagcttgcagtgagccaagatcacgccattgcactccagcctgggcaaaagagcaagactgtctcaaaaaaaaaattatcgattgtatcctt

SEQ ID NO: 57296 - DNA, 201 bp, Homo sapiens
gatcttggctcaccgcaacctccgcctcccaggttcaagcgattctcctgcctcagcctcctgagtaactgggattacaggcatgcgccaccacgcccagmtaattttgtatttttagtagagatggggtttctccatgttggtcaggctggtctcaaactcttgacttcaggtgatccacctgcctcagcctcccaaagt

SEQ ID NO: 57297 - DNA, 201 bp, Homo sapiens
cttgaactcctgagctcaagtgatctgcagtagctgggactaagggcatgtgccactgtgcctggcttagggaaacttaatcacttcaggaagcatcgtcrtcctaatagcagagttcaggaggatgcacctaaattgacaattcccaacttcggttgacttgctttgtttttttattagtgggagcaaattttgtaaagt

SEQ ID NO: 57298 - DNA, 201 bp, Homo sapiens
agtcatgcctatgtaatgaggcctccataaaactcaaaaggacagggtttggggagcttctgggtagcagaacatgtggaagtttctggagggtggccccygagagggcatggaagctttgcccctcacccccactttgcccctcacccccactttgccttatgcatctcctcatctgtatcctttgtaatatcttttttt

SEQ ID NO: 57299 - DNA, 201 bp, Homo sapiens
ccaggctggagtgtggtggcatgctctcggctcactgcaaccactgggttcaagcgattctcctgcctcagcctccctagtagctgagattacaggcgccygccaccacgcccatctgagttttgtatttttagtagagacggggtttcaccaatgttggccaggctggtctcgaactcctgacctcgtgatccgcccgcc

SEQ ID NO: 57300 - DNA, 201 bp, Homo sapiens
gagtaactgggattacaggcatgcgccaccacgcccagataattttgtatttttagtagagatggggtttctccatgttggtcaggctggtctcaaactcytgacttcaggtgatccacctgcctcagcctcccaaagtgctgggattacaggcgtgagccaccgcgcctggcaatgctgagatttttaaaaacactctgt

SEQ ID NO: 57301 - DNA, 201 bp, Homo sapiens
tgcctcagcctccctagtagctgagattacaggcgcctgccaccacgcccatctgagttttgtatttttagtagagacggggtttcaccaatgttggccargctggtctcgaactcctgacctcgtgatccgcccgcctcggcctctcaaagtgctgggattacaggcgtgagccaaggcacctggcctgtaatatccttt

SEQ ID NO: 57302 - DNA, 201 bp, Homo sapiens
agtagagatggggtttctccatgttggtcaggctggtctcaaactcttgacttcaggtgatccacctgcctcagcctcccaaagtgctgggattacaggcrtgagccaccgcgcctggcaatgctgagatttttaaaaacactctgtagcaaggttttataattttcttcaaaggggtcttaatttataaagacttacttc

SEQ ID NO: 57303 - DNA, 201 bp, Homo sapiens
gggtttctccatgttggtcaggctggtctcaaactcttgacttcaggtgatccacctgcctcagcctcccaaagtgctgggattacaggcgtgagccaccrcgcctggcaatgctgagatttttaaaaacactctgtagcaaggttttataattttcttcaaaggggtcttaatttataaagacttacttccagctgcatt

SEQ ID NO: 57304 - DNA, 201 bp, Homo sapiens
ttgacttcaggtgatccacctgcctcagcctcccaaagtgctgggattacaggcgtgagccaccgcgcctggcaatgctgagatttttaaaaacactctgyagcaaggttttataattttcttcaaaggggtcttaatttataaagacttacttccagctgcatttttatttgtttatttattttgggggggtctcactgt

SEQ ID NO: 57305 - DNA, 201 bp, Homo sapiens
aaggttttataattttcttcaaaggggtcttaatttataaagacttacttccagctgcatttttatttgtttatttattttgggggggtctcactgtgtcrcccaggctggagggcagtgatgcggtcataggttgctgcagccttgaacttttgggttcaagccgtcctctgcctcagcctcctgtgtagctgggactac

SEQ ID NO: 57306 - DNA, 201 bp, Homo sapiens
ttattatgcttttgttgctactgtgtgaaaataccgttttttccccctgactgtttagagtttgcacttagaacagttggtggttttgaatgtttatcttmtctggccattttactgaactgtggttttgtttttttggagacggagtctcactctgtcgcccacgctggagtgcagtggtgtgatctctgctcactgcaa

SEQ ID NO: 57307 - DNA, 201 bp, Homo sapiens
ggccgtgctgcacaagacctgcagcctctcctacgtcgcgggggctccacggtacaaacatcatggggccgtgtttgagctccagaaggagggcagagagkccagcttcctgccagtgctggagggagagcaggtacctgctggggaaagcctccaccccttatgaccgatggggaatctggaggcccccaagggaaagga

SEQ ID NO: 57308 - DNA, 201 bp, Homo sapiens
ggacccaccaccatgcccagctaatttttgcacttttagtagagatggggtttcaccatgttaggctggtctcgaactcctgacctcaggtgatccacccrcctcaggctcacaaagtgctgggattacaggcatgagccaaatccgggcccggccaaactgtttttaaatcactctttagttgattctttgggatttttc

SEQ ID NO: 57309 - DNA, 201 bp, Homo sapiens
agatttccagaagaaactctttggggttttaatttaaacatacaggttaagtttgggagcattgatatctttatagatttcctttctactccgcttgctgygatttattttttattttttattttactttatttttttttttttgagacagagttttgctcttacttcccagactggtgtgcaatggtgtgatcttggctc

SEQ ID NO: 57310 - DNA, 201 bp, Homo sapiens
ccgtctccactaaaaatataaaaattagccgggtgtggtggtgggcgcttgtaatcccagctacttaggagaggcaggagaatcgcttgaacccgggaggyggaggttacagtgagccaagaccgcagcattgcactccagcctgggcaacaagaatgaaactctgtctctccaaaaaaaaaaaaaaaaagaagagaaaaa

SEQ ID NO: 57311 - DNA, 201 bp, Homo sapiens
tgggcgtggtggtgggtgcctgtaatcccagctactctggaggctgaggcaggagaatcgcttgaacccgggaggcagagcttgcagtgagccaagatcgygccactgcactccagcctgggtgacagagcgagactccgtctcaaaaaaaaaaaaaaaaaaaaaaaaaaaagaatgagtgctgggctcagccctgtggag

SEQ ID NO: 57312 - DNA, 201 bp, Homo sapiens
ttaaaaaaatagagacaggggtcttgctatgttgaccaggctagatatgaactcttgggctcaagcgatcctcctgcctcagcctcccgagtagctgggaytacaggcgcacgccactgcgcccggctagtttacttctttcagaacatttgttatcagcaaatttaaacatttcaacaaatatttcagtttccatttgga

SEQ ID NO: 57313 - DNA, 201 bp, Homo sapiens
gctgaagtgttttaaagccttggtactcagaatgtggtctgaagacctgcagtgtgggtgtcccttagaatcttgttggaaatgtagtcttgggcccttasatccttcctagagtgtcacaccaagaaggacatgcctgagaggcccactcctagggatgctaagattgactagtgggctcaggtggtgtcagcctaattg

SEQ ID NO: 57314 - DNA, 201 bp, Homo sapiens
ccactcttctgttactctcagtgagcaaattgatatgtaacgacccaaattgggtggtccaggaagcacgcgggcaggggtgtagccttgctgaggggtgsaggagcggggctcctggtgagctgagttcctcccgggctgtagatggggtcctattttggctctgagctgtgccctgtggacattgacatggatggaagc

SEQ ID NO: 57315 - DNA, 201 bp, Homo sapiens
acagctgccctatgagaaggcctgcaagaataagctgttttgtgtcgcagaattacagttggccaccaccgtctctcagtgagttggacatagccgtcagyttcctcgattaaccttctcccgaacgcttgcctgggcaattccttcattaggacaccctgcacatccccttcccctctccccgtggcccacaaatggctt

SEQ ID NO: 57316 - DNA, 201 bp, Homo sapiens
ctgcttttctgtggtgaccccctcactggcacccctgcctccagcctcctcctggtccaaccaacagatggttaataactagataaatccccgccagtccrgctccatgcctcccgaggcaccatattctgctgcagtaccaccctccctatgtgcggccctttcttcaccagggttctgagagagaagtgagtctaatgc

SEQ ID NO: 57317 - DNA, 201 bp, Homo sapiens
aataaatttgaatttgttggactgtagatttgtccccggtcatcttaggctatttgggctaggacagtatccattatatgaatgaagcaatctcctaggcygggcaccgtggctcacggctgtaatcccatcactttgggaggctgaagtgggtggatcacttgaggtcaggagttcgagaccagcctggctaacatggtg

SEQ ID NO: 57318 - DNA, 201 bp, Homo sapiens
aacctgcagttgaagaggatgcaaaaggtgactgtgacggtggctgtggaaacaggtccctcacgcccctccctcgctgcatgcctgcttttctgtggtgrccccctcactggcacccctgcctccagcctcctcctggtccaaccaacagatggttaataactagataaatccccgccagtccagctccatgcctcccga

SEQ ID NO: 57319 - DNA, 201 bp, Homo sapiens
atggtggtaaacacctgtagtcccagctactcgggaggctgaggtgggaggatcacttgaacccaggaagtggaggctgcggtgagccgtgatcattgcaycacagcaccacgctctagcctcggtgaatgtcctattgtattgcgttgaggtttttacagatgaaataaactgtaacatttttatctgtaccctgtgcag

SEQ ID NO: 57320 - DNA, 201 bp, Homo sapiens
ctgtaaaagagcgattttattttaattaattaatttatttatttattttgagacggagtcttgctctgtcgcccagtctggagtgcagcggtgcaatctckgctcactgcaacaaaagggtggccatattgatgacaggaggtcgcttttttctgtgtgctcaaacatccagttgttcccctgaatacagaccaggcaaca

SEQ ID NO: 57321 - DNA, 201 bp, Homo sapiens
agcactttgggaggccatacttcctagatctgcacatctcatctttggacatttcagatggaaaacagttttctcggtattgctaatatgtttttctgtcdatctcagctactgagagtggttctgcactctgggtccctgtgatacctcagcattctggaggaccctttcacacatccccaggaccctcttttccaggac

SEQ ID NO: 57322 - DNA, 201 bp, Homo sapiens
atctgtgtgatggggatgtgtgtgactggcaaagtgagagtgctcgctgatgccgatttttaacatagtgagaaagacagtctctcctattttgccccccwccccaggccactttgaaggcctgactgggaaggtgccggggccaagagagaggccaggtgggagcacacggtgtgttcacagccacaccacccttgcccc

SEQ ID NO: 57323 - DNA, 201 bp, Homo sapiens
catgtctgattgctaggcagtttcctccgctgtggggcctgggctgctcctccactcttctgttactctcagtgagcaaattgatatgtaacgacccaaaytgggtggtccaggaagcacgcgggcaggggtgtagccttgctgaggggtgcaggagcggggctcctggtgagctgagttcctcccgggctgtagatgggg

SEQ ID NO: 57324 - DNA, 201 bp, Homo sapiens
aaatctctgaagtggcttcttcacctgtaaaaggggaatgaggccgcctgccttgcttactccatatttgtatttgaggcttaactgaaataacggggccrggcgcggtggctcatgcctgtaatcccagcactttgggagaccgaggtgggtggatcatttgaggtcaggagttcgagaccagcctggccaacatggtga

SEQ ID NO: 57325 - DNA, 201 bp, Homo sapiens
ggaggctgagaagcccttttaaaatcagtattcttctaagtgtggtcttctagagacaattctgaactccaattgcttatctctgaaagccttttatttatttatttattttttgagacgagtctcgctctgtcgcccaggctggagtgctgtggcgtgatctcggctcactgcaacctctgcctccaggttcaagcagtt

SEQ ID NO: 57326 - DNA, 201 bp, Homo sapiens
gctgagaagcccttttaaaatcagtattcttctaagtgtggtcttctagagacaattctgaactccaattgcttatctctgaaagccttttatttatttatttattttttgagacgagtctcgctctgtcgcccaggctggagtgctgtggcgtgatctcggctcactgcaacctctgcctccaggttcaagcagttctct

SEQ ID NO: 57327 - DNA, 201 bp, Homo sapiens
taaaatcagtattcttctaagtgtggtcttctagagacaattctgaactccaattgcttatctctgaaagccttttatttatttatttattttttgagacgagtctcgctctgtcgcccaggctggagtgctgtggcgtgatctcggctcactgcaacctctgcctccaggttcaagcagttctctgcctcagcctcccga

SEQ ID NO: 57328 - DNA, 201 bp, Homo sapiens
ggaggtaggggaacgagctatgtggatgggtgtctaagggaagagcagctgcaggtaccctgggttggaagcctgcctggtgggtggggggcagggtgagragctagtggctgcagtggagtggggcggggtgtaatgagggaaggggaggaagggggaagaggccatggggcttcttaagccctcagaagggcttttgct

SEQ ID NO: 57329 - DNA, 201 bp, Homo sapiens
ctgcagcaaagcaccatggcacacgttcacctatgtaacaaacctgcacatctgcacatgtaccctggaacttaaaaaaatagccaggcgcagtggctcaygcctgtaatcccagcactttgggaggccaaggcaggcagatcacttgaggtcaggagttcgagaccagcctggccaacatggtgaaaccccatctctact

SEQ ID NO: 57330 - DNA, 201 bp, Homo sapiens
gggggagaagatggtaagtaggtaaattccatgttgatgagatgaacgttgaagacacagggaaggtgggaaggagtgttgggtggcagctgatgctgaagttttcaatggggtggtcacggagggtgacactttggcacacactggaggaggtaggggaacgagctatgtggatgggtgtctaagggaagagcagctgca

SEQ ID NO: 57331 - DNA, 201 bp, Homo sapiens
ggagttcagtggcgtgatctcggctcactgcaacctctgcctcctgggttcacaccattctcctgcctcaggctcccgagtagctgggactacaggcaccygccaccacgcccggctaattttttgtatttttagtagagacggggtttcaccatgttagccaggatggtctcgatctcctgacctcgtgatctgcctgcc

SEQ ID NO: 57332 - DNA, 201 bp, Homo sapiens
actgggtatggtggctcacgcctgtaattccagctactcaggaggctgaggcatgagaattgcttgaacccggggggcggaggttgcagtgagctgagacrgcaacactgcactcctgcctgggcaacagagcgaagccctttttaagaagcacttgctatgtacaaagcaggtgtgctatgaactaacactcttattcct

SEQ ID NO: 57333 - DNA, 201 bp, Homo sapiens
ggctaacacagtgaaaccccgtctctactaaaaatacaaaaaaaaaaaaaaaattagctgggcgtggtggcgggcagctgtagtcccagctactcgggagkctgaggcaggagaatggcgtgaacccgggaggcggagcttgcagtgagcggagattgcgccactgcactccagcctgggcgacagagcgagactccgtct

SEQ ID NO: 57334 - DNA, 201 bp, Homo sapiens
gaactccctcagactgtggctccaggcccagcaccctgtaccctgtgccgggttgggcctccttaggctggagagaatccaggactggcctggcctggccstgaccttccactctctccaggccagccactctggtgatgcctacttcttatttgtggcagcagacggaataatagcagttgtctaagggagattttagaa

SEQ ID NO: 57335 - DNA, 201 bp, Homo sapiens
ccacacccagctaatttttgagttttttagtagagacgatgtttcaccaagttggccaggctggtctcgaacccctgacctcaggtgatcctcccgcctcrgcctcccaagtgctgggattacaggcgtgagccaccgcactcggccaacagtattttaatttttctcatagccttgccaatacatagtatctccctgttt

SEQ ID NO: 57336 - DNA, 201 bp, Homo sapiens
cgggttcaagtgattctccttcctcagcctcctgagtagctgggattacaggcgtgcagcactacacccggctaatttttaaaatatttttggtagagatrgggtttcaccatgttggccaggctggtctcaaactcctgtcctcaagtgatccacctgcctcgacctcccaaagtgctgggatgacaggcatgagccacc

SEQ ID NO: 57337 - DNA, 201 bp, Homo sapiens
gggttcacaccattctcctgcctcaggctcccgagtagctgggactacaggcacccgccaccacgcccggctaattttttgtatttttagtagagacgggstttcaccatgttagccaggatggtctcgatctcctgacctcgtgatctgcctgcctcggcctcccaaagtgctgggattacaggcgtgagccaccgcgcc

SEQ ID NO: 57338 - DNA, 201 bp, Homo sapiens
tatgaggatcatgcaagcgaatatatacaaagtatttagcacagtgctcagcgatggctgtgattgcagagttttttgttttttgttttttttctgaggcrgagtcttcctcttttgcccaggctggagtgcagtggtgtaatcttggttcactgcaacctccgcctcccaggttcaagcaattcttctgcctcagcctcc

SEQ ID NO: 57339 - DNA, 201 bp, Homo sapiens
cgttctggctgggagtttagatggcttaaccccattctctttcactggggctgggtggaagagatcaggctatgtggctatattaaaaatacaacaaaagsccgggcgcgggggctcacgcctgtaatcccagcactttgggaggccgaggctggcggatcatgaggtcaggagatcgagaccatcctggctaacacagtg

SEQ ID NO: 57340 - DNA, 201 bp, Homo sapiens
gtcccagctacttgggaggctgaggcaggagtatcgtttgagcccaggaatttgaagcttcagtgagctatgattgagccactccattccggcccgggtawcagagtgagaccttgtctcaaaaaaaaaaaaaaaaaaaaaaaaaaaggaaaaatctcttacgttaaataaaatgaataagctgggtgtggtggctcatgc

SEQ ID NO: 57341 - DNA, 201 bp, Homo sapiens
acgtaggcgtcatctttgatgcctcttttccttcctctccaccacatcaacaagtcttagttggctctgcctccagaccagtgcaggcactgtcttcactycctggacactgctgccacagcctttcctgcttccagcccctgcgctccattctccacacagcagcagccctatcccttcactctgctgcctgaaactcct

SEQ ID NO: 57342 - DNA, 201 bp, Homo sapiens
tagaatattagtttttaaccatacattgtcccaaaagtgtctgtgcattgtgcaaaaagtaaacttaggaaacatttggtattaaataaatttacactttwctttgcagtagtgcctttaatctggaaatacagtattacttaggatttgcagtacattttgcctgatagggcaagttttcattcttatttttaaaaaatg

SEQ ID NO: 57343 - DNA, 201 bp, Homo sapiens
tctgtgaccacccagtctcagtagccctcggtccttattaccgtatttttgttgttgttgttgagatggagtcttgctctgtcacccaggctggagtgccrtggcaggatgtcggctcactgcaacctccgcctcccaggtttaagcaattctcctgcctcagcctcccaagtaggtgggattacaggcgcccgccaccac

SEQ ID NO: 57344 - DNA, 201 bp, Homo sapiens
catcttattagtgagatctgaatctcatgtcagtcactggcaaaggagaatagctgtgtcatgatcacctgagaccaacgatgattcctgaataaaatccraaaggagagaggggcccctgggcaggccagcatccgtgtttgctgcaaacagtagtacccggtgccttgcttctcccttaacctctacttgggcatcttt

SEQ ID NO: 57345 - DNA, 201 bp, Homo sapiens
gctgagaatcaccctacctcagaacaacaatcaccacatttgctcacaattctatgggtcacatacttgggctgggctcagctggatgattcttctgtccrtcttgcctggagttaccctggagctgcaggcgtctggttgcttgactggggctggatggcctaagatgacctcacttacttgtctggaccatgtgtcttt

SEQ ID NO: 57346 - DNA, 201 bp, Homo sapiens
attagaaaatgaaccagcccaacgatacagaattcaaatattccacctcaccccaactgcgctacgaccactttatattttgacattcagcttttattccttttttttttttttttaaactgagacgaagtctcactctgtcgcccaggctggagtgcagtggtgccatctcggctcactgcaacctctgccgcccaggtt

SEQ ID NO: 57347 - DNA, 201 bp, Homo sapiens
ctggcttatttggaagatgcttaggacttctgactcaccacttttattgtttatttcttcttatgatgacatcaaagtagaaagtattcttgcaaggtgcrgtggctcatatttggaaatcccagcactttgggaggccaaggtgggtgaattgcttgagcccaggtggttgaggctgcagtgagccatcatggtgctgct

SEQ ID NO: 57348 - DNA, 201 bp, Homo sapiens
gggctgctgcagggcctggaggggatcaggctgcacttcctttgggaaggcttcctgaggagctggggtttgggatgattgctctgcagcaggagggatckcaggcagaggaaacagtccgggcagaggactgaggaggagagagactggaggcgggtccaggcctgcacctaccccaccaaaacggggtctgcggtggag

SEQ ID NO: 57349 - DNA, 201 bp, Homo sapiens
ttgactgtctgtctctgatggggctcagttagagccagaggttagagagtggcagctcctccaggaaaggagtcttgctcggtgggtcagggccccaggcwtgttgggaagggcggctgaggcttcgtgttgccagttctgtcagccagggcctttggactccagggctctgccattctgttcctcctccagccagcctcc

SEQ ID NO: 57350 - DNA, 201 bp, Homo sapiens
ttagaaaatgaaccagcccaacgatacagaattcaaatattccacctcaccccaactgcgctacgaccactttatattttgacattcagcttttattccttttttttttttttttaaactgagacgaagtctcactctgtcgcccaggctggagtgcagtggtgccatctcggctcactgcaacctctgccgcccaggttc

SEQ ID NO: 57351 - DNA, 201 bp, Homo sapiens
ccagctacttgggagactgaggcaggagaaccttgaacctaagaggcagaggttgcagagagccaagatcgagccactgcactccagcctgggcgacagarcgagactccatctcaaaaaaaaaaaaaaaaaagagagagaaagaacttgataaacccaggtgtggctgtgactcttcccttctgtctgagccagttcttt

SEQ ID NO: 57352 - DNA, 201 bp, Homo sapiens
cggctcccacacagccgcctctgctccagcaaggatgtggctcttccacactctgctctgcatagccagtaagtcctctcacccgctgcttcgaggggctsctgtgccctcagctccagccaggtgtctgcagactacagccttgactgtctgtctctgatggggctcagttagagccagaggttagagagtggcagctcc

SEQ ID NO: 57353 - DNA, 201 bp, Homo sapiens
tagaaaatgaaccagcccaacgatacagaattcaaatattccacctcaccccaactgcgctacgaccactttatattttgacattcagcttttattccttttttttttttttttaaactgagacgaagtctcactctgtcgcccaggctggagtgcagtggtgccatctcggctcactgcaacctctgccgcccaggttca

SEQ ID NO: 57354 - DNA, 201 bp, Homo sapiens
gagcctgggctgatcgggactctctgtctggttacagctgccctatgagaaggcctgcaagaataagctgttttgtgtcgcagaattacagttggccaccrccgtctctcagtgagttggacatagccgtcagtttcctcgattaaccttctcccgaacgcttgcctgggcaattccttcattaggacaccctgcacatcc

SEQ ID NO: 57355 - DNA, 201 bp, Homo sapiens
caggttcaagcgattctcctgcctcagcctcccgagtagttgagactacaggtggacaccaccaggcccagctaatttttaaaaaatttttaatagagacrgggatttcaccatgttggccaggctggtcttgaactcctggcctcaggtgatccgcctgcctcggcctcccaaagtgctgggatgataggcatgaaccac

SEQ ID NO: 57356 - DNA, 201 bp, Homo sapiens
tcaagaaccacgtaatggcacggaagatggagatgctgtcattgctgacgtttttcttggtaataactcaggaatgccagtgttcttggcatgcgttatcmgacctcacctgataataactaggaccgagggcctgaatgtcagttggcatcaaaaaagtgaacaactaaaaggaagaataaaaagatagaaacgaccatc

SEQ ID NO: 57357 - DNA, 201 bp, Homo sapiens
tgaaccactgcacccggcctcattcctggtaaaggtctggtgccctctgtcctaatgtattcagttgaaagcagtcgagttcattcaaaaagagaaggccrggtgcggtggctcacgcctgtcatcccagcactttgggaggctgaggtgggtggatcacctgaggtcaggagttcaagaccagcctggctaacatggcga

SEQ ID NO: 57358 - DNA, 201 bp, Homo sapiens
cctctgtcctaatgtattcagttgaaagcagtcgagttcattcaaaaagagaaggccgggtgcggtggctcacgcctgtcatcccagcactttgggaggcygaggtgggtggatcacctgaggtcaggagttcaagaccagcctggctaacatggcgaaaccccgtctctactgaaaatatgaaaattagccaggtgtggt

SEQ ID NO: 57359 - DNA, 201 bp, Homo sapiens
ttaggcaggagaatcacttaaacccaggaggcagaggttgcagtgagctgagatcgcaccactgcactccagcctgggcaacagagcaagactccacctcaaaaaaaaaaaaaaaaaaaaagggatgagtgtagtggctcatgcctgtcatcccaacactttcgcaggctgaggtggaggatcacttgagcctgggaggtt

SEQ ID NO: 57360 - DNA, 201 bp, Homo sapiens
gaggcaggagaatggtgtgaacctgggaggcaaagcttgcagtgagctgagatctcgcctctgcgctccagcctgggtgacagagtgtgactccatttccaaaaaaaaaaaaaaaacaaataaacaaacaaacaaaaaaaccaaaaattagccgggcatggtggcacatgcctgtaatcccagctactcgggaggctgagg

SEQ ID NO: 57361 - DNA, 201 bp, Homo sapiens
taggcaggagaatcacttaaacccaggaggcagaggttgcagtgagctgagatcgcaccactgcactccagcctgggcaacagagcaagactccacctcaaaaaaaaaaaaaaaaaaaaagggatgagtgtagtggctcatgcctgtcatcccaacactttcgcaggctgaggtggaggatcacttgagcctgggaggttg

SEQ ID NO: 57362 - DNA, 201 bp, Homo sapiens
ggtggatcacctgaggtcaggagttcgagaccagcttgcccaacatggtgaaaccctgtctctactaaaaatgcaaaaattagcctggcgttgtggcaggmgcctgtaatcccacctccttgggaggctgaggcaggagaatcgcttgaacacgggagggggatgttgcagtgagccaagattgtgccattgcactacagc

SEQ ID NO: 57363 - DNA, 201 bp, Homo sapiens
cccgggaggcggagcttgcagtgagccgagattgcgccactgcactccagcctgggcgacagagcgagactccgtctcaaaaaaaaaaaaaaaatatatawatatatatatatatatttagtttccagcacacagtagtgctcaaggcctgttggcctttcttgttattagggagatgaagggtgagggagagagatgggc

SEQ ID NO: 57364 - DNA, 201 bp, Homo sapiens
acggcagatgcagtgggacgcaggcccacagtggagcaaggcagggttgaggcatcacgtgaaaggaatcagggcagaaccatgtgtgagcgtgctcaggygaggatggagcctttctgactctgagctcttccatgtgtgtttttaaagaaaatctcctggatccagatgcacgtgtggacactggagactgctacagca

SEQ ID NO: 57365 - DNA, 201 bp, Homo sapiens
atccgggaggcagagatggcagtgagccgagatcgcgccattgcactccagcctggatgacagagcgagactccatctgaaaacaaacaaacaaacaaccraaaaaacagatgactagccatgaggaaggaacctccaaggcctggaccttgacgatatttggctaggcatcccccactcctgcccgggctgttctgccta

SEQ ID NO: 57366 - DNA, 201 bp, Homo sapiens
tgtggccatcttctcctcagggcctgtgagaggcaggcagcatctttagctgaggtagaatgcctgttggggaaagtcaaataggatggtggctggggccrgggctctggggactccttctgccccacatactcaattggaaagactgagcaagtcccctcacctccctgggcctcagcttccctgtctgtcaaatggagg

SEQ ID NO: 57367 - DNA, 201 bp, Homo sapiens
aaaaaatgatagattgtggctgggcatgatggctcacgcctgtaatcccagcactttgagaggctgaggcaggcagatcacgaggtcaagagatcgagacyatcctggccaacatggtgaaaccccatctctactaaaaatacaaaaattagctgggcatggtggcgggcgcctgtagtcccagctactcaggaggctgag

SEQ ID NO: 57368 - DNA, 201 bp, Homo sapiens
catttcagggccaaaatatatcctaaacccattcacttctctccatttccactgccgttgtaattcaagctaccctttcttgccagggctgttgcaataascttcggcctgcctttcttgcctctgcttttcccacattctttacaaataattcccacgtaacagctatccgtcttctaagagcagacattagattgtgcc

SEQ ID NO: 57369 - DNA, 201 bp, Homo sapiens
gaggtgggaagtgcttctttggggagagctaggggcggcttcttggaggaggggggctcgggtactggtacagcttggtttagtaggaggatcagaggctstgggtcagatacacctgcgtctagtctttctctctcacacacacataaagatccctgggcagtctcacttttctcagctgtaaaacggggttcatgacac

SEQ ID NO: 57370 - DNA, 201 bp, Homo sapiens
gctgaattgctgtgaggaaaccacgtttttgttttgttttgtttggctctttaagagaatgtcatctgctcttttaacagcctccctctccaaacattcastgtgatgaccctcagccggttgcttctgtcctgatcatgaactgcaggattggtcaccccgtcctcaagaggtcatctgtgagtcggtttggaccgattc

SEQ ID NO: 57371 - DNA, 201 bp, Homo sapiens
ggtggatcacaaggtcagcagatcgagaccatcctggctaacacggtgaaaccccgtctctactaaaaatacaaaaaattctccgggcgtggtggcgggcrcctgtagtcccagctacttgggaggctgaggcaggagaatggtgtgagcccgggaggcggagcttgcagtgagccgagatcctgccactgcactccagcc

SEQ ID NO: 57372 - DNA, 201 bp, Homo sapiens
tggtctgtggggtccacggaaccccagcctcacgcctcactgggcctctccctgctccattgcccagggggagggtggacttaaagacaattttagtggcygggcacggtggctcacgcctgtaatcccagcactttgggaggccgaggcgggcggatcacgaggtcaggagattgagaccatcctggctaacacggtgaa

SEQ ID NO: 57373 - DNA, 201 bp, Homo sapiens
gattggtcaccccgtcctcaagaggtcatctgtgagtcggtttggaccgattcgctcttctcaccaccctgcagttggcgtcttctgcatcttggtctcayctcaatctctcggttccagctttgcgcttcgcttgactgcagtgtgtccccagcagtgcttacagtggctaagctggctctgaaagtagggggtgatggg

SEQ ID NO: 57374 - DNA, 201 bp, Homo sapiens
tgaggcaggagaatggtgtgagcccgggaggcggagcttgcagtgagccgagatcctgccactgcactccagcctgggagacagagtgagactccatctcaaaaaaaaaaaaaagcaaaaattaaaaccttgtcagtagacagagacattttccctttgaaaattgataaattctgcttctctgtgtgagtgatgtaacat

SEQ ID NO: 57375 - DNA, 201 bp, Homo sapiens
caccacgcctggctaatttttttgtagttttagtagagaaggggtttcaccgtgttagccaggacggtctcgatctcctgacctcgtgatctgcctgcctyggcctcccaaagtgctgggattacaggcgtgagccaccatgcccggcctccaaatgtctttttaacagttggtttgttcaaagcaagatccaaacaaggt

SEQ ID NO: 57376 - DNA, 201 bp, Homo sapiens
caatctctcggttccagctttgcgcttcgcttgactgcagtgtgtccccagcagtgcttacagtggctaagctggctctgaaagtagggggtgatggggaygagagctttccagtacacagccctaggtgaactgcctgctcacctccgtgaagcagagtgaagttgtgggtagtatggagggcgtgtcagacaaaaagtt

SEQ ID NO: 57377 - DNA, 201 bp, Homo sapiens
agaattgcttgaacccgggaggcggaggttgcagtgagctgagatcgcaccactgcactctagcctgggtgacagagcaagactctgtctcaataaaattwaaaaaaaaaaaaagagggtttataaatataaacgtttgttttcacatgtagtttatttatttaaaaaaatagagacaggggtcttgctatgttgaccagg

SEQ ID NO: 57378 - DNA, 201 bp, Homo sapiens
cgagcaaagctgcatacgtgacagacagcgtgtgcatcatatctgtgtgatggggatgtgtgtgactggcaaagtgagagtgctcgctgatgccgattttwaacatagtgagaaagacagtctctcctattttgcccccctccccaggccactttgaaggcctgactgggaaggtgccggggccaagagagaggccaggtg

SEQ ID NO: 57379 - DNA, 201 bp, Homo sapiens
gacgcatgtcctgtcaattgcagaccatccataatgtacgtgaacacaggccaggggctttctcaccacaaagaattcctcttccatgtaagtacttattwttgtaaagctgtagatggcaaagcaataccagctttgatttcctactctgattttaatttgcaggtacatggggagaacctctttggagcagaataccag

SEQ ID NO: 57380 - DNA, 201 bp, Homo sapiens
agactttgtacttgctgttcctttgcttgacactgctcttcctctaggtcctgacgtaggtggtttcttcttaaatttagctcaggtgttcttttcttttytttttttttttttttagatggagtcttgctctgtcacccgggctggagtgcagtggcacgatctctactcactgcaacctccgcctcccgggttcaagtg

SEQ ID NO: 57381 - DNA, 201 bp, Homo sapiens
acagtattacttaggatttgcagtacattttgcctgatagggcaagttttcattcttatttttaaaaaatgatagattgtggctgggcatgatggctcacrcctgtaatcccagcactttgagaggctgaggcaggcagatcacgaggtcaagagatcgagaccatcctggccaacatggtgaaaccccatctctactaaa

SEQ ID NO: 57382 - DNA, 201 bp, Homo sapiens
ctgggtgtggtggcaggtgcctgtaatcccagctactcgggaggctgaggcagggagaattgcttgaactcgggaggcagaggttgcagtgagctgagatsgtgctattgcactccagcctgggtgacagagcgagactccatctatctcaataataataataataaaaataaataaataaaatgagaataataatagtac

SEQ ID NO: 57383 - DNA, 201 bp, Homo sapiens
cctctaggtcctgacgtaggtggtttcttcttaaatttagctcaggtgttcttttcttttttttttttttttttttagatggagtcttgctctgtcaccckggctggagtgcagtggcacgatctctactcactgcaacctccgcctcccgggttcaagtgattctcctgcctcagcctcccgagtagctgggattacagg

SEQ ID NO: 57384 - DNA, 201 bp, Homo sapiens
ccagggttcagtggcagcttcaccgtggatttgccgcatagcctgagcaaggtgctcgggcctgagcttcagtttcccttctctgcagtcagcgtggggawctacctacttcacaggattgtcgcaaagactatttgagataatgcatgtaaagggcttagcacaggttctgccgggcgcggtggctcacgcctgtaatcc

SEQ ID NO: 57385 - DNA, 201 bp, Homo sapiens
ctctaggtcctgacgtaggtggtttcttcttaaatttagctcaggtgttcttttcttttttttttttttttttttagatggagtcttgctctgtcacccgsgctggagtgcagtggcacgatctctactcactgcaacctccgcctcccgggttcaagtgattctcctgcctcagcctcccgagtagctgggattacaggc

SEQ ID NO: 57386 - DNA, 201 bp, Homo sapiens
caaggtgctcgggcctgagcttcagtttcccttctctgcagtcagcgtggggaactacctacttcacaggattgtcgcaaagactatttgagataatgcaygtaaagggcttagcacaggttctgccgggcgcggtggctcacgcctgtaatcccagcactttgggaggccgaggcgggcggatcatttgaggtcaggagt

SEQ ID NO: 57387 - DNA, 201 bp, Homo sapiens
cgagacagaagaatcactcgaacccaggaggcagaggttgcagtgagccaagatcgcgccactgcactccaggatgggtgacagagcgaggctccatctcaaaaaaaaaaaaaaaaaaattagccaggcgtggtggcgcatgacctctattcccagctacttgggaagctaaggcaccaggtcacttgaccttgggaggca

SEQ ID NO: 57388 - DNA, 201 bp, Homo sapiens
tggagtgcagtggcacgatctctactcactgcaacctccgcctcccgggttcaagtgattctcctgcctcagcctcccgagtagctgggattacaggcgcyggcgaccacgcccagctaatttttgtatttttagtagagagggggtttcaccatgttggccaggctggtctcgaactcctgacctcaggtgatcgcccgc

SEQ ID NO: 57389 - DNA, 201 bp, Homo sapiens
gtggtcaagggtttccttcacacccagcacacaggagcaagtgagcccagggttcaaacaggcactggggcagagccaggtgaggagccagggttcctggstgggcagggcgggagctttgcttgaataggatgggtgggcagtggtggctcccgaagcagcctcataggccctgggacttgggccttgaccctgacagcc

SEQ ID NO: 57390 - DNA, 201 bp, Homo sapiens
gggaggcacaagttgcagtgagctgatattgagccatggcactccagcctgagcaacagagtgagacactgtctcaaaaaaaaaaaaaaaaaaaaaaaaarggcaacaatatccccaggcctccttgcgtcccagaatctccatgaagctctgatgaactgagctggtgctggagaaacaaggatggctggggcatagtcc

SEQ ID NO: 57391 - DNA, 201 bp, Homo sapiens
ctgcctcagcctcccgagtagctgggattacaggcgccggcgaccacgcccagctaatttttgtatttttagtagagagggggtttcaccatgttggccargctggtctcgaactcctgacctcaggtgatcgcccgcctcagcctcccaaagtgctgggattacaggcgtgagccaccgcacccgacctaggtgttcttt

SEQ ID NO: 57392 - DNA, 201 bp, Homo sapiens
tatatttgacattccaagactgaatatatattttacaatataacaaataaaaatatatttggtctcaaaataaacatttggtcccattatctggcatacaygcctaaaatctctggaatctccaaagtaataaatgtctttttctttgttaatgagttgacgggggaccggcagcccccagatagcttcaaaatgggggct

SEQ ID NO: 57393 - DNA, 201 bp, Homo sapiens
ccgcctcagcctcccaaagtgctgggattacaggcgtgagccaccgcacccgacctaggtgttcttttcttttcttttctttctttcaagacggagtttcrctcttgttgtgcaatggcacgatctcggctcactgcaacctccgcctcccgggttcaagcgattctcctgcctcagcctcccaagtagctgggattacag

SEQ ID NO: 57394 - DNA, 201 bp, Homo sapiens
ggcctggggcgatggcctggcttctttggtccttgtactctgccgtgtgggggacgcattccttcatggccagcacaaagttgccacatctccaaatgctrtattttcacatggcaggatacaaaacaggaagcaagaagtcagtagcaaaaggatgttggatttttcttcatgtgccttcccttttcagggatgaaacag

SEQ ID NO: 57395 - DNA, 201 bp, Homo sapiens
gctcaccgcaacctctgcctccggggttcaagcaattctcctgcctcagcctaccaagtagctgggattacaggcatgggccacacacccggctaattttrtatttttggtagagacagggtttctccatgttggtcaggctggtcttgaactcccgacctcaggtgatccacccacctcggcctcccaaagtgttgggat

SEQ ID NO: 57396 - DNA, 201 bp, Homo sapiens
attgcactccagcctgggcaacaagaatgaaactctgtctctccaaaaaaaaaaaaaaaaagaagagaaaaatgcacacctcataagcatgcagcgcagtraacatccgcagagtgaagcactgtgtaagcagcatgcagatcaagggcacgtgagctgcggcgcctaggccccctctaagccccgcactcccttccagac

SEQ ID NO: 57397 - DNA, 201 bp, Homo sapiens
gaggcacaagttgcagtgagctgatattgagccatggcactccagcctgagcaacagagtgagacactgtctcaaaaaaaaaaaaaaaaaaaaaaaaaagscaacaatatccccaggcctccttgcgtcccagaatctccatgaagctctgatgaactgagctggtgctggagaaacaaggatggctggggcatagtccct

SEQ ID NO: 57398 - DNA, 201 bp, Homo sapiens
tgcctgggcaacagagcgaagccctttttaagaagcacttgctatgtacaaagcaggtgtgctatgaactaacactcttattcctagttccaatgaaagayggtctttggccaacgagacccacacccttcaattcaggcatggcttcgttgcagttctgtccaagtgagtactcccaagaggccagcagcggtgtgactc

SEQ ID NO: 57399 - DNA, 201 bp, Homo sapiens
ctggtggtcaggatgaatgtggacactgtccttctgagaggagcctgcttagaacccaggctctgatattgatctctagggtgctaacatttgggtcacaraaaccccactgtggtcatcaaaggaggtgtattgccaactagtcgtgctacaaaagggaattaatatgacgctgtggagggaagaaggcagctgtgggac

SEQ ID NO: 57400 - DNA, 201 bp, Homo sapiens
agtctcactctgtcgcccaggctggagtgcagtggtgccatctcggctcactgcaacctctgccgcccaggttcaagcgattctcctgcctcagcctcccragtagttgagactacaggtggacaccaccaggcccagctaatttttaaaaaatttttaatagagacagggatttcaccatgttggccaggctggtcttga

SEQ ID NO: 57401 - DNA, 201 bp, Homo sapiens
gcctgtcatcccagcactttgggaggctgaggtgggtggatcacctgaggtcaggagttcaagaccagcctggctaacatggcgaaaccccgtctctactraaaatatgaaaattagccaggtgtggtggcaggcgcctgtaatctcagctacttgggggcttaggcaggagaatcacttaaacccaggaggcagaggttg

SEQ ID NO: 57402 - DNA, 201 bp, Homo sapiens
gggcttaggcaggagaatcacttaaacccaggaggcagaggttgcagtgagctgagatcgcaccactgcactccagcctgggcaacagagcaagactccasctcaaaaaaaaaaaaaaaaaaaaagggatgagtgtagtggctcatgcctgtcatcccaacactttcgcaggctgaggtggaggatcacttgagcctggga

SEQ ID NO: 57403 - DNA, 201 bp, Homo sapiens
ctgagccatgattgttccactgtgctctagcctgggcaacagagtgagaccctgtctccaaaaaagggagaaagactcctcaagggctgacgcatgtcctstcaattgcagaccatccataatgtacgtgaacacaggccaggggctttctcaccacaaagaattcctcttccatgtaagtacttattattgtaaagctgt

SEQ ID NO: 57404 - DNA, 201 bp, Homo sapiens
attatattataatggcaccagaattttaccattacttgaactaggaacagattcagtatatggaatcaagggaaactttcattttattaattaattaattwatttatttatttgagatagagtcttgctctttctcccaggctggagtgcagtagcatgatctcggctcactgcaacctccgcctcccaggttcaatcgat

SEQ ID NO: 57405 - DNA, 201 bp, Homo sapiens
agttagagccagaggttagagagtggcagctcctccaggaaaggagtcttgctcggtgggtcagggccccaggcttgttgggaagggcggctgaggcttcrtgttgccagttctgtcagccagggcctttggactccagggctctgccattctgttcctcctccagccagcctccccccgccaccgaggccctctccccat

SEQ ID NO: 57406 - DNA, 201 bp, Homo sapiens
gcagaataccagttgcaaatttgcgtcccaaccaaattacgaggtctccaggttgtagcagtgaagaagctgacgaggactcaggtatttaaaggcagttmtttatcagtcacacctctttccacagtgactacagagtctcaagtataaaaaccagagttctagaaacagagtgaagacaagttaaccatgggaaaagat

SEQ ID NO: 57407 - DNA, 201 bp, Homo sapiens
ttcaggtaagcgcggccgtcccgagaggccaggggagggcggagggcctgaagcgggtaacgagaggccaggagactgtttttcctgggttacccctgcckgccagtgccgggggctgccaggccctccctagcttcgtccctgggtctcaattgctcccgctggagcttcgcttgggccgaggtgagcgctgaaattgct

SEQ ID NO: 57408 - DNA, 201 bp, Homo sapiens
aaaagaagttgaagaaaaggccaggcgcggcagctcacgcctgtaatcccagcactttgggaggccgaggtgggtagatcatctgaggtcaggagttcgaracaagcctggccaacatggcaaaaccccatctctactaaaaatacaaaaattagcctggcatggtggcacatgcccataattccagctactcgggaggct

SEQ ID NO: 57409 - DNA, 201 bp, Homo sapiens
gtgtttgagactgaaatgctccagatttgattatccagttgctcacgggcatcgcccctagaagagataatagcatctttgcataacatgtccatgtccawaatagatcttttggtgcaaaaaaccaaccctctgtcccaacccgttccttagctaccctcaggagggagatatactccagttacagtacaaggaactcga

SEQ ID NO: 57410 - DNA, 201 bp, Homo sapiens
gccaatataacatttccttttatttttaagtagtgtatttctttttcttttcttttctttcttttttttttttttttttgaggaagaatctcactgtgtcvcccaggctggagtccgttggtgccatctcggctcactgcaacctccacctccccagttcaagtgattcttcttcctcagcctcccgagtagctgggatta

SEQ ID NO: 57411 - DNA, 201 bp, Homo sapiens
tgcttttttttctttttttttttgagacggagttccgctctttcgcccaggcttgagtgcggtggtgcgatctcggctcactgcaacctccccgtcccccbgccctgaccccgggttcaagagattctcctgcctcagcctcctgagtagctgggattacaggaatgtgccaccatgcctggctaattgttttgtattttt

SEQ ID NO: 57412 - DNA, 201 bp, Homo sapiens
gagaatggtgaacccgggaggcggagcttgcagtgagcggagatcgcgccactgcactccagcctgggcgacagagcgagactccgtctccaaaaaaaaaraaagaaaaacagagcttttatctccccccacccttcattcccccaaatctatcctgccctcaggctttctgtctcagcaaatggcatcatcatccaccca

SEQ ID NO: 57413 - DNA, 201 bp, Homo sapiens
gccaggctggtctcaaactcctgaccttgtgatcctcccgcctcggcctcccaaagttctgggattacaggcatgaaccaccactcccagcctcttttttwaaaataaacaccagggtctttgtcccccaagctggagttcagtggcacagttaagggctcactgcagcctcctactcctaggctcaggtgatcctcccat

SEQ ID NO: 57414 - DNA, 201 bp, Homo sapiens
tgctctgtcacccaggctggagtgccgtggcaggatgtcggctcactgcaacctccgcctcccaggtttaagcaattctcctgcctcagcctcccaagtargtgggattacaggcgcccgccaccacacccagctaatttttgagttttttagtagagacgatgtttcaccaagttggccaggctggtctcgaacccctga

SEQ ID NO: 57415 - DNA, 201 bp, Homo sapiens
gaataaaatccgaaaggagagaggggcccctgggcaggccagcatccgtgtttgctgcaaacagtagtacccggtgccttgcttctcccttaacctctacytgggcatctttggggcacttttgggaatctgtgggtttagaagaagataaagggaggtggctttgagaaatagggacatttcttctactcacatctggcc

SEQ ID NO: 57416 - DNA, 201 bp, Homo sapiens
gtgaaacaccgtctctactaaaaatacaaaaaattagccgggcaggtgcctgtaatcccagctactcgggaggctgaggcaggagaatagcatgaacccaggagacggagcttgcagtgagctgagatcgcaccactgcactccacgctgggcgacagagcgagactccgtctcagaaaaaaaaaaaagactcagaaaaag

SEQ ID NO: 57417 - DNA, 201 bp, Homo sapiens
acctctacttgggcatctttggggcacttttgggaatctgtgggtttagaagaagataaagggaggtggctttgagaaatagggacatttcttctactcamatctggcctgtttcccgagtcaccttgggacttcctttcacttcccaaacccagggtcttgagtccccctccttctcctgtagaatattccagccctctt

SEQ ID NO: 57418 - DNA, 201 bp, Homo sapiens
ctttggggcacttttgggaatctgtgggtttagaagaagataaagggaggtggctttgagaaatagggacatttcttctactcacatctggcctgtttccygagtcaccttgggacttcctttcacttcccaaacccagggtcttgagtccccctccttctcctgtagaatattccagccctctttctgttcttcctccct

SEQ ID NO: 57419 - DNA, 201 bp, Homo sapiens
tttggggcacttttgggaatctgtgggtttagaagaagataaagggaggtggctttgagaaatagggacatttcttctactcacatctggcctgtttcccsagtcaccttgggacttcctttcacttcccaaacccagggtcttgagtccccctccttctcctgtagaatattccagccctctttctgttcttcctccctc

SEQ ID NO: 57420 - DNA, 201 bp, Homo sapiens
taatcccagcactctgagaggctgaggcaggtggatcacgaggtcaggagatggagaccatcctggctaacacggtgaaaccccgtctctactaaaaatamaaaaaattagccgggtgcggtggcaggtgcctgtagtcccagctactcgggaggctgaggcaggagaatggcgtgaacctgggaggcagagcttgcagtg

SEQ ID NO: 57421 - DNA, 201 bp, Homo sapiens
tccctaaataggttcgtgcctctgcgtacgcgtaggctgcttttcttgtcaggaatgccctccatgactgctcacttcactcactgtcttccctgaaagcrgtctagagactcctgagtcctctgtgctggcttctgtgtgtttgctgtgagctcccttctagaaacccttccaaatggcagtcatcacactgtattgtaa

SEQ ID NO: 57422 - DNA, 201 bp, Homo sapiens
actgaggcaggagaaccttgaacctaagaggcagaggttgcagagagccaagatcgagccactgcactccagcctgggcgacagaacgagactccatctcaaaaaaaaaaaaaaaaaagagagagaaagaacttgataaacccaggtgtggctgtgactcttcccttctgtctgagccagttctttacccctttgtgactg

SEQ ID NO: 57423 - DNA, 201 bp, Homo sapiens
ctgaggcaggagaaccttgaacctaagaggcagaggttgcagagagccaagatcgagccactgcactccagcctgggcgacagaacgagactccatctcaaaaaaaaaaaaaaaaaagagagagaaagaacttgataaacccaggtgtggctgtgactcttcccttctgtctgagccagttctttacccctttgtgactgg

SEQ ID NO: 57424 - DNA, 201 bp, Homo sapiens
ggagactgtttttcctgggttacccctgccggccagtgccgggggctgccaggccctccctagcttcgtccctgggtctcaattgctcccgctggagcttygcttgggccgaggtgagcgctgaaattgctcacaccctctattctgggaccttacgatgctctgtgtccgaagtgttaaaaagatttcagactttccgca

SEQ ID NO: 57425 - DNA, 201 bp, Homo sapiens
tacttgggaggctgaggcaggagaatggtgtgagcccgggaggcggagcttgcagtgagccgagatcctgccactgcactccagcctgggagacagagtgmgactccatctcaaaaaaaaaaaaaagcaaaaattaaaaccttgtcagtagacagagacattttccctttgaaaattgataaattctgcttctctgtgtga

SEQ ID NO: 57426 - DNA, 201 bp, Homo sapiens
actccatctcaaaaaaaaaaaaaagcaaaaattaaaaccttgtcagtagacagagacattttccctttgaaaattgataaattctgcttctctgtgtgagygatgtaacatgtgacatttcttacactgccccctataagttgcttactagcttcccttcttctcccctgagactcttttttggtctctgctttgcctcag

SEQ ID NO: 57427 - DNA, 201 bp, Homo sapiens
aattgataaattctgcttctctgtgtgagtgatgtaacatgtgacatttcttacactgccccctataagttgcttactagcttcccttcttctcccctgaractcttttttggtctctgctttgcctcagcctctttgctttcagttgtctcatctgtagtctggttcccaaagctagccttgatacctgaagcaacaggc

SEQ ID NO: 57428 - DNA, 201 bp, Homo sapiens
aacctccaaggcctggaccttgacgatatttggctaggcatcccccactcctgcccgggctgttctgcctatatccgaaaggactaaggaagcttctcttygcgtaggtgtctgctccctgaatgctcaaagtcgtgagctgtgtgttgctgctgaattcgcatgatgtaaatgtcatgggcacccctaacattccgtgaa

SEQ ID NO: 57429 - DNA, 201 bp, Homo sapiens
ttcggcctgcctttcttgcctctgcttttcccacattctttacaaataattcccacgtaacagctatccgtcttctaagagcagacattagattgtgccaytcccctgcttattaaaaataacaaacaaacaaaactgatgcttgagcacacttagactaaaatccatacttttttcatggccagagcaaggcagtacttg

SEQ ID NO: 57430 - DNA, 201 bp, Homo sapiens
ctctttgctttcagttgtctcatctgtagtctggttcccaaagctagccttgatacctgaagcaacaggctctgctcagtatgaagctgaagcctgggcattttttttttgctcagactacataagtgttaaggctcaaaaaacggaaaggaatttacagaaaggactctgctgacaattagaaagagggcttataggtca

SEQ ID NO: 57431 - DNA, 201 bp, Homo sapiens
atgaactgcaggattggtcaccccgtcctcaagaggtcatctgtgagtcggtttggaccgattcgctcttctcaccaccctgcagttggcgtcttctgcaycttggtctcatctcaatctctcggttccagctttgcgcttcgcttgactgcagtgtgtccccagcagtgcttacagtggctaagctggctctgaaagtag

SEQ ID NO: 57432 - DNA, 201 bp, Homo sapiens
cagaagttcaacacaagcctggccaacatggagaaaccctgtctaccaaaaatacaaaaattagccggacatgatggtgggtgcctgtaatcccacctacytgggaggctgaggcacgagaatcgcttgaatctgggaggcagaggttgcagtgagccgagatcacaccactccactccagcctcagtgatagagtgagac

SEQ ID NO: 57433 - DNA, 201 bp, Homo sapiens
cagctactcgggaggctaaggcaggagaatcgcttgaacctgacggggtggaggttgcagtgagccgagatcgcaccacttcactccagcctgggcgaaaragcgaaactccatctcaaaaaaaaaaaaaaggaagttgaagaataactgcagatgtcttgtttgggtaactttatgtagtgttgtgtacgttagggccat

SEQ ID NO: 57434 - DNA, 201 bp, Homo sapiens
cgaaactccatctcaaaaaaaaaaaaaaggaagttgaagaataactgcagatgtcttgtttgggtaactttatgtagtgttgtgtacgttagggccattamctaagcccaggaatacctttaaagggaaaggtggtgaaggctgttcaaacacagtgagttcatgtctaaaatatgttttgtttccctcattcctttcccc

SEQ ID NO: 57435 - DNA, 201 bp, Homo sapiens
tctgcctttgggtagtttctagggcttggttggagcagcccattcacctctcatggagccccgtaccttgccagtgttacatcactaggctgttgggcacsatctgcttccctgttgatctgattccatcatcttcatttcgttcagaaatccgtctgtgctatcggtcacttgatgatattgttctctgttttccaatgc

SEQ ID NO: 57436 - DNA, 201 bp, Homo sapiens
tgattccatcatcttcatttcgttcagaaatccgtctgtgctatcggtcacttgatgatattgttctctgttttccaatgctgccacaggcttttcccctyccttgtaactcttgggttgtttcagtggaatttgcctttgagggaaaacacacaggtaagtttgcttacttattttcctgttgtgctcaggagttgtgtc

SEQ ID NO: 57437 - DNA, 201 bp, Homo sapiens
atctggtccttcaatagcaatgatttttatggctacgggtgtgtgatcagcaattgtttgaaacacttcgccaaacaccccttccccaatcttctcacagmgttgcagtttttctgtgggaaggcaatggctaaaggggacaggacccttctgactgcattccccataaaccttttcagcatcagatgcctttttgtttga

SEQ ID NO: 57438 - DNA, 201 bp, Homo sapiens
agagtgtttaaggggcttagcaaatacatagaggaggagtgccaagaggacggagcaccacttgttctgttcatgacaggccggtttgaacattctgatargagggatccagagagagaagtggcagtggtatagatgctgcagacctctgacacatcagtcacaattttcttcttgtggaaactgaaggaagccctggtt

SEQ ID NO: 57439 - DNA, 201 bp, Homo sapiens
aactctttggggttttaatttaaacatacaggttaagtttgggagcattgatatctttatagatttcctttctactccgcttgctgcgatttattttttawtttttattttactttatttttttttttttgagacagagttttgctcttacttcccagactggtgtgcaatggtgtgatcttggctcaccgcaacctccgc

SEQ ID NO: 57440 - DNA, 201 bp, Homo sapiens
atctttatagatttcctttctactccgcttgctgcgatttattttttattttttattttactttatttttttttttttgagacagagttttgctcttactkcccagactggtgtgcaatggtgtgatcttggctcaccgcaacctccgcctcccaggttcaagcgattctcctgcctcagcctcctgagtaactgggatta

SEQ ID NO: 57441 - DNA, 201 bp, Homo sapiens
tgaacctaagaggcagaggttgcagagagccaagatcgagccactgcactccagcctgggcgacagaacgagactccatctcaaaaaaaaaaaaaaaaaagagagagaaagaacttgataaacccaggtgtggctgtgactcttcccttctgtctgagccagttctttacccctttgtgactgggataagaaccatagcag

SEQ ID NO: 57442 - DNA, 201 bp, Homo sapiens
attttactttatttttttttttttgagacagagttttgctcttacttcccagactggtgtgcaatggtgtgatcttggctcaccgcaacctccgcctcccrggttcaagcgattctcctgcctcagcctcctgagtaactgggattacaggcatgcgccaccacgcccagataattttgtatttttagtagagatggggtt

SEQ ID NO: 57443 - DNA, 201 bp, Homo sapiens
aacctaagaggcagaggttgcagagagccaagatcgagccactgcactccagcctgggcgacagaacgagactccatctcaaaaaaaaaaaaaaaaaagagagagaaagaacttgataaacccaggtgtggctgtgactcttcccttctgtctgagccagttctttacccctttgtgactgggataagaaccatagcagct

SEQ ID NO: 57444 - DNA, 201 bp, Homo sapiens
gtgtgcaatggtgtgatcttggctcaccgcaacctccgcctcccaggttcaagcgattctcctgcctcagcctcctgagtaactgggattacaggcatgcrccaccacgcccagataattttgtatttttagtagagatggggtttctccatgttggtcaggctggtctcaaactcttgacttcaggtgatccacctgcct

SEQ ID NO: 57445 - DNA, 201 bp, Homo sapiens
gtttcagtcagcgttttctgtaactgtctcctgcctagttccctcccaccaatacccagcgaccccacgcctcagctccaggtcccaccgacattcacagyccctctctcagaagcctaaaggccagggtgcaggagagagtttggagcccgtgtcgcagagggctctgagtccaccaggggctgggggagggcccagcgg

SEQ ID NO: 57446 - DNA, 201 bp, Homo sapiens
cacgccactgcactccagcctgggagacagagtgagactccatctcaaaaagcaaacaaacaacgaaaaacatactaaagcaataaataaaggcaggagayggacaagggttgctgggctgtacccagctcagggtgtaacagggcccctgtggctgcgagctgatggccagtcctctgtcagagctggtgggtcaatggt

SEQ ID NO: 57447 - DNA, 201 bp, Homo sapiens
ttattcaaattttgccagttgtcctattaatgtcctttatagcaaaagaaaaaaaaggttctggtccaggatcattcatagcgttctacagttatttatcyttagtctcctttaatctggaagggtttctcactcagtctttccttgtcttttaatgacattaacatttttgaagggtacaggccagtccttttgtagaat

SEQ ID NO: 57448 - DNA, 201 bp, Homo sapiens
tctagaagctgcctgcattccttggctcacggcctcctcctcctcaagcctgcagcatagtaagctttgcatctttctctgacactttggaagaccaaggygggagtgcttgagcccaggatcagcttgggcaacacagtgagacttcatctctatagacaaattaacaaaattagctgggcaaggtaactcgctcctgta

SEQ ID NO: 57449 - DNA, 201 bp, Homo sapiens
gcaaaagaaaaaaaaggttctggtccaggatcattcatagcgttctacagttatttatctttagtctcctttaatctggaagggtttctcactcagtcttyccttgtcttttaatgacattaacatttttgaagggtacaggccagtccttttgtagaatgttcctcaatttgtctgatatttcttcataattagattcag

SEQ ID NO: 57450 - DNA, 201 bp, Homo sapiens
tagtttttaaccatacattgtcccaaaagtgtctgtgcattgtgcaaaaagtaaacttaggaaacatttggtattaaataaatttacacttttctttgcartagtgcctttaatctggaaatacagtattacttaggatttgcagtacattttgcctgatagggcaagttttcattcttatttttaaaaaatgatagattg

SEQ ID NO: 57451 - DNA, 201 bp, Homo sapiens
ttcctcaatttgtctgatatttcttcataattagattcaggttatacatttttgttttgtttttgagacagagtttcgcccttgttgcccaggctggagtrcaatggcgtgatctcggctcactgcaacctctgcctcccaagttcaagcaattctcctgcctcagcctcccgagtagctgggattacaggcatgtatcac

SEQ ID NO: 57452 - DNA, 201 bp, Homo sapiens
gaaacatttggtattaaataaatttacacttttctttgcagtagtgcctttaatctggaaatacagtattacttaggatttgcagtacattttgcctgatrgggcaagttttcattcttatttttaaaaaatgatagattgtggctgggcatgatggctcacgcctgtaatcccagcactttgagaggctgaggcaggcag

SEQ ID NO: 57453 - DNA, 201 bp, Homo sapiens
ctgcagatccttggtgaaatatctttcaacaaatctctatatgagggactgaatgcagagaaccacagaactaaggtaattcctggctggcttctgagtastgcccaaggaaaattgtgcctaacctttgagcacctccacagacattctgttgccctcttcctgttttcagccttaacacttctgatcttggctctgcca

SEQ ID NO: 57454 - DNA, 201 bp, Homo sapiens
agcctggccctgaccttggggatgtagtttgggtttgtggggaaagcagctaccgccaggtgggctttacggacccctgtgtgtctcatgactagaggcastgacgcttggataaatacatactggatggatgcaggatgagtccgcattctagaagtgtgcagaggtacagaagtggccctgctccctgtccagcaccca

SEQ ID NO: 57455 - DNA, 201 bp, Homo sapiens
catcagccacgccatctgtgaccacccagtctcagtagccctcggtccttattaccgtatttttgttgttgttgttgagatggagtcttgctctgtcaccsaggctggagtgccgtggcaggatgtcggctcactgcaacctccgcctcccaggtttaagcaattctcctgcctcagcctcccaagtaggtgggattacag

SEQ ID NO: 57456 - DNA, 201 bp, Homo sapiens
cctacttgggaggctgaggcacgagaatcgcttgaatctgggaggcagaggttgcagtgagccgagatcacaccactccactccagcctcagtgatagagygagactcagtctcaaaaaataaataaataaataaaaaatgaattacctaagtgagaaattgttttttgtatccagtaactgtcttagtgtgctgtatcag

SEQ ID NO: 57457 - DNA, 201 bp, Homo sapiens
tgaatctgggaggcagaggttgcagtgagccgagatcacaccactccactccagcctcagtgatagagtgagactcagtctcaaaaaataaataaataaawaaaaaatgaattacctaagtgagaaattgttttttgtatccagtaactgtcttagtgtgctgtatcagtgtttagttatagtattaaacagtactcagga

SEQ ID NO: 57458 - DNA, 201 bp, Homo sapiens
tagactagatactggaactcttggaattctttttgcaaaagtatgactagaagtcagactgatgcctgtgatttgtggactgaatgctttgtgtgttaccstgtgttttcattcttgttgacccttgcctggacatggcttcagaggtgatctatctgtgagctctgagctctttagttaggcatgattctctactagagg

SEQ ID NO: 57459 - DNA, 201 bp, Homo sapiens
ggaggcacaagttgcagtgagctgatattgagccatggcactccagcctgagcaacagagtgagacactgtctcaaaaaaaaaaaaaaaaaaaaaaaaaargcaacaatatccccaggcctccttgcgtcccagaatctccatgaagctctgatgaactgagctggtgctggagaaacaaggatggctggggcatagtccc

SEQ ID NO: 57460 - DNA, 201 bp, Homo sapiens
ctgtggttttgtttttttggagacggagtctcactctgtcgcccacgctggagtgcagtggtgtgatctctgctcactgcaacctccgcctcccgggttcmagcaattctcctgcctcaccctcccgagtagctgggactacagggacccaccaccatgcccagctaatttttgcacttttagtagagatggggtttcacc

SEQ ID NO: 57461 - DNA, 201 bp, Homo sapiens
cttcatctctatagacaaattaacaaaattagctgggcaaggtaactcgctcctgtaggcccagcaacttgtgaggctgaggtaggaggattgctgagccsgggaggtcaaggctgcagtgagctgtgatcacactactgcactccagcctggacaacagagcaagacactacctaaaaaacaaacaaaccccacaaaata

SEQ ID NO: 57462 - DNA, 201 bp, Homo sapiens
gtgatctctgctcactgcaacctccgcctcccgggttccagcaattctcctgcctcaccctcccgagtagctgggactacagggacccaccaccatgcccrgctaatttttgcacttttagtagagatggggtttcaccatgttaggctggtctcgaactcctgacctcaggtgatccacccgcctcaggctcacaaagtg

SEQ ID NO: 57463 - DNA, 201 bp, Homo sapiens
ccccacaaaataacaggaggctattaccatcaacaaggcaggacgatgatggaaggagcatctggagaagagttgctttctagaaataatttggagagtcrggcacggtggctcatgcttgtaattccagcactttgggaggctgaggtgggtggatcacctgaggtcaggatatcaagaccagcctggccaacatggtga

SEQ ID NO: 57464 - DNA, 201 bp, Homo sapiens
ctcccgggttccagcaattctcctgcctcaccctcccgagtagctgggactacagggacccaccaccatgcccagctaatttttgcacttttagtagagayggggtttcaccatgttaggctggtctcgaactcctgacctcaggtgatccacccgcctcaggctcacaaagtgctgggattacaggcatgagccaaatcc

SEQ ID NO: 57465 - DNA, 201 bp, Homo sapiens
aatctgttttcttgcctttttaggcttctagaagctgcttgcattccttggctgacgggctcctcctcctccttaggcctgcagcatagcaagcttcacawctttctccgactctgattctcctgcctccctcctagaaggacttttgtgattacactggggctttacagcccagccaggacagccctgggggcttctggg

SEQ ID NO: 57466 - DNA, 201 bp, Homo sapiens
cttcagcatcataggctatactgagtatttttgcataaataagattagatccagtacagccgaaattatcatgctttgcaaaataagttaaaaaggttcarctgctcgggagagcagggttcagaggaaggtggagtcagttctgattgagggatgagcaccagaggtcttgaaggattggactctccaggagagattcag

SEQ ID NO: 57467 - DNA, 201 bp, Homo sapiens
aatcccagcactttgggaggccgaggctggcggatcatgaggtcaggagatcgagaccatcctggctaacacagtgaaaccccgtctctactaaaaatacaaaaaaaaaaaaaaaattagctgggcgtggtggcgggcagctgtagtcccagctactcgggagtctgaggcaggagaatggcgtgaacccgggaggcggag

SEQ ID NO: 57468 - DNA, 201 bp, Homo sapiens
catgcccagctaatttttgcacttttagtagagatggggtttcaccatgttaggctggtctcgaactcctgacctcaggtgatccacccgcctcaggctcmcaaagtgctgggattacaggcatgagccaaatccgggcccggccaaactgtttttaaatcactctttagttgattctttgggatttttctaaggagacaa

SEQ ID NO: 57469 - DNA, 201 bp, Homo sapiens
ccttttgccataaaaggcaacatattcacaggttctggggattaggacgtggccttctttggggggccattattctgcctacgatagcagatggagaggtrggaatttcagccgttataggtgtattgaagccatgggcttggaagggatcactagggagagtgtgccggcaaggaagacagtgacccagcccccagatcc

SEQ ID NO: 57470 - DNA, 201 bp, Homo sapiens
gaaagcggtctagagactcctgagtcctctgtgctggcttctgtgtgtttgctgtgagctcccttctagaaacccttccaaatggcagtcatcacactgtrttgtaattatctctttttcctactagatgatgagcttgatgtaggaagctgtacttgatctccttctgtcttcagcatcataggctatactgagtatttt

SEQ ID NO: 57471 - DNA, 201 bp, Homo sapiens
ttttagtagagatggggtttcaccatgttaggctggtctcgaactcctgacctcaggtgatccacccgcctcaggctcacaaagtgctgggattacaggcrtgagccaaatccgggcccggccaaactgtttttaaatcactctttagttgattctttgggatttttctaaggagacaattttatttgcaaataatggcaa

SEQ ID NO: 57472 - DNA, 201 bp, Homo sapiens
ggtgcatgccaccacacccagctaattttttaattttaattttgtggagatgaggtctccctatattgcccaggctggtctcaaactccggggctcgagcsatcttctcatcttggcctcccgaagtggtggggttacaggcataagcacctgaccttgcttttttctcccaacaagtcaaactattccctaaataggttc

SEQ ID NO: 57473 - DNA, 201 bp, Homo sapiens
atgaaccaccactcccagcctcttttttaaaaataaacaccagggtctttgtcccccaagctggagttcagtggcacagttaagggctcactgcagcctcstactcctaggctcaggtgatcctcccatcttagtctcctgagtaactgggactgttactcaggtgcatgccaccacacccagctaattttttaattttaa

SEQ ID NO: 57474 - DNA, 201 bp, Homo sapiens
ctgacacagtcctagcaacagaaatgatacctacagcgtattgcgtgcccaccctgtgcccggcagtcctctgagtcattctgttttcatcctcaaaaccrcgccatttataagagaggaagctacagttcagagaatgtaggtcttttggttgccagtatgacaaagttcacacttttagtgttggtggctgattcgaaa

SEQ ID NO: 57475 - DNA, 201 bp, Homo sapiens
cgcctcggcctcccaaagttctgggattacaggcatgaaccaccactcccagcctcttttttaaaaataaacaccagggtctttgtcccccaagctggagytcagtggcacagttaagggctcactgcagcctcctactcctaggctcaggtgatcctcccatcttagtctcctgagtaactgggactgttactcaggtgc

SEQ ID NO: 57476 - DNA, 201 bp, Homo sapiens
gagagagcgccacgctttgacttctgcaaatggcatcccccttccgcaggaagtagaaagttccctttcaagccctgggctgtcattccccctctaggccrtgggaacagacctgcagacagctgccgaggtggccaccgggagagaagtgcgaagtgcagaggctctccagccgaggagctggctgccttccttcataat

SEQ ID NO: 57477 - DNA, 201 bp, Homo sapiens
gaccctgtctcaaaaaaataaataaataaataaataatgaggccgggcgcagtggctcacgcctgtaatcccagcacttcgggaggcgccgacgtgggcasatcacctgaggtcgggagcttgagagcagcctgaccaacatggagaaaccccatcttcattaaaaatacaaaattagctgggcgtggtggtgggtgcctg

SEQ ID NO: 57478 - DNA, 201 bp, Homo sapiens
tatcctgaggctgacagtggggaggacgaggaaggagctaccatttctgcccctgaggctgggggcagtaagattccccaggatgggtctgtgaggctggsgggttccttggtccacacagccagtcccacggtatcttgcacattccttggcacttacatacccaccaggcagtgcttctccacccacctgcccgaccaa

SEQ ID NO: 57479 - DNA, 201 bp, Homo sapiens
ttttagtagagacggggtttcaccatattggccaggctggtctcaaactcctgaccttgtgatcctcccgcctcggcctcccaaagttctgggattacagkcatgaaccaccactcccagcctcttttttaaaaataaacaccagggtctttgtcccccaagctggagttcagtggcacagttaagggctcactgcagcct

SEQ ID NO: 57480 - DNA, 201 bp, Homo sapiens
cctccatggggccttttgaaatgtggctttcagaattagtcgattatgtgtaggcaagggaaatagttagcttacagagacgactagccaggccgggcgcrgtggctcacacctgtaatcccaacactttggaaggccaaggtgggtggatgacctgaggtcaggagtttgagaccaacctggtcaacatggcgaaaccct

SEQ ID NO: 57481 - DNA, 201 bp, Homo sapiens
tagtcataattatattataatggcaccagaattttaccattacttgaactaggaacagattcagtatatggaatcaagggaaactttcattttattaattwattaatttatttatttatttgagatagagtcttgctctttctcccaggctggagtgcagtagcatgatctcggctcactgcaacctccgcctcccaggtt

SEQ ID NO: 57482 - DNA, 201 bp, Homo sapiens
gctggggggttccttggtccacacagccagtcccacggtatcttgcacattccttggcacttacatacccaccaggcagtgcttctccacccacctgcccraccaaacccactgaggaaaagcagcaggcatccgctgttgctggacgcccatcaccacgctcacaaggctgggcacagagcagacgtcaatgggcacgtg

SEQ ID NO: 57483 - DNA, 201 bp, Homo sapiens
accatgcctggctaattgttttgtatttttagtagagacggggtttcaccatattggccaggctggtctcaaactcctgaccttgtgatcctcccgcctcrgcctcccaaagttctgggattacaggcatgaaccaccactcccagcctcttttttaaaaataaacaccagggtctttgtcccccaagctggagttcagtg

SEQ ID NO: 57484 - DNA, 201 bp, Homo sapiens
tttgaaatgtggctttcagaattagtcgattatgtgtaggcaagggaaatagttagcttacagagacgactagccaggccgggcgcggtggctcacacctrtaatcccaacactttggaaggccaaggtgggtggatgacctgaggtcaggagtttgagaccaacctggtcaacatggcgaaaccctttctctaataaaaa

SEQ ID NO: 57485 - DNA, 201 bp, Homo sapiens
cataattatattataatggcaccagaattttaccattacttgaactaggaacagattcagtatatggaatcaagggaaactttcattttattaattaattwatttatttatttatttgagatagagtcttgctctttctcccaggctggagtgcagtagcatgatctcggctcactgcaacctccgcctcccaggttcaat

SEQ ID NO: 57486 - DNA, 201 bp, Homo sapiens
agacgactagccaggccgggcgcggtggctcacacctgtaatcccaacactttggaaggccaaggtgggtggatgacctgaggtcaggagtttgagaccarcctggtcaacatggcgaaaccctttctctaataaaaatacaaagttagccaggcgtggtggcacatgcctgtaatcccagctacttgggaggctgaggca

SEQ ID NO: 57487 - DNA, 201 bp, Homo sapiens
aggcacggggctcagggacatagagcagtgtagcggcgtgacagcctcacagtcctgtgttgagaccggattccgtgggaccctctttcaagctgtcagarcatctttaacagaaggtcataatctcctgacagacctagcccttctagataaggggccagaatagtttcttacgaagtatttgggtgattggatagtttt

SEQ ID NO: 57488 - DNA, 201 bp, Homo sapiens
accctttctctaataaaaatacaaagttagccaggcgtggtggcacatgcctgtaatcccagctacttgggaggctgaggcaggagaatcgcttgaatcckggaggcagagatggcagtgagccgagatcgcgccattgcactccagcctggatgacagagcgagactccatctgaaaacaaacaaacaaacaaccgaaaa

SEQ ID NO: 57489 - DNA, 201 bp, Homo sapiens
tgggtctcaggaaggacatctcctgaactttctagctgagccctgccagaagagagattagactcccgaaattgggagagcctttggaaaacaaaacctgmggatgacttctaatagctgagctctgcaagtagtacacatggatataatttgcatttattatgtcccttaggtaatacacactttttagtctggtgaggg

SEQ ID NO: 57490 - DNA, 201 bp, Homo sapiens
gtggcggatgcctgtagtcccacgtactcggaaggctgaggcacaagaatcgcttgaacccgggagggggaggttgcaatgagccaagactgtgccactgmactccagcgtgggcgacagactgagactctgtctcaaaaataaataaataaataaataaaaataataatagtggtgggcgtcctctcacccctcttctcc

SEQ ID NO: 57491 - DNA, 201 bp, Homo sapiens; identical to SEQ ID NO: 10773

SEQ ID NO: 57492 - DNA, 201 bp, Homo sapiens; identical to SEQ ID NO: 10774

SEQ ID NO: 57493 - DNA, 201 bp, Homo sapiens; identical to SEQ ID NO: 10775

SEQ ID NO: 57494 - DNA, 201 bp, Homo sapiens
aggacgactgccgtgagtggcgggccagggagctcagacccggggagagaaaaggaacggtggggggcaccatgcttggcgcgcacgtggctgcagccgcsgcgctgccacctgcgcgggacttgccgccggagcctgcgaccgggaaaccgcctgggcaccgcctccctcggggccgggtggctcttagcgacccggagc

SEQ ID NO: 57495 - DNA, 201 bp, Homo sapiens
cagcgggtccttccgggtggcccggactgcatggtggggagtggggccgagtccgctgatccagctcacgctccctccccctcgcagggccggccaaggaktgcgaaaaggaccaattccagtgccggaacgagcgctgcatcccctctgtgtggagatgcgacgaggacgatgactgcttagaccacagcgacgaggacg

SEQ ID NO: 57496 - DNA, 201 bp, Homo sapiens
ccaggacctcctcgattataaatctggtaaacattttcagtcttgctcttccttgacctggaagcagtagttaacactgttagccactcttttcttggcayattcttattttggcttccatgataacatttcatgttttttctcctatctctctggccacatcttagtatcctttgcctaccccttaaattatggtattcc

SEQ ID NO: 57497 - DNA, 201 bp, Homo sapiens
cctgtctccagcttcatcactcactactctatattctaatcacacagttctgggcctccgtctggaacatttccttcaggaacatttccctaaggaccctrcactggattaggagtcacctcatgtgcttccatagtcctctgtgcttcctttattggtaatcttatccttacattgtaattgcttgtatgctccttaact

SEQ ID NO: 57498 - DNA, 201 bp, Homo sapiens
aaattcatttaaaaaaaatcttttaagttttgtttcattgtaatactttaatgagggggagtgaactattactgagtccctaatgtgtaccagtattctayataaattatcccaatctttgtcaacaattcggtgagataaatactatcaatactatccactcccattttatagatgagaaaatgggcaaagtaactgccc

SEQ ID NO: 57499 - DNA, 201 bp, Homo sapiens
cacataactatgaggaaaagtactgaagctggggagggtctttccaaaggagggtatctgggaaatggaaaagaggcaaacaagattacatcaggactagytggggaaagttagatgtgtaccctggagaagaaaacactcagaatgaacggaagggaattcaaacaccatctataaatttcaagggttgtcctatgtaga

SEQ ID NO: 57500 - DNA, 201 bp, Homo sapiens
attgaataacttgcctaaggtcatagccaggaagtggcagaaccagaattcaaactccagtctgtatatacacaaaagcccatgctctttcctttatatcrtgaggtaaatagccttgaagctctggaaatcaatattctcaacaacctgtctctcctctgtccatttctcggataactgtaccatcactactggggccta

SEQ ID NO: 57501 - DNA, 201 bp, Homo sapiens; identical to SEQ ID NO: 10794

SEQ ID NO: 57502 - DNA, 201 bp, Homo sapiens
gggtgggggtgggcctcagtttcctcctcagatcttccttgagaggctgtgaggctcaggagaggtaaccagttgaacattctgtgccacgcactcagggygctcctggtaaacagatatatttagttgctggtttctactgacctgtttctggactttcttcacagccctcttgtaggttggaccctgtttctgtggcag

SEQ ID NO: 57503 - DNA, 201 bp, Homo sapiens
ctcgggcctggcctccttggccctggctgcagagttctgctctgggagccctgagcttcccacttacagttagtgggggccgagagcccagagaggcctgycccttgtcacacagcgtgttggtggcagagcagggctggaatgagatctagaaccttctcctcaactgcaaaagaagaagcggaagagctgcccctcctt

SEQ ID NO: 57504 - DNA, 201 bp, Homo sapiens
cccctcagtctgggtgggggtgggcctcagtttcctcctcagatcttccttgagaggctgtgaggctcaggagaggtaaccagttgaacattctgtgccaygcactcagggcgctcctggtaaacagatatatttagttgctggtttctactgacctgtttctggactttcttcacagccctcttgtaggttggaccctgt

SEQ ID NO: 57505 - DNA, 201 bp, Homo sapiens
gtctgagcagtgggttggagcctgctggaggtccagtgtcctgtgtccttcctccagtggtgatagccctcctgtgcatgagtggatacctgatctggagraactggaagcggaagaacaccaaaagcatgaattttgacaacccagtctacaggaaaacaacagaagaagaagacgaagatgagctccatatagggagaa

SEQ ID NO: 57506 - DNA, 201 bp, Homo sapiens
ctgtgccttcctgctcctcagatctccagccactctcccaagtacacatgtgcctgtcctgacacaatgtggctgggtccagacatgaagaggtgctaccraggtaagcagaccttccaggagggatggcccctggcagtgtcagaccctaccctgctgaaatcttcccttggcttctgggacacagtatgctgctggttt

SEQ ID NO: 57507 - DNA, 201 bp, Homo sapiens
actgaggtcatggatttacactccaggcctcccatcctctgcatctataccccacaggacaaggtgttctggacagacctggagaacgaggccattttcastgcaaatcggctcaatggcctggaaatctccatcctggctgagaacctcaacaacccacatgacattgtcatcttccatgagctgaagcagccaagaggt

SEQ ID NO: 57508 - DNA, 201 bp, Homo sapiens
actggggtcccaggttcatgacctgatcctgcttccttcccaagatctgctgagccagcgcttgtactgggtagactccaagctacaccaactgtccagcmttgacttcagtggaggcaacagaaagacgctgatctcctccactgacttcctgagccacccttttgggatagctgtgtttgaggtgagtcctgtaaggag

SEQ ID NO: 57509 - DNA, 201 bp, Homo sapiens
tccacagatccacctaccagaaccacagcacagagacaccaagcctgacagctgcagtcccaagctcagttagtgtccccagggctcccagcatcagcccrtctaccctaagccctgcaaccagcaaccactcccagcactgtaaggaaatgagttctgcattctttcatgacatgggagggctcctagggaagccaggaa

SEQ ID NO: 57510 - DNA, 201 bp, Homo sapiens
ctggtttgggaaggctgcaaattgtaagctgggtgttggggcaaagaagaaaaatgggttagtcacagaccaatgaatggcatgtggaagaaagcaatcargtttggggcagggcagacagaattgctgctgaggcaaactgttcatgaaggggagacatgggaaatgagatggagcaaatgaggagggttagcagatggc

SEQ ID NO: 57511 - DNA, 201 bp, Homo sapiens
caaaagcacctggtatgaaggccaatggcttgtccataaccattgagtggttactggaggcaggtgatggccagggatgggccagagcagtagcagggcasgttgaactgttcctgagtgccctgctaaggcagttggtcatattcaaggggagatgggaagccagcaggcaaggaaagatggctctttgattacggagag

SEQ ID NO: 57512 - DNA, 201 bp, Homo sapiens
agcctggaggggtagccagggctcccgaggcccaaactactgagacggtctggaacccaggcagggctttgtggaactccccagagaagccctgtgaaggrctttctcacaccgagggcccagctttcactaggagactgggaagggtttgcatctccctgagccctgctttatgacagtggccgagccacgtgtcactgg

SEQ ID NO: 57513 - DNA, 201 bp, Homo sapiens
aagtgggtggtggcttctgcctcacacccacctcacagctgccctgaggagccaggccgagggactggggatggagtctcaaacctgtcactcaactccayacccgctaaggacccagggccagtctgctagatttctcttgggctcagggagtatcccaatcagacaattcccttgttccccaatgcccccatgatcccc

SEQ ID NO: 57514 - DNA, 201 bp, Homo sapiens
gcatgagtggatacctgatctggagaaactggaagcggaagaacaccaaaagcatgaattttgacaacccagtctacaggaaaacaacagaagaagaagaygaagatgagctccatatagggagaactgctcagattggccatgtctatcctgcagtaagtatttctcactgggagaattcctaccttccgaccatcttcc

SEQ ID NO: 57515 - DNA, 201 bp, Homo sapiens
aaaaaggcaaatgacctagtccatcagcaacataaagacctaagtgctcactttgccatgcacagcccccagcttcctactaccatgatgctatggaaagrgtatgggacttgggacatgagtcctgggttcaagtcccagctctgccacttttctgaaacccctcagttaagactcagtttccttgcctgtaaaatggag

SEQ ID NO: 57516 - DNA, 201 bp, Homo sapiens
tggggcaacactatgaagtacctgaaatagtcctatctcatcgaggcacagacgggttacgtaactggcccaagggtgtagaactgctggggtgtgaatgygggtgaccagctatggaacttgtactgtctcaagtactggctggtgacttaggtaggtccttcccaggccttcatttccctgtcttgagatgacatctta

SEQ ID NO: 57517 - DNA, 201 bp, Homo sapiens
cgcggcggccggagccccgggcccgccatgggcctccccgagccgggccctctccggcttctggcgctgctgctgctgctgctgctgctgctgctgctgcrgctccagcatcttgcggcggcagcggctgatccgctgctcggcggccaaggtgcgtgcaaaaggtctctgactcggctctgctccgccctagccaccaac

SEQ ID NO: 57518 - DNA, 201 bp, Homo sapiens
ggctgttacacctggggttctcctttcctcagtttggctatagactctctgaaggaaggtccacctctcactttttcctttgcttgcacagcattcgggakgaaacaacctgcgttctggtcctgcctcaagctacatgaccttgggacaatcaatgcctttttttttttttaagacagggtttccctctgttgcccaggc

SEQ ID NO: 57519 - DNA, 201 bp, Homo sapiens
agggggtatgtgataagacagaacctaccagagctgaatactgcatatctttgaggaggttactgcatatctgagagggaggtagagtaccagcctgcgakttaggactcataggtgcccctaccttacagagggtcttgtaggaagctgagaccctgtgagcctcagttgcttctcttacaaagtggaaataaccaccct

SEQ ID NO: 57520 - DNA, 201 bp, Homo sapiens
caagtatacaataaatattggctattgttgttattttatgtggttttcttttaactttttcaagtaaatataacttacctcatgcttgttatgtgtcaggycttgtatttatcctctgaagacaaagatgaggaagacatagtcctcctaggggtacaaatccttcaataaaggcagaaacaagcattggtcaaatgtgcc

SEQ ID NO: 57521 - DNA, 201 bp, Homo sapiens
ccctccatcccaggtttaataaagagtggccacagggaggtctcccatggctgagagttcattagctgggcaaggccaggctgcaggagtgctgagtcttrctgggaaacagcctcataaataattaaagctcggccacagctccctgcctgtgctgtagcccgcatctggccctcagtgtgcggcctggacgtgtgctcc

SEQ ID NO: 57522 - DNA, 201 bp, Homo sapiens
gaggccacttgcagtgagtcctgcccctcagtctgggtgggggtgggcctcagtttcctcctcagatcttccttgagaggctgtgaggctcaggagaggtraccagttgaacattctgtgccacgcactcagggcgctcctggtaaacagatatatttagttgctggtttctactgacctgtttctggactttcttcacag

SEQ ID NO: 57523 - DNA, 201 bp, Homo sapiens
ctgcctcctctccctccagcagaccttactcacaggcaagggagatgcaggcttggagaccaccaaggtcagtgtccttgttttacagctgaggcactggrgtccagagaggggagatgagtgacgtcaccaccccagagtctaaccaagacgcatctccttttgttctgggttgtggctgttacacctggggttctcctt

SEQ ID NO: 57524 - DNA, 201 bp, Homo sapiens
aaagatcatagcccactggggagattaggaaaggcttcacagaagtggcatttgagctacgccatgaagataagttcctaagtatatctcagaggcaatamcttaggcaacaaaattatctgtccaagtgacctccatggtatttcccctccagcacctcaatctacctcaactacgacgttagcttctaccatgacgagg

SEQ ID NO: 57525 - DNA, 201 bp, Homo sapiens
tcactgaggtctctaggtacctgacgtctggtctttgcaggccaacccggaccccttgcttcccctgctcctgtctgcttagccagatgtcgaggttcctrcagctggtgctcgcctcagccagggagttgcccagccaccgtagaggtgacagaaagctgcttggaaaggagctgggggaagaaatgagtcaaacaggcc

SEQ ID NO: 57526 - DNA, 201 bp, Homo sapiens
gggaacagaggattccagcactggtgggggttgggggaaaggggcaggcctttgccactcctggtgcctggattagattagaagcttctagggttttgttytgtttgtgagtctaagatttgtgatttaaaactggaaagattctgtggctccttggtcctaacgttcaacggaatgagcctaagtacttgtaaattgtgt

SEQ ID NO: 57527 - DNA, 201 bp, Homo sapiens
attggtataacaatatatgagtgtaaaatccttctagatttatctgatttcccctccctacagtctttttattgctgatcttacaactaattccacagcartgttttaatgactcatctttattgaatcaaagtgaagtgcttagcattcagctaaagaaaagatcatagcccactggggagattaggaaaggcttcacag

SEQ ID NO: 57528 - DNA, 201 bp, Homo sapiens
gaggcttctgaagtagcctgcactgtgagccccgctggctgccaggtaataattccacccgccttgacctttttctccaaggaacaggccttctactttayacatggagaaaacaagtcacagaagaaccaggtggcccaggatgacagaggctaggcctccagatgccctttaaaaattgcaacaaaaacctcttaagga

SEQ ID NO: 57529 - DNA, 201 bp, Homo sapiens
gccactctcccaagtacacatgtgcctgtcctgacacaatgtggctgggtccagacatgaagaggtgctaccgaggtaagcagaccttccaggagggatgscccctggcagtgtcagaccctaccctgctgaaatcttcccttggcttctgggacacagtatgctgctggttttcttccatcttccctggttacttgttgc

SEQ ID NO: 57530 - DNA, 201 bp, Homo sapiens
ccagagagtgaggaatgtgtgcgcctcagacaccctggccccctggcagtctgggcctcataagagctcatgcttgggcaggctcaccgttcaccctggartgggtggctgggtgccttccagcttcctcctcagcgcctctcctgtgccagggcccatgcacgtgggtggaggagaggccattctagaggcccctggctc

SEQ ID NO: 57531 - DNA, 201 bp, Homo sapiens
ggtctgttctgcttcagactgcctgcctccatccctacccctgttgcctatggtctctgggccctcaccacctaggttgccctgctctggccacccctcarttttgggagttagggattctgaacagaacaggactccctctctccctcagtgtggatatcttgagatggtttttttagcgttatatcatgttaagtttaa

SEQ ID NO: 57532 - DNA, 201 bp, Homo sapiens
atatcgtagaattggagtgtctcagagcagagtagggctctagagatggcctgatagaagctcctgggggaggaagcctttcttcaggctgctgtaggtgrgcatctgacagctgctcacatacttccaaagacaggtagctcattacctcccatagggcctgtttcaccgtggggcagctctgctcattagaaagtgggt

SEQ ID NO: 57533 - DNA, 201 bp, Homo sapiens
cccatccactccatagatgccacagtgaactaacatgcttattggactatatcctctggcctgtctagttatcactggggagaaatcctaattccttggcrtggtactcaaagcccatcaagatggggttcctgcctacacctgcttgcagtctgacacccacataagcagctcccctaagtatctcactgttccagagca

SEQ ID NO: 57534 - DNA, 201 bp, Homo sapiens
cagtagaggaggatcagggctcagggtttgggccgtctggttggccgaggggaagggaatggggatgaacagttttggacatattgagttcaaggtgtccwtgggacatccaaggggagctagttagctttgcagtctggatcgtaagagagctgttgggattggagacttagttattgatggcagtggacactaaggaac

SEQ ID NO: 57535 - DNA, 201 bp, Homo sapiens
ggaggatcgacctggtgaagcggaactattcacgcctcatccccatgctcaagaatgtcgtggcactagatgtggaagttgccaccaatcgcatctactgstgtgacctctcctaccgtaagatctataggtgagcggccatatcctctgcagcaaggcatgaagagtgggggtgaggggtggtgacaggtgaggagggga

SEQ ID NO: 57536 - DNA, 201 bp, Homo sapiens
tgcctcctgtgggccccagcccagcccttcttgtccaaggtctcacaggcactgtccactctcttgtccggcccaacagagtcaccctgtgagggtccccrcagatttcagtgtaagagtggcaagcgcgtggacggcgggaaagtgtgtgatgtgcagagggactgccgggactggtcggatgagcttctgaaagtgtgg

SEQ ID NO: 57537 - DNA, 201 bp, Homo sapiens
caagagcccatccctaatcttcaccaaccggcacgaggtgcggaggatcgacctggtgaagcggaactattcacgcctcatccccatgctcaagaatgtcrtggcactagatgtggaagttgccaccaatcgcatctactggtgtgacctctcctaccgtaagatctataggtgagcggccatatcctctgcagcaaggca

SEQ ID NO: 57538 - DNA, 201 bp, Homo sapiens
tgctctgcatcttctgctttctgtactcattatttcatctgctcctgcaacctgtaaagtaggaattgtcactactattttaaggaaaatggatgtgtcakccagcaagccagtggcagagtcttggtctccaggctccctgcctcttgcactgactctttctctttcaacctccctgcatgacagctggcaagagcccat

SEQ ID NO: 57539 - DNA, 201 bp, Homo sapiens
cccactcctcctgggctcctggaccttcaggagcccatgtccctccccagggctgaacgagtgtctgcacaacaatggcggctgctcacacatctgcactsacctcaagattggctttgaatgcacgtgcccagcaggcttccagctcctggaccagaagacctgtggcggtgagaccttctcccacacccccaagcagaa

SEQ ID NO: 57540 - DNA, 201 bp, Homo sapiens
gatttgaaaattcctggcacagacagaggcttcttctcagctgatgaaactgagacatgggccagaagagccctgatggactcctagggccttggaccagrtggctggaacagggtggtaggactggttggcaccatgccctgtgtcccccttggctaagctatgcatggacgtctgtctccacagccaagcaggtgtgtc

SEQ ID NO: 57541 - DNA, 201 bp, Homo sapiens; identical to SEQ ID NO: 10778

SEQ ID NO: 57542 - DNA, 201 bp, Homo sapiens
tggttcttctggtcaccacctgccctctgcaggagcagggaccctcattcactagtcatcttggggaatggataacaggctgggcagtgtagcaacttccyctatccggggtccatggggcaaagtccccccaggagatgatcagtccagcctctaaggtctctctagagctgctgcctggtcctcctaggacctgagtcc

SEQ ID NO: 57543 - DNA, 201 bp, Homo sapiens
gcattctgctggaagcggtcgtcttggcaacgctggggcatggcgagctctgtcgaagggtaactgttggtgggagcagccctttcatctccccgacccgrgtacaagtggcccaactgccttagggccagagccaggccaccctgtgctggcccaggcctgggagaggaagtgggaacatccaagtcccttctgtgcacc

SEQ ID NO: 57544 - DNA, 201 bp, Homo sapiens
aaggcaataataatagcaatgacttatatagtgtgtacttaagttcttagaagggtttttagtacatagtacacactatataagtgtatacatagttggcycgctctatccatgggttccgaatcctggattcaatcaactgcagatcagaaatattcaggaaaaaataattgcatctgtactgaacatgtacaggctttt

SEQ ID NO: 57545 - DNA, 201 bp, Homo sapiens
cttgccgccggagcctgcgaccgggaaaccgcctgggcaccgcctccctcggggccgggtggctcttagcgacccggagcgggcaggaaagctggcgtgtyctggtggggccggggcggagccccgggcagtgtgccggaggaggaaggcgcaccatgctggggagactgaaccggagctgtgggcggggacgcggcagtc

SEQ ID NO: 57546 - DNA, 201 bp, Homo sapiens
ggcaataataatagcaatgacttatatagtgtgtacttaagttcttagaagggtttttagtacatagtacacactatataagtgtatacatagttggctckctctatccatgggttccgaatcctggattcaatcaactgcagatcagaaatattcaggaaaaaataattgcatctgtactgaacatgtacaggcttttta

SEQ ID NO: 57547 - DNA, 201 bp, Homo sapiens
tgaagacgttgagtctggagaggggatactaatcactgtccagttgggcactggtgggaatggggaaatggcacaggaatgcaagcctctccaccctaccmcccgaactccagccatacactcatcgtttcacaaaatataaatgagttagcattaaatgtttcagagtaaataattccttttcccgaaatgcatgaagat

SEQ ID NO: 57548 - DNA, 201 bp, Homo sapiens
gacttatatagtgtgtacttaagttcttagaagggtttttagtacatagtacacactatataagtgtatacatagttggctcgctctatccatgggttccraatcctggattcaatcaactgcagatcagaaatattcaggaaaaaataattgcatctgtactgaacatgtacaggctttttatcctggtcactattccct

SEQ ID NO: 57549 - DNA, 201 bp, Homo sapiens
tgggttccgaatcctggattcaatcaactgcagatcagaaatattcaggaaaaaataattgcatctgtactgaacatgtacaggctttttatcctggtcaytattccctaaacaatacatcgtaacaactatttacatagcatttacattgtataggtattataaataatctagagatgatgtaaagtatacgggaggatg

SEQ ID NO: 57550 - DNA, 201 bp, Homo sapiens
ggtctctgatcccacatggggtcgtggaaagcttcccaatagaatagagaaggggaggagggtcctccactcccaactcccagagagtgaggaatgtgtgygcctcagacaccctggccccctggcagtctgggcctcataagagctcatgcttgggcaggctcaccgttcaccctggaatgggtggctgggtgccttcca

SEQ ID NO: 57551 - DNA, 201 bp, Homo sapiens
aagacaaagatgaggaagacatagtcctcctaggggtacaaatccttcaataaaggcagaaacaagcattggtcaaatgtgccctgtgccaagaatccagraatgcaggagagcgggctcctgtcctccagcagctcacagagtgacgagggagacagttgcataagcagactgtggcaacacagggtggtcagggctgcg

SEQ ID NO: 57552 - DNA, 201 bp, Homo sapiens
gcttttcctaggtatgcagaatgctggagggtaaatagggtttgtgtcctgggctgtacattctgtatagatggaaaagccccaggcttccagattgcctrcatgcgatgccttcagcacacgcttcctcagtgcctgcctccaccgagctgctagtctggtagagaaagatggttgagtgccaccaacacaggatgatga

SEQ ID NO: 57553 - DNA, 201 bp, Homo sapiens
ttttgccaaggtcatccaggacctcctcgattataaatctggtaaacattttcagtcttgctcttccttgacctggaagcagtagttaacactgttagccrctcttttcttggcatattcttattttggcttccatgataacatttcatgttttttctcctatctctctggccacatcttagtatcctttgcctacccctt

SEQ ID NO: 57554 - DNA, 201 bp, Homo sapiens
tgactgctgtgtgacctgggcccatcctgtccctctctgaacctcaggggtgattgtaagaactaaatgaggagacatatacaaagggcttcgtaaaccasgagatgaggtgaggtgatgtagacagatgagggcctggcccagagatggcatcacaatacgatcagagccaaagctgaggcccaagttcatgtgtcccag

SEQ ID NO: 57555 - DNA, 201 bp, Homo sapiens
gatctgtcctgtctctttactgatagagatggtgaggcacagagaggtggggaaacacccagggtcacgtagcataggagtggcagcagcaggatttaaamgcgggtctcttgcactccaaggtccacgtgttagccagtgcaccaggcaagggataaaggacttagtgtgagagctcctttggaattggagttgcagagg

SEQ ID NO: 57556 - DNA, 201 bp, Homo sapiens
aactgtttggccagggcagaaaggaagaaatcctggctttggggaggactttccaagcagctcacatccctgtgtgttggaacctggggacttagacctgstccctgcccagaggatcccactcacaacacagtgacatccatttgtgatgatcatgagaaagtacagaggaggcctccgaacccacctgggcatctgatc

SEQ ID NO: 57557 - DNA, 201 bp, Homo sapiens
agtgcaatggcatggtctcggctcactgcaacctccgcctcctgagttcaagtgattctcttgccttagactcccaagtagctggcattacaggcgcctgygaccatgcccagctaatttttgtatttttagtagagatggagtttcatcatgttggccagactggtctcgaactcctgacctcaggtgatctgcccgtct

SEQ ID NO: 57558 - DNA, 201 bp, Homo sapiens
cacagcatgtgggctggatgagccacctcccctctcagtgtcttggtttcctcttctgcacaggggcgtcttggcaggccctacctcaaagggctgttggytgggaagattaaatgagatgatgagccccacgcactatcatcaatgacgcttatgcttatggggagtggggtgggaagcacctctgctctccatgcatga

SEQ ID NO: 57559 - DNA, 201 bp, Homo sapiens
tggcctctctgacgagatgcccactgtccaagggtacactggtccacagcatggccccgcagcctgacctctcccctcaccgtggctctctggatccttcraggggctcctgccagtgactgtagtgggtgactggagcctcttcccccaacgtcacacagcatgtgggctggatgagccacctcccctctcagtgtcttg

SEQ ID NO: 57560 - DNA, 201 bp, Homo sapiens
gccaacccggaccccttgcttcccctgctcctgtctgcttagccagatgtcgaggttcctgcagctggtgctcgcctcagccagggagttgcccagccacygtagaggtgacagaaagctgcttggaaaggagctgggggaagaaatgagtcaaacaggcctagggccctaggaggggcagcggatggcttccctctggct

SEQ ID NO: 57561 - DNA, 201 bp, Homo sapiens
cggcgatcactgatgataaatgaaggtgtgcctgccccgtgccagggctgggctgggtgccctggggacagctgagaggagtcggaggtggaatccatccygagagcaggggcacagctttcaccacctttatctcatccccggagcctgacacaggctgggccctcagggggcagcttagtaatgccttagtcattgaaa

SEQ ID NO: 57562 - DNA, 201 bp, Homo sapiens
tcaaacaggcctagggccctaggaggggcagcggatggcttccctctggctgtgtgctggtcctagaggctggcttctgtcctgtctgctcctttcctctyggctgtgcctggggaggagaggagggcctgcatcccccatggcactgcccagcaggccctagcaggccttgggagtgtttgctgaagactttcccttggg

SEQ ID NO: 57563 - DNA, 201 bp, Homo sapiens
ggatccctgacaccaagactccaactggggtagtcccagaggtgagacctgtgaacctggggcccagagcgcttcctgtccccctgaaggccagggtgtgrgtatgctccggggcagagctcaaggccgctaaactgacaggaaaggtcagtccagtgatccgagacgtgcagggttatggctgggggcgtggggactccc

SEQ ID NO: 57564 - DNA, 201 bp, Homo sapiens
atagtcccaagctactcaggagactgaggcaggaagatcccttgagcctgggagtttgaggtcacagtgagttatgatgccactgcactccagcctgggtracagagtgagaccttttctaaaaaaaaaaataataataataataaataaaaagggagtgagggaggtgagacagtaagctaccatgcaattatctatagg

SEQ ID NO: 57565 - DNA, 201 bp, Homo sapiens
agggcctgcatcccccatggcactgcccagcaggccctagcaggccttgggagtgtttgctgaagactttcccttgggccctcccaggtcagcattccccrgtgtgagtcccttgggcctcagggatggttggcttcttcctccccagttgtctgctggtggccgacttgacaactttcctccttggggaaatgctggtag

SEQ ID NO: 57566 - DNA, 201 bp, Homo sapiens
ctcttccctctccccatgctgtctccaaatggatccctgacaccaagactccaactggggtagtcccagaggtgagacctgtgaacctggggcccagagcscttcctgtccccctgaaggccagggtgtgagtatgctccggggcagagctcaaggccgctaaactgacaggaaaggtcagtccagtgatccgagacgtgc

SEQ ID NO: 57567 - DNA, 201 bp, Homo sapiens
gcagctcagaccagctatatgcatggccatggctggctcagctcagcactgcttggcttggctggagtggcagtgcatgagcctggggggcagagggggaraggggcgcggcacctctccttggcttgtggaattaaccttctgtgactctaaagctcaggagaggctgtaagagcattggtcctggattccctgacctcc

SEQ ID NO: 57568 - DNA, 201 bp, Homo sapiens
gcccaggggtaaaggggttattccctaagcatggctcaggctggaagtgggggcaccccatagctgtgcatggcctggggtgggcagctcagaccagctayatgcatggccatggctggctcagctcagcactgcttggcttggctggagtggcagtgcatgagcctggggggcagagggggagaggggcgcggcacctct

SEQ ID NO: 57569 - DNA, 201 bp, Homo sapiens
ctagctcccccaacacccagatttggagtagccagggactactgtcctactaatccctctcttctctctcgtcgtttgcatgacacaccaaagaggagtaygtacacacgtgcttgtgtctgtgtgtggcctctgtctctgtgttggtgagaggccggtgtctgtatccatgtcttcttctctgagtaaagcaggggaact

SEQ ID NO: 57570 - DNA, 201 bp, Homo sapiens
attcactagtcatcttggggaatggataacaggctgggcagtgtagcaacttcccctatccggggtccatggggcaaagtccccccaggagatgatcagtmcagcctctaaggtctctctagagctgctgcctggtcctcctaggacctgagtcctgcaagatgagacgcagatccccacagccctgcccagctacatgag

SEQ ID NO: 57571 - DNA, 201 bp, Homo sapiens
agaagagagcaaggcacagagaaggccagagacttacatcaaggccacagagcagagccaggccctccaggccaggagtggcagacggcccattgctaacyccattctcagtgagatattcttaacctctctccagaaaagccagcagactccctgcacaggcctcagcgatatcacagagtgatactttaacctgcagac

SEQ ID NO: 57572 - DNA, 201 bp, Homo sapiens
tcaccatgccatgaaagaagagagcaaggcacagagaaggccagagacttacatcaaggccacagagcagagccaggccctccaggccaggagtggcagayggcccattgctaactccattctcagtgagatattcttaacctctctccagaaaagccagcagactccctgcacaggcctcagcgatatcacagagtgata

SEQ ID NO: 57573 - DNA, 201 bp, Homo sapiens
ccctgccccagcccgtctcttccctctccccatgctgtctccaaatggatccctgacaccaagactccaactggggtagtcccagaggtgagacctgtgawcctggggcccagagcgcttcctgtccccctgaaggccagggtgtgagtatgctccggggcagagctcaaggccgctaaactgacaggaaaggtcagtcca

SEQ ID NO: 57574 - DNA, 201 bp, Homo sapiens
tttatgtggttttcttttaactttttcaagtaaatataacttacctcatgcttgttatgtgtcaggccttgtatttatcctctgaagacaaagatgaggargacatagtcctcctaggggtacaaatccttcaataaaggcagaaacaagcattggtcaaatgtgccctgtgccaagaatccaggaatgcaggagagcggg

SEQ ID NO: 57575 - DNA, 201 bp, Homo sapiens
tgggatggaggcctcactcctttatacaacaattggttccaagattttcagaaacgaagttctttctggttcttcccgagaggctccatggctcccaggcytgccacaggggccacacagacaccctggctgatcctgcgtcctcagagcagcgcagaaaagaccagagacctctgagccagcccagctcctcacaggctc

SEQ ID NO: 57576 - DNA, 201 bp, Homo sapiens
atgcttgttgaatgaatgaatggatccccctgcttgcatacctcctgggatggaggcctcactcctttatacaacaattggttccaagattttcagaaacraagttctttctggttcttcccgagaggctccatggctcccaggcttgccacaggggccacacagacaccctggctgatcctgcgtcctcagagcagcgca

SEQ ID NO: 57577 - DNA, 201 bp, Homo sapiens
cacagaggaggggcccattgtatgcttgttgaatgaatgaatggatccccctgcttgcatacctcctgggatggaggcctcactcctttatacaacaattrgttccaagattttcagaaacgaagttctttctggttcttcccgagaggctccatggctcccaggcttgccacaggggccacacagacaccctggctgatc

SEQ ID NO: 57578 - DNA, 201 bp, Homo sapiens
tgcggagctcaggtctaactccagaagcctccactggtatctgtgtccctgctgtgagccctcccagtcgtacttcccacccccatcccccgaacccctcyacccagaaacctggcaggctcaggagctccccccatctctttacccgctaggcctgctcattcctcaaggcctggcctagactcctctgaccttcccagc

SEQ ID NO: 57579 - DNA, 201 bp, Homo sapiens
gcccagcacagaggaggggcccattgtatgcttgttgaatgaatgaatggatccccctgcttgcatacctcctgggatggaggcctcactcctttatacarcaattggttccaagattttcagaaacgaagttctttctggttcttcccgagaggctccatggctcccaggcttgccacaggggccacacagacaccctgg

SEQ ID NO: 57580 - DNA, 201 bp, Homo sapiens
ggagggggacggattcctgaggtgtcaaggacgactgttgctgaaatctcagattcaagcacagacgtcacagggcagagaagacattctcagcagcctcrgcagggacagatggaagtggtcactgggacagttccacatcactgagcttcaaacacaggattatctccttcccagggagcaggccagcagggcctgggc

SEQ ID NO: 57581 - DNA, 201 bp, Homo sapiens
ccctggatgtttcccaagccccttttcatggcatagggcctcctgcatttcctccgggctctgaagcatgtgcagggctgggcaggcatgacccggggtcratttggcacctttgtcatctcctgtgtctttatagtatggctttcttcaggcaggactggctttcatgcactctttcccaaccccccagtgcccatcaca

SEQ ID NO: 57582 - DNA, 201 bp, Homo sapiens
gcaccatgcctggcacatcctagagaccacggaggtcgggcctcctgcacaccctggaaggctgaagggagccaaccacggaggtctgagatgcatctgcyttggctgagcctgtcacatgggtccagcagaaactcatgataagagctgtccccagccttgaatagggttctcattcttccttccaaattgagattcaac

SEQ ID NO: 57583 - DNA, 201 bp, Homo sapiens
ctaaaatgcagatccctaggctctgccctagaagtctagattcagtcagtatgagctgaggctcaggaacctgcactttgagtagctccctcaccccccaycctttgatgagaggaccccagcaaagcactggtcagcttcagcttcctgtgttccagtggggcccagaggggaggtgcttacctggggtcctgcagtgtt

SEQ ID NO: 57584 - DNA, 201 bp, Homo sapiens
aagactttcccttgggccctcccaggtcagcattccccggtgtgagtcccttgggcctcagggatggttggcttcttcctccccagttgtctgctggtggycgacttgacaactttcctccttggggaaatgctggtagcaggtgaagccagagagagagagacccccagggggcagtgaggagcgagagcccagagggcg

SEQ ID NO: 57585 - DNA, 201 bp, Homo sapiens
ggctctgaaggcctggcagggatgccacttcctccagagatgcctttctagacccctgtcctccagcccctcaggccctgagctcccacaacgtgtccttkttcttcccgcagttgcagatccttctcaacattgtgcactccgccagccttgtgctgggcagtaggaattccaaagtcgtttcctcaaggggtagctaat

SEQ ID NO: 57586 - DNA, 201 bp, Homo sapiens
tttttcctttgcttgcacagcattcgggatgaaacaacctgcgttctggtcctgcctcaagctacatgaccttgggacaatcaatgcctttttttttttttaagacagggtttccctctgttgcccaggctggagtgcagtagcatgatcatggctcactgcagcctcaacctcccgggctcaagccagccgaccacccca

SEQ ID NO: 57587 - DNA, 201 bp, Homo sapiens
cttaattaaaaacaaagaaaaaggccaggcacagtggctcacacctataatcccagaattttcgggaggctgagatgggaggatcacttaaggccgggagktcaaggccagcctgggcaacatagtgagactccgtctctcaaaaaaaaaaaaaattagccaggtgtcatggtccatgcctatagctacttgggaggctga

SEQ ID NO: 57588 - DNA, 201 bp, Homo sapiens
taccagcctaattggtgaaagcatttgcgtttttcactagccagggctgcttcctagtgtgtgcagtctctacctggtgggcagaggagagggtgctgcarcgacccactgctgacatcagaggcctgagtgccctgcctgcctgtgggtagcagccagggacccgccacccctccccacacaggcaggggtcatcactga

SEQ ID NO: 57589 - DNA, 201 bp, Homo sapiens
gctgctttggctcccctagcatggggcctggtggcgtgcacattcgcaggctctataaatgttagctgcatcctgtgacttgcctcccagggctttgagaagtggagggtgaggacagaaatgccgtgcctggaggcaaaggtatcgttatggacagcttgctctcctgggtagcagggcagcagcgcccagatcctgcaa

SEQ ID NO: 57590 - DNA, 201 bp, Homo sapiens
ttctcacccttgctagtaccactatgtaagcagcatagccttctagagatttttctctgcatgtgagctcttgggcatgaacatatgtattttttttttttaacaaaaatgaggccatgttatgccggttgttttcacatatggctttctatggcaataacagtagttcacatccttgttttaaagggctagatagtattg

SEQ ID NO: 57591 - DNA, 201 bp, Homo sapiens
ctgtccctccaacgctggctgtgcacatagacacacagggctggcaagaagggaacggatggatgagtgttcccacctccacggcctttagaaacggactsctggtagccataaagggaaactgaagaaacggagtggggcttacgtggctgtgttggggccaggtgctggaaaatgttctttcctcagcccttcccgcat

SEQ ID NO: 57592 - DNA, 201 bp, Homo sapiens
tctagataaggatgcctcctcagagaagttgagtgacttatgcaaggtcacacagctcaggatgacagaacttggtcaggatctctgcctgcctcgagttsagggcactgtctgctgaggtggggagtgtggtgcggaaagcaccaggagtgtgatctaggagctggaaagacgggctttaaatgttaggcctggtgcgtt

SEQ ID NO: 57593 - DNA, 201 bp, Homo sapiens
gtaggccaggggcgggctggcacgccccctgcccccaccccggatctgcattctgctggaagcggtcgtcttggcaacgctggggcatggcgagctctgtygaagggtaactgttggtgggagcagccctttcatctccccgacccgggtacaagtggcccaactgccttagggccagagccaggccaccctgtgctggcc

SEQ ID NO: 57594 - DNA, 201 bp, Homo sapiens
ccttaatttcctcttctgtacaatgggattaataacaacagctaccaagatagctgtgaggagtcactgggatattgggtgaaaggtgccaggccagagcyagagtggaaaatctccaagctggtccagccagtgaacaaatctgttcccaaaaacaccaccgaatctgttgccaaaaacaccactctccctgcagctgcc

SEQ ID NO: 57595 - DNA, 201 bp, Homo sapiens
gtaggaattccaaagtcgtttcctcaaggggtagctaataacagctattggctgcctatatcccatgcctgggaccacgttggacaattcacatcctttarcttcactactcacaaccctgggagggctagtttttcgttctcatttcgaagatgatgaaactgaggctcagaaaggagacggaacttggccaatgtcatg

SEQ ID NO: 57596 - DNA, 201 bp, Homo sapiens
aggggctgagggccttcaggggaatcctgctcagtcttgaccgagttcctcactgactgtacccgctctgacctctttgtctctggtggggcccagcctakgtacccacaatgggagagccgggcctagctgctttgggggcatagaatgcggcatgctctcaggcgccatggagtgtccttgggaaactgagagtcaccc

SEQ ID NO: 57597 - DNA, 201 bp, Homo sapiens
ggtggagccaggagctgacccaggtctgtctggtctggagcccagactcttcttaagccgttccccgctgagcgctgtctaccctggtggggtcagaggcyggtgcttggagggtgtgggaggaagtagggagcagctgcaggactcagcagtgcctccctgagctaccagtttctgacctggggagtgggactggggagg

SEQ ID NO: 57598 - DNA, 201 bp, Homo sapiens
tgtgctggtcctagaggctggcttctgtcctgtctgctcctttcctcttggctgtgcctggggaggagaggagggcctgcatcccccatggcactgcccakcaggccctagcaggccttgggagtgtttgctgaagactttcccttgggccctcccaggtcagcattccccggtgtgagtcccttgggcctcagggatggt

SEQ ID NO: 57599 - DNA, 201 bp, Homo sapiens
aatgggctccccagggcccctgattggctgggcgaggaccaccccataggcccccgtggccggagcggccaatcgcggagcagacggatgtgtagtattcsggttccctgggcgcgggggcaccgccctgccctgccccggccccgccccggccacacccccgcgcatatccttagggtggtaggtgcaggcggggctcgg

SEQ ID NO: 57600 - DNA, 201 bp, Homo sapiens
gtcttcccagaggaggaggcatttgaggtgaggcccaaacggtaaacagaagccaacccatgcgggagtgttctaggcagagggcatggcctagcagaggkcacagcctggcaaagttctgaagctccagttcctggggggcagtgtgaaagagtaggctgctggggctcccatggctctggagaccaacatgggacttgg

SEQ ID NO: 57601 - DNA, 201 bp, Homo sapiens
attggatggaggagccaacaacgacaggccagtgtgatcagggagattgggacacacagtgccgtgggggcccagaggagcagggaggatctctgtggagkaggcgagaagtcttcccagaggaggaggcatttgaggtgaggcccaaacggtaaacagaagccaacccatgcgggagtgttctaggcagagggcatggcc

SEQ ID NO: 57602 - DNA, 201 bp, Homo sapiens
cttgcccttgcagcctggctgtgtttggcttggggctgctggtctccgaccctggctgggctggtgacacagcctaaggtacctgggggtggaatctggcrcccctgagcagacccctccctggctcttgtccccctgtgctgacactctctgtcccaggctctctctgcctccagaccagagctcctccagggaaaaggt

SEQ ID NO: 57603 - DNA, 201 bp, Homo sapiens
agcccctttccctttctgggcctcaatctacccatctgaaggtggactctgattcctcaggtttcttctagttctgcacgtacagaggcattcttctaagyaaagtgtgaagaaaactcatcttagaatgcagatgtactgcaaagattccactgagaaggacagacatggaacagattcagagacacagtctctctcacc

SEQ ID NO: 57604 - DNA, 201 bp, Homo sapiens
gactgcttctgccccatagtggcaggattgagtggtgtgaccgagaccatttggccctcaaagcctaaatagctactatctggcccttcacagaaaaagtktgccaacctctgccctagaaggacattcaggggattgtaggagctcaggagaggctactgatcaagactggaggtgatacttaagcccagtgtgtaatgg

SEQ ID NO: 57605 - DNA, 201 bp, Homo sapiens
cagcaggaacagggcatgtgtgagttcaatgcagatttgatgcagatgagcccccaataattcagaggcctagggctgctacagagggtgcaggatgtcakgggtggagcgctcaaggccccttcccggtctccaacacccccgcacccccaccacctactgggggtagccaggcagcctcagttcccccatggaagccct

SEQ ID NO: 57606 - DNA, 201 bp, Homo sapiens
gactgtatggaaggggaaactgagaacctgatgatagtgatgcacatgacctcagggagtgtcagcccagggtcatctcttttactctctgtagtaacacrgggcctggctgcctcctcgcacccaggcttagaaaggtgaaactaaggccctgatggtcgaattggctccatcgtcagtagggcaccattctcagaactc

SEQ ID NO: 57607 - DNA, 201 bp, Homo sapiens
acctgatgatagtgatgcacatgacctcagggagtgtcagcccagggtcatctcttttactctctgtagtaacacggggcctggctgcctcctcgcacccmggcttagaaaggtgaaactaaggccctgatggtcgaattggctccatcgtcagtagggcaccattctcagaactcaggtgtcctcaattctgggtgggac

SEQ ID NO: 57608 - DNA, 201 bp, Homo sapiens
tacctgaatacattacccgggtttactacagaggagaccgaggctgggagaagtgaggtgacttatttgaattcacgcagctgccgggctgcggagctcargtctaactccagaagcctccactggtatctgtgtccctgctgtgagccctcccagtcgtacttcccacccccatcccccgaacccctccacccagaaacc

SEQ ID NO: 57609 - DNA, 201 bp, Homo sapiens
tgaggggtggacacaagccttttgcagtaccgaagggctttgggctcctgactggggacctcaggtgcaccactggccccactgggccctgcttgcccacytctggattgccaagaagtcatctaaaatactcacgttaacactaagaagagttagggagcgagctagtgaggggctttctcatgcaagacctccttcagc

SEQ ID NO: 57610 - DNA, 201 bp, Homo sapiens
cccttttcgttaatttgtgaatttatgaattggagaaagtaccaatggatttgaatttctggggcaggattctctgggaatttaaatgcctttaaatgccrtgagccactccaggatacagagtttcatgaaaagcccccttgccagctttggagggttcctgttgtctgagagacagtgggattcttcactcctgcctct

SEQ ID NO: 57611 - DNA, 201 bp, Homo sapiens
agtaaagtgtagtgagtttgggattggatatagttgggttcaggtcttttaacctgttagacctcgggcaagctgcccagtcatcctgaacctcagtttaytcatctgtaaaatgtggtaatggtacctgccttagagggattgtgagaatcaaatgaaagaatgcaagtatcatcgctggagtaaatggcagtgttattt

SEQ ID NO: 57612 - DNA, 201 bp, Homo sapiens
gtgcagctttttctccccttaactgttagattctcttggagtaacatggataaacagtcacattgagagaggatgggccttgggccattgccgggacagtsatctcacctgcagcaagtgtagatgatagctccttttcacaccacagggagctgtcaggaggatctaagggaaaaatgctttctgaactataaagtgctt

SEQ ID NO: 57613 - DNA, 201 bp, Homo sapiens
acccccgcacccccaccacctactgggggtagccaggcagcctcagttcccccatggaagccctgacagggcaactgctctcccccgggcctgctaggtgygcccagtgctgtgctgctgcttgggaagaagctggggcaccttatgacatgggcatccatctctgtttcctctcattgatctggaaactctagttcctcg

SEQ ID NO: 57614 - DNA, 201 bp, Homo sapiens
ctcactgcagtcagccagctcctccatccgtacctcactccagcagatactccgacaatgggggcagaaagggaagggagaggagcctcatcgtggttatyagagggggctgccttgctacctgagggctaggctccccttctccccctgccccacccccacccccgtctctatctctttgtgtggatgtcccttttcatc

SEQ ID NO: 57615 - DNA, 201 bp, Homo sapiens
gctacctgtgagtctggggtcagatctccagggtctgccaagcatggtcaggcagcctcagggagtggcagccacttctggggagggggcccagttccccrtggggcttggtggtggagaggaaaggataacgatcaggacactagtaatggctagattctatggagacatggtcttctttcatcttcacaagcacctcat

SEQ ID NO: 57616 - DNA, 201 bp, Homo sapiens
taagtctgcccaaaccaagccagagctccccgcctccccaccaggccgtcgtggtggggaatgatttgtagctggagaggcgccagcagtctctcttcctrgcctgccccctgccacagcagcctctcctccccaggccatgtgtgctctggtcccacccggagagggctgcttgttataaacagcagccttcctcctctg

SEQ ID NO: 57617 - DNA, 201 bp, Homo sapiens
tgactttcatcctcttggcaacctaaggaaggaggaggatccccatgtagagagaaagaaactgaggctggagtcagttctcccccttgcccaaggctgcscagctaacaagaggcagagtcgtgtgcagcctggagtgtgtgcttggggagggtttgtggccacagggagcttttccctcactgcagtcagccagctcct

SEQ ID NO: 57618 - DNA, 201 bp, Homo sapiens
ccaggccgtcgtggtggggaatgatttgtagctggagaggcgccagcagtctctcttcctggcctgccccctgccacagcagcctctcctccccaggccaygtgtgctctggtcccacccggagagggctgcttgttataaacagcagccttcctcctctgctcccaccttgccgagtggccatttggcagatgcttgccc

SEQ ID NO: 57619 - DNA, 201 bp, Homo sapiens
ccaaccccatggggccccaacaggagacatggcctaaaccacacaactgtttattagcagagcctacatctactggaggctttttacacctacttattttkgtgctgagctctgacggggctgattttttaatacctatgagccagtgagagcagactctacatcagctgcctatgcaacactcttttgtctccctcccct

SEQ ID NO: 57620 - DNA, 201 bp, Homo sapiens
aacatcctcaaggtcacacagataggaggaggaggaggaggaggaagtgggattgagatccccagagcagtgtggaggtcaccctgcaggctgtaggcacsggggggcagggactgatttgggtgtcttgcccagtagatcctcttccgactgctctgaacacaaaatacgtcattcatcttgccacaaaggaatcatcta

SEQ ID NO: 57621 - DNA, 201 bp, Homo sapiens
gcaaactgttcatgaaggggagacatgggaaatgagatggagcaaatgaggagggttagcagatggccttgaggatccttaacctcggccagtccaaaaawatagttgcttgaccagtttttgaagatcagagggagcacagtggaagaagcactgaacttggaataagaaaactcccagttccatccttccactgccctg

SEQ ID NO: 57622 - DNA, 201 bp, Homo sapiens
caaagaacaagcacaggtaatcccattgaccctaggggctgacatttattaggtgcttgatacctggtcccttttctttttttctctttttttttttttttgagacagggtcttgctttgtcacccaggctggagtgtaatggtgtgatcatggttccctacagcctcgacctcccaggctcaaattatcctcctacctca

SEQ ID NO: 57623 - DNA, 201 bp, Homo sapiens
ggccacatcttagtatcctttgcctaccccttaaattatggtattccatctcaaatccatccacttttctatctccattacttttttttttttttttttttaagagacagggtcgtactctgttacccaggctggagtacagtggtaggatcatagctcattgcaacctccgcctcctgggctcaagcaattctcctgtct

SEQ ID NO: 57624 - DNA, 201 bp, Homo sapiens; identical to SEQ ID NO: 10785

SEQ ID NO: 57625 - DNA, 201 bp, Homo sapiens
gtctgtccctcggagacgctcttcttccctgtggtgacagggaggcctacataccccagcaagggcttgggcctcccttggtgacagtggggccagggtcyggcagtatctgagagcagctgggatgtactggggcctggaggaggtgcttggttgtgggaagccccagatgacctctttggaaggacttggaacagcacc

SEQ ID NO: 57626 - DNA, 201 bp, Homo sapiens
ggtctgccaagcatggtcaggcagcctcagggagtggcagccacttctggggagggggcccagttccccgtggggcttggtggtggagaggaaaggataaygatcaggacactagtaatggctagattctatggagacatggtcttctttcatcttcacaagcacctcatgagcagccattatcatccccattttataggt

SEQ ID NO: 57627 - DNA, 201 bp, Homo sapiens
tcaggggtggagcgctcaaggccccttcccggtctccaacacccccgcacccccaccacctactgggggtagccaggcagcctcagttcccccatggaagycctgacagggcaactgctctcccccgggcctgctaggtgcgcccagtgctgtgctgctgcttgggaagaagctggggcaccttatgacatgggcatccat

SEQ ID NO: 57628 - DNA, 201 bp, Homo sapiens
agatgagcccccaataattcagaggcctagggctgctacagagggtgcaggatgtcaggggtggagcgctcaaggccccttcccggtctccaacacccccrcacccccaccacctactgggggtagccaggcagcctcagttcccccatggaagccctgacagggcaactgctctcccccgggcctgctaggtgcgcccag

SEQ ID NO: 57629 - DNA, 201 bp, Homo sapiens
ggcctggtggcgtgcacattcgcaggctctataaatgttagctgcatcctgtgacttgcctcccagggctttgagaagtggagggtgaggacagaaatgcygtgcctggaggcaaaggtatcgttatggacagcttgctctcctgggtagcagggcagcagcgcccagatcctgcaatgactgtggcacagcacatagcac

SEQ ID NO: 57630 - DNA, 201 bp, Homo sapiens
tctctcaccagatcaccctctcttttcctgatgaagaagctgtaggccagaaaagggccatgatgtgcttgaggatacagagcaaaatagcacagcagtgwctcaaatccagacctccggactccctgcccagtgctctcttcctcaccttgttctgtagcgggtcctggatgcttggtccagcaggaacagggcatgtgt

SEQ ID NO: 57631 - DNA, 201 bp, Homo sapiens
acaccctttcctcgctcagcttctgcagtgacgcccacccctcataggaccaagtcttcttaactgacattcagagcccttcaagaccagacatgtacctstctcctctccaggtctcacctggcactgaccccaagccccaggcgtctcctgtccagccacacctccaagagaagcctcaggcccttttgcatgcaggcc

SEQ ID NO: 57632 - DNA, 201 bp, Homo sapiens
ctgagcgccccaaggcctggggtaagtcactgctgtgctgaggtatcctcttttaggctgaaaagagacccccctgccgtcttcatttctgggcctcctgrtctcgaactaccacacctgaaagcttatctctcaccagatcaccctctcttttcctgatgaagaagctgtaggccagaaaagggccatgatgtgcttgag

SEQ ID NO: 57633 - DNA, 201 bp, Homo sapiens
tttctgtgagtccctgggaagcgcctgctgtggactggagcctttgggtcccagctccaacattcactgagggtttgttctgtgccaggtgccctgccagracctggggaggatctacagatgggaaagcaggccacgccctgggggcaccagcccctaacttaatgtgtgaccttttctgaacctcagcttcctctgctg

SEQ ID NO: 57634 - DNA, 201 bp, Homo sapiens
atacttaagcccagtgtgtaatggaaagaaggtgagaggtgggggaaggggctttcagactaaagacagcttgggcaaggtatgatggtataaaaagcatkgagtatatgaggacccaccggcagttgaggtggggctagattgggaagtatgaggaggggaagatgagggagcggggcaggctggggccacgggacttct

SEQ ID NO: 57635 - DNA, 201 bp, Homo sapiens
cagagggcctgtgggtagatttgaataaaggtggtccatgggagtggcttcccagggagaaggcaagccccagaactgtaagtatggagcagaggctgggkggctgtgctcgcatttagctcagtgtcccgcactgagacctaccccaagctggattcttgctgaatttgacagtctctgtgctgcagggacagggaagaa

SEQ ID NO: 57636 - DNA, 201 bp, Homo sapiens
ccttcagagaacattctctagagcccaagacctgtccacagaaaccagagatcagtcagagcctgtaaggctgacagctccctcatctccctgtcctaggwggctgggtatcaattctctctgttctttccagggcctttctctagacgtgtccctgctctgaggattggggtctccagtggggtccctgcagcttcactc

SEQ ID NO: 57637 - DNA, 201 bp, Homo sapiens
taatacctgttaaagtaacgtaagtctgtgatttgtcaatactaaataaatagtaactcttatggatctaatgatgaattctttggtttgtctccccagcragtggcattaagccttgaagatgatggactaccctgaggatgggatcacccccttcgtgcctcatggaattcagtcccatgcactacactctggatggtg

SEQ ID NO: 57638 - DNA, 201 bp, Homo sapiens
tctgagatggaatcagggaatgtcagaagatataaacaaacaaatttcacattaatataggaaagaatttaaatctgttgtccacaatggaatagactggytcaggggttagtgggctcaccttcccatggtcagccatttttggcagacaggagtctagcatctacctaatgactggaaagcaggggtgagggagagagg

SEQ ID NO: 57639 - DNA, 201 bp, Homo sapiens
ggatgtgtcagccagcaagccagtggcagagtcttggtctccaggctccctgcctcttgcactgactctttctctttcaacctccctgcatgacagctggmaagagcccatccctaatcttcaccaaccggcacgaggtgcggaggatcgacctggtgaagcggaactattcacgcctcatccccatgctcaagaatgtcg

SEQ ID NO: 57640 - DNA, 201 bp, Homo sapiens
cagctcataggaccttttgtgatctggcccctgccaatctctgaagctcatctcttgctatgtccccaatactttctatcctgaatcatctttttttttttcctttgagacagagtctctgtcactcaggctggagtgcagtggcacaatcatggctcactgcagccttaacctcccgggctcaaatgattctcccacttc

SEQ ID NO: 57641 - DNA, 201 bp, Homo sapiens
taacgtgtaacctgttcttgcccccatatagaacacatgtaatacatgacacagattatgtacatgcactggagacaacatgcaactacccatgcatatacaaaatccacacacatgaatatttcaagtgcagttacataaaatctcaaatcataaacacagggggttcctgtcacagtcacagctgtcatttaagatcac

SEQ ID NO: 57642 - DNA, 201 bp, Homo sapiens
tgtccccatctgagcattcctcacccttgctctgcaccctgagctcctagaggatgaggaggctcttaggagtctctgggctcccacccccacctccaccyctcccagcacagcacctggcacaggaaggtttgccaaatggatgaagtcattaagtaatgagcaccaagactcaaaagaaggccgtgtgtctgttctgag

SEQ ID NO: 57643 - DNA, 201 bp, Homo sapiens
ccacctgccctctgcaggagcagggaccctcattcactagtcatcttggggaatggataacaggctgggcagtgtagcaacttcccctatccggggtccayggggcaaagtccccccaggagatgatcagtccagcctctaaggtctctctagagctgctgcctggtcctcctaggacctgagtcctgcaagatgagacgc

SEQ ID NO: 57644 - DNA, 201 bp, Homo sapiens
accctgtctcaacccctgcctgccaaaagaaaagactgatttcttcctcaccttttgggagaactcaagaaagaaacagaggatcttggaaggtctggaasagcagggccaaacattctgagtagggagctgtgtggatagggccaggaggcctggccgctgttacagactgcctctagcccagctgtgtgacctccctcc

SEQ ID NO: 57645 - DNA, 201 bp, Homo sapiens
tggtgcagtgagccaggctgagctgtgtgcagatagggaaggggctcgtgactcctcctggctgaggtggtgggcacagacagctgtgtagaaggtgggayggggtaagtgtggcaagtgcacagctggccttcagtgggtgaggcagggcaggcatccttgccctcatttgacagatgggaaaacccaaaactggagcct

SEQ ID NO: 57646 - DNA, 201 bp, Homo sapiens
gtgattgtaagaactaaatgaggagacatatacaaagggcttcgtaaaccaggagatgaggtgaggtgatgtagacagatgagggcctggcccagagatgrcatcacaatacgatcagagccaaagctgaggcccaagttcatgtgtcccagggtttcctgaggagcaggccaggaggtgggacccaggacagaggcaggt

SEQ ID NO: 57647 - DNA, 201 bp, Homo sapiens
gggagagggcaggaacgtggtcatcttctcagcgtgctgcctgctctcagcagcaccccttgcgtaatgcttggtccctttgcaggcgccagccagggacycctgctgatcccatcctgcccacctctcccccatacccacctcctcccagcccctcagctgtcactcgttcaatacctcctgcaaccacaaatcactggg

SEQ ID NO: 57648 - DNA, 201 bp, Homo sapiens
aggtaatgcctcctccaggaagccttcccttttctctaagactaggttagataactcacctctgtacttcgataacaatttttgcctacttgcatcccaawacttctgccttaccattcattcccatgccattggggttgcttttgccaaggtcatccaggacctcctcgattataaatctggtaaacattttcagtcttg

SEQ ID NO: 57649 - DNA, 201 bp, Homo sapiens
gacgttgagtctggagaggggatactaatcactgtccagttgggcactggtgggaatggggaaatggcacaggaatgcaagcctctccaccctacccccckaactccagccatacactcatcgtttcacaaaatataaatgagttagcattaaatgtttcagagtaaataattccttttcccgaaatgcatgaagatagag

SEQ ID NO: 57650 - DNA, 201 bp, Homo sapiens
ccctcccatcctttcttccttcccatcctttcttccctcccttccttccttccgtccttccctccctcctttccttccgtccttccctccctccctgtctkttttctttccttctttccttcctttcctccctccttcccttcctccttctttccttcctcaaacatttatcaaaaacgcaccatgtatcaggcactgttc

SEQ ID NO: 57651 - DNA, 201 bp, Homo sapiens
cttccgaccatcttcccttccatcctttcttcccctcccatcctttcttccttcccatcctttcttccctcccttccttccttccgtccttccctccctcstttccttccgtccttccctccctccctgtcttttttctttccttctttccttcctttcctccctccttcccttcctccttctttccttcctcaaacattt

SEQ ID NO: 57652 - DNA, 201 bp, Homo sapiens
aaactggaagcggaagaacaccaaaagcatgaattttgacaacccagtctacaggaaaacaacagaagaagaagacgaagatgagctccatatagggagamctgctcagattggccatgtctatcctgcagtaagtatttctcactgggagaattcctaccttccgaccatcttcccttccatcctttcttcccctcccat

SEQ ID NO: 57653 - DNA, 201 bp, Homo sapiens
ttctcatatgtatttatttatttacttttttttttttttttttgagacaaggtctcactctgttgcccaggctggagtgcagtggcatgattgtggctcaytgcagccttgacctcccaggctcaagcaatcctcccacctcagccttctgagtagctgggactacaggtgcccgccaccatgcccaactactttgtattt

SEQ ID NO: 57654 - DNA, 201 bp, Homo sapiens
gtttccccatctataaactggcaatagggctggctggcctctaagttcctcccggccactgaactcagactagcctaccagagagaagcccagagccccargcagagccatgacgtgtgtccttaattactgcacatcccataattatacctcatacctgggccagaccagttccatccactccacacccactcactacag

SEQ ID NO: 57655 - DNA, 201 bp, Homo sapiens
gatgtactggggcctggaggaggtgcttggttgtgggaagccccagatgacctctttggaaggacttggaacagcaccaagatccacaacccctccgtgtsacggggtcactaatccagaaggtcagctggagggggcccttagagatgtgttcacctgaggaaactgaggcccagaatgggaaggggtgacactccttcc

SEQ ID NO: 57656 - DNA, 201 bp, Homo sapiens
cactgccgctgttatcgggatcatcgtgcccataggtgagtgtggcccccagtcactgaagagaaaagagagaccctgcttaggcctagggaagagcgctrgcagggtagagaacttggcctgccctattgacttgttctgcccttgcagccttcctgcccacctcccagtcctgatttaatttggttttttagcctagca

SEQ ID NO: 57657 - DNA, 201 bp, Homo sapiens
cactccttccaccgctgggggccctgctgctgcctcccattttgtctttcctcgggcctcctgatctttgcaacctcattttcatgccttggtgttttggrgcaaaggtggaccacttgtttcatgtttggaccacttgtttcttgggaaataaatagatttatggtcttaggatctggcttggttagaattgtgtaactc

SEQ ID NO: 57658 - DNA, 201 bp, Homo sapiens
agctgagaccctgtgagcctcagttgcttctcttacaaagtggaaataaccacccttccacaacctgcttcacaagattgccatgatagacaaaggtgtamccggtataactggaggtgctcacgcacacagccgttgctgactctgcgagggtgtgtgtgtctatgtttcacaaagttctgatgtgtatatgaggaggtg

SEQ ID NO: 57659 - DNA, 201 bp, Homo sapiens
tcaaagtgaagtgcttagcattcagctaaagaaaagatcatagcccactggggagattaggaaaggcttcacagaagtggcatttgagctacgccatgaarataagttcctaagtatatctcagaggcaataccttaggcaacaaaattatctgtccaagtgacctccatggtatttcccctccagcacctcaatctacct

SEQ ID NO: 57660 - DNA, 201 bp, Homo sapiens
tcatgcccccaggatccttccaaagctttttctcactcccaaggaaaaaatgcacatatacataaaacattttaaattcagtttcagggagtttctggaaygctttaaaaacctcaagttaagaacccttaatcgccgtggcttcaggtacatgcagataactatatatttgcctgtttctcacctagaacttaacaaaca

SEQ ID NO: 57661 - DNA, 201 bp, Homo sapiens
caccctgctttgaattagtctccatcactacacacaggtcacacacccagccccaggccctacctgactctgtgctggtcccatcctccagggagcacatkagcttggcaaagatgcacagtgacagggactggtggctggcagaagtgtcagctggaaaacaagagaaggaggcacagggagcttgaggggcaggtgtta

SEQ ID NO: 57662 - DNA, 201 bp, Homo sapiens
tctctgtgccctcagcacccagcactgtaacccatatacaaaaggcacccagtaaagggaggaaaggaagaaggaacatacatatccttagaatcatttamtggaggaaatggcctgagagatgctgttcaattctgcacacttttattgacctctgccagaccctggggtcatagaagtgaatcagacactatcctagtc

SEQ ID NO: 57663 - DNA, 201 bp, Homo sapiens
ctcacgcttgtaatcccaacactttgggaggcctaggcaggaagatcacttgaggccaggagttcaagactagtctgggcaatgtagtaagaccctatatytaaaaaaaaatttaaaaactagccaggtatagtaccatgcacctatagtcccaagctactcaggagactgaggcaggaagatcccttgagcctgggagtt

SEQ ID NO: 57664 - DNA, 201 bp, Homo sapiens
gtgagcagggggttctagttttaaatggaatggtcagggaagccctcactgagaaggtatttgagtaaagaaggtgaaggggggtgggtgtggtggctcaygcttgtaatcccaacactttgggaggcctaggcaggaagatcacttgaggccaggagttcaagactagtctgggcaatgtagtaagaccctatatctaaa

SEQ ID NO: 57665 - DNA, 201 bp, Homo sapiens
aatgggaatagggaagtccaggtgagcagggggttctagttttaaatggaatggtcagggaagccctcactgagaaggtatttgagtaaagaaggtgaagkggggtgggtgtggtggctcacgcttgtaatcccaacactttgggaggcctaggcaggaagatcacttgaggccaggagttcaagactagtctgggcaatg

SEQ ID NO: 57666 - DNA, 201 bp, Homo sapiens
cagggacagacaggtgcagacctgctctcctttctcttcccctcacccacctgagccctggaggactctgtgccttccttcatcagaagccagtcactttragttctctcctttccccttccccctttcagggccatcccacctacacatgccacttcatcaagtgctcagtaaatagaattgttgagttgttgctagctg

SEQ ID NO: 57667 - DNA, 201 bp, Homo sapiens
tggtcttaggatctggcttggttagaattgtgtaactccttagtggaatgggttggaggagagaacccagaaaattttgagggaaactcttcccgatttgraagcaaagccgccctcaccaaaaagtgctccttccgctgcagcctcttcattccgaatggggtgaatcctttggctggagcccttcgtgtgtctccctcc

SEQ ID NO: 57668 - DNA, 201 bp, Homo sapiens
gatgtcgcctgctgatggatgatggtggcttgagccccagagcccgctgggcagtacaaagccacgcaccgagtcccgcccaccacacgcgggtgctggcycctgcaccctactgtcaggacactgtgggaaccgttcgccttctgggaaccgccgagccttgagtagtcagagactgtccgcatgtggacttctggactc

SEQ ID NO: 57669 - DNA, 201 bp, Homo sapiens
ggaaaggagctgctgagtgtgtgcattttcatcattgccgttctgctctctagaggggagaatctttcccatctcacaactctctccctctatggccccayggctctcctttccagcgaggcaggcagctgaaggacttccctcttctctgagcacagggccacctcattctggtcccatgggacaaagcagccatatcca

SEQ ID NO: 57670 - DNA, 201 bp, Homo sapiens
catctatgtgtgtgaccccatgtatgtgtgaatgtatctatggagtccatgggactgtttgtgctctgcacataagctggtatgtgtgcatgtagttgtgkgcatgctggtgtgtgcatgtaggtgtgtgcagtgacaccacttcttccttccatggaaggaagccgcaaatactactctggcctctctgcaccactctac

SEQ ID NO: 57671 - DNA, 201 bp, Homo sapiens
gggttcctctgcttaaaaatagttttccaggccctgtgctgagccccagctccatgccaggacccgccacagcctgagagggtggctctggtagtgggacrgccgtcaggccagggcccccgggtggggtgcaggttgctctgggccacggtctcctccccctctcattactgctctgtcgttgctgcagccagagaacac

SEQ ID NO: 57672 - DNA, 201 bp, Homo sapiens
tccttccccttttgaagattaaaaaactgattgtgaaaggaagagtagttgagtgaaagtgactcagcttctacctgagctggcaggagatagacactccytctgcctccaggccctgccaagagaagtcccagaagaaggaacttgtggaaaaagagacagggaagccagaactactgagcctagctcccccaacaccca

SEQ ID NO: 57673 - DNA, 201 bp, Homo sapiens
agagcatatttccttccccttttgaagattaaaaaactgattgtgaaaggaagagtagttgagtgaaagtgactcagcttctacctgagctggcaggagayagacactccctctgcctccaggccctgccaagagaagtcccagaagaaggaacttgtggaaaaagagacagggaagccagaactactgagcctagctccc

SEQ ID NO: 57674 - DNA, 201 bp, Homo sapiens
ccccaagatgcattttcccccagagcatcacttgcccctaaatcacctggctccctttccatggggtcctagtagcaccagaactggatttgtaaggactytgccaaagctgaaagacacctagggggacatgacagagcacttgggaagtccagcccccaccacttgtccaggtcccagctggtgagtggcttccctcac

SEQ ID NO: 57675 - DNA, 201 bp, Homo sapiens
aggtttggagggatgggaggtgtggccaggaggggcaggcagaagtcaatggatcaaagggacttgagggccagggaccagggggccatgaaagatgttawgtagagaagggtcagatttaggatttgaaaattcctggcacagacagaggcttcttctcagctgatgaaactgagacatgggccagaagagccctgatgg

SEQ ID NO: 57676 - DNA, 201 bp, Homo sapiens
cctccacccagaaacctggcaggctcaggagctccccccatctctttacccgctaggcctgctcattcctcaaggcctggcctagactcctctgaccttcscagctgggctgggtccctctgctgggcaggtccccagcagctttctcttatagctcatctcacactgatgtccccatctgagcattcctcacccttgctc

SEQ ID NO: 57677 - DNA, 201 bp, Homo sapiens
tccgctatccgatccggatccgccaggtgcaggcttcctttcattgccttacctgaatacattacccgggtttactacagaggagaccgaggctgggagargtgaggtgacttatttgaattcacgcagctgccgggctgcggagctcaggtctaactccagaagcctccactggtatctgtgtccctgctgtgagccctc

SEQ ID NO: 57678 - DNA, 201 bp, Homo sapiens
caatgccccagtgtctcaaaagcccaggaggggaaaaaaattcaactgtcagacacttggtagagctgtcagaaacgcatgacacgagctacctacctggkgaaactgaagacatcactctattttatcttcaataacaatgaaaattcacatttttccatcagaaagtgaaaacacagactctgggcgcccccacgtgga

SEQ ID NO: 57679 - DNA, 201 bp, Homo sapiens
aattatagctcacttgattggggacggcttctgacccaccttcaggcttctgttgggaggggtgagggtgggggaggggaggatggttcaaggtgagttayagttctggatgctatttatttgaatatggaggctttttcatgcatcttagaacctttccacctgggaggggggcctctctgattaaccaggctcatcttg

SEQ ID NO: 57680 - DNA, 201 bp, Homo sapiens
tgcctcattcctcctgcctcccaggcccgcttttcacagttgagggacaacaggaggcccagagaagttgatagacttccttcaaaaacacacagcttatscatggcaggtctcccttttatgaaaaaaggctcttcgagctctctgaggtttcataaggcgtctatgggagcagtagccaaggcagcaccccaggagaca

SEQ ID NO: 57681 - DNA, 201 bp, Homo sapiens
gccgagagcccagagaggcctgccccttgtcacacagcgtgttggtggcagagcagggctggaatgagatctagaaccttctcctcaactgcaaaagaagmagcggaagagctgcccctccttccctcagagggctggtggcaagaacagggcctggaatgcaggggtccttggcaagctccaaggtcagcctgcccaagg

SEQ ID NO: 57682 - DNA, 201 bp, Homo sapiens
ccgaaacacggccctctcggactcttgcctcggccccgcgggacgcgcgcgtgtttcaaagttccacgcagctccgggccgcactgcgctccttttcctgmtcagtttttgtgaatgaatgggctccccagggcccctgattggctgggcgaggaccaccccataggcccccgtggccggagcggccaatcgcggagcaga

SEQ ID NO: 57683 - DNA, 201 bp, Homo sapiens
ttccttccttccttccttcctttctttctttttctttctttctttttttttttttgagacagagtctggtcctgtggcccaggctggagtgcagtggcgcsatctcggctcactgcaacctccgcctcccgggttcacgccattctcttgcctcagcttcctgagtagctgggactacaggtgcccgacaccatgcccggc

SEQ ID NO: 57684 - DNA, 201 bp, Homo sapiens
gggccacgggacttctaagcccctggggagaggccacatcctagtggcccctgatgttaaatccatcccaagctcattccaggggaggactttggtggtcygagcgccccaaggcctggggtaagtcactgctgtgctgaggtatcctcttttaggctgaaaagagacccccctgccgtcttcatttctgggcctcctggt

SEQ ID NO: 57685 - DNA, 201 bp, Homo sapiens
cacacacagttgaaatcacacttctgccacctaacacccttacctctaagccttaatttcctcttctgtacaatgggattaataacaacagctaccaagayagctgtgaggagtcactgggatattgggtgaaaggtgccaggccagagccagagtggaaaatctccaagctggtccagccagtgaacaaatctgttccca

SEQ ID NO: 57686 - DNA, 201 bp, Homo sapiens
gcggcacagccctcatctcatggcagggctgatatggtctcttcacgagggactattgggctcattgcactgaacggcctgacactgggtgttcaccaggrtcccccagaagagtctttttgccttttgtccttgtgacaaagctgcatgggaaagccacatccccacttgcccaggttcaccccgaggtggctatgccag

SEQ ID NO: 57687 - DNA, 201 bp, Homo sapiens
ccaagccccataatcagatgattcctccaatatgaaggccgctactgcaagggatgggagtctctccaactagggcatgttggaataggaacattccccawtaattatgggagagagaggtgtcagaaggtcttactgggcttctatgctatagcttccaccctcctaggcagaggaaagagtcctcccacccctcatctc

SEQ ID NO: 57688 - DNA, 201 bp, Homo sapiens
agccgaaggttctcaggagcccctggcttcagggcccttccactctctccattgagcacctgccctgagccacgtgctctgctgtccgcatcacccagcarcacacctgtctcccctcccggagcgggtgctgactacactggcccacaccactccaccccaccccccacacctcgagcaccctccttctgtccctttcac

SEQ ID NO: 57689 - DNA, 201 bp, Homo sapiens
gaggctgggaatctgcttgttgggtgggggttgtggaccacacgcttacacctccctgttggaaccaatcctggggcggttaaagagcttcagagaatggrccccatttccttccaaacgcactgagaagccagaagcagccttctccatctgctttcagaatccaccttttccttctggatcaaacatagttccctcggg

SEQ ID NO: 57690 - DNA, 201 bp, Homo sapiens
tgctaacaatgttttgcagatgagggaattgaggcataaaagtaacttgccccaggtcacacaggtaacaagtcgtttaaaccatggcagtttggatctaygtaaagttcagtaataaattagaatctctcttttacaggaatcaggacactttgcctgctcagagggagagagggaaagagacagagacacaaacacaga

SEQ ID NO: 57691 - DNA, 201 bp, Homo sapiens
gaatggtgcctgacccccagcaagtatacaataaatattggctattgttgttattttatgtggttttcttttaactttttcaagtaaatataacttacctmatgcttgttatgtgtcaggccttgtatttatcctctgaagacaaagatgaggaagacatagtcctcctaggggtacaaatccttcaataaaggcagaaac

SEQ ID NO: 57692 - DNA, 201 bp, Homo sapiens
cccggccctgccagaaccaacacctggagacatggccacctccgaaggtcttacctaactgcagggcgtgccagcatctagcagggtccctcacgcacagytggcctgctgcttgattattttggcttccagcagcagagacctgagactttcccggtagcataggagtcagcagaagcttggccttcccagaacatggga

SEQ ID NO: 57693 - DNA, 201 bp, Homo sapiens
gactaatagttaatacttcaaccgcatacacagattcatgtcctaatcttgatgtatagccaaggcctttcatttgagcctaagtctactgcattattaaygatttacaggttcaattgtttaaagtggaataagaatttcaatctattggtataacaatatatgagtgtaaaatccttctagatttatctgatttcccct

SEQ ID NO: 57694 - DNA, 201 bp, Homo sapiens
attctggcctgctcggagcatactgcctggagatgcggtgagcactgtctcagcactaactctctggtagctctgtgctctgtgaacatcccgttccctgygctgtcctcccacagtgccttgaagtgtgccctgcacagtagggctcagcaaaggtgtgtttggatttggatgtgcagccccgagcccacctccatgtca

SEQ ID NO: 57695 - DNA, 201 bp, Homo sapiens
tagcagaaaccctctgcatttacaaacactttgtgctataaaaaagtaatttttaaaaagccacgtgtgtgtgtgtgtatatatatatatatatatatatwtaaagccaaggttttgatacttttttacaaaaactacaagagaaaacaaatatacctgtccaaaccatatacttttaaaagagcatttttttttccatac

SEQ ID NO: 57696 - DNA, 201 bp, Homo sapiens
gcaccatgtgcacagtcaagaattagcagaaaccctctgcatttacaaacactttgtgctataaaaaagtaatttttaaaaagccacgtgtgtgtgtgtgkatatatatatatatatatatatttaaagccaaggttttgatacttttttacaaaaactacaagagaaaacaaatatacctgtccaaaccatatactttta

SEQ ID NO: 57697 - DNA, 201 bp, Homo sapiens
ggctctgccctctgggcagcggatcttgggggaggggtgcaggggggcttggccagcggggaactttgccggaggggcggccattcatggttccggatgarctgtgtgattctcgccgttggggtttatttgacacgcgcgctccgcggcggtaatgagcagagccgggcggcttctccgcttgacaatgcgtttccgcag

SEQ ID NO: 57698 - DNA, 201 bp, Homo sapiens
tctgtcctgtctctttactgatagagatggtgaggcacagagaggtggggaaacacccagggtcacgtagcataggagtggcagcagcaggatttaaacgygggtctcttgcactccaaggtccacgtgttagccagtgcaccaggcaagggataaaggacttagtgtgagagctcctttggaattggagttgcagaggct

SEQ ID NO: 57699 - DNA, 201 bp, Homo sapiens
gcaggaagatcccttgagcctgggagtttgaggtcacagtgagttatgatgccactgcactccagcctgggtgacagagtgagaccttttctaaaaaaaawaataataataataataaataaaaagggagtgagggaggtgagacagtaagctaccatgcaattatctataggaacaagcatttcaggctgaagagacaga

SEQ ID NO: 57700 - DNA, 201 bp, Homo sapiens
gggcggacaggctccacgcgaagcggctattcctgaatttgccctcggccccccgcccccgcgggcctcggtgttgagggctctgccctctgggcagcggmtcttgggggaggggtgcaggggggcttggccagcggggaactttgccggaggggcggccattcatggttccggatgagctgtgtgattctcgccgttggg

SEQ ID NO: 57701 - DNA, 201 bp, Homo sapiens
tccagcagcagagacctgagactttcccggtagcataggagtcagcagaagcttggccttcccagaacatgggaccagaggaggtgtcctggacagggccrggtgaggggaggctgctggtggcccctcactgagcctttctgcagtgggcctggggaccccctctgccctgagcatttgccaagcagtccagtggctgcg

SEQ ID NO: 57702 - DNA, 201 bp, Homo sapiens
ttcctttctgctgctgctcaaagttggttctgctcagaagcatcctcccattcatatgaataacggcgatcactgatgataaatgaaggtgtgcctgcccygtgccagggctgggctgggtgccctggggacagctgagaggagtcggaggtggaatccatcctgagagcaggggcacagctttcaccacctttatctcat

SEQ ID NO: 57703 - DNA, 201 bp, Homo sapiens; identical to SEQ ID NO: 10788

SEQ ID NO: 57704 - DNA, 201 bp, Homo sapiens
acagcagtttcaaagtcccagtgatggcactggctcacttcctcagctgtgataattttgctgggactcactggccaatgagaatcctctttcctctttamcaagccccataatcagatgattcctccaatatgaaggccgctactgcaagggatgggagtctctccaactagggcatgttggaataggaacattccccat

SEQ ID NO: 57705 - DNA, 201 bp, Homo sapiens
cagcagggccctccctgtaaactatggattcctcctgcgcacccctcactcggtgttgggggtgggcaggggcctggggactggccctgagctgtgatggrggtggaccagggcagggaggcccccgggataccggagggcatggcagctcagagcaggctggggtctgggtcttgcatctgctggctggagctcagccct

SEQ ID NO: 57706 - DNA, 201 bp, Homo sapiens
ctagtgccaagaggctgtcaccacaggcgggcagagttgggggagggcgctttgtggccagggcttgtgtggggaggggaagcagctggtggtctggctgytgggcctccttggagcccacaccccaggaactgccaggggacaagaaagtgggcaaagggtaagcccgccacctgcctgggactggccgtgcccatgccc

SEQ ID NO: 57707 - DNA, 201 bp, Homo sapiens
gagagagctagtgccaagaggctgtcaccacaggcgggcagagttgggggagggcgctttgtggccagggcttgtgtggggaggggaagcagctggtggtytggctgctgggcctccttggagcccacaccccaggaactgccaggggacaagaaagtgggcaaagggtaagcccgccacctgcctgggactggccgtgcc

SEQ ID NO: 57708 - DNA, 201 bp, Homo sapiens
ccttcagttgtgagcaaactgggacacttgaccagtctagctgagcccccaagccctggccactgctctctcaggtccccaggaggtcctccccatccctkgtggaatctgctagctgggcacggctcacttaattaaaaacaaagaaaaaggccaggcacagtggctcacacctataatcccagaattttcgggaggctg

SEQ ID NO: 57709 - DNA, 201 bp, Homo sapiens
cggcagccctaagagttctgcattgggtttttttcttgaagttcctgtctctgtcctaaatctctgccattttctttgtctagttttcccattcctgcttyaagtccctgcctgttcctcacctagttcccacccaggcttgtgggacctccccttactattagcttgtgtgcatgcccagctctgggcacaaatactacc

SEQ ID NO: 57710 - DNA, 201 bp, Homo sapiens
gttcctcacctagttcccacccaggcttgtgggacctccccttactattagcttgtgtgcatgcccagctctgggcacaaatactacctaatggtgccatyactcgttaccaccaccctaggaaggttgtatagcagtcaaatctgattgggcctgcatatttcttagggatttcccctttgcccttcccctcctcctcaa

SEQ ID NO: 57711 - DNA, 201 bp, Homo sapiens
caattcagccagcagaattaattcattgtattcagttgtttatattgaacacctaacattgtagtagacactggggattcagcagtaagcaaaacagatgsaaatccctgtctgccctcaagggactcatattctaatgggtgagccaggctagaaatcagataaatacataaaatatagtgcatggcagatggcgataag

SEQ ID NO: 57712 - DNA, 201 bp, Homo sapiens
atgttaaatccatcccaagctcattccaggggaggactttggtggtctgagcgccccaaggcctggggtaagtcactgctgtgctgaggtatcctcttttrggctgaaaagagacccccctgccgtcttcatttctgggcctcctggtctcgaactaccacacctgaaagcttatctctcaccagatcaccctctcttttc

SEQ ID NO: 57713 - DNA, 201 bp, Homo sapiens
cggggtaagtgtggcaagtgcacagctggccttcagtgggtgaggcagggcaggcatccttgccctcatttgacagatgggaaaacccaaaactggagccygggctctggggctccctgcgtggtgctctttctgttccagcgggctgctgccctggctggcacctatgcttttggcatctttatgctgttagattttcat

SEQ ID NO: 57714 - DNA, 201 bp, Homo sapiens
cctaaaaaggagaggaacttagagcttatctcatccaactcaccatgccatgaaagaagagagcaaggcacagagaaggccagagacttacatcaaggccrcagagcagagccaggccctccaggccaggagtggcagacggcccattgctaactccattctcagtgagatattcttaacctctctccagaaaagccagca

SEQ ID NO: 57715 - DNA, 201 bp, Homo sapiens
gtgctactcactgacaactagattcctgcctccctgcaacatacagacactccgttcacacacacccaaaaacataactagaacaatgcctgtccaagagwtgtaactgaaagaggcaggatttggtgacagactagatatggggctgatggaagaaatttactccttcatagtgaattttgggagtttcaggtttttggc

SEQ ID NO: 57716 - DNA, 201 bp, Homo sapiens
ctggggctggagtagtctgagggctcccttgggttagcagctttgagccccaaacacctgggatttgtctgacctctggaggcctaatatggaagcacaaracacaggaactgtttggccagggcagaaaggaagaaatcctggctttggggaggactttccaagcagctcacatccctgtgtgttggaacctggggactt

SEQ ID NO: 57717 - DNA, 201 bp, Homo sapiens
ggagaccaacatgggacttgggagtggcagggtgccatattgacagcaggtgaaatatcacctacatctgtctcatggggaattcattacattttgggttrggtttgggagttttctttggaaactcagggtaggcagggtctgtaagcttgagtcagcccaggatggagaggcagggtaggggagaaccaaagtcacctg

SEQ ID NO: 57718 - DNA, 201 bp, Homo sapiens
agatgtgttcacctgaggaaactgaggcccagaatgggaaggggtgacactccttccaccgctgggggccctgctgctgcctcccattttgtctttcctcrggcctcctgatctttgcaacctcattttcatgccttggtgttttggggcaaaggtggaccacttgtttcatgtttggaccacttgtttcttgggaaataa

SEQ ID NO: 57719 - DNA, 201 bp, Homo sapiens
tgcataaattgaacacggctcctcggctgctcagaactatcccagttttaaaactcaacatcctgcatctcaggaaccccttcagttgtgagcaaactggracacttgaccagtctagctgagcccccaagccctggccactgctctctcaggtccccaggaggtcctccccatcccttgtggaatctgctagctgggcac

SEQ ID NO: 57720 - DNA, 201 bp, Homo sapiens
ggtatgtgataagacagaacctaccagagctgaatactgcatatctttgaggaggttactgcatatctgagagggaggtagagtaccagcctgcgatttargactcataggtgcccctaccttacagagggtcttgtaggaagctgagaccctgtgagcctcagttgcttctcttacaaagtggaaataaccacccttcca

SEQ ID NO: 57721 - DNA, 201 bp, Homo sapiens
aacactggtccaagcttcacaggagcaaggggtgagcagaggttttgctctcttttcagcgaaaacgcccacttcatttgcccagcacgtcagcattgccrtgtgcttgccatgcataaattgaacacggctcctcggctgctcagaactatcccagttttaaaactcaacatcctgcatctcaggaaccccttcagttgt

SEQ ID NO: 57722 - DNA, 201 bp, Homo sapiens; identical to SEQ ID NO: 10784

SEQ ID NO: 57723 - DNA, 201 bp, Homo sapiens
atgtagtaggtaagtaagcggcccgggtatgtagtaggtaagtaagcggcccgggtatgtagtaggtaagtaagcggcccgggtatgtagtaggtaagtargcggcccgggtatgtagtaggtaagtaagcggcccgggtatgtagtaggtaagtaagcggcccgggtatgtagtaggtaagtaagcggcccgggtatgta

SEQ ID NO: 57724 - DNA, 201 bp, Homo sapiens
acgccctgggggcaccagcccctaacttaatgtgtgaccttttctgaacctcagcttcctctgctgtgaaggggatgaggacccaagacccttccctgttmccttgggtacatctatgctgtggctgggatcagacatggccccgcatgaccctgaggctgcagctagaccagaacttgccctccactgggcctctggaac

SEQ ID NO: 57725 - DNA, 201 bp, Homo sapiens; identical to SEQ ID NO: 10786

SEQ ID NO: 57726 - DNA, 201 bp, Homo sapiens
atgtagtaagtaagtggcccgggtatgtagtaggtaagtggcccgggtatgtagtaggtaagtaagcggcccgggtatgtagtaggtaagtaagcggcccrggtatgtagtaggtaagtaagcggcccgggtatgtagtaggtaagtaagcggcccgggtatgtagtaggtaagtaagcggcccgggtatgtagtaggtaa

SEQ ID NO: 57727 - DNA, 201 bp, Homo sapiens
cttctgcagtgacgcccacccctcataggaccaagtcttcttaactgacattcagagcccttcaagaccagacatgtacctgtctcctctccaggtctcayctggcactgaccccaagccccaggcgtctcctgtccagccacacctccaagagaagcctcaggcccttttgcatgcaggcccctagcctggaaggctcca

SEQ ID NO: 57728 - DNA, 201 bp, Homo sapiens
gtgcagtaagtggcccaggtatgtagtaagtaagtggcccaggtatgtagtaagtaagtggcccgggtatgtagtaagtaagtggcccgggtatgtagtargtaagtggcccgggtatgtagtaggtaagtaagcggcccgggtatgtagtaggtaagtaagcggcccgggtatgtagtaggtaagtaagcggcccgggta

SEQ ID NO: 57729 - DNA, 201 bp, Homo sapiens
gagatgcaaagctacaccctttcctcgctcagcttctgcagtgacgcccacccctcataggaccaagtcttcttaactgacattcagagcccttcaagacmagacatgtacctgtctcctctccaggtctcacctggcactgaccccaagccccaggcgtctcctgtccagccacacctccaagagaagcctcaggccctt

SEQ ID NO: 57730 - DNA, 201 bp, Homo sapiens
gcctcagtttcctcatctataaaatggagtgcttacgtgcaggactgctgccctgctgtagtgcagtaagtggcccaggtatgtagtaagtaagtggcccrggtatgtagtaagtaagtggcccgggtatgtagtaagtaagtggcccgggtatgtagtaggtaagtggcccgggtatgtagtaggtaagtaagcggcccg

SEQ ID NO: 57731 - DNA, 201 bp, Homo sapiens
cccttcccacatgttgcctccaggctcatggtggcccttgggaggtgggccagcaggaatgactccacccattgtacagatggggacactgagcccatagwcccacagcatctgactccttaatggtggggagaagggaagccacatgggtggctgggctgtggccgtggcgtgtggtggttacgagtggggtcactggtt

SEQ ID NO: 57732 - DNA, 201 bp, Homo sapiens
cactggggattcagcagtaagcaaaacagatgcaaatccctgtctgccctcaagggactcatattctaatgggtgagccaggctagaaatcagataaatamataaaatatagtgcatggcagatggcgataagggctaaggaaaaatagaaagtagagaatgggaatagggaagtccaggtgagcagggggttctagtttt

SEQ ID NO: 57733 - DNA, 201 bp, Homo sapiens
cctagtttctgttctgtcctccaaacccatcttcgctctgcagctgagtgctctgagagatgcaaagctacaccctttcctcgctcagcttctgcagtgaygcccacccctcataggaccaagtcttcttaactgacattcagagcccttcaagaccagacatgtacctgtctcctctccaggtctcacctggcactgacc

SEQ ID NO: 57734 - DNA, 201 bp, Homo sapiens
agagcaagagcggcccccacccgagacaaggagccctcatttcctcgtacagctgctcctggcctccccagccatgccgcaggccccatcctttccttacmcaccacgtggccaaactccatgccgtcctgaaggctcccaggcaggagggaagcccagtgctttgtcctgagcttcagaaggaacaaagccctgccacgc

SEQ ID NO: 57735 - DNA, 201 bp, Homo sapiens
gccttgtatgagtctctgcagtcgacaaggcccttcccacatgttgcctccaggctcatggtggcccttgggaggtgggccagcaggaatgactccacccrttgtacagatggggacactgagcccatagtcccacagcatctgactccttaatggtggggagaagggaagccacatgggtggctgggctgtggccgtggc

SEQ ID NO: 57736 - DNA, 201 bp, Homo sapiens
aacgtcttctgcctcttggactaggccggagtgcaggcattgcctgggccttgggcaggaacctgggagtcatcacaacccctctcttccttcccccaagscctcaccttgaataggggaaggaagaaggtcccgacactcaccctgcctacctgccagcctgggcctcccccgcccctgccacccactgccatgcccttc

SEQ ID NO: 57737 - DNA, 201 bp, Homo sapiens
gcagtccagaggcagagcttcagcagcgtgagcccgagacaaaaggctcaggcaaaagcatgtggaggatagtggggctggcggggacccaggagcccctstttaggggtaacagtcgtcccagaggcagaggtggggacaatggagaccggagtcccatctaacgccgtggctggtgataactgggtttccttgtctcct

SEQ ID NO: 57738 - DNA, 201 bp, Homo sapiens
tgttggcctcactcctcccaagtggagggcagcactgagatcgttgttctcatgatgaatagaaagaagctggaggcgctggccacgtgccttgtatgagkctctgcagtcgacaaggcccttcccacatgttgcctccaggctcatggtggcccttgggaggtgggccagcaggaatgactccacccattgtacagatgg

SEQ ID NO: 57739 - DNA, 201 bp, Homo sapiens
ctgcaaggctgctggtatgaacaccccaagggcagaggggcagctctgaaaggcatacaggaagcagcgtgcttccacttgtgaggagtgggcgtgtacaygtgcgcacacacaagaaggcaggttgtgttactgagaggtacgggaatcctcggtcccttgtctagcttgggagaaagaattcagccaagagacaattag

SEQ ID NO: 57740 - DNA, 201 bp, Homo sapiens
ctgaacgtcttctgcctcttggactaggccggagtgcaggcattgcctgggccttgggcaggaacctgggagtcatcacaacccctctcttccttcccccraggcctcaccttgaataggggaaggaagaaggtcccgacactcaccctgcctacctgccagcctgggcctcccccgcccctgccacccactgccatgccc

SEQ ID NO: 57741 - DNA, 201 bp, Homo sapiens
gcccttctgcccagaaggagccctagcgtgtcctccaggcctccctgctgctgttcttgaggaccccgaccataattccaggagtgccagtggcagctggygcttcttaagcctttatcgtgtgctaagctctctgtgtgcattaatgcctttgataaccacagcagcctcatgaagcagatactgtcattttctgagttt

SEQ ID NO: 57742 - DNA, 201 bp, Homo sapiens
cctgggtagcagggcagcagcgcccagatcctgcaatgactgtggcacagcacatagcactggggggctgtggctgaacgtcttctgcctcttggactagkccggagtgcaggcattgcctgggccttgggcaggaacctgggagtcatcacaacccctctcttccttcccccaaggcctcaccttgaataggggaaggaa

SEQ ID NO: 57743 - DNA, 201 bp, Homo sapiens
caggctctataaatgttagctgcatcctgtgacttgcctcccagggctttgagaagtggagggtgaggacagaaatgccgtgcctggaggcaaaggtatcrttatggacagcttgctctcctgggtagcagggcagcagcgcccagatcctgcaatgactgtggcacagcacatagcactggggggctgtggctgaacgtc

SEQ ID NO: 57744 - DNA, 201 bp, Homo sapiens
gcgcctgcagaagggactttgacttccagtccagttggggaaagtgggacaggcaggtaaagagactgagaactggctgaaggagctaaggcagctgctgkagggtatcagggaaggcttcctggggacagtggcagtggaactagacattgaggggaagcaggagtgtggtggggtatgataaatcttgtcatgcttgct

SEQ ID NO: 57745 - DNA, 201 bp, Homo sapiens
cttcctggactgtcatttaaatctgcctgccaggttagtaggccaggggcgggctggcacgccccctgcccccaccccggatctgcattctgctggaagckgtcgtcttggcaacgctggggcatggcgagctctgtcgaagggtaactgttggtgggagcagccctttcatctccccgacccgggtacaagtggcccaac

SEQ ID NO: 57746 - DNA, 201 bp, Homo sapiens
gaagaagaagacgaagatgagctccatatagggagaactgctcagattggccatgtctatcctgcagtaagtatttctcactgggagaattcctaccttcygaccatcttcccttccatcctttcttcccctcccatcctttcttccttcccatcctttcttccctcccttccttccttccgtccttccctccctcctttc

SEQ ID NO: 57747 - DNA, 201 bp, Homo sapiens
ctcatctggaggatggagccgcccctcaaggtggttgtgggattgacaggtgagttaacttctgaggcacactaagagcagtgcatggtgcatgcgcagtkctcaattcaagattgcctgggcttcttttgacctccttctctgaacctccctctcccatctgtccttcaggaatccccatccttactgggctgctgcact

SEQ ID NO: 57748 - DNA, 201 bp, Homo sapiens
cttttgtcttcttctccctattatatagataagaaaatgtaggctcagagattaaggaacatcctcaaggtcacacagataggaggaggaggaggaggagraagtgggattgagatccccagagcagtgtggaggtcaccctgcaggctgtaggcaccggggggcagggactgatttgggtgtcttgcccagtagatcctc

SEQ ID NO: 57749 - DNA, 201 bp, Homo sapiens
ttcccctcccatcctttcttccttcccatcctttcttccctcccttccttccttccgtccttccctccctcctttccttccgtccttccctccctccctgycttttttctttccttctttccttcctttcctccctccttcccttcctccttctttccttcctcaaacatttatcaaaaacgcaccatgtatcaggcactg

SEQ ID NO: 57750 - DNA, 201 bp, Homo sapiens
ggaaaacgaggctcagagaggataagagactcacccagttattggtagttctggagctaaaactcacttcaactgattttacttatttagttttccagggkaagtaacttctggttagctgaaagtaactttacacttgtaatgaaaaacatagttaataaagaacaggaaacgaaggttgcagtgagccgagatcacacc

SEQ ID NO: 57751 - DNA, 201 bp, Homo sapiens
aataataagtgtctatcccaaatatcctggtgcatggccacccctgggctctgtcctgccccctacccctcccctcctctgctaagggccgattttctgtsttgcatggcctcacgaaatcccaaaggaagctctggcagcctggagccctgggtttttttggctgctggagagcagccctgtgtttagcaagaggctgga

SEQ ID NO: 57752 - DNA, 201 bp, Homo sapiens
gaggtatcatgactgcatttcgcagaggagagaaccaagactctgagagatgaagtcacttgccccgggtggccccgctggtcagtggcaggactgggccrtgcctgtctggctgcaggtctgaggcagctgaaaggagatatgcattcacacatcccagtcacgatgacagtaaagtgtggcttgcaggctgtgctgggg

SEQ ID NO: 57753 - DNA, 201 bp, Homo sapiens; identical to SEQ ID NO: 10789

SEQ ID NO: 57754 - DNA, 201 bp, Homo sapiens
gtcagagcctgtaaggctgacagctccctcatctccctgtcctaggtggctgggtatcaattctctctgttctttccagggcctttctctagacgtgtccmtgctctgaggattggggtctccagtggggtccctgcagcttcactctgggctccatgctctgtgaacactttgttctattttttatggcctagtggggct

SEQ ID NO: 57755 - DNA, 201 bp, Homo sapiens
aggctggaaggagggaacttttaaggaagccaagaaaggcttcctggaggaggagactgctgaactaggcctgaaagatggtaactaatagcattcccccrgagtttaccatttaaaaacaggtggtattgttcctatattatagaggacataggcttggagaggtgaagtgactcccccaaagtcacagagctcctcagg

SEQ ID NO: 57756 - DNA, 201 bp, Homo sapiens; identical to SEQ ID NO: 10792

SEQ ID NO: 57757 - DNA, 201 bp, Homo sapiens
tacagccttagaaccgtaggtccctagagtgtcagaagcagagccatgtggaagctgtttgcaatgttataatggacccacgggatctttaaactgagggytttaggaacatcacatgtccagggaggggttaggatttgaatccattgctgctggaccccagatctgctggcgatggaggatttgaatccagtgctgctg

SEQ ID NO: 57758 - DNA, 201 bp, Homo sapiens
actgcgcctggcgcgcgggcgcggggactccctatgggctgtatctgagcagatctctgactatgggtcgcgtgtgcgggtgagtgcgtctgaatggaggktatacccaggtcgtgtgacactttaagtaggtgcctggtctcgccgtgccaccgagcggcccgacatccacggaacccctgccatcgtgccctccctttg

SEQ ID NO: 57759 - DNA, 201 bp, Homo sapiens; identical to SEQ ID NO: 10793

SEQ ID NO: 57760 - DNA, 201 bp, Homo sapiens
ggtgggatgggaaggtgggggagagggcgaatttagatgtcgcctgctgatggatgatggtggcttgagccccagagcccgctgggcagtacaaagccacrcaccgagtcccgcccaccacacgcgggtgctggctcctgcaccctactgtcaggacactgtgggaaccgttcgccttctgggaaccgccgagccttgagt

SEQ ID NO: 57761 - DNA, 201 bp, Homo sapiens
ccgcagacccctgcgcgcggcggagagagagggggctgcctgccagggtgatgtgcctgcggctcccactgcgcctggcgcgcgggcgcggggactccctrtgggctgtatctgagcagatctctgactatgggtcgcgtgtgcgggtgagtgcgtctgaatggagggtatacccaggtcgtgtgacactttaagtaggtg

SEQ ID NO: 57762 - DNA, 201 bp, Homo sapiens
gaacgtggtcatcttctcagcgtgctgcctgctctcagcagcaccccttgcgtaatgcttggtccctttgcaggcgccagccagggactcctgctgatccmatcctgcccacctctcccccatacccacctcctcccagcccctcagctgtcactcgttcaatacctcctgcaaccacaaatcactgggacaggaagacgc

SEQ ID NO: 57763 - DNA, 201 bp, Homo sapiens
gatatcacagagtgatactttaacctgcagaccttctgctgggcacacaggtgggcacaggtgggcagaggctccctggatgaccaatgtgaggctggggktggcagagagctcacaccagcctcctgggcacagcctgccacacactccctggtgaggagcccagagcccagcacagaggagcactccagagaggcagca

SEQ ID NO: 57764 - DNA, 201 bp, Homo sapiens
ctgctcacctcgtatgactgtggtgagaatcataacattcatgggcctgcctgtgttaccaccgccatttctattcttccaggcatgtggctgtctgtctrtgtcccatgttggcctcactcctcccaagtggagggcagcactgagatcgttgttctcatgatgaatagaaagaagctggaggcgctggccacgtgcctt

SEQ ID NO: 57765 - DNA, 201 bp, Homo sapiens
ccagggaccagggggccatgaaagatgttatgtagagaagggtcagatttaggatttgaaaattcctggcacagacagaggcttcttctcagctgatgaarctgagacatgggccagaagagccctgatggactcctagggccttggaccagatggctggaacagggtggtaggactggttggcaccatgccctgtgtccc

SEQ ID NO: 57766 - DNA, 201 bp, Homo sapiens
atcttggaaggtctggaagagcagggccaaacattctgagtagggagctgtgtggatagggccaggaggcctggccgctgttacagactgcctctagcccrgctgtgtgacctccctccctggcctgtttccccatctctgccctgctcacctcgtatgactgtggtgagaatcataacattcatgggcctgcctgtgtta

SEQ ID NO: 57767 - DNA, 201 bp, Homo sapiens
gaagtctgcgagcttccgggaagtaagtgaaacctgtaattgaaatggctggatcccaaacaagtaatgaagtcactttcaaagcagttctctacaattcwacagttcataaaagcagagttggaattccacaccagctccctagggctggccttgcgtaacagctgcccttcctgtaccctctggggcttcctcctcttc

SEQ ID NO: 57768 - DNA, 201 bp, Homo sapiens
aaccctgatttaagggtcaatttccttggaagagaggaaaaccagccaagctgtcgtaggaaatcttcttcttttacgtgagggtggagttgcaccacttmttttcagagagtactaggcaggacttacgatgtatgactcaaagagcagaaaaagacctcacaaaccctaacacctctccttctagcccagaaattcacc

SEQ ID NO: 57769 - DNA, 201 bp, Homo sapiens
tcaataagctgtttggtgagaagtctgcgagcttccgggaagtaagtgaaacctgtaattgaaatggctggatcccaaacaagtaatgaagtcactttcaragcagttctctacaattcaacagttcataaaagcagagttggaattccacaccagctccctagggctggccttgcgtaacagctgcccttcctgtaccct

SEQ ID NO: 57770 - DNA, 201 bp, Homo sapiens
aataaacctgcttccaaacaacaatacatttgttgtcatttcattaggtctgcagatcatagaccttgactcctaggagttgagcattatgactcacttgygagaactcagaaaaaatagacaggatgaaggagccaaggacataacaaccttcattcaaaaagacccaatgttgagggtcagtgggatggggttgtatga

SEQ ID NO: 57771 - DNA, 201 bp, Homo sapiens
tgtattccaaatgagacattttaatacaaataaattccaatcactttcttaaaaaaaaagagttcatgaatcaagggttcacgcaagaaagaagcgaccartggtccttgttggagagcaatgctgtgtgagaccacaggtgtacacagccaagaccagagccagaggacatgcttcctcctgggtacttccagcccctcc

SEQ ID NO: 57772 - DNA, 201 bp, Homo sapiens
tcctcctgggtacttccagcccctccccagttcggggaaggcactgtcataagaaggtttcctgagggatgatcagtatcagcattgtttggtatatttayatattttgataattatcgggtatgttgcaagctatgatgaaagcaaaacatacagctggaaagacgatcattggtcaggaccaaaaaacacacacacctt

SEQ ID NO: 57773 - DNA, 201 bp, Homo sapiens
caaatttttgagccatccaatgtaatctagtatctatgatgaagcaagagaaaaaaaaaagtgactttttgtttttacttcctaataagccttctagtagrattacaggtttactacttttttcttttgacttcctctttctagcatttcttgcactacaacttgcttaagctcttacacttcatagtgaagctatgcacc

SEQ ID NO: 57774 - DNA, 201 bp, Homo sapiens
tctttagagttaaatatttttactatcaaagttactatgtggattgttacaaagaatccggtatgaattgttacaaagaatcacgtatttaggtatgggaraagtctaaatttatgtttgtggctctgatctcttatttacatttctcacatggggatcgagaaatattttatttgtgttattaatactcagtttgtttcc

SEQ ID NO: 57775 - DNA, 201 bp, Homo sapiens
gtgacctcatcctcccccaaaatttcttaaaccatgcctttacaaacaagtatttctattctaatgatgtcttcctgagtaaaatgttgaatcactcaaargacacagatcaaaagacagagggagaaaaaaaaatgccatgtgggaggggcaaagctgtataaaaccagtcattaccatgtctgaactgtaacaactctc

SEQ ID NO: 57776 - DNA, 201 bp, Homo sapiens
tatgattatcttgtatacattttcctagaaaataagacactttctgtttcattaatctcatattccgtaggagtgacctgctctgcaattgttgcctgtaytatttcaggttatttgagaaagcttaatctgatgtattttctattggtaaggaacactctttagtgactgtgctttttttctagttgacctactggctgg

SEQ ID NO: 57777 - DNA, 201 bp, Homo sapiens
tgcatctcagttttctcatctacaaaatgggaataaaaatgtgtagcatgcaagaaagttgtgaagattagaggtactatgtaaggcacttagtagcagtygctataataacaaccaatacttattagtgccttagccaggcatctttctaagaacttcttataaatttactcacataagacaaaatattatgaggtaggt

SEQ ID NO: 57778 - DNA, 201 bp, Homo sapiens
aaacagttttattaactataactattaatgaacacaatcttattaactatagtcattatactgtacattagatccccagaacttatccatcttataaatayaacaaaaattccttagagactttgaagtttaggaaactgagaaggggcctttcttctaggctgttggtcacctggttaaatccaatccatagacagagca

SEQ ID NO: 57779 - DNA, 201 bp, Homo sapiens
cctcatgctgttttctataagggaaatttaggttggctgatacttttatattacacagaaagagtattgagtatctatggttgttccccatgtataagggmagggaaaagatctaggaccattttagagccacctgatagccatctgttttaaaagttcagtaaatccgtgggcaagtgtaaccgttttctctaattctga

SEQ ID NO: 57780 - DNA, 201 bp, Homo sapiens
gtgggagaaaacaaggtattgtaaatatttctttggttaatgattttatttatgtttttcttcttggttgaagtgcccagctaggtaacaaataatgaagyccccttcccccaaaaaagtccagaaataatagataaggcccaatcccttaagaatttgtctgtataagtcagagagtaacctgagctggtttgaagtttg

SEQ ID NO: 57781 - DNA, 201 bp, Homo sapiens
acgtgcagctaatttttgtatttttagtagtgacagggtttcaccatgctggccaggctggtctcaaactcctgacctcaagtgatcctcccgcctcggcmtcccaaagtgctgggattacatgcatgagccaccacacccggccataagatctattttataatcaagagaagatgaaaaattcttcttgtgtcaggatat

SEQ ID NO: 57782 - DNA, 201 bp, Homo sapiens
ggaaggaagcgaatataccctcccccattcacagaaagaaaactaagactcagagtcattaagaaaaacatgtcctaagatgatacccataacgagagacragccaggacagaatccagacttcatgagttttaggccaagcctatttacttctaaattctctcatgcctctctgtcattggtgaggtatgtgtaatttat

SEQ ID NO: 57783 - DNA, 201 bp, Homo sapiens
acagagggagaaaaaaaaatgccatgtgggaggggcaaagctgtataaaaccagtcattaccatgtctgaactgtaacaactctcagaggagcattgcccrtcagacagcaactcagagaataaccagagaacaaccaggtatttcaatgatttccatgccatgtctatgggaaatagggtttcatgttttctcttccctc

SEQ ID NO: 57784 - DNA, 201 bp, Homo sapiens
aattgattgagaaatggcagaaggctgggcccaatgattgcatgagaaatcactgaccttcaggtaactttccttctatctatctaatctatcatctatcrttgatctctctcatctatcttacctatcatacatctatcaatcctatctatctatatattttatgaatcatctatttatcatctatcttctctgtcatct

SEQ ID NO: 57785 - DNA, 201 bp, Homo sapiens
agcgtcgaatgctgcttaaacaatacagacttgtttattataatatctcagcaacagcaagaacaaaaactagaggtaggtggtttctagcactggccaawgtcagagctcttgtttgggatcgctgcaaatttctcagtcttcctatatggttgaaatatgactgtgactgtggcatcttctggcatcacatcctcgcac

SEQ ID NO: 57786 - DNA, 201 bp, Homo sapiens
tcacaggctcctgcctccctctgtatattttacaatgaataaattatttaattgaatcatttattcattgtaatttagtttattaagtcatttattcattraattcattcattcattaagttctattaagttcattcacttagtcaacaaatatttatccaccacacaccatattccagaaactatatgtggagataaaga

SEQ ID NO: 57787 - DNA, 201 bp, Homo sapiens
tatattttacaatgaataaattatttaattgaatcatttattcattgtaatttagtttattaagtcatttattcattgaattcattcattcattaagttcwattaagttcattcacttagtcaacaaatatttatccaccacacaccatattccagaaactatatgtggagataaagataaaaatggtaaatcctgccacc

SEQ ID NO: 57788 - DNA, 201 bp, Homo sapiens
tgttacactccctaacaaagctgacttcatgtgcagactttctcacactcatagctggcccagggccacttcttaaaataggtgaggtttgttttctttgscctgtctctcgggaccttgcctcccggtggcctaagcctatgcttattcaaagccttctcattctcctatcctcgtcacacaccccgaaactccttcctg

SEQ ID NO: 57789 - DNA, 201 bp, Homo sapiens
ttacaatgaataaattatttaattgaatcatttattcattgtaatttagtttattaagtcatttattcattgaattcattcattcattaagttctattaasttcattcacttagtcaacaaatatttatccaccacacaccatattccagaaactatatgtggagataaagataaaaatggtaaatcctgccaccatagag

SEQ ID NO: 57790 - DNA, 201 bp, Homo sapiens
ctgaatgacagaacactggatttttgttcagatagcctatcaacttggcatctgtgttgcggttgtcacttggtaacaagataagtacttcgacagaggtrttacactccctaacaaagctgacttcatgtgcagactttctcacactcatagctggcccagggccacttcttaaaataggtgaggtttgttttctttgcc

SEQ ID NO: 57791 - DNA, 201 bp, Homo sapiens
aatggtaaatcctgccaccatagagcctatagaggagggattcagtcatgttggcaattgctatagagtagtagtcagtgctttcattgagaagtacaggygctatgtgggagtacacaggaaaggcatctgactggatttaaaaatgattaaattgtaattgggaagacaggctggagctggccaggtggagggtgcatg

SEQ ID NO: 57792 - DNA, 201 bp, Homo sapiens
tatcatcagaaaggcaagaggcccttgggagtgtctcatggaaaacgggacaagaatcctccccactctccagatcttctttctcctcctgatggttctcyatcatgtaatctctctctttagccactaaaatcttaaacacaatgagatacaatggcaagagcaactgtattcacagtcaagataacacagttgcagttt

SEQ ID NO: 57793 - DNA, 201 bp, Homo sapiens
tggtaaatcctgccaccatagagcctatagaggagggattcagtcatgttggcaattgctatagagtagtagtcagtgctttcattgagaagtacaggtgytatgtgggagtacacaggaaaggcatctgactggatttaaaaatgattaaattgtaattgggaagacaggctggagctggccaggtggagggtgcatgcc

SEQ ID NO: 57794 - DNA, 201 bp, Homo sapiens
tgacagtgaaaatccttcattcttctgaatttccaggtagagttgtaggccttaagtaaacaattgctgaataataacatataaatgtatttctaagaaayagagatgattatgaattcagaattgtgtaagtatttcattcatttatgatctgttaggattgaaaatgtcctaagagagctcctatccatcttaccaatt

SEQ ID NO: 57795 - DNA, 201 bp, Homo sapiens
ataaggtttaattttgaatctcagaagccaacaaatacctttgtagcattaaccaaaacaaaatgtacattcagattgtgatgccaattttattgaacagrttagattatatatgttctctactagctactgttttgacactaaatttgatggaaacaactagatacattaaaatattttcatttaagcaattgaatgtaa

SEQ ID NO: 57796 - DNA, 201 bp, Homo sapiens
aacagctttattgaagtggcagtattacagctccatgattcctcctgcagagaagggctaccccaggcactgtgctgagaggcacagctcagggcagtttkggggtcatatttatacctacttttaattacatgtagattaaggggcagtttacgcagaaatttctagggaacggggaataacttttgggtcatcaggtca

SEQ ID NO: 57797 - DNA, 201 bp, Homo sapiens
tcagactgggaaggaagcgaatataccctcccccattcacagaaagaaaactaagactcagagtcattaagaaaaacatgtcctaagatgatacccataaygagagacgagccaggacagaatccagacttcatgagttttaggccaagcctatttacttctaaattctctcatgcctctctgtcattggtgaggtatgtg

SEQ ID NO: 57798 - DNA, 201 bp, Homo sapiens
ctcaactgtagctgttgaaggcatatgggagttgaatagcctgcaaggctggagacagttatgagtgaccacatcttatattttaataatataatattctyatttttcaaagttagtgttttgtacccattatctcattcagttttaagacagatatcattttacagatgagagccctggtggtgtcagagaagcccccac

SEQ ID NO: 57799 - DNA, 201 bp, Homo sapiens
ccagtggtccagacacagaagaaggcctcagtcattgagctcagagttgcaagcagtgaagatgggagatgggttgggtgcaagagcaggaggggaaacawaagatggctctttctaagtgtgtttgtttctaatagcagtaatgcttttgaatgagtcagaggcagaggagaacataattgaagacctgagaaataaggc

SEQ ID NO: 57800 - DNA, 201 bp, Homo sapiens
ggattttcatttaactcttatgtttaagacattgtttcaagaaatagtttggtgtcttgctttattaattaccacaatggaaaatgcacataaactaagtkctatgggatttcaaaaaatatatatttatttgtttatctgaaaataattgatttccttttagttcttcattttcattgtggatttgtgaaatactgttct

SEQ ID NO: 57801 - DNA, 201 bp, Homo sapiens
ggagatgggttgggtgcaagagcaggaggggaaacataagatggctctttctaagtgtgtttgtttctaatagcagtaatgcttttgaatgagtcagaggyagaggagaacataattgaagacctgagaaataaggcaaattgtaggttgggggcctgaacaacagagtctggctgcagaagtgcggctggatcctggaaa

SEQ ID NO: 57802 - DNA, 201 bp, Homo sapiens
ggcatctttctaagaacttcttataaatttactcacataagacaaaatattatgaggtaggtacgatgattaccgtactcattttacagatgagggaatcrgggcaagaagaggccacacagttgagaattgctgtagctgttagaagtggtacatttgtagtgaaagaaaagaatacataaaagatataagctcctggat

SEQ ID NO: 57803 - DNA, 201 bp, Homo sapiens
ataggcgtgagccagtgcacccggcctaggtttttttgttttttaaatgtaaaggaatcagtagcaatatattttgggagcaaatgctaaatgaagtgctstgggttgttaaagtaaaaatcttgattttggtactagaggaaaataaactgattgctctggacacaagacagcttttctgtgtctaagaagtgctttaag

SEQ ID NO: 57804 - DNA, 201 bp, Homo sapiens
ctgataaagagatttcaaaaagtgtatattggagaatgttttagccaagatgtcccaaattcacaccatggaggtgactgccttcacctccatttggttckgctcacagcaacaactacttaaatttctggaataaatcatgctatctaactactaaggctaattaatactaatgatctttgctataaattaacatagttt

SEQ ID NO: 57805 - DNA, 201 bp, Homo sapiens
atgttcttgttgcttccagatgaaattgccgatgtgtccactggcttggagctggtaagacattcagatatttaagtttctggggctatacctacctttcgtgagatgagatgaatatatactccttacaaatggtgtggtaatttctcatggaaatatatgaaacagttgatagtaaatatggcatgcctctacatttca

SEQ ID NO: 57806 - DNA, 201 bp, Homo sapiens
tgttcttgttgcttccagatgaaattgccgatgtgtccactggcttggagctggtaagacattcagatatttaagtttctggggctatacctacctttcgtgagatgagatgaatatatactccttacaaatggtgtggtaatttctcatggaaatatatgaaacagttgatagtaaatatggcatgcctctacatttcat

SEQ ID NO: 57807 - DNA, 201 bp, Homo sapiens
gttcttgttgcttccagatgaaattgccgatgtgtccactggcttggagctggtaagacattcagatatttaagtttctggggctatacctacctttcgtgagatgagatgaatatatactccttacaaatggtgtggtaatttctcatggaaatatatgaaacagttgatagtaaatatggcatgcctctacatttcatt

SEQ ID NO: 57808 - DNA, 201 bp, Homo sapiens
catctcgtccaccatggccatggtctacatgggctccaggggcagcaccgaagaccagatggccaaggtgagtttgagctgaagctccacatttgggccgmgtagttcctgaatggaattggagaactgctcttgttttatgctaaagacattttaactcaggaggtcagcaatcatcacaggtaatgaagcactgatcct

SEQ ID NO: 57809 - DNA, 201 bp, Homo sapiens
ttcttgttgcttccagatgaaattgccgatgtgtccactggcttggagctggtaagacattcagatatttaagtttctggggctatacctacctttcgtgagatgagatgaatatatactccttacaaatggtgtggtaatttctcatggaaatatatgaaacagttgatagtaaatatggcatgcctctacatttcattc

SEQ ID NO: 57810 - DNA, 201 bp, Homo sapiens
tagaaaaaagattaattcctgggtcaagactcaaaccaaaggtaaatccaagaaaatattttatttacttctttccagttagaaaactctgatctatcttkttccatccatgaacttagttagccctcacccctttacaatttgtccaactgcagttactttggtggatgtgaatttattcctgattagctcagtggtgtt

SEQ ID NO: 57811 - DNA, 201 bp, Homo sapiens
acggttcctggcccatagtaagaactaaacaagtgttttagaattatggttgtcattaccattgttgtccatcttactaaataatgggtataaagttgaayaagctaataacatcagagtacccactgtaaggatgtacaaataatttattttgttgatttaaaaaaatcacatttatcctacactaaagtagaaccaatc

SEQ ID NO: 57812 - DNA, 201 bp, Homo sapiens
cttgttgcttccagatgaaattgccgatgtgtccactggcttggagctggtaagacattcagatatttaagtttctggggctatacctacctttcgtgagatgagatgaatatatactccttacaaatggtgtggtaatttctcatggaaatatatgaaacagttgatagtaaatatggcatgcctctacatttcattcaa

SEQ ID NO: 57813 - DNA, 201 bp, Homo sapiens
tgatagtgagttctcatgagatctggtcacttaaaggtgtgtggcaactcccccaaccctctctctctcttgttcctgcttctatcatatggtatgcctgcccccccctttgccttctgccatgattataagcttcctgaggcctccccagaagctgagcagatgccatcactatgcttcctatacagcctgcagaactgt

SEQ ID NO: 57814 - DNA, 201 bp, Homo sapiens
gatggaaacatgatgtgtccagcttcggaccatggacatgggtgcagccataatgaggggaggggtcatggctggagatagagttgcgggagtctttgttrtctctttctttttcccccacccaccactcacatccgattcacattctcatcttcctgcccatacactcagtgtattatgactaatcaacaggggaagaac

SEQ ID NO: 57815 - DNA, 201 bp, Homo sapiens
gtgtccagcttcggaccatggacatgggtgcagccataatgaggggaggggtcatggctggagatagagttgcgggagtctttgttgtctctttctttttyccccacccaccactcacatccgattcacattctcatcttcctgcccatacactcagtgtattatgactaatcaacaggggaagaactgagcaataatttt

SEQ ID NO: 57816 - DNA, 201 bp, Homo sapiens
ctttacaaattacccagtcttgggcatttccttacagcaatgcaagaatggcctaatacatagggggtttaatcaagaagtgaggaagaaatctggagaasgttttgagggaaaaaatgaataaaacttaatctttgactttagggaagatgaaaccatttgttgcataaatccgcaaaatctacattgatgcctttacta

SEQ ID NO: 57817 - DNA, 201 bp, Homo sapiens
ggtatgtatgcaggtggcatatatttcaatatgtgtatatcttcctgtgtggcagtgtgtgtggtgtggatgtgtgcgttgtgcttgtgggggcagcataraagttgagagcatgatcctagggtctgcctatctggcttcaattcctactcctgtccctatatattgtcattgttattctatggaatgccacaaagtgtc

SEQ ID NO: 57818 - DNA, 201 bp, Homo sapiens
attttggccaggctggtctcaaactcctgaccttgtgatccacctgcctcggcctcccaaagtgctgggattataggcgtgagccagtgcacccggcctasgtttttttgttttttaaatgtaaaggaatcagtagcaatatattttgggagcaaatgctaaatgaagtgctctgggttgttaaagtaaaaatcttgattt

SEQ ID NO: 57819 - DNA, 201 bp, Homo sapiens
ttttcttttttcctttcttttttttgagatggagtctcgccctatcacccaggctggagtgcagtggtgcgatcttggctcactacaacctccaactcccrggttcaagccattctcctgcctcagcctcccgagtagctgggattacaggcgcctgccacgatgcccatctaatttttgtattagtagagatggggtttc

SEQ ID NO: 57820 - DNA, 201 bp, Homo sapiens
gggatatgggagaaagaacattcattcccaaaaaaagttagagaaattgtttttctaggaattgtggagtggaatttgctccttgttttactgggaattgwgaaatcatcagtggagtttcctccagtcacatttatgtatctgtcaacataggcagagataaataaaatattctctcaggacggttgagccaaaaccctt

SEQ ID NO: 57821 - DNA, 201 bp, Homo sapiens
caaagggtggagctaagaacagggaggtgctaaaattttttttttttttttaatttcttcagttgaaagtttctcaactcttcagccacaatctcttactrcaggagcaaattgccaattctgctccagtgggagaaaacaaggtattgtaaatatttctttggttaatgattttatttatgtttttcttcttggttgaag

SEQ ID NO: 57822 - DNA, 201 bp, Homo sapiens
taattatggaagtatcactgtttgctcttcaaagtgaagaggatagaaatgcattacaatgtgccaaacatgagtaagtcattcagcaaacactaagtgarcacctaatatgagccaaatgcctgtcctagccactggggaaaaccattatagtcttggagttcatggttgttaccatccagcagggaagataggcactga

SEQ ID NO: 57823 - DNA, 201 bp, Homo sapiens
ctcagctctttgctcaagaccctaacacacattatcaatcgtttcccttctttctatgatacttactattagcaccactcaatttgggtttaagttacatrttatcttttacaagtctctctagttgtttgaggtgtgaaagtctagtcttcttatactagagctcataaattgctctaatctaggcagaaaggcagctcc

SEQ ID NO: 57824 - DNA, 201 bp, Homo sapiens
attatttcttcattttttcttggattttgcaagcttttgggaaatttgtttcaattttaattttgctttaaataaacctaaaaaactttagcttgaagatkaacaactctgcaatttgaagaatttagtttgatggctactcagaagattcagtaagtaatttcacagttcttgattatgaaacctaaatatatgttatgt

SEQ ID NO: 57825 - DNA, 201 bp, Homo sapiens; identical to SEQ ID NO: 10851

SEQ ID NO: 57826 - DNA, 201 bp, Homo sapiens
gagttaatcttgtgactttctttaaaatactggcatttttttttcaagaccatttattggttggatataatttagataatttggggaagaggttttaaatyatttcataataacaatttgttttccaaaatggccaggatataaattaatctaaaacacctcatgctgttttctataagggaaatttaggttggctgatac

SEQ ID NO: 57827 - DNA, 201 bp, Homo sapiens
atataaattaatctaaaacacctcatgctgttttctataagggaaatttaggttggctgatacttttatattacacagaaagagtattgagtatctatggytgttccccatgtataagggaagggaaaagatctaggaccattttagagccacctgatagccatctgttttaaaagttcagtaaatccgtgggcaagtgta

SEQ ID NO: 57828 - DNA, 201 bp, Homo sapiens
tttttgggtaggtccagtatgtcacacttatcctatgcccccacaaaaatttgcacagttttttgctgacagtgaaaatccttcattcttctgaatttccrggtagagttgtaggccttaagtaaacaattgctgaataataacatataaatgtatttctaagaaacagagatgattatgaattcagaattgtgtaagtat

SEQ ID NO: 57829 - DNA, 201 bp, Homo sapiens
tggagagaattgtctgtttcatcatgctatgatcaaatactagttttatcatatacatcacaacattactataccccaatactaaccaaaaattttaatarcttgggaaatatattgaatgtatatattaaatgaatacattgaagatgaaactgatgcaaggcaggcaagctccaaagtggggcttagccttcaagggtt

SEQ ID NO: 57830 - DNA, 201 bp, Homo sapiens
aaaaattccttagagactttgaagtttaggaaactgagaaggggcctttcttctaggctgttggtcacctggttaaatccaatccatagacagagcaaaaytggaaagaaattaaaattcaccttattagttttaatgtaccacatccttatcgaaatgattttctcaaagattcctctaatgtaccaaaaataaagtatg

SEQ ID NO: 57831 - DNA, 201 bp, Homo sapiens
gctggagtgcagtggtgcgatcttggctcactacaacctccaactcccaggttcaagccattctcctgcctcagcctcccgagtagctgggattacaggcrcctgccacgatgcccatctaatttttgtattagtagagatggggtttcaccattttggccaggctggtctcaaactcctgaccttgtgatccacctgcct

SEQ ID NO: 57832 - DNA, 201 bp, Homo sapiens
ggggaaaacagacatcccagtcattcaagtgatgctctgggttctacaccaatgctctaaatgagaacagaaaatcttccggggtgcctttcacatagtawctgagagccatttttaacaggcttacaataaaggccaggcatgatgggttgtgcctgaaatcccagcactttgagaggccagaggtgggaggatcacttg

SEQ ID NO: 57833 - DNA, 201 bp, Homo sapiens
aaagaaaacaaggcttgaccctgagcttagtaaatggtgtgagctataaagaatacaggcagtggaggagggaagaatcataaaattattttcactctttyttctctttcaccattcaaagccaatccattgtcaagtttttttggtctctgcttcatccctccttgattatctaagtcacgtctaccattttaactcatg

SEQ ID NO: 57834 - DNA, 201 bp, Homo sapiens
gcccagctaggtaacaaataatgaagaccccttcccccaaaaaagtccagaaataatagataaggcccaatcccttaagaatttgtctgtataagtcagasagtaacctgagctggtttgaagtttgtactagaaaaagggatatgggagaaagaacattcattcccaaaaaaagttagagaaattgtttttctaggaatt

SEQ ID NO: 57835 - DNA, 201 bp, Homo sapiens
aggtaaaggggaagactgtggctttttaattatacatgcccagactccaacgttggctctaccacttatttcaaagggctgtaaatattgagacatggcayggttcctggcccatagtaagaactaaacaagtgttttagaattatggttgtcattaccattgttgtccatcttactaaataatgggtataaagttgaaca

SEQ ID NO: 57836 - DNA, 201 bp, Homo sapiens
gtaacctgagctggtttgaagtttgtactagaaaaagggatatgggagaaagaacattcattcccaaaaaaagttagagaaattgtttttctaggaattgkggagtggaatttgctccttgttttactgggaattgtgaaatcatcagtggagtttcctccagtcacatttatgtatctgtcaacataggcagagataaat

SEQ ID NO: 57837 - DNA, 201 bp, Homo sapiens
tgtttttctaggaattgtggagtggaatttgctccttgttttactgggaattgtgaaatcatcagtggagtttcctccagtcacatttatgtatctgtcamcataggcagagataaataaaatattctctcaggacggttgagccaaaacccttcaactctttaggaaatgtgagcttggcaccctgaatttggatcctat

SEQ ID NO: 57838 - DNA, 201 bp, Homo sapiens; identical to SEQ ID NO: 10844

SEQ ID NO: 57839 - DNA, 201 bp, Homo sapiens
ggctttttaattatacatgcccagactccaacgttggctctaccacttatttcaaagggctgtaaatattgagacatggcacggttcctggcccatagtamgaactaaacaagtgttttagaattatggttgtcattaccattgttgtccatcttactaaataatgggtataaagttgaacaagctaataacatcagagta

SEQ ID NO: 57840 - DNA, 201 bp, Homo sapiens
catcaggtcattgccacagaaagaggtggtaactccaaggtgttgccatcacaatggtaaactgacatggtacactgcttccatcctgtccctggtccccrttttagctagccctcaatttggcctggtgtctaaaacctgcctccagagtcaggtcccacctcctacttcaaaaccacattgacctattaatttgttaag

SEQ ID NO: 57841 - DNA, 201 bp, Homo sapiens
agcatctcgtccaccatggccatggtctacatgggctccaggggcagcaccgaagaccagatggccaaggtgagtttgagctgaagctccacatttgggcygagtagttcctgaatggaattggagaactgctcttgttttatgctaaagacattttaactcaggaggtcagcaatcatcacaggtaatgaagcactgatc

SEQ ID NO: 57842 - DNA, 201 bp, Homo sapiens
aatgaatacattgaagatgaaactgatgcaaggcaggcaagctccaaagtggggcttagccttcaagggttcttggcttcacccaggaaagtattcaaggrtgagctggaggtagggtagaagaaaacagctttattgaagtggcagtattacagctccatgattcctcctgcagagaagggctaccccaggcactgtgct

SEQ ID NO: 57843 - DNA, 201 bp, Homo sapiens
tctcgtccaccatggccatggtctacatgggctccaggggcagcaccgaagaccagatggccaaggtgagtttgagctgaagctccacatttgggccgagkagttcctgaatggaattggagaactgctcttgttttatgctaaagacattttaactcaggaggtcagcaatcatcacaggtaatgaagcactgatcctta

SEQ ID NO: 57844 - DNA, 201 bp, Homo sapiens
gtttctaaaaaaggccttaggtgaatagagaggtgctggggattggggaagctgtcattctctgatatgcacaactccatgaggaggtaatattatcagtrtcatcagaaaggcaagaggcccttgggagtgtctcatggaaaacgggacaagaatcctccccactctccagatcttctttctcctcctgatggttctcca

SEQ ID NO: 57845 - DNA, 201 bp, Homo sapiens
aaaaatcttgattttggtactagaggaaaataaactgattgctctggacacaagacagcttttctgtgtctaagaagtgctttaagcctttgggactatgmgaggattctatatagtctttttttttttgagactctatatatatcgtcttttgacaactctgttgcatgtgtagattttgaaattcaaatgttaatatga

SEQ ID NO: 57846 - DNA, 201 bp, Homo sapiens
cttctgacctacacatttgcagtcttctctgaaaatataattgtccaacatttgtatggaataattatttcctgtaaaatttcacctcacaattctacacycttcagaaagtatttttcattgttgggttaaatatcactaatggatggcttagtacttcattagatttctttaaaaaaagaaaataaagaattgtttctc

SEQ ID NO: 57847 - DNA, 201 bp, Homo sapiens
gagtaactaaacaactcaggcaaacccttaactgtctctttctgtctttttattgagacttctgacaaaaataagcctgaaagaaagagtatacatgcttktgaaactgaatcaaagggtggagctaagaacagggaggtgctaaaattttttttttttttttaatttcttcagttgaaagtttctcaactcttcagccac

SEQ ID NO: 57848 - DNA, 201 bp, Homo sapiens
attgcaccactgcccttcagtctgggtgacagagtgagaccctatttctagaaaaaacaaaacagacacaacacaaattaataattcagtaatattttcartttcattgatcattattattccactaatttgaagctttctatttgtgttttataaaaaaaatactacctgggaaaaccatgccaaatattctctgttggc

SEQ ID NO: 57849 - DNA, 201 bp, Homo sapiens
aatacaacaaaaattccttagagactttgaagtttaggaaactgagaaggggcctttcttctaggctgttggtcacctggttaaatccaatccatagacasagcaaaattggaaagaaattaaaattcaccttattagttttaatgtaccacatccttatcgaaatgattttctcaaagattcctctaatgtaccaaaaat

SEQ ID NO: 57850 - DNA, 201 bp, Homo sapiens
gtacttggaggtggttcctttggaagataattagggttagatgaggtcatgagggcagaatccatgatggaattactgccctcataaggagctctaggcamcagatctttttctatctgtcatgtgaggatataacaagaaagcagtcatctgtgaatcaggaagaggccctcactagaacctaaccatgtggaaacaccc

SEQ ID NO: 57851 - DNA, 201 bp, Homo sapiens
tgtacaataaatctatttaattatgaagacaattttaagaggaagaggaacaaatttttgagccatccaatgtaatctagtatctatgatgaagcaagagaaaaaaaaaagtgactttttgtttttacttcctaataagccttctagtagaattacaggtttactacttttttcttttgacttcctctttctagcatttct

SEQ ID NO: 57852 - DNA, 201 bp, Homo sapiens
cgatgtgtccactggcttggagctggtaagacattcagatatttaagtttctggggctatacctacctttcgtgagatgagatgaatatatactccttacaaatggtgtggtaatttctcatggaaatatatgaaacagttgatagtaaatatggcatgcctctacatttcattcaaagccttaactatgtcatacgtgtt

SEQ ID NO: 57853 - DNA, 201 bp, Homo sapiens
tactatgtaaggcacttagtagcagttgctataataacaaccaatacttattagtgccttagccaggcatctttctaagaacttcttataaatttactcayataagacaaaatattatgaggtaggtacgatgattaccgtactcattttacagatgagggaatcagggcaagaagaggccacacagttgagaattgctgt

SEQ ID NO: 57854 - DNA, 201 bp, Homo sapiens
ccaggtagagttgtaggccttaagtaaacaattgctgaataataacatataaatgtatttctaagaaacagagatgattatgaattcagaattgtgtaagyatttcattcatttatgatctgttaggattgaaaatgtcctaagagagctcctatccatcttaccaatttgtggttggagcatcctgttcccaggggatta

SEQ ID NO: 57855 - DNA, 201 bp, Homo sapiens
ttttattgagacttctgacaaaaataagcctgaaagaaagagtatacatgcttgtgaaactgaatcaaagggtggagctaagaacagggaggtgctaaaattttttttttttttttaatttcttcagttgaaagtttctcaactcttcagccacaatctcttactacaggagcaaattgccaattctgctccagtgggaga

SEQ ID NO: 57856 - DNA, 201 bp, Homo sapiens
ttattatggccagccctgaaaaccaaggtagatgggatgcacaacatcattgtgagggatttctgcaaggccactgcctgccttccttggtgaatggacgyggactcagtcaggaaactctttccacggagtctgggcccttgaaattatgccggactacttcaattatacactgcaatcgttactgtaatagtcactcag

SEQ ID NO: 57857 - DNA, 201 bp, Homo sapiens
gggcctttcttctaggctgttggtcacctggttaaatccaatccatagacagagcaaaattggaaagaaattaaaattcaccttattagttttaatgtacyacatccttatcgaaatgattttctcaaagattcctctaatgtaccaaaaataaagtatgtattaatatagcatttcatgattgtattcaaaaactattac

SEQ ID NO: 57858 - DNA, 201 bp, Homo sapiens
caagcagctattttggcagattgttttaccagcttttgtaagaattggagagaattgtctgtttcatcatgctatgatcaaatactagttttatcatatayatcacaacattactataccccaatactaaccaaaaattttaatagcttgggaaatatattgaatgtatatattaaatgaatacattgaagatgaaactga

SEQ ID NO: 57859 - DNA, 201 bp, Homo sapiens
tcagttattttgccaaaatgccaagcagctattttggcagattgttttaccagcttttgtaagaattggagagaattgtctgtttcatcatgctatgatcraatactagttttatcatatacatcacaacattactataccccaatactaaccaaaaattttaatagcttgggaaatatattgaatgtatatattaaatga

SEQ ID NO: 57860 - DNA, 201 bp, Homo sapiens
aaacaagtaatgaagtcactttcaaagcagttctctacaattcaacagttcataaaagcagagttggaattccacaccagctccctagggctggccttgcrtaacagctgcccttcctgtaccctctggggcttcctcctcttcccattgcaaatgtcccaatctcagagtcataaatcaggaaaacaaatgcaactgttt

SEQ ID NO: 57861 - DNA, 201 bp, Homo sapiens
atatataaagaattccttctttcttttcaaggcacaagctgcagataaaatccattcatccttccgctctctcagctctgcaatcaatgcatccacagggrattatttactggaaagtgtcaataagctgtttggtgagaagtctgcgagcttccgggaagtaagtgaaacctgtaattgaaatggctggatcccaaacaa

SEQ ID NO: 57862 - DNA, 201 bp, Homo sapiens
ttgtacatgttcaagatgtacagtgtgatgacttgctatacctatacattgtgaaatgattacagtcaaattaatgagcacatccatcactacaattaccyaccatttgtatgtatgtgtgtatgtatagtgaggacacttaaaaaatatattcttcacaaatttcaagtaaacagttttattaactataactattaatga

SEQ ID NO: 57863 - DNA, 201 bp, Homo sapiens
ttaatgaagtgggagccaatgcagttacccccatgactccagagaactttaccagctgtgggttcatgcagcagatccagaagggtagttatcctgatgcvattttgcaggtatctgacttactggtccaaatttcttttgtggtttatttttgcaatcttcctgtcttaaagccacagtgtcagactgggaaggaagcga

SEQ ID NO: 57864 - DNA, 201 bp, Homo sapiens
ccatgttttccactgcatagtttgccccataaaataggtatctagagaagctatatgaactttgtaagatcattactaaggcaacatttcctccctgccarctttactgaggtataatggacaaataaaaattgtacatgttcaagatgtacagtgtgatgacttgctatacctatacattgtgaaatgattacagtcaaa

SEQ ID NO: 57865 - DNA, 201 bp, Homo sapiens
aaggatttccagaggagagagggtagggactgacaattgattgagaaatggcagaaggctgggcccaatgattgcatgagaaatcactgaccttcaggtawctttccttctatctatctaatctatcatctatcattgatctctctcatctatcttacctatcatacatctatcaatcctatctatctatatattttatga

SEQ ID NO: 57866 - DNA, 201 bp, Homo sapiens
gggtagttatcctgatgcgattttgcaggtatctgacttactggtccaaatttcttttgtggtttatttttgcaatcttcctgtcttaaagccacagtgtyagactgggaaggaagcgaatataccctcccccattcacagaaagaaaactaagactcagagtcattaagaaaaacatgtcctaagatgatacccataacg

SEQ ID NO: 57867 - DNA, 201 bp, Homo sapiens
agataatttcagtggtgatattactgctgatacagaaatgatgcattttcctaatttgtacattccccatatatccacaaatcatgtaaaataggtaattwtggaagtatcactgtttgctcttcaaagtgaagaggatagaaatgcattacaatgtgccaaacatgagtaagtcattcagcaaacactaagtgaacacct

SEQ ID NO: 57868 - DNA, 201 bp, Homo sapiens
tgcaactgttttccagagacactatcccccaagtcaaacctctttccttttattctgtctctataatgcaaggagtacaagagggtggatagagttggggwgtaagcgtggacaaaggggtctgcactctttcccccttcagcacctgccttccatagccaacctccactcccaccctaccccaggtctcctaatttcaat

SEQ ID NO: 57869 - DNA, 201 bp, Homo sapiens
agtagtcttttgcaatattctttccccattattttttattttttgccttgaaagaataaagatagtaaattggcacaaaagctttagaaacatcaggtctyaggtttttttcttttttcctttcttttttttgagatggagtctcgccctatcacccaggctggagtgcagtggtgcgatcttggctcactacaacctcca

SEQ ID NO: 57870 - DNA, 201 bp, Homo sapiens
cacattagtgttagccatatatggccttaaacaattatggaactgatttttgttagtttgttttgcttttcctctcaggctctaattatttttgggtaggkccagtatgtcacacttatcctatgcccccacaaaaatttgcacagttttttgctgacagtgaaaatccttcattcttctgaatttccaggtagagttgta

SEQ ID NO: 57871 - DNA, 201 bp, Homo sapiens
gtttggtatgtattttatgtagcctttgtcattttcttgctttaaaggaatatattcgactctgtcagaaatattactcctcagaaccccaggcagtagayttcctagaatgtgcagaagaagctagaaaaaagattaattcctgggtcaagactcaaaccaaaggtaaatccaagaaaatattttatttacttctttcca

SEQ ID NO: 57872 - DNA, 201 bp, Homo sapiens
cagacagggaatctgtccctacacagaatgcagcctgtcctactgttgctgacctcacccaaaatgttaccttatgtttcagagctgtttttttcttcctstctttgcttctagattgaaacaatggaggatctttgtgtggcaaacacactctttgccctcaatttattcaagcatctggcaaaagcaagccccacccag

SEQ ID NO: 57873 - DNA, 201 bp, Homo sapiens
gattggggtaggcaatcaacagtaccagctgtatagaattattagaaaattagaagttagagtagttgagaaatacgtgcaagattatacaactagtaaayggcaaaaagaagattctgagtctgagacttttctgagtctctcagtattcatatccttgttcaccacagtatagggcctctctagagagttttagcatgt

SEQ ID NO: 57874 - DNA, 201 bp, Homo sapiens
gcctggccaacatggtgaaaccccgtctctactaaaaataccaaaaattagccagtcgtagtggtgggcacctgtaatcccagctattcaggaggctgagrcaggaggatcacttgaacccaagaggcgggagttgcagtgagcagagatcacgccattgcaccccagcctgggcaacaagagtgaaactcgatctcaaaa

SEQ ID NO: 57875 - DNA, 201 bp, Homo sapiens
aaggctgtggtatgtgtggtgcatatagggaaggggttctgggataggggctgggtgaaactccaaaccttcaaacaatgagtcaaagtcactttagaagyaggaaagcagaaagaagattgaccgtcttaccagatgcaacaaggtatgtatgcaggtggcatatatttcaatatgtgtatatcttcctgtgtggcagtg

SEQ ID NO: 57876 - DNA, 201 bp, Homo sapiens
tcaaagcagttctctacaattcaacagttcataaaagcagagttggaattccacaccagctccctagggctggccttgcgtaacagctgcccttcctgtaycctctggggcttcctcctcttcccattgcaaatgtcccaatctcagagtcataaatcaggaaaacaaatgcaactgttttccagagacactatcccccaa

SEQ ID NO: 57877 - DNA, 201 bp, Homo sapiens
aacccatgttttccactgcatagtttgccccataaaataggtatctagagaagctatatgaactttgtaagatcattactaaggcaacatttcctccctgycagctttactgaggtataatggacaaataaaaattgtacatgttcaagatgtacagtgtgatgacttgctatacctatacattgtgaaatgattacagtc

SEQ ID NO: 57878 - DNA, 201 bp, Homo sapiens
acattttaactcaggaggtcagcaatcatcacaggtaatgaagcactgatccttacaacacaaattccttagattcaaatctataagacagccaagccccmgaatccctcaactgtagctgttgaaggcatatgggagttgaatagcctgcaaggctggagacagttatgagtgaccacatcttatattttaataatataa

SEQ ID NO: 57879 - DNA, 201 bp, Homo sapiens
ctgggcactctgaagctccttctacccattgcccagggaattatgggctagaggaggtggacaggatcctgatcatgtggagattccgccaggtgttctgyggtacctggcagtccatcaggagggctctgtcccctgccctaggacaggctgctgctgtgaccaagccctgtgtctgacatggtgcttacaaacttcagt

SEQ ID NO: 57880 - DNA, 201 bp, Homo sapiens
ttcttgctttaaaggaatatattcgactctgtcagaaatattactcctcagaaccccaggcagtagacttcctagaatgtgcagaagaagctagaaaaaarattaattcctgggtcaagactcaaaccaaaggtaaatccaagaaaatattttatttacttctttccagttagaaaactctgatctatctttttccatcca

SEQ ID NO: 57881 - DNA, 201 bp, Homo sapiens
aaaaaaaaaaaaacataccagggtggtgctcactatacccacaggatgcatggatagtgttgtagctgcagaagatcatgcctgtgaggtcacggtagcaraatgagacctggcattattatggccagccctgaaaaccaaggtagatgggatgcacaacatcattgtgagggatttctgcaaggccactgcctgccttcc

SEQ ID NO: 57882 - DNA, 201 bp, Homo sapiens
aatatattcgactctgtcagaaatattactcctcagaaccccaggcagtagacttcctagaatgtgcagaagaagctagaaaaaagattaattcctgggtsaagactcaaaccaaaggtaaatccaagaaaatattttatttacttctttccagttagaaaactctgatctatctttttccatccatgaacttagttagcc

SEQ ID NO: 57883 - DNA, 201 bp, Homo sapiens
ctttccagttagaaaactctgatctatctttttccatccatgaacttagttagccctcacccctttacaatttgtccaactgcagttactttggtggatgygaatttattcctgattagctcagtggtgttttaactgagaagaaataattgaggcctactaatagaagacatatgtttagtacttaaatatttgattttg

SEQ ID NO: 57884 - DNA, 201 bp, Homo sapiens
taaatggtgtgagctataaagaatacaggcagtggaggagggaagaatcataaaattattttcactctttcttctctttcaccattcaaagccaatccatygtcaagtttttttggtctctgcttcatccctccttgattatctaagtcacgtctaccattttaactcatgcttttaattgtttcacaggctcctgcctcc

SEQ ID NO: 57885 - DNA, 201 bp, Homo sapiens
ttcttcattttttcttggattttgcaagcttttgggaaatttgtttcaattttaattttgctttaaataaacctaaaaaactttagcttgaagattaacawctctgcaatttgaagaatttagtttgatggctactcagaagattcagtaagtaatttcacagttcttgattatgaaacctaaatatatgttatgttttct

SEQ ID NO: 57886 - DNA, 201 bp, Homo sapiens
ctctgcaatttgaagaatttagtttgatggctactcagaagattcagtaagtaatttcacagttcttgattatgaaacctaaatatatgttatgttttctrtaggcaaaatcccaaacttgttacctgaaggttctgtagatggggataccaggatggtcctggtgaatgctgtctacttcaaaggaaagtggaaaactcc

SEQ ID NO: 57887 - DNA, 201 bp, Homo sapiens
atgccggactacttcaattatacactgcaatcgttactgtaatagtcactcagcacatacaaaattcttgtgatcatgttacttccaaggttagtgacctygatgtggccatgatatcattaaaattcctttgcattcacacatacaaacattaacattaaatgctttaaggacacgcatgcattgtgcatgcagtcacac

SEQ ID NO: 57888 - DNA, 201 bp, Homo sapiens
atgttacttccaaggttagtgacctcgatgtggccatgatatcattaaaattcctttgcattcacacatacaaacattaacattaaatgctttaaggacamgcatgcattgtgcatgcagtcacaccaagatgccgccggctggtttccagtttcccacgagaatgtacctgagtgtaaatacattctttccatgcacatg

SEQ ID NO: 57889 - DNA, 201 bp, Homo sapiens
gatgagggaatcagggcaagaagaggccacacagttgagaattgctgtagctgttagaagtggtacatttgtagtgaaagaaaagaatacataaaagatayaagctcctggatggcataggtctgtgggaattaggatataagctcttttccttacagtgaggcaacagacccatccaggccaaactgcctcactattttc

SEQ ID NO: 57890 - DNA, 201 bp, Homo sapiens
ataatgttaagagagtatcacaaagggaaaaaaaaaaaaacataccagggtggtgctcactatacccacaggatgcatggatagtgttgtagctgcagaaratcatgcctgtgaggtcacggtagcagaatgagacctggcattattatggccagccctgaaaaccaaggtagatgggatgcacaacatcattgtgaggga

SEQ ID NO: 57891 - DNA, 201 bp, Homo sapiens
ctaataatgttaagagagtatcacaaagggaaaaaaaaaaaaacataccagggtggtgctcactatacccacaggatgcatggatagtgttgtagctgcaraagatcatgcctgtgaggtcacggtagcagaatgagacctggcattattatggccagccctgaaaaccaaggtagatgggatgcacaacatcattgtgag

SEQ ID NO: 57892 - DNA, 201 bp, Homo sapiens
caaattccttagattcaaatctataagacagccaagcccccgaatccctcaactgtagctgttgaaggcatatgggagttgaatagcctgcaaggctggavacagttatgagtgaccacatcttatattttaataatataatattcttatttttcaaagttagtgttttgtacccattatctcattcagttttaagacaga

SEQ ID NO: 57893 - DNA, 201 bp, Homo sapiens
cactaaagtagaaccaatcctcctttatgtctaattgtaaatctcttgatatcttataatcgacttccatattttaccttttaataatattaggctcagcrcacacctgtacagatgatgtacttgcgtgaaaagctaaacattggatacatagaagacctaaaggctcagattctagaactcccatatgctggagatgtt

SEQ ID NO: 57894 - DNA, 201 bp, Homo sapiens
ataatgggtataaagttgaacaagctaataacatcagagtacccactgtaaggatgtacaaataatttattttgttgatttaaaaaaatcacatttatccwacactaaagtagaaccaatcctcctttatgtctaattgtaaatctcttgatatcttataatcgacttccatattttaccttttaataatattaggctcag

SEQ ID NO: 57895 - DNA, 201 bp, Homo sapiens; identical to SEQ ID NO: 10845

SEQ ID NO: 57896 - DNA, 201 bp, Homo sapiens
tttattcattgaattcattcattcattaagttctattaagttcattcacttagtcaacaaatatttatccaccacacaccatattccagaaactatatgtrgagataaagataaaaatggtaaatcctgccaccatagagcctatagaggagggattcagtcatgttggcaattgctatagagtagtagtcagtgctttca

SEQ ID NO: 57897 - DNA, 201 bp, Homo sapiens; identical to SEQ ID NO: 10846

SEQ ID NO: 57898 - DNA, 201 bp, Homo sapiens
aaaataatatattttgatgcttggaatactgcagagcgagtactaactataaacaaactgcttcttaaaccaatttcatttttttaaatgaccacactcakttgtcattgtttctgtcaatcttctcgggcttactccttcactcccttctctgtatgatcatagtactcaatatattatttagctcaattacagaagtta

SEQ ID NO: 57899 - DNA, 201 bp, Homo sapiens; identical to SEQ ID NO: 10848

SEQ ID NO: 57900 - DNA, 201 bp, Homo sapiens; identical to SEQ ID NO: 10849

SEQ ID NO: 57901 - DNA, 201 bp, Homo sapiens
atcttacctatcatacatctatcaatcctatctatctatatattttatgaatcatctatttatcatctatcttctctgtcatctgtctatcttatctattwatcaatcagctatctcggggagtaacacctttcctcagtactccatttccttaaatgtcagctatccagttaaattataaaaactgagtatagactgctc

SEQ ID NO: 57902 - DNA, 201 bp, Homo sapiens
ggagtgcagtggcacagtctcagctcaatgcaacctccacctcccaggttcaagtgattcttctgcctcagcctctcaagtagctggaactggagatgtgygccaccacgtgcagctaatttttgtatttttagtagtgacagggtttcaccatgctggccaggctggtctcaaactcctgacctcaagtgatcctcccgc

SEQ ID NO: 57903 - DNA, 201 bp, Homo sapiens
gcctcccgagtagctgggactacaggcggcccactgccttttcattcttacgaagcagggccggccgggcccggtggctcacgcctgtaatcccagcactytgggaggccgaggtgggcggatcatgaggtcaggagatcaagaccatcctggctgacacggtgaaaccccgtttctactaaaaatacaaaaaattagccg

SEQ ID NO: 57904 - DNA, 201 bp, Homo sapiens
tttaacattacctataaagctgttgtaaacaagacaatgtggttttggcataaggacagagaaagagaacagagttcagaaatagacccagacttatgctygttttcaacaaaggcatcaatggaatgaaatggagaaattaaagtcttttcaacaaatggtgctggaataacagattactcacatgggaaagatgaacct

SEQ ID NO: 57905 - DNA, 201 bp, Homo sapiens
atatgggtattacaggtaaggcagacatggctgaaactgtattagctttaaaaaggttaaaaagaccatatactaatctgcttcttaggtgctttcgtccktatggccagagactgtcttaaggatttttatatctcttctttgattaactgaagtgaagtaagtattctcttctttgtgaactcttgattatcagagaat

SEQ ID NO: 57906 - DNA, 201 bp, Homo sapiens
ggtgctacagccccaccctctcctctcccgatgtgcgtactccgtccctcgtgcttggattggctcccggggtagagccatcgcgtggcctgcctctcccrttggttggcgtagggaggtgttctcctccggggcccctgattggccggctccgggaggcgccatcggtaatgcctgcggcaggggcggaactgctaggtg

SEQ ID NO: 57907 - DNA, 201 bp, Homo sapiens
taatcccagcactttgggaggctgaggcgggcagatcacctgaggtcaggagttcgagaccaacctggccaacacggtgaaaccgcctctactaaaaatasaaaaaattagttgggcctggtggtgggcgcctgtaatcccagatactcaggagactgaggcaggagtatcacttaaacccggaaggcggaggtcgcagtg

SEQ ID NO: 57908 - DNA, 201 bp, Homo sapiens
attactaattgagaactatggttaaacagggaacacaggtcctgccttcaaggatctagtggggagagggattaccaatcacactccagggcaagtgtcaytaaagtggtatgcagagattacaagcacataaaagacataaatttagcctaggaggtggacaatgaagatgagtccaggccaagtgcagtggctcacgcc

SEQ ID NO: 57909 - DNA, 201 bp, Homo sapiens
ttttaaaaataatttaacttccattaagtatttatcacaagataatcatagatcaaattgtattatcctttgttatctctgaccagaatttaaattagtcsaattcatggaaaatttgaaggaattaaaaattaccacttagctctccccaacccaaatttgaattactaattgagaactatggttaaacagggaacacag

SEQ ID NO: 57910 - DNA, 201 bp, Homo sapiens
tgaaagggtagcatgctgatacattaagaggaaaaagacaagtttaagattttaaactgtgtccacagaagaataaacaatctaaatcttttctcccccgytaggtcaatattgaaggaggggctatagccttgggccaccctcttggagcatctggctgtcgaattcttgtgaccctgttacacacactggagagaatgg

SEQ ID NO: 57911 - DNA, 201 bp, Homo sapiens
ttgagatttcaggtgtgagccactacccccagccactgagagcatttggatcacatgctttctaggggaactgattctgttacattagccttaggtacacrtaacagatgctactggttcaaaattttaagacaatttagaatttctaagggatcttttagatcacacccttaaccttttggatggaatggatgtcactaa

SEQ ID NO: 57912 - DNA, 201 bp, Homo sapiens
aataagcatggtagaaattaagtcactcatattttacaggaataaatgatggtgctgcagctgtcgttcttatgaagaagtcagaagctgataaacgtggrcttacacctttagcacggatagtttcctggtcccaagtgggtgtggagccttccattatgggaataggaccaattccagccataaagcaagctgtgagta

SEQ ID NO: 57913 - DNA, 201 bp, Homo sapiens
tttcctgtcagagatctcccctccccaactgctgtaatcctttttttttctttttgagacggagcctcactctgtcgcccaggctggagtgcagtggtgcratcttggctcactgcaatctccgcctcccaggttcaagcaattctcctgtctcagcctcctgagtggctgggactacaggcgcacaccaccacaccggct

SEQ ID NO: 57914 - DNA, 201 bp, Homo sapiens
tcctgggctcaagtgagccccctgccttaacctcccaagtagctgggggactacaggcatgagccaccacacccaactcaatatttatgtacaaaattatycttaaaacagtttaaggaaacatgtcatttctctgtatttgatcattgacttaacctatactgaaagaattaatttggtttcttgacatcccaactagac

SEQ ID NO: 57915 - DNA, 201 bp, Homo sapiens
tttgaggttgtatagtatactatggttgattttgcctgttagtagctgctgcactccagcctggtcaacatagtgagacatcatccaacaaaaaaaaaaaraaagaaagaaaaacagcttgataagtaaagacaagacatagaaagcaaagcaataacttttttgtgtgtgtgtgtggagacgggtctcactctggcaccc

SEQ ID NO: 57916 - DNA, 201 bp, Homo sapiens
gccactaataactgatgtgggatgaattttctgtttgactaattcatctgcattttttaggagttctgctgcaataataacctgttgagaaaacattcacyggtctgagtgtgccggatattcaacatgtgcaatacatatggaatgacactaaaatggccatatattattaaccaaaatggtagtgatgaaatgaattaa

SEQ ID NO: 57917 - DNA, 201 bp, Homo sapiens
caggacaaggttgcagttctgtcccagaacaggacagagaatgcacagaaagctggccattttgacaaagagattgtaccagttttggtgtcaactagaaraggtgagtatatcatagtggtttaaacatcaacctatttataggtaagagtaacatctaaaagagtaatacataggaatctttagaaattatatcttagt

SEQ ID NO: 57918 - DNA, 201 bp, Homo sapiens
cttgtcagtatacaggtggtgattgatgccgtaggaatgactggtattacccagggagctggtgcaaagtaggagccttggggaacatgttaaggggatgwgagagtaagcccacaaagactcagaagtggccagggagtaaggggaaaatgggatagaatagagcaaaagccacgggaggcattccttgaattccttgga

SEQ ID NO: 57919 - DNA, 201 bp, Homo sapiens
tgaacccgggaggcggagcttgcagtgagctgagattgtgccactgcactccattcagcctgggcaacagagtgagactccttttaaaaagaagaagaagmagcagcagcagggccagcctgacgcataggaaagtatgcctgctcctccttactacctcaaagtgtcactcattcaacaaaaatgtattcagttcctcct

SEQ ID NO: 57920 - DNA, 201 bp, Homo sapiens
tttttcttgacttataattgttacaaaatattttaaaatacagaaaagtataaagaaaatagtcatctatttcttaggctttttttttttttttttttttttaattgagacagggtcttgctttgtcacttaggctcaagtgcagtggtgcagtcatggctcactgcagcctcaaagtcctcgactcaagtgatcctccca

SEQ ID NO: 57921 - DNA, 201 bp, Homo sapiens
gggcggatcatgaggtcaggagattgagaccatcctggctaacacggtgaaaccccatctctactaaaactacaaaaaattagccaggtgttgcagcaggygcctgtagtcccagctactctggaggccaagggaggagacttgcttgaacctaagaggcggaggttgcagtaagctgagatattgcaccattgcactcca

SEQ ID NO: 57922 - DNA, 201 bp, Homo sapiens
attcatgttaaatttcctgatttttgttttgttttgtgagacagggtcacccaggctggagtgcagaggcacaatcatggctcactgcagccttgaactcytaggctcaagtgatccttctgcctcagcctcccaagcagctaggactactagctacatggcacacacaccatgcccggctaaatttatttttaatggaga

SEQ ID NO: 57923 - DNA, 201 bp, Homo sapiens
gaaagtaatgagttataacttattcaataaaatgaaaatgtatgagtccatcctgatataaataactgaataaatgggagaaaaggaaaaggttttctttrtggtaaaatgccaattaatatcttaccaatagaaggaatgttggagttagaaagtcatgaatgaatgctaaaactagtgggtgaaaatatgatggggaag

SEQ ID NO: 57924 - DNA, 201 bp, Homo sapiens
gcctaaattttgaacaatttcagcgtgcaaataagtaatgatagtaatgggttataactgcccaagtattgaaaaatttcagcatcaaagtaagtaatgaragtaatgagttataacttattcaataaaatgaaaatgtatgagtccatcctgatataaataactgaataaatgggagaaaaggaaaaggttttctttatg

SEQ ID NO: 57925 - DNA, 201 bp, Homo sapiens
tcagtttccttggctcctcaggtgtattggatacaactgactactccagtttttgagacacttttgcaaaacaatgtaaagccattccttctgacaacttwctttctcagatgttccctctttcatgagtagttatgccctgtactcaaatcattgcctgctgctctacgtcactgtcttgggagttcacctatccctgtg

SEQ ID NO: 57926 - DNA, 201 bp, Homo sapiens
gatgagaagaaaagcaccagagaagttttgtgtagtaaaccactcatgacatctgcctgtaaagatgtacgatagggagtacctatagcacaaggatgtaygaagaagcttgaaggacaaaagagccacaggaagaatccaggaaagagcataattagttgaagatgcaagtatgaaacaagaatcaaagaaaaggctcta

SEQ ID NO: 57927 - DNA, 201 bp, Homo sapiens
tgggagtatggttccaacaatacaggtaagttccctgccctcttagggctcagttctgagcttggaaaataggtgccacatcatgccccttgcaaatgggrcatatcactccccagaggaatatagctgagtcctgagagtgcccccatcttctgattctttgggtttgaacactcgtaattaattaattaattattatta

SEQ ID NO: 57928 - DNA, 201 bp, Homo sapiens
ttttcagtctcaagtaaccttacccgtttttagtttccagcctaatcccagattgataacattgtgatgaatataatctctaagtttttatcagcgacttmtttgctagttcttccccacaaactctccaaggaagggtggtaggtttgagtatatctgaaactgggaatagagtaaccactttataaacatttaccattg

SEQ ID NO: 57929 - DNA, 201 bp, Homo sapiens
ggatttaaaaataaaagcaaaaaatgtaaagcttctagaagtatatataagagaatagcttttacagggtgcagtggcaggtgcctatagtcccagctacyagggaggctgtggtgggaggatcacttgaggccagcagtttgaggttgtatagtatactatggttgattttgcctgttagtagctgctgcactccagcct

SEQ ID NO: 57930 - DNA, 201 bp, Homo sapiens
tacagccccaccctctcctctcccgatgtgcgtactccgtccctcgtgcttggattggctcccggggtagagccatcgcgtggcctgcctctcccattggktggcgtagggaggtgttctcctccggggcccctgattggccggctccgggaggcgccatcggtaatgcctgcggcaggggcggaactgctaggtggtctg

SEQ ID NO: 57931 - DNA, 201 bp, Homo sapiens
aagtaaccctgagagcttaccagtgaatttcacaatccaattttaagatagtatcttctaggtgttggccatgtgggtaatagttaaagaaatactagttactaggactgagttcattacttcccaaggtaaaaaaaaaaaaaaaaaaaaaaagacattggcttacttggcataaaaggaacgaggtaagataggcaggga

SEQ ID NO: 57932 - DNA, 201 bp, Homo sapiens
gcaccgcactgggcctgtctttttaatatgtatatgatcctgcatatgttttcagtctcaagtaaccttacccgtttttagtttccagcctaatcccagaytgataacattgtgatgaatataatctctaagtttttatcagcgacttatttgctagttcttccccacaaactctccaaggaagggtggtaggtttgagta

SEQ ID NO: 57933 - DNA, 201 bp, Homo sapiens
caggagcgccgagggccggacttgtgtaggagaggggcgtatgtggaggaagccggtcaggccaagccgcgaggagccgcgggatccctggaaccctgcgsctcccgcgttccctgacctggtgctacagccccaccctctcctctcccgatgtgcgtactccgtccctcgtgcttggattggctcccggggtagagccat

SEQ ID NO: 57934 - DNA, 201 bp, Homo sapiens; identical to SEQ ID NO: 10880

SEQ ID NO: 57935 - DNA, 201 bp, Homo sapiens
tccaccagtggttagaataacattggcaccagttgccaggatcttctgaattctctccttggtgatatctgattctctgcaaagtatttttgtaacctgarttaccttctgtgatttttaaaaataatttaacttccattaagtatttatcacaagataatcatagatcaaattgtattatcctttgttatctctgaccag

SEQ ID NO: 57936 - DNA, 201 bp, Homo sapiens
aggtggtaaagaagccacagatatgtaactgaggttaataagcatggtagaaattaagtcactcatattttacaggaataaatgatggtgctgcagctgtygttcttatgaagaagtcagaagctgataaacgtgggcttacacctttagcacggatagtttcctggtcccaagtgggtgtggagccttccattatgggaa

SEQ ID NO: 57937 - DNA, 201 bp, Homo sapiens
ggcgtagggaggtgttctcctccggggcccctgattggccggctccgggaggcgccatcggtaatgcctgcggcaggggcggaactgctaggtggtctgagcccggctttgggctggggtcgggctgtcacacaatggctagaagtcgtgacttcgtctccttcgtgccgcatggttttcaacgcccttgacccgccggtt

SEQ ID NO: 57938 - DNA, 201 bp, Homo sapiens
ccaagacgtcaagtcggggaactccaacattggggtgtccagaaacactggggtttcaggcgctctgtaaatgcgtccgaggtccgcggttctgcccgcargcccagaccccggcctcacttccgccccgcgccccgcgccccggcctcacttccgccccgcgccccgcgccccgcgccccgcgcgcctccgcccgcccct

SEQ ID NO: 57939 - DNA, 201 bp, Homo sapiens; identical to SEQ ID NO: 10875

SEQ ID NO: 57940 - DNA, 201 bp, Homo sapiens
gagagtaagcccacaaagactcagaagtggccagggagtaaggggaaaatgggatagaatagagcaaaagccacgggaggcattccttgaattccttggaytcagatatgttaggggacaggaaacacattgaagacaactgaagagacttcagtgtgctgctgagttcttagcagagtagacagctgatttcaccactat

SEQ ID NO: 57941 - DNA, 201 bp, Homo sapiens
aaattgatactgctgctactacgcacgcgtgcgcgcaacacatgcgcacacacgcacccactcccgagacagggtcttgctatgttgcccacattggactrgcactcctgggttcaattaatactcctacctcagcctccttagtagctgggactacaggcacataccaccatgcccatctcaaagtcttatgctttaaaa

SEQ ID NO: 57942 - DNA, 201 bp, Homo sapiens
caggccaagccgcgaggagccgcgggatccctggaaccctgcggctcccgcgttccctgacctggtgctacagccccaccctctcctctcccgatgtgcgyactccgtccctcgtgcttggattggctcccggggtagagccatcgcgtggcctgcctctcccattggttggcgtagggaggtgttctcctccggggcccc

SEQ ID NO: 57943 - DNA, 201 bp, Homo sapiens
tctgtcgctcaggctggagtgcagtggtgtgatctcggctcactgaaacctctgcctcctaggttcaagcgattttcccatgtcagcctccccagtagctrggattacaggcgcacggcaccacgcccggctaatttttctattttatggtagaaacgggatatcaccatgttggccaggctggtgtcaaactgctgacct

SEQ ID NO: 57944 - DNA, 201 bp, Homo sapiens
agcataataaagagtacctataatcgattgtatgtaaacacacaaatttagactaattcattgcattttatcttagaaaaattttatggcattaaatgcaygtaatttcttttaattcacattccttctaccatgttgtatgtgctttaaattacaaaaagatgtactgcacataatccacaaaaaaacattttttatttt

SEQ ID NO: 57945 - DNA, 201 bp, Homo sapiens
aacaacaacaacaaaagaatagcttccagccgggcgcggtggctcacgcctgtaatcctagcactttgggaggccgaggcgggcggatcatgaggtcaggmgattgagaccatcctggctaacacggtgaaaccccatctctactaaaactacaaaaaattagccaggtgttgcagcaggtgcctgtagtcccagctactc

SEQ ID NO: 57946 - DNA, 201 bp, Homo sapiens
cagacaaaagcaaactagagagattgatagttgtacaatgcatgcttctttattggctcaaataaaggagctagaaggacattactgaaatataggtgaartttgaatgtggaccaaggattagataatagtgtttgattcatgttaaatttcctgatttttgttttgttttgtgagacagggtcacccaggctggagtgc

SEQ ID NO: 57947 - DNA, 201 bp, Homo sapiens
ctcctgagtagctgggattacaggcgtgcgccaccatgcccggcttatttttgtatttttagaagagatgaggtttcactgtgttggccaggctggtctcraactcctgaccttgtgatccacccacctcggcctcccaaagtgctgggattacaggtgtgagccaccgcgcccaaccttgattaaccttttctacagtct

SEQ ID NO: 57948 - DNA, 201 bp, Homo sapiens
gccagggttgacagaatagttgctaataagagagttacaaaggatctgtgaatattgctctttcatgattttaatatccttggactcagtagcatttgtgrtaaaagtgctatattacaagtttagaatttagttaggcagcacacggtaactccttttatcctaagatggaactgtcattttagaaatgaacaaattcag

SEQ ID NO: 57949 - DNA, 201 bp, Homo sapiens
ggctggagtgcagtggcaccatcgtggctcactgcaacctccacctcccggattcaagtaattctcctgcctcagactcctgagtagctgggattacaggygtgcgccaccatgcccggcttatttttgtatttttagaagagatgaggtttcactgtgttggccaggctggtctcgaactcctgaccttgtgatccaccc

SEQ ID NO: 57950 - DNA, 201 bp, Homo sapiens
tctgcaattcatatcacttttagacatgctttttattaccttttcaccctaaaaaagcagggaaggcaacaggtaatttcaatacagcattactcctctctattgatatcaatttgcataaaattggttattcaaaattttattgcacaaaattgatactgctgctactacgcacgcgtgcgcgcaacacatgcgcacaca

SEQ ID NO: 57951 - DNA, 201 bp, Homo sapiens
caaaactctgtctcaaaaaattaaattaaattaaattaaattaaaaaataggccaggtgtggtggctcatgcctgtaatcccagcactttgggaggtcaaygcaggcagatcacctgaggtcgggagtttgagacccacatgaccaacatggagaaactccatctctactaaaaatacaaaattagccaggctggtggcgc

SEQ ID NO: 57952 - DNA, 201 bp, Homo sapiens
attgcaggagtgagctacagctcctggccctttttgagttttaattgaaaagcagcgttggttttttgtgacctgatttcaagtagagtatctttgtagtyagtgatgtttgttttaaaacgctggccagcactactgatttttactaacaacatatctggtaatattatatgagtaaggggtgttagaatgtaggtagga

SEQ ID NO: 57953 - DNA, 201 bp, Homo sapiens
atctgcaattcatatcacttttagacatgctttttattaccttttcaccctaaaaaagcagggaaggcaacaggtaatttcaatacagcattactcctctctattgatatcaatttgcataaaattggttattcaaaattttattgcacaaaattgatactgctgctactacgcacgcgtgcgcgcaacacatgcgcacac

SEQ ID NO: 57954 - DNA, 201 bp, Homo sapiens
ctatctgcaattcatatcacttttagacatgctttttattaccttttcaccctaaaaaagcagggaaggcaacaggtaatttcaatacagcattactcctctctattgatatcaatttgcataaaattggttattcaaaattttattgcacaaaattgatactgctgctactacgcacgcgtgcgcgcaacacatgcgcac

SEQ ID NO: 57955 - DNA, 201 bp, Homo sapiens
tctcaggttcaagcaattctcctgcctcaacctcctgagtagctgggattacaggcgtgcaccaccatgcccagctaatttttgtatttttagtagagagrgggggtttcaccatattgtccaggctggtctcaaactcctgacctcaagtaatgcgcccccccccccggcctcccaaagtgctgggattacaggtgtgag

SEQ ID NO: 57956 - DNA, 201 bp, Homo sapiens
ttaattcacattccttctaccatgttgtatgtgctttaaattacaaaaagatgtactgcacataatccacaaaaaaacattttttatttttttttttttttgagacggagtctcactctgtagcccaggctggagtgcagtggtgtgatcttggctcactgcaatctccgcctcccaggttccagtgattctccttcctca

SEQ ID NO: 57957 - DNA, 201 bp, Homo sapiens
tctcctgaaattgcactgttatgcaatttttttccttctctattgccccacctctggggcctacactctttaccttctctgatttatctgacccatccgcrtatctctgcaaagtcttaatgtaggtttccaggatttaatgattctttcaatcaactttaaagttcttcaggaagattctccaggtccgtcaacagtttt

SEQ ID NO: 57958 - DNA, 201 bp, Homo sapiens
ctgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactgcagcctcaacctcctgggcttcagattcttgccacctcagcc

SEQ ID NO: 57959 - DNA, 201 bp, Homo sapiens
actgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactgcagcctcaacctcctgggcttcagattcttgccacctcagc

SEQ ID NO: 57960 - DNA, 201 bp, Homo sapiens
ttgtatgaggaaggaaggaaaaaagaatacccgtgcagactgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactgcag

SEQ ID NO: 57961 - DNA, 201 bp, Homo sapiens; identical to SEQ ID NO: 10874

SEQ ID NO: 57962 - DNA, 201 bp, Homo sapiens
caagagattgcttgagtccaagagtttgagtctagcctgggcaatgctatcatagtctactatgattgcacctgtgagtatctactgcattccagtctggktaacatagtgacacaacaacaacaacaacaacaaaagaatagcttccagccgggcgcggtggctcacgcctgtaatcctagcactttgggaggccgaggc

SEQ ID NO: 57963 - DNA, 201 bp, Homo sapiens
agataacatcacctgggataaactgattgtcatttgtgtcctaataagactcactgagaaaaatcatactatcattcagtggtatacctgccttttggcasaatcttaatctaattctgaggaaacatcagacaaatcaaaattgatgacccttaacaaaagaactcgcccatgttcttcaaaaatatcaagcttaagaag

SEQ ID NO: 57964 - DNA, 201 bp, Homo sapiens
tcaacatagtgagacatcatccaacaaaaaaaaaaaaaaagaaagaaaaacagcttgataagtaaagacaagacatagaaagcaaagcaataacttttttktgtgtgtgtgtggagacgggtctcactctggcacccagattggagtgcagtggctcaatcttggctcactgcaacccccacctcagcctcctgagtagct

SEQ ID NO: 57965 - DNA, 201 bp, Homo sapiens
ttacagcttgtactttactttaatgtgtaatactcaactcaaggtacaagacaattgcatttaacattgttataaataaaaggaacatcagatcaatcatwaagggctccagagtgaacagcatcttcataacttccatgtttatcatctttactttctggatgtaatttaataagatcatcaattcgaagaatggtgatt

SEQ ID NO: 57966 - DNA, 201 bp, Homo sapiens
tttacagcttgtactttactttaatgtgtaatactcaactcaaggtacaagacaattgcatttaacattgttataaataaaaggaacatcagatcaatcawtaagggctccagagtgaacagcatcttcataacttccatgtttatcatctttactttctggatgtaatttaataagatcatcaattcgaagaatggtgat

SEQ ID NO: 57967 - DNA, 201 bp, Homo sapiens; identical to SEQ ID NO: 10879

SEQ ID NO: 57968 - DNA, 201 bp, Homo sapiens
gttgtatgaggaaggaaggaaaaaagaatacccgtgcagactgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactgca

SEQ ID NO: 57969 - DNA, 201 bp, Homo sapiens
tgttgtatgaggaaggaaggaaaaaagaatacccgtgcagactgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactgc

SEQ ID NO: 57970 - DNA, 201 bp, Homo sapiens
ttgttgtatgaggaaggaaggaaaaaagaatacccgtgcagactgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactg

SEQ ID NO: 57971 - DNA, 201 bp, Homo sapiens
ggcaaatgtatcctcgaggctcgatattttgttttgtttttctcccctgtaagagcactcactgctgtcttagcttgggctgctgtgaaaaaaaaaaaaaaccacagactgggtggctttacacgcgcattcctcactgtttttggaggctgggaagtctaaagatcacagtgccccctgattggtgccccagtttggttc

SEQ ID NO: 57972 - DNA, 201 bp, Homo sapiens
tttgttgtatgaggaaggaaggaaaaaagaatacccgtgcagactgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcact

SEQ ID NO: 57973 - DNA, 201 bp, Homo sapiens
cttgggagcaaatggccctagttagaaacactgataatgcctaggttatatcctgtgtttattagacataggtttgataatgcttatttaagcacccccccgcacttttttttttttgagacggagtttcgcccttgttgcccaggctggagtgtaatggtgtgatctcagctcaccgcaacctccgcttcccaggttcaa

SEQ ID NO: 57974 - DNA, 201 bp, Homo sapiens
ctctgtctcaggttcaagcaattctcctgcctcaacctcctgagtagctgggattacaggcgtgcaccaccatgcccagctaatttttgtatttttagtasagagggggggtttcaccatattgtccaggctggtctcaaactcctgacctcaagtaatgcgcccccccccccggcctcccaaagtgctgggattacaggt

SEQ ID NO: 57975 - DNA, 201 bp, Homo sapiens
tagatatactatacagaaacaatgtctagtccctgcagaagagatgaaaatggttacttcatctcaatttacagtggcccaatgttattttatcccatgcstataactgctcgtatcactgtgagactacaagcagcaaataaatgggaagaaaacctacttttacttaacaaaatcggtataactttacaattttagaaa

SEQ ID NO: 57976 - DNA, 201 bp, Homo sapiens
gcacttattctgtggtacacagagtcagtatttctcatttctggaattggatgctttattttctggtatgcctgtgataagagaggtgatagagtggcttytgcatctaattggtttgaatcctggtattacacttaactgatttgggcaaatgtatcctcgaggctcgatattttgttttgtttttctcccctgtaagag

SEQ ID NO: 57977 - DNA, 201 bp, Homo sapiens
gacttataattgttacaaaatattttaaaatacagaaaagtataaagaaaatagtcatctatttcttaggctttttttttttttttttttttttaattgaracagggtcttgctttgtcacttaggctcaagtgcagtggtgcagtcatggctcactgcagcctcaaagtcctcgactcaagtgatcctcccacttcaggc

SEQ ID NO: 57978 - DNA, 201 bp, Homo sapiens
gtgtaaataaatactgtataaaatgcaaagcactcagaatagccaaaacaattttgaagtcagaaaatagcacttacatgctctgattttaacattacctwtaaagctgttgtaaacaagacaatgtggttttggcataaggacagagaaagagaacagagttcagaaatagacccagacttatgctcgttttcaacaaag

SEQ ID NO: 57979 - DNA, 201 bp, Homo sapiens
ttttcttgacttataattgttacaaaatattttaaaatacagaaaagtataaagaaaatagtcatctatttcttaggctttttttttttttttttttttttaattgagacagggtcttgctttgtcacttaggctcaagtgcagtggtgcagtcatggctcactgcagcctcaaagtcctcgactcaagtgatcctcccac

SEQ ID NO: 57980 - DNA, 201 bp, Homo sapiens
gtcaccaaaatgttacaacattatcactatctgcaattcatatcacttttagacatgctttttattaccttttcaccctaaaaaagcagggaaggcaacargtaatttcaatacagcattactcctctctattgatatcaatttgcataaaattggttattcaaaattttattgcacaaaattgatactgctgctactacg

SEQ ID NO: 57981 - DNA, 201 bp, Homo sapiens
aaatttctccagttacatgaaaaatggctctataaatgtgttggtagcacaaagcattaagagaatataaatgtttttgagctgttttctgtcaatattcyaatgtaaaaagacctttgataggatcagggataataaaagtattttatgtgacagccagcacaagacatacctccagaagctttggcaatgcgtttaagg

SEQ ID NO: 57982 - DNA, 201 bp, Homo sapiens
agacctcttttctatgaatctttcctctaggttacaaaagcaggttggtcactggaagatgttgacatatttgaaatcaatgaagcctttgcagctgtctytgctgcaatagttaaagaacttggattaaacccagagaaggtaaagatgcacaagtaaccctgagagcttaccagtgaatttcacaatccaattttaaga

SEQ ID NO: 57983 - DNA, 201 bp, Homo sapiens
ttagacctcttttctatgaatctttcctctaggttacaaaagcaggttggtcactggaagatgttgacatatttgaaatcaatgaagcctttgcagctgtytctgctgcaatagttaaagaacttggattaaacccagagaaggtaaagatgcacaagtaaccctgagagcttaccagtgaatttcacaatccaattttaa

SEQ ID NO: 57984 - DNA, 201 bp, Homo sapiens
cagtaccagaaactcccaatacctccttgtgaagcccaggcttattcttccatttcctgtcagagatctcccctccccaactgctgtaatccttttttttyctttttgagacggagcctcactctgtcgcccaggctggagtgcagtggtgcaatcttggctcactgcaatctccgcctcccaggttcaagcaattctcct

SEQ ID NO: 57985 - DNA, 201 bp, Homo sapiens
aacttcagtttatctacctttgtatttttccagtaccagaaactcccaatacctccttgtgaagcccaggcttattcttccatttcctgtcagagatctcycctccccaactgctgtaatcctttttttttctttttgagacggagcctcactctgtcgcccaggctggagtgcagtggtgcaatcttggctcactgcaat

SEQ ID NO: 57986 - DNA, 201 bp, Homo sapiens
cctatagtcccagctactagggaggctgtggtgggaggatcacttgaggccagcagtttgaggttgtatagtatactatggttgattttgcctgttagtakctgctgcactccagcctggtcaacatagtgagacatcatccaacaaaaaaaaaaaaaaagaaagaaaaacagcttgataagtaaagacaagacatagaaa

SEQ ID NO: 57987 - DNA, 201 bp, Homo sapiens
aggtcatctttggacatgtcttggcagcaggtaagtctcagtgattccaggagaagtcaggcttattagaaacagcccataaacacacacacacacacacwctctcacacactcacacactctctcactcactcaagttcttgcctccttgcttttgctcagagttccctctgttatgattcctcctgttggcccccttct

SEQ ID NO: 57988 - DNA, 201 bp, Homo sapiens
catcgcgtggcctgcctctcccattggttggcgtagggaggtgttctcctccggggcccctgattggccggctccgggaggcgccatcggtaatgcctgcrgcaggggcggaactgctaggtggtctgagcccggctttgggctggggtcgggctgtcacacaatggctagaagtcgtgacttcgtctccttcgtgccgca

SEQ ID NO: 57989 - DNA, 201 bp, Homo sapiens
tttagctgatacaggtatatccggtcttcagcagtatgttaaatactgcactgtctcttgattaaccttttcttttttttctttttctcttttttttttttgccgagagtctcgctctgccacccaggctggagtgcagtggcaccatcgtggctcactgcaacctccacctcccggattcaagtaattctcctgcctcag

SEQ ID NO: 57990 - DNA, 201 bp, Homo sapiens
tcacaatttgcctttttgtgggtgtacgttttggtttttttttgttgttttttttctttgttttttttttcttttctttttttttttttttttttttttttgcttcaatacttctgccgctttggaaattgtaacagttaattactttgaatgttgctaaaaggacattttgtgtagggtcaagttatttttatatgagtt

SEQ ID NO: 57991 - DNA, 201 bp, Homo sapiens
aaaaaaatggcattttaataaaataagtctacataaagttcccttaagtcctgcctacacaggatatttagatatactatacagaaacaatgtctagtccmtgcagaagagatgaaaatggttacttcatctcaatttacagtggcccaatgttattttatcccatgcgtataactgctcgtatcactgtgagactacaag

SEQ ID NO: 57992 - DNA, 201 bp, Homo sapiens
taatgtgctaggagctgtgcataaagcagtgtaacaggatcatcttggaaagcttatgtagtcagtagaggagacagataaactaggaattacatggtaarttgaaagaggaagttaggggtaagatgctgcaccaaatgcaggagattggaaggtttttctggaagaagtgatgtttagggggagtttcagaggtaaatt

SEQ ID NO: 57993 - DNA, 201 bp, Homo sapiens
gtagggtcaagttatttttatatgagttaatgtgaaattgtaaatggaaatttttccttaaaatacaacacaatgatgtctgtataaatctgtctgtttaraatctgtgctgtgtaagggcattcgtactcatgctgttactgtacttatgcaccattcagacttgttagagtagatgtgggtttatgactgccaagtttg

SEQ ID NO: 57994 - DNA, 201 bp, Homo sapiens
attccctagatagaagctgattcagcccagccattgctgaggttcaggaggaggcaggctaaaggtaacaaaaataatcggagtgattttgatgggatgayactgacatctgtgtagtactttaccaggtgcttttgtacatgtgttcacaacagccccatatagggtagatgataccattcccagtttacaggtaaggaa

SEQ ID NO: 57995 - DNA, 201 bp, Homo sapiens
aaaataaattgctcttctttagaaaaaaagaaaagaaaaaaggctcaggtcatgatggagtaattgacaaagattagatttcctactataaacaagcatawaacttgtgaaaatatataaagccactgttttatgtatgtcaggttttgactaatactcatgtaagactgagatccttgagagaagggaaaaccccactgt

SEQ ID NO: 57996 - DNA, 201 bp, Homo sapiens
ccagctactctggaggccaagggaggagacttgcttgaacctaagaggcggaggttgcagtaagctgagatattgcaccattgcactccagcctgggcaamaagaatgaaactccatctctaaataaataaataaatagtgtaaataaatactgtataaaatgcaaagcactcagaatagccaaaacaattttgaagtcag

SEQ ID NO: 57997 - DNA, 201 bp, Homo sapiens
acgcaggcagatcacctgaggtcgggagtttgagacccacatgaccaacatggagaaactccatctctactaaaaatacaaaattagccaggctggtggcrcatgcctgtaatcccagctactcgggaggctgaggcaggagaatcgcttgaacctgggaggcggaggttgcgttgagctgagatcacgccattgcactcc

SEQ ID NO: 57998 - DNA, 201 bp, Homo sapiens
cggcctcccaaagtgctgggattacaggtgtgagccactgctcacagcctgaggcaccgcactgggcctgtctttttaatatgtatatgatcctgcatatsttttcagtctcaagtaaccttacccgtttttagtttccagcctaatcccagattgataacattgtgatgaatataatctctaagtttttatcagcgactt

SEQ ID NO: 57999 - DNA, 201 bp, Homo sapiens
caagccgcgaggagccgcgggatccctggaaccctgcggctcccgcgttccctgacctggtgctacagccccaccctctcctctcccgatgtgcgtactcsgtccctcgtgcttggattggctcccggggtagagccatcgcgtggcctgcctctcccattggttggcgtagggaggtgttctcctccggggcccctgatt

SEQ ID NO: 58000 - DNA, 201 bp, Homo sapiens
agtcagcttaggagacgaggttagatgtaaggatttcagacttgtcagtatacaggtggtgattgatgccgtaggaatgactggtattacccagggagctsgtgcaaagtaggagccttggggaacatgttaaggggatgtgagagtaagcccacaaagactcagaagtggccagggagtaaggggaaaatgggatagaat

SEQ ID NO: 58001 - DNA, 201 bp, Homo sapiens
aggcgtgcgccaccatgcccggcttatttttgtatttttagaagagatgaggtttcactgtgttggccaggctggtctcgaactcctgaccttgtgatccrcccacctcggcctcccaaagtgctgggattacaggtgtgagccaccgcgcccaaccttgattaaccttttctacagtctgctcaagtgagtaaaaaatcc

SEQ ID NO: 58002 - DNA, 201 bp, Homo sapiens
aaatacaacacaatgatgtctgtataaatctgtctgtttagaatctgtgctgtgtaagggcattcgtactcatgctgttactgtacttatgcaccattcaracttgttagagtagatgtgggtttatgactgccaagtttgcccagtacagtagttttttatcactaaaagttggactcattgatggagtcctgtagtagt

SEQ ID NO: 58003 - DNA, 201 bp, Homo sapiens
tcattaagggctccagagtgaacagcatcttcataacttccatgtttatcatctttactttctggatgtaatttaataagatcatcaattcgaagaatggkgattgcagcttctgttgcaaatttcaaactcttaactttaactatggttggttcaaacacccctgcttgtttgttgtctcgaggtttaccattgctcaaa

SEQ ID NO: 58004 - DNA, 201 bp, Homo sapiens
gatatctgattctctgcaaagtatttttgtaacctgagttaccttctgtgatttttaaaaataatttaacttccattaagtatttatcacaagataatcayagatcaaattgtattatcctttgttatctctgaccagaatttaaattagtccaattcatggaaaatttgaaggaattaaaaattaccacttagctctccc

SEQ ID NO: 58005 - DNA, 201 bp, Homo sapiens
cgatgtgcgtactccgtccctcgtgcttggattggctcccggggtagagccatcgcgtggcctgcctctcccattggttggcgtagggaggtgttctcctscggggcccctgattggccggctccgggaggcgccatcggtaatgcctgcggcaggggcggaactgctaggtggtctgagcccggctttgggctggggtcg

SEQ ID NO: 58006 - DNA, 201 bp, Homo sapiens
ggatcttttagatcacacccttaaccttttggatggaatggatgtcactaaggcaaaaatgtgtgagaatgtcactgtattaacctaagaacaaaccaaastagcagttaccagtatcatgcagcatatatttatgttgacaaagaatggtttaactttagcctttccacccaagtttagacctcttttctatgaatcttt

SEQ ID NO: 58007 - DNA, 201 bp, Homo sapiens
acctttagcacggatagtttcctggtcccaagtgggtgtggagccttccattatgggaataggaccaattccagccataaagcaagctgtgagtataaccytattcccttttatgaaatttgtcttcctgttagccttaagtgagcttattcatgtagttagctctagtctttccctaccagaagagtaaccaagagcatt

SEQ ID NO: 58008 - DNA, 201 bp, Homo sapiens
tgagccccctgccttaacctcccaagtagctgggggactacaggcatgagccaccacacccaactcaatatttatgtacaaaattattcttaaaacagttkaaggaaacatgtcatttctctgtatttgatcattgacttaacctatactgaaagaattaatttggtttcttgacatcccaactagacatacaaatgaaga

SEQ ID NO: 58009 - DNA, 201 bp, Homo sapiens
gttaaggacagtaacaggtttggaatggacaaagggtacacacgtgaaaaatcaagggtaatttcaagggacttccttttagtaatctaatctattaaagmagcaagcattacttgtcaccaaaatgttacaacattatcactatctgcaattcatatcacttttagacatgctttttattaccttttcaccctaaaaaag

SEQ ID NO: 58010 - DNA, 201 bp, Homo sapiens
tttggggtcactcgctattttctaatacagaatgctcccgtcaagctcccttattgataactgatatctcttatgtcctgccagcagtgcacgattggctytgagactgcctgatccactcactcgtaaccagccaagtactatgacccaaactatagcagaatttggcacaaacaggtccctggtagctactttcctcag

SEQ ID NO: 58011 - DNA, 201 bp, Homo sapiens
ttttcaacaaatggtgctggaataacagattactcacatgggaaagatgaacctagatccctacctcacaccctatataaaagctaatttgagataaatcrtggatttaaaaataaaagcaaaaaatgtaaagcttctagaagtatatataagagaatagcttttacagggtgcagtggcaggtgcctatagtcccagcta

SEQ ID NO: 58012 - DNA, 201 bp, Homo sapiens
gtgcagtggcaccatcatagctcactgcagcctcaaaactcctaggctcaaatattcctcctgccttagcctcccattacctcgaactacaggtgcaccamgccttcttcatttcgtagagacaaggtctatgtcgcccaggctggttttgaactcctgagttcaattgatcctcttgccttaggctccccaagtgttgag

SEQ ID NO: 58013 - DNA, 201 bp, Homo sapiens; identical to SEQ ID NO: 10869

SEQ ID NO: 58014 - DNA, 201 bp, Homo sapiens
atggctaaagtttaatctagaaatacattttccccacaaactatctagtttctccagaattaacatctttctcaccaaacaatagtgtttctactataccrgcatgctggatgatctatgaagagtttatactgtgtatcacatttactgactcggtaagatcacactgtcatatcatgatgtatttattaatttctcaca

SEQ ID NO: 58015 - DNA, 201 bp, Homo sapiens
gttcatcaatacaaccgtaaaagacaacacatctattacctttagaaaaaatgctcaacagaagctaaaccgagtgtgactattcatatgacctatattargctattattttatttaaaaaagatagttcttcaagttgataaaacactaagaaatatttttaaagcaaaaagactgtcagcttcttatggaaggaaaact

SEQ ID NO: 58016 - DNA, 201 bp, Homo sapiens
atgttacaacattatcactatctgcaattcatatcacttttagacatgctttttattaccttttcaccctaaaaaagcagggaaggcaacaggtaatttcmatacagcattactcctctctattgatatcaatttgcataaaattggttattcaaaattttattgcacaaaattgatactgctgctactacgcacgcgtgc

SEQ ID NO: 58017 - DNA, 201 bp, Homo sapiens
tatctgcaattcatatcacttttagacatgctttttattaccttttcaccctaaaaaagcagggaaggcaacaggtaatttcaatacagcattactcctcyctattgatatcaatttgcataaaattggttattcaaaattttattgcacaaaattgatactgctgctactacgcacgcgtgcgcgcaacacatgcgcaca

SEQ ID NO: 58018 - DNA, 201 bp, Homo sapiens
tcacatttctaaagggtggatcttttggggtcactcgctattttctaatacagaatgctcccgtcaagctcccttattgataactgatatctcttatgtcmtgccagcagtgcacgattggctttgagactgcctgatccactcactcgtaaccagccaagtactatgacccaaactatagcagaatttggcacaaacagg

SEQ ID NO: 58019 - DNA, 201 bp, Homo sapiens
gtttaaacatcaacctatttataggtaagagtaacatctaaaagagtaatacataggaatctttagaaattatatcttagttatgtttttcaggttgcaartatatgtcctggatacatgaatgtggggagggggtatgctgggtttacaggacacggtaacatgggacctatgtcagcactcaagcactcttggttccag

SEQ ID NO: 58020 - DNA, 201 bp, Homo sapiens
tacataggaatctttagaaattatatcttagttatgtttttcaggttgcaaatatatgtcctggatacatgaatgtggggagggggtatgctgggtttacrggacacggtaacatgggacctatgtcagcactcaagcactcttggttccagagcgtccatgaccactgtgcacacacagcaggtttcatgagaagctgga

SEQ ID NO: 58021 - DNA, 201 bp, Homo sapiens
tgtgatggtcttacagatgcatttcacaactgtcatatgggtattacaggtaaggcagacatggctgaaactgtattagctttaaaaaggttaaaaagacmatatactaatctgcttcttaggtgctttcgtccttatggccagagactgtcttaaggatttttatatctcttctttgattaactgaagtgaagtaagtat

SEQ ID NO: 58022 - DNA, 201 bp, Homo sapiens
ctggccccaagggatccttctgccttggcttcccaacgtgttgggattgcaggagtgagctacagctcctggccctttttgagttttaattgaaaagcagsgttggttttttgtgacctgatttcaagtagagtatctttgtagtcagtgatgtttgttttaaaacgctggccagcactactgatttttactaacaacata

SEQ ID NO: 58023 - DNA, 201 bp, Homo sapiens
tcgtaagtaataatacccgttcagccatttcatataggaggaggacatgaaaaaaccctccctcttcagatcatggcaagtttaatctatcccataagcayagccactaaaatctattattaggagaaaatgtggtagtcaaatgagaaaaaagatactggtccaagtttttaacttcaaatattactacttaaatgctaa

SEQ ID NO: 58024 - DNA, 201 bp, Homo sapiens
tgtcattaactgatctggacccatcatggggtggctgtgctgagggagtgttgagctagcccctagtggtaaggagtacactgctgaccttcatcctatgrcaattccactttggtgattcactgttcccctcatggagaccaaggaggaatttgctgcatggtaggttggtgaatccagcctgtagcaaagacctggctt

SEQ ID NO: 58025 - DNA, 201 bp, Homo sapiens
gtttaaaagtgtgggggagaaaaacgcttataaagtcactactcaaactctttgcattcatcatgcttaacacagagccaaaatgtcgtaagtaataatayccgttcagccatttcatataggaggaggacatgaaaaaaccctccctcttcagatcatggcaagtttaatctatcccataagcatagccactaaaatcta

SEQ ID NO: 58026 - DNA, 201 bp, Homo sapiens
ttactgtagagggactggctttgatggaagaaaggacactttgttgtatgaggaaggaaggaaaaaagaatacccgtgcagactgatttaaaagatgacarcacatttcttactcttggcaaagctttcttgtaggtctggtttaactactgtttaaactattttttttttttttttttttttgagacagggtctcgctgt

SEQ ID NO: 58027 - DNA, 201 bp, Homo sapiens
tagagcagaaggaaacagactctagaacacttactgtagagggactggctttgatggaagaaaggacactttgttgtatgaggaaggaaggaaaaaagaayacccgtgcagactgatttaaaagatgacagcacatttcttactcttggcaaagctttcttgtaggtctggtttaactactgtttaaactatttttttttt

SEQ ID NO: 58028 - DNA, 201 bp, Homo sapiens
agcattctactagatagaggtatgtgtgtttggagcttagagaaacagctgaaagagtctctggcatagagagataatacatgaagtcatgggaacaaagrggctatcctggagagtattatgacatggtccagacaaagcagcatcacaaagccttccatccccgaaagcatttcaagaaggacataatcaaagggttgc

SEQ ID NO: 58029 - DNA, 201 bp, Homo sapiens
tgccactgcactccagcctgggcaacaagagcaaaactccgtctcaaaaacaaacaaacaaacaaaaacaggagtccagagttgaaagcacaaaagaaggyagaaccagaaaagtgaaaaaccttgcaggttacaccaaacaatctagatactaagcttaatatctctaagcaagactagtatatcatctgtgttttcaaa

SEQ ID NO: 58030 - DNA, 201 bp, Homo sapiens
ctttgggaggctgaggcgggcagatcacctgaggtcaggagttcgagaccaacctggccaacacggtgaaaccgcctctactaaaaatacaaaaaattagytgggcctggtggtgggcgcctgtaatcccagatactcaggagactgaggcaggagtatcacttaaacccggaaggcggaggtcgcagtgagccgagaccg

SEQ ID NO: 58031 - DNA, 201 bp, Homo sapiens
gatttcaggtgtgagccactacccccagccactgagagcatttggatcacatgctttctaggggaactgattctgttacattagccttaggtacacataasagatgctactggttcaaaattttaagacaatttagaatttctaagggatcttttagatcacacccttaaccttttggatggaatggatgtcactaaggca

SEQ ID NO: 58032 - DNA, 201 bp, Homo sapiens
gaccactgacctacaccacctacactgccttttcttttccttttttttttttttttttttttttttttgagacggagtctctctctgtggcccaggctggrgtgcagtggcgtgatctcggctcactgcaagctccgtctcccggtttcacgccattctcctgcctcagcctcccgagtagctgggactacaggcggccca

SEQ ID NO: 58033 - DNA, 201 bp, Homo sapiens; identical to SEQ ID NO: 10909

SEQ ID NO: 58034 - DNA, 201 bp, Homo sapiens; identical to SEQ ID NO: 10891

SEQ ID NO: 58035 - DNA, 201 bp, Homo sapiens
cagcgcggagagcagccacttctttgcatatctggtgactgcagccattcttgtggctgtcctctatatcgctcatcacaacaagcggaaggtaagtcgayagcggccttccggaggggagtggggtttccagcaccctggaagcttgggtgtgggtgggtatcccgtcactagatgcccgtgagcactggggactttaaa

SEQ ID NO: 58036 - DNA, 201 bp, Homo sapiens
gtgagatacaaaaccacttacctgattatcccaatatggggagaaaataaatatgcatagaggaaaagagaaatacactaattaagaagggaaagagtccttttttttttttttaacaaaactaaatggaaacataataaactaatgtaagcggtaacctgtggaggagtaggaagacttttctaaagtctgtttacttta

SEQ ID NO: 58037 - DNA, 201 bp, Homo sapiens; identical to SEQ ID NO: 10892

SEQ ID NO: 58038 - DNA, 201 bp, Homo sapiens; identical to SEQ ID NO: 10893

SEQ ID NO: 58039 - DNA, 201 bp, Homo sapiens
caacgctttgcaggtgatcggatggatttattcccacatgggagagaccagagcacagcacgtttgtgtacggccaggagggaaccacgaaaaaagcagargatagaaacgcaagcacacgatggtggtggccaagaggagcctgcccctagtgacctcacttccgcggccagtgcgagaggcgagggagctccagctctg

SEQ ID NO: 58040 - DNA, 201 bp, Homo sapiens; identical to SEQ ID NO: 10896

SEQ ID NO: 58041 - DNA, 201 bp, Homo sapiens; identical to SEQ ID NO: 10895

SEQ ID NO: 58042 - DNA, 201 bp, Homo sapiens; identical to SEQ ID NO: 10897

SEQ ID NO: 58043 - DNA, 201 bp, Homo sapiens; identical to SEQ ID NO: 10898

SEQ ID NO: 58044 - DNA, 201 bp, Homo sapiens; identical to SEQ ID NO: 10899

SEQ ID NO: 58045 - DNA, 201 bp, Homo sapiens; identical to SEQ ID NO: 10900

SEQ ID NO: 58046 - DNA, 201 bp, Homo sapiens
tagagctcagacagccttctatttgttatttcctattaagcaatacaaaggattctgatgtaattaggctctgtctttcttaaaatggttatagtttaaayagacctctgtgagtgtactgctctttctacagtcagggtcattaacaaatatgctaccaggtgactgcctctgatttcagagactgaactatgtcattac

SEQ ID NO: 58047 - DNA, 201 bp, Homo sapiens
agaaacatctagatacacatatctgtgacgttagagctagcagagaccttggaatactctacagcagctacctcccttcacagatgaggaaataggcccaygcagaaacactcttttttttttttttccgctaagtttctactgcaagttagtggcaaactcaggacctgatagcaactccctagtctcccagtcctgagc

SEQ ID NO: 58048 - DNA, 201 bp, Homo sapiens
atgaggaaataggcccacgcagaaacactcttttttttttttttccgctaagtttctactgcaagttagtggcaaactcaggacctgatagcaactccctmgtctcccagtcctgagctttctgcattctgccagcgctccataaactttaataggcatttgaatcaccttggggaattttgataaaaagcattatctgat

SEQ ID NO: 58049 - DNA, 201 bp, Homo sapiens
atcattttgtgtgctattttaattaattgctgtttctgtggtggtgggtcagtatgtcttaattctgaatgttttccctgcacctcctaaaagatcttttytcccccaagtcctaacagaatggtatattcctctggaaaaagatgaacgtcaccaatggattgtgctgctctcgtttcagctttgatttttttgtccttg

SEQ ID NO: 58050 - DNA, 201 bp, Homo sapiens; identical to SEQ ID NO: 10920

SEQ ID NO: 58051 - DNA, 201 bp, Homo sapiens; identical to SEQ ID NO: 10921

SEQ ID NO: 58052 - DNA, 201 bp, Homo sapiens; identical to SEQ ID NO: 10902

SEQ ID NO: 58053 - DNA, 201 bp, Homo sapiens
gatagaaacgcaagcacacgatggtggtggccaagaggagcctgcccctagtgacctcacttccgcggccagtgcgagaggcgagggagctccagctctgmctgtaaggtctcggaagtacgaggcggaggggacgaaaaacggggggccagactgttgtggctgtggtggagacgagaaaccaggaagaagaggctcgct

SEQ ID NO: 58054 - DNA, 201 bp, Homo sapiens
ttaagaactgtaacactcaccgcgagggtccgcggcttcattcttgaagtcagtgagaccaagaacccaccaattccagacatacctccccactgaagttyttcatgctacaaccagagtaatatttaaaaatttggctgagcccagtggctcacgcctgtaatcccgacactttgggaggccgaggtgggtggatcactt

SEQ ID NO: 58055 - DNA, 201 bp, Homo sapiens
gcgcagcaggggcgggactggagaggggccccgcgcgcggatctcgcgagagcattagagggcggaagcgctatccgagcaggatgcggttcgtggttgcmttggtcctcctgaacgtcgcagcggcgggtaagaccctccatcccgcatcccactcttgcccccagatcccccattctcacctgggcaggtcacctctag

SEQ ID NO: 58056 - DNA, 201 bp, Homo sapiens; identical to SEQ ID NO: 10925

SEQ ID NO: 58057 - DNA, 201 bp, Homo sapiens
gtagcatcgtggggtgaaaaagtacatttgtagataggaaattctgattatgactttttttaaaggaatgtcctatatcctagatatctctaggaaggagwtgatagatctttgactgtgtacctttgaataaatcaaacagacttcctcccacacgctagagctcagacagccttctatttgttatttcctattaagcaa

SEQ ID NO: 58058 - DNA, 201 bp, Homo sapiens
acatggggcagtgagtatacctgtcagaggttggtgatggggctctgggccttcaaggccatcacacaagggtgcaggcggcccaggtcatggtcagcccygtagcagacacctcggggagcagccagatagaactggttggtgagtggggatcctgcagtcacactctccacctgagggcagaaagggtggggcaggcat

SEQ ID NO: 58059 - DNA, 201 bp, Homo sapiens
cagtgagtatacctgtcagaggttggtgatggggctctgggccttcaaggccatcacacaagggtgcaggcggcccaggtcatggtcagccctgtagcagrcacctcggggagcagccagatagaactggttggtgagtggggatcctgcagtcacactctccacctgagggcagaaagggtggggcaggcatgtgagatc

SEQ ID NO: 58060 - DNA, 201 bp, Homo sapiens; identical to SEQ ID NO: 10908

SEQ ID NO: 58061 - DNA, 201 bp, Homo sapiens; identical to SEQ ID NO: 10930

SEQ ID NO: 58062 - DNA, 201 bp, Homo sapiens; identical to SEQ ID NO: 10933

SEQ ID NO: 58063 - DNA, 201 bp, Homo sapiens; identical to SEQ ID NO: 10935

SEQ ID NO: 58064 - DNA, 201 bp, Homo sapiens; identical to SEQ ID NO: 10936

SEQ ID NO: 58065 - DNA, 201 bp, Homo sapiens; identical to SEQ ID NO: 10937

SEQ ID NO: 58066 - DNA, 201 bp, Homo sapiens
tgtttaagttgataaagtaaaaaagttaaactaaggttaatttattcttgaagaaagaagaatatttctttataaacctagtgttgcctaagtgtacagcrtcatggttactcaccactcactgacgcacccagagcagctgccagtcctgcaagctccatgcctgggaaatgccctatacagctatgccatcttttatct

SEQ ID NO: 58067 - DNA, 201 bp, Homo sapiens
tttactgttccctcaccagacacacatacccttgataagccaatatctttaaatgttagtcaaacacttatttaggggaggtagaaataattttcttttcyttttttttttgagagagtcttgctctgtcgcctaagctggggtgcagtggtgcagtctcagctcactgcaacctctgcctcccaagttcaagtgattctt

SEQ ID NO: 58068 - DNA, 201 bp, Homo sapiens
tgccatcttttatcttgttttttgttttttttttcccaagacagaattttgatcttgttgcccaggctggagtgcaacggtgcgatctcggctcaccgcawcctctgcctcctgggttcaagcaattctcctgcctcagccacctgagtagctgggattacaggcgcccaccaccacgcccagttactttttgtattttta

SEQ ID NO: 58069 - DNA, 201 bp, Homo sapiens
attttcttttccttttttttttgagagagtcttgctctgtcgcctaagctggggtgcagtggtgcagtctcagctcactgcaacctctgcctcccaagttmaagtgattcttctgcctcagcctcccgagtagctgagattacaggcatgcaccaccatgtccagctaaattttttttttgtatttttagtagagacgggg

SEQ ID NO: 58070 - DNA, 201 bp, Homo sapiens
tcccagctactcgggaggctgaggcaggagaatcgcttgaacctgggaggcagaggttgtgctgagccgaaaatgcaccattgcactccatccaaaaaaawttttttttatatagttgtacatatttatggggtacatgtggtggtatttttatacaggtatacaatatgtaatgaccaaatcagggtaagtgggatatcc

SEQ ID NO: 58071 - DNA, 201 bp, Homo sapiens
cataagccaccgtgcctggcctgtgtctacattcttaggaagttcccaggtgaaaccaaatgccactggatccacactttgtgtggtaaagtgctagactrtgctccctggaaacacgagcctggaagcacataggcctccaactccccacatcagcctggcttaagcaccgtaggctggagttcctgagtacagccaatc

SEQ ID NO: 58072 - DNA, 201 bp, Homo sapiens
ggccaacatagcaagacctcgtctctacatataataaaaaaattagccagatgtggtggtggacgtgtgtggtcccagctactcaggaggctgaagtgggrggatggcttgactgtgggaggtcgaggcttcagtgagccatgatcacgccattgcactccagcccgggtgacagagtgagaccttgcctctaagaaaaaa

SEQ ID NO: 58073 - DNA, 201 bp, Homo sapiens; identical to SEQ ID NO: 10976

SEQ ID NO: 58074 - DNA, 201 bp, Homo sapiens
tagaactggttggtgagtggggatcctgcagtcacactctccacctgagggcagaaagggtggggcaggcatgtgagatcctggctcccctccctcttccrctctttcccattcactgactccggggttgggtgccctgtccttccctggggctcatgtcttggggcccaattcccctgtctcaaggaaagggcagaaata

SEQ ID NO: 58075 - DNA, 201 bp, Homo sapiens; identical to SEQ ID NO: 10940

SEQ ID NO: 58076 - DNA, 201 bp, Homo sapiens
ggcgacaggggcccagggtctcaggtcctgacaacatggggcagtgagtatacctgtcagaggttggtgatggggctctgggccttcaaggccatcacacragggtgcaggcggcccaggtcatggtcagccctgtagcagacacctcggggagcagccagatagaactggttggtgagtggggatcctgcagtcacactc

SEQ ID NO: 58077 - DNA, 201 bp, Homo sapiens; identical to SEQ ID NO: 10905

SEQ ID NO: 58078 - DNA, 201 bp, Homo sapiens
gctggctcagcacctgcaggaaggtcaagcttactgcctcccatcttccccttcgtgtcttgaagtgtggagcacatgactgggttccccccatgaagacyacacatgaacagcagctcattaccagcctgatttcaggatgaacttttatgcagtcacggagtgagtgaacatgcatgattcttagtgtgacatcagaac

SEQ ID NO: 58079 - DNA, 201 bp, Homo sapiens; identical to SEQ ID NO: 10943

SEQ ID NO: 58080 - DNA, 201 bp, Homo sapiens; identical to SEQ ID NO: 10944

SEQ ID NO: 58081 - DNA, 201 bp, Homo sapiens; identical to SEQ ID NO: 10907

SEQ ID NO: 58082 - DNA, 201 bp, Homo sapiens
ttgtgtgctattttaattaattgctgtttctgtggtggtgggtcagtatgtcttaattctgaatgttttccctgcacctcctaaaagatcttttttccccyaagtcctaacagaatggtatattcctctggaaaaagatgaacgtcaccaatggattgtgctgctctcgtttcagctttgatttttttgtccttgagaacc

SEQ ID NO: 58083 - DNA, 201 bp, Homo sapiens
tttcttaaaatggttatagtttaaatagacctctgtgagtgtactgctctttctacagtcagggtcattaacaaatatgctaccaggtgactgcctctgakttcagagactgaactatgtcattacagagccacctgttaatcattttctttttcctttcctcagatcattgcttttgtcctggaaggaaaaagatctaaa

SEQ ID NO: 58084 - DNA, 201 bp, Homo sapiens
gaactacactatggcagaggccacagccactgtggggcacctgatgttccccagacctaaacagctgggcttccccactcctcagcagatgacctgagacyggtgttccggaaactgcccccacagattcttctgctgtcttcccattcccgtgccagagggatgccgggtccctggctcctctgctttttccatttttta

SEQ ID NO: 58085 - DNA, 201 bp, Homo sapiens; identical to SEQ ID NO: 10901

SEQ ID NO: 58086 - DNA, 201 bp, Homo sapiens
cgcccagggtggagtgcagtggtgcgctttcggcttactgcaaactctgcctcccgggttcaagtgattcttgtgcctcagcctcctaagtagctgggatkacaggcatgtgccacacacctggctaatttttgtatttttagtagagatggggtttcaacatgttggccaggttggtctcgaactcctgacctcaagtga

SEQ ID NO: 58087 - DNA, 201 bp, Homo sapiens; identical to SEQ ID NO: 10926

SEQ ID NO: 58088 - DNA, 201 bp, Homo sapiens; identical to SEQ ID NO: 10927

SEQ ID NO: 58089 - DNA, 201 bp, Homo sapiens; identical to SEQ ID NO: 10929

SEQ ID NO: 58090 - DNA, 201 bp, Homo sapiens
cctggccaggacagtgtcagttcccagaggtcctgggacaggggagaagggaggtcagggtcacagagagagaggcaggaagtagcaaaggcagagtctgyctgtgcaccaagcccgacccccctgctctgcccctgggccgtctctacctcaccccctcagctcccccggtctgagagaggggaggccgagccggctgca

SEQ ID NO: 58091 - DNA, 201 bp, Homo sapiens; identical to SEQ ID NO: 10931

SEQ ID NO: 58092 - DNA, 201 bp, Homo sapiens
tgtgttgggattacaggcgtgaaccaccgcgcctggcctatagtactttttaatgaacgaaatgactatgttactggtttatgtatttgctatatttttattgttttaaacaaaaaagtttaagaagtaaaaaaaaaaatgtttttgtttttgttttctttgagagggagtctcgcattgctgcccaggctggagtacagt

SEQ ID NO: 58093 - DNA, 201 bp, Homo sapiens; identical to SEQ ID NO: 10932

SEQ ID NO: 58094 - DNA, 201 bp, Homo sapiens
gtgttgggattacaggcgtgaaccaccgcgcctggcctatagtactttttaatgaacgaaatgactatgttactggtttatgtatttgctatatttttatwgttttaaacaaaaaagtttaagaagtaaaaaaaaaaatgtttttgtttttgttttctttgagagggagtctcgcattgctgcccaggctggagtacagtg

SEQ ID NO: 58095 - DNA, 201 bp, Homo sapiens
gtttttgttttctttgagagggagtctcgcattgctgcccaggctggagtacagtggcatgatctcagctcactgcaacctccgcctcccgggttcaagarattctcctgcctcaacctccctagtagctgggattacaggcgcccgccaccgtgtccggctaatttttatatttttagtagagttggggttttgaggtca

SEQ ID NO: 58096 - DNA, 201 bp, Homo sapiens
tacaggcatgcaccaccatgtccagctaaattttttttttgtatttttagtagagacggggtttcaccatgtatgtcatgccggtctggaacacctgacckcaaatgatccgcctgcctcggcctcccaaagtgctggaattacaggcttgagccaccgcacccagccagaattttttttttctcttgtcttctctttttt

SEQ ID NO: 58097 - DNA, 201 bp, Homo sapiens
aaactcctgacctcaagtgatctgcctgcctcgtcctcccaaagtgctgggattgaaggcgtgagtcaccgtgcccggcctgcttcgttcatgtaactaartatttgtgaggccctcaggttgtgttcaggaggaagagacacaggaacacagatggagggcaagagggacagatggctctagctgggctgcctgggtgag

SEQ ID NO: 58098 - DNA, 201 bp, Homo sapiens
gagtctgcctgtgcaccaagcccgacccccctgctctgcccctgggccgtctctacctcaccccctcagctcccccggtctgagagaggggaggccgagcmggctgcagacccaaccacatggggcaggggaaggagaggctggcattggtggagccacccactgcactgccagtcatacaaagaagtctatcacacagaa

SEQ ID NO: 58099 - DNA, 201 bp, Homo sapiens
accaagcccgacccccctgctctgcccctgggccgtctctacctcaccccctcagctcccccggtctgagagaggggaggccgagccggctgcagacccarccacatggggcaggggaaggagaggctggcattggtggagccacccactgcactgccagtcatacaaagaagtctatcacacagaattatgtgcagtatt

SEQ ID NO: 58100 - DNA, 201 bp, Homo sapiens; identical to SEQ ID NO: 10894

SEQ ID NO: 58101 - DNA, 201 bp, Homo sapiens
caccaataggcactctgtatctagctcaaggtttgtaaacacgccaatcagcaccctgtgtctagctcaaggtttgtgaatgcaccaatcgacactctgtrtacagctactctggtggggacttgcagaacctttggtccacactctgtatctaactaatctagtgggcaggtggagaacctttgtgtctagctcagggat

SEQ ID NO: 58102 - DNA, 201 bp, Homo sapiens
ctgcagcttcactcctgaagccagcgagaacacgaacccaccgggagcaacgaacaactccagatgcgccgccttaagagctagctgtaacactcaccgcraaagtccgcagcttcgctcctgagccggccagaccatgaacccaccagaaggaagaaactcccaacacatccgaacatcagaaggaacaaactctggaca

SEQ ID NO: 58103 - DNA, 201 bp, Homo sapiens
ggccagaccatgaacccaccagaaggaagaaactcccaacacatccgaacatcagaaggaacaaactctggacacgcctttaagaactgtaacactcaccscgagggtccgcggcttcattcttgaagtcagtgagaccaagaacccaccaattccagacatacctccccactgaagtttttcatgctacaaccagagtaa

SEQ ID NO: 58104 - DNA, 201 bp, Homo sapiens; identical to SEQ ID NO: 10938

SEQ ID NO: 58105 - DNA, 201 bp, Homo sapiens
cacgaacccaccgggagcaacgaacaactccagatgcgccgccttaagagctagctgtaacactcaccgcgaaagtccgcagcttcgctcctgagccggcsagaccatgaacccaccagaaggaagaaactcccaacacatccgaacatcagaaggaacaaactctggacacgcctttaagaactgtaacactcaccgcga

SEQ ID NO: 58106 - DNA, 201 bp, Homo sapiens
cccaggccacttttacagctgtttcaacttgatgttggcaggggcctgctcttctgtgtcctcctgcctgggaaggacactgccccaggttcctattcttycacctcccctgcctctgctccaagccccttcagaggcaggtaaagcccagccctggtcctcagcccccatgagctggctcagcacctgcaggaaggtcaa

SEQ ID NO: 58107 - DNA, 201 bp, Homo sapiens
atggtggtggccaagaggagcctgcccctagtgacctcacttccgcggccagtgcgagaggcgagggagctccagctctgcctgtaaggtctcggaagtamgaggcggaggggacgaaaaacggggggccagactgttgtggctgtggtggagacgagaaaccaggaagaagaggctcgcttcccactcggcgaccgtaag

SEQ ID NO: 58108 - DNA, 201 bp, Homo sapiens
tagtaaaaatgtgcattcctggcccggtgcagtggctcctgcctctaatcccagcactttgggaggccgaggcaggaggatcgcttgagcccaggagtccragaccagcctggccaacatagcaagacctcgtctctacatataataaaaaaattagccagatgtggtggtggacgtgtgtggtcccagctactcaggagg

SEQ ID NO: 58109 - DNA, 201 bp, Homo sapiens
cccagagaggtgccataacttgctcagggtcacacagcacgtaagtgccaaaggcagggagctgtagctgctccagcgtggatatgccagggactagtgamaagcccaacccctccagcccaactccacccttcctcatgccaacaaaaggagaatcatttcctatttctggcatctttgccagcccacagagacagagag

SEQ ID NO: 58110 - DNA, 201 bp, Homo sapiens
gtgtgggtccagttactagacagaggagccaaggccgcagcaagcactcacgaccaagatgtggcctgcagcaggggagatgctgacagtccggacttgayggctgatgggacgggaaggggcagggtgcctgggatggggcgtggaggctgggggatcttgagagtgctgaaggtcaatgagaagtgggtctgggcagtg

SEQ ID NO: 58111 - DNA, 201 bp, Homo sapiens
cctcagtttccacccttgtaaagtggaatgctaatgctgcaccttgaagagctgttatcaagtcagagacgctgtatataaagtgccacgcttgatgctgrgtggatagtgggcactcaaacaaaagcagtgattagtgttagtactttcattctacaacctcagtcaaatgagggaccaggcccagggccagatcctcaa

SEQ ID NO: 58112 - DNA, 201 bp, Homo sapiens
taatgtctaagaccccatccagcttctacaattcctccctgtgtccggggactgtggggtcatgtgcctttattgctggatgctgaagacaagatgaggabcccagtcctggatccctctagaggctcccaggggataatgggttcaaatgggtgttctgtgtgtcacccagttctgagatgtgtatgtgtgcatgtgtgt

SEQ ID NO: 58113 - DNA, 201 bp, Homo sapiens
tcagtgctttacatgcatcatctcatttaatccccatgacagttctcctaggcaggtagcctcacaaacccattttacaaggcccagtgaggttgtggcarttgccaaggtcacacagctcagaactcaggcctgtctgactccatagccacactgctatttaaggagctaggttagccaaggtcacagtcagaggcattg

SEQ ID NO: 58114 - DNA, 201 bp, Homo sapiens
gctctgttcaggctagagtgcagtggcacaatcttgactcactgcaacctccgcctcccaggttcaagcgattctcctgcctcagcctcccaagtagctgrgaccacaggcatgcaccactatgcccgactaatttttgtatttttagtagagatggggtttcgccatgttgcccaggatggtctcaaactcctgggcttg

SEQ ID NO: 58115 - DNA, 201 bp, Homo sapiens
gtctgctgctcaagacccacaggacgccgggaagactgtgagtaccgggcctgaaagcacttgggaagtgatttctctgaagaccgggctggagggagacwggggaaagcagcctgccacggggcagggagggaggcaggcaggaggactcccttcctctcggggctgtccttctggatggagggcccgtggtctggtggc

SEQ ID NO: 58116 - DNA, 201 bp, Homo sapiens
cagatttgaaaagggcaaaatgggaagaagccatcacctttaccattcccactccaggaagttttcctagaacgatgactgtccaagtgtggtccctgggscagcagcatcaggatcctgtggcagcttgtgagaaatgcacactctcaggcccctgtcccagccccaccacgccagaagccctgcacggggtgggggtag

SEQ ID NO: 58117 - DNA, 201 bp, Homo sapiens
gagtcagaggaaaaaggagtgagtatcaccctacacagcagggaacaactttaccatgttttttgtcgtgtcttgttgtgtgaccatttaattgtaatatyggcatttacttttgctgttgttatactttgtcatctcaactctactaaaaaacctcccaccgttatttcctctgccttttattactgtctctcatttaaa

SEQ ID NO: 58118 - DNA, 201 bp, Homo sapiens
tccctggagacgggcggggaggccaaacttcctgctgaagctctgtggcctcttttggggtgggggcgggggtccaggcagaaagaaaccgtctgctgctmaagacccacaggacgccgggaagactgtgagtaccgggcctgaaagcacttgggaagtgatttctctgaagaccgggctggagggagacaggggaaagca

SEQ ID NO: 58119 - DNA, 201 bp, Homo sapiens
aggtacatgtcccgagagcgtgtggggggaactcgagcccccgtctatgacttagccttgaacatcgtgctgtgtccttctaccatattctactattgagrcccttacgaagctccacccagggtgaaggggaagagacatcaatgcccctcttgatggtggagtgttgatgccacactgtgaaaagggcacatggaatgg

SEQ ID NO: 58120 - DNA, 201 bp, Homo sapiens
ctgggggctggggaaactcagggtgacctccagagcctcaggtggcagcttactgtatgatcgaggtgatttttaatgtctcagagcagccccagggtcakcagagacagaccaagctgtgccatctggaagggccagcttcgaatctagttctggcccctagggttgcaccagtgacttcaagcctccaagtctcagttt

SEQ ID NO: 58121 - DNA, 201 bp, Homo sapiens
cattcacttgtcttattgctaggaagaaatctctgtactttcgcggtctctgggagggcccctggtgagcagactgtccctggacctggttggaagcagtygtggagctctcactactcccagcttcagctcagttggtccttaaaaagtcagttctctccccttgccataaatccccaccgtctctaactcccatcacta

SEQ ID NO: 58122 - DNA, 201 bp, Homo sapiens
cgatcgataggggaggtggaccagctcactgggaaggtgtgatgggtatccgtggtgcctgaccctggtctcttccctttagcggagatgcccgggtatgrgggcagcctggctaaggggagggagtcaagaatctctgaatatttgaaacagtctagtagttaagagacgcctgagcagaaaatagagcactttgcagaa

SEQ ID NO: 58123 - DNA, 201 bp, Homo sapiens
cctctgcaaaatgaagacgatatggataagaaagtctcaggtttggctgctcgtcagaatcacatcagggagctttgaaaaaacacccagggcctgggccraaccacccaagaagttctgattcacttgctctggggtgtagcttggacacgggaatctttttagaagctccccaggttgttgcaagagtagccaaggttg

SEQ ID NO: 58124 - DNA, 201 bp, Homo sapiens
ctcttccctttagcggagatgcccgggtatgagggcagcctggctaaggggagggagtcaagaatctctgaatatttgaaacagtctagtagttaagagaygcctgagcagaaaatagagcactttgcagaaaatctctttggactaaggcctgtcacccggacactggctaattaaacaaacaaaaaccataatatgttt

SEQ ID NO: 58125 - DNA, 201 bp, Homo sapiens; identical to SEQ ID NO: 11081

SEQ ID NO: 58126 - DNA, 201 bp, Homo sapiens
cctcactcttcacaacgctgaagcgattccaggctggactcttaatctggtgaagcaccatctagagactgtccccaccatctttcccatcctggctcaamtcaaaccccttctacatctgctccttttaggggaaagaacacagctctccaacccactcagacctagcttcaggtcctgcaaggtctcagcaaagtcact

SEQ ID NO: 58127 - DNA, 201 bp, Homo sapiens
ctgcaggctgcactccctgcagtggccgtgggggatgagccattgttccttgcccccgccagcttctgacgcactccttggcctgtggtcacatcactctmattgctgtctccctggtcatatcaccttagctttctcatctgtttaatctcccttcacttccctcttattaggacccttgggattacatttaggagctac

SEQ ID NO: 58128 - DNA, 201 bp, Homo sapiens
ataagctgccttctaccaccacgcctgatacttaggaaagccccaatatctgggattgtttttgttgttttgttgaaaatatatatatatatatatatttkttttttttttttgagacggggtctcgctctgttcaggctagagtgcagtggcacaatcttgactcactgcaacctccgcctcccaggttcaagcgattct

SEQ ID NO: 58129 - DNA, 201 bp, Homo sapiens
atgtggacttgggatgtgcactgtttgggttcaaattccagctgtgctgttcacaagctgggtgactttggacgaataacctttctgtgcctgtttcctcrtttgcaaaacgaaactgataatagtatctttccatagagttttggcatgaaacaaatttttatgtaaatttcctaggatagtgacatatggtaagtgcta

SEQ ID NO: 58130 - DNA, 201 bp, Homo sapiens
ctctaattgctgtctccctggtcatatcaccttagctttctcatctgtttaatctcccttcacttccctcttattaggacccttgggattacatttaggakctacatggataatccaatattgtctccccatttcaagagcctttatctttttttgttttttgtttttttttttgacggagtcttgctttgttgcccaggc

SEQ ID NO: 58131 - DNA, 201 bp, Homo sapiens
ggggagggtggcacagtggccaggttactctggtagtaagcgccctggccctctaggtcccagttctcagagtggccagaaggctgcagcctggagattarcaccaatgctggcacttgtcaccggtagagaggtgggacaaaaatagattcatcaagaggggtccagacttctgctccaaactttcagggtttccttcgt

SEQ ID NO: 58132 - DNA, 201 bp, Homo sapiens
ttcctttgtccttctccatcttctctgaatctatcccagatctcaagtgacctttctaaatgggaagatatatcctggaacttcagagatatttagaaatrctcaaaactgggaagttcttcttacagtctaactgaaatccctcctatgatagctgaaacccacttcttccttttctttctgtcccttgggggatattga

SEQ ID NO: 58133 - DNA, 201 bp, Homo sapiens
tcctggtgccaaataaaggagaaaaagttgtcattggatgtcacctctgccgatcgataggggaggtggaccagctcactgggaaggtgtgatgggtatcygtggtgcctgaccctggtctcttccctttagcggagatgcccgggtatgagggcagcctggctaaggggagggagtcaagaatctctgaatatttgaaac

SEQ ID NO: 58134 - DNA, 201 bp, Homo sapiens
tgggctgatctcacttctgtttgcttctgtggacctagaaatgatcactgcccccagtgaatatggtgaagaagctggtgatggcccagaagcggggagaracacgagccctttgcctgggtgtaaccatggtggtgtgtgccgtcatcacctactacatcctggtcacgactgtgctgcccctctaccagaaaaggtact

SEQ ID NO: 58135 - DNA, 201 bp, Homo sapiens
ggggtgtatgcagctggaaaaggctgtcagggcagactaaggtctgttcccagaggcctttgatcaccacaatatggaattaaaatgtgagtgtgtatgtstcaagatatgtcaactttggctatgcattagaaccctgtaagagtcttaaaaaacaaaactagggtccaacactagacatatcaaggtggaatctctggt

SEQ ID NO: 58136 - DNA, 201 bp, Homo sapiens
gcaatgggaatctttagggcatgatcagagtttcagagttgggctgggaagatggagcctacaggtgtgtgggtccagttactagacagaggagccaaggmcgcagcaagcactcacgaccaagatgtggcctgcagcaggggagatgctgacagtccggacttgatggctgatgggacgggaaggggcagggtgcctggg

SEQ ID NO: 58137 - DNA, 201 bp, Homo sapiens
caaaaggaaggagggagtggggcaaaggctgaaaatcttctttttgggtactatgttcactctatcagtgatgggatcaatagaagctcaaacgtcagcawcacgcattacaccctcacaacaaacctgcacgtgtatcccccgaatctataattaaaattcaagaaagaaaagtgttttatgtacaactgtgaaactata

SEQ ID NO: 58138 - DNA, 201 bp, Homo sapiens
ggcacgttccagcagctgacagcccccttctgactggcaatgggtctcccacaggatacttgggagttgaagcacaactgatttactaatatgttgatgarcctgttagcctctcccgggcctgctgcagcctcactcttcacaacgctgaagcgattccaggctggactcttaatctggtgaagcaccatctagagactg

SEQ ID NO: 58139 - DNA, 201 bp, Homo sapiens
ctcagtgctttacatgcatcatctcatttaatccccatgacagttctcctaggcaggtagcctcacaaacccattttacaaggcccagtgaggttgtggcrgttgccaaggtcacacagctcagaactcaggcctgtctgactccatagccacactgctatttaaggagctaggttagccaaggtcacagtcagaggcatt

SEQ ID NO: 58140 - DNA, 201 bp, Homo sapiens
ctttgcatcactttccagctggcctcatctgaacagggcagaaagttcctaataacaataatcaacgtcagaattaaatgtgtgtcatgctctgctggcayaaaactcttttcaatgcattctttctttcctttggatcccagtgtcaaatacccgcttgccaacatagtttgtttgctgtacacaggttgaaactgcaaa

SEQ ID NO: 58141 - DNA, 201 bp, Homo sapiens
gggatgtgcactgtttgggttcaaattccagctgtgctgttcacaagctgggtgactttggacgaataacctttctgtgcctgtttcctcgtttgcaaaaygaaactgataatagtatctttccatagagttttggcatgaaacaaatttttatgtaaatttcctaggatagtgacatatggtaagtgctatctaagttac

SEQ ID NO: 58142 - DNA, 201 bp, Homo sapiens
tgtaaagtgaggggctaggactcaagcctggagctgtgtgttccagtacctggcatctcaaccacagaactcagcagagccagctgtgaagggctgagggrcagagccagctgtgaagggctgaggggcagagccagctgtgaagggctgaggggcagagccagctgtgaagggctgagggacacagccactcaaagccac

SEQ ID NO: 58143 - DNA, 201 bp, Homo sapiens; identical to SEQ ID NO: 11082

SEQ ID NO: 58144 - DNA, 201 bp, Homo sapiens
caggggaaaaggccatgttcctctagaaaaattagtatgtgaggatgcctaacccccactgtcccataaattattaatgatgaccttcatttgcttgagayagatgttctcctcctgtcaataaagactggccttctagcaaatgccacaactgtctgctgctcacagaactttatgcacgggataagcatgaaataatgg

SEQ ID NO: 58145 - DNA, 201 bp, Homo sapiens
ctgcaaggaacttggtgtcttcttgccattctccctccctacccctcactaatcattgtgaggggcttccttcttcacagtgaagactcagcattatgcasatttaaaataatgcaatataaatattaatataatcttattttctgtgacttactgaagtgataccagctcctcctctaaatcaacaactcatccaaaatt

SEQ ID NO: 58146 - DNA, 201 bp, Homo sapiens
taaattcaaattaaatatttttaccattcttagttctaatctctaaaatggtaactgttaatagatataacccatatacaccaaagctcttaggatccttratattttttaagcatgtaaaagggtcctgatgatgaaaagcttcagaactgccagcctagtgcatccagagacaaggcctccaggcccctcccacaccgt

SEQ ID NO: 58147 - DNA, 201 bp, Homo sapiens
gggatgtgtcttctgtccccacgccccatgagattgctgcactgagtcctcctcctgtgtcaattctggagccccttttactcaactcccctttgattccrcatgttcaaatacaaacacttgttctccaagtgccagtaagactttagagatcatctagtgcttctccactttatatttggtgcttgaactctctgttgt

SEQ ID NO: 58148 - DNA, 201 bp, Homo sapiens
gataagctgccttctaccaccacgcctgatacttaggaaagccccaatatctgggattgtttttgttgttttgttgaaaatatatatatatatatatattwtttttttttttttgagacggggtctcgctctgttcaggctagagtgcagtggcacaatcttgactcactgcaacctccgcctcccaggttcaagcgattc

SEQ ID NO: 58149 - DNA, 201 bp, Homo sapiens
gagtttcagagttgggctgggaagatggagcctacaggtgtgtgggtccagttactagacagaggagccaaggccgcagcaagcactcacgaccaagatgyggcctgcagcaggggagatgctgacagtccggacttgatggctgatgggacgggaaggggcagggtgcctgggatggggcgtggaggctgggggatcttg

SEQ ID NO: 58150 - DNA, 201 bp, Homo sapiens
tactagacagaggagccaaggccgcagcaagcactcacgaccaagatgtggcctgcagcaggggagatgctgacagtccggacttgatggctgatgggacrggaaggggcagggtgcctgggatggggcgtggaggctgggggatcttgagagtgctgaaggtcaatgagaagtgggtctgggcagtgcaggatggtcagg

SEQ ID NO: 58151 - DNA, 201 bp, Homo sapiens
acaccctcacaacaaacctgcacgtgtatcccccgaatctataattaaaattcaagaaagaaaagtgttttatgtacaactgtgaaactataatatatcartttaaagaagaaaaatgtttcatggcatgggaaaatgattataatattctgttatgtaaaaaagcgagagattttttttcccgaaaaccaaagcacgatg

SEQ ID NO: 58152 - DNA, 201 bp, Homo sapiens
aggctgggggatcttgagagtgctgaaggtcaatgagaagtgggtctgggcagtgcaggatggtcaggtgttctgtcatcgctagtatgactcggccccamccggtggagagaggtctcagggcccactggaggcagctcctacccatgacccctgcctctgcgttggcattcagtagcccttgatttatcccaatgcaag

SEQ ID NO: 58153 - DNA, 201 bp, Homo sapiens
acaacaaaaccgcaagatctttgtttattcctcctggcgctagagatgcggcagtgaataagaacggttccagtccctgattttagagagcttacccttgrgttaggagacatgttaatggaggatgcacatgaataaatgttaaattacaggcggaggaagtgttctgcagaagaggcatgcggtgctcccagcatgcgg

SEQ ID NO: 58154 - DNA, 201 bp, Homo sapiens
aatgagaagtgggtctgggcagtgcaggatggtcaggtgttctgtcatcgctagtatgactcggccccacccggtggagagaggtctcagggcccactggrggcagctcctacccatgacccctgcctctgcgttggcattcagtagcccttgatttatcccaatgcaagaaacaaattttcaataactggtaacattctc

SEQ ID NO: 58155 - DNA, 201 bp, Homo sapiens
taggagacatgttaatggaggatgcacatgaataaatgttaaattacaggcggaggaagtgttctgcagaagaggcatgcggtgctcccagcatgcggaascagagcttccgcctggcccaggaggcgcggagagtggctaaggggctgggggcgagggaaggccccagcggggagtcctgtggaagaggaagagctggcc

SEQ ID NO: 58156 - DNA, 201 bp, Homo sapiens
ttttactcaactcccctttgattccgcatgttcaaatacaaacacttgttctccaagtgccagtaagactttagagatcatctagtgcttctccactttayatttggtgcttgaactctctgttgtctcacagaaagatatttggtctttggtacagaggtcctttaggggcgataggagtgtcttttttccagtgagata

SEQ ID NO: 58157 - DNA, 201 bp, Homo sapiens
tgttaacagcatggcaggataaaggaagaaaaatcaggccaagggaaaatatggtgaaaagagtcagaggaaaaaggagtgagtatcaccctacacagcakggaacaactttaccatgttttttgtcgtgtcttgttgtgtgaccatttaattgtaatatcggcatttacttttgctgttgttatactttgtcatctcaac

SEQ ID NO: 58158 - DNA, 201 bp, Homo sapiens
gtctctcatttaaaacacatctttcactttctgttctgtatttttgtagttgaggaaatctggcatcgcttttctgcagtgaagggaccgtgtctgagtcrcctcggcacagtggtgtatccagagcctctgcatagcaagtgctgggatgtctgtgaacgcacagcttcgctaggactgagagtgactaacacccatccc

SEQ ID NO: 58159 - DNA, 201 bp, Homo sapiens
ctattgtgagcctattgtgctagtaccttaagaagctgttggaagagtcagagaagatattttgtgatctctgacaccccgtactaatgcaaaccgtcaayatttattgttgcagcattgttattttcttgccctccacctgtagccatctgtcacacacaaccccgcagccagcaaaggacctgggttttcacccacaaa

SEQ ID NO: 58160 - DNA, 201 bp, Homo sapiens
ttagggggagcagaagaccccacggccccccttccctgtttgttcccaccttcccttgggaagaatgctaaagtttgtttatgatttccaaataatatgtrgcccttaataacttattcagagtatcacgagcaaggagcccttcggttatactcataaatggcagcctgttgcactgtgtatctctcccccagggaagca

SEQ ID NO: 58161 - DNA, 201 bp, Homo sapiens
gggcctggcatttctggattagccccaggaggacttttcctgcttctgagtggacagaggatcatccttggaaaattgctcttctgagattgaattccagrtcctacatccctctgtcaatctgcctgcaaggtctgaagctggtcttagaccctctggtgctatggtgcccattaaacagacactgtagtctcctgttaa

SEQ ID NO: 58162 - DNA, 201 bp, Homo sapiens
attcacttgtcttattgctaggaagaaatctctgtactttcgcggtctctgggagggcccctggtgagcagactgtccctggacctggttggaagcagtcktggagctctcactactcccagcttcagctcagttggtccttaaaaagtcagttctctccccttgccataaatccccaccgtctctaactcccatcactac

SEQ ID NO: 58163 - DNA, 201 bp, Homo sapiens
tcaagcgattctcctgcctcagcctcccaagtagctgggaccacaggcatgcaccactatgcccgactaatttttgtatttttagtagagatggggtttcrccatgttgcccaggatggtctcaaactcctgggcttgagcaatccatctaccttggcatcccaaagtgctgggattatgggcgtgggccactgtgcctgc

SEQ ID NO: 58164 - DNA, 201 bp, Homo sapiens
gtgagcagactgtccctggacctggttggaagcagtcgtggagctctcactactcccagcttcagctcagttggtccttaaaaagtcagttctctcccctygccataaatccccaccgtctctaactcccatcactaccctaaagcaaagtaggttttaaaaatgccagtaacacaagtgagaaaactgaggtcatttaac

SEQ ID NO: 58165 - DNA, 201 bp, Homo sapiens
ctttgcctgggtgtaaccatggtggtgtgtgccgtcatcacctactacatcctggtcacgactgtgctgcccctctaccagaaaaggtactgagctctccyggcctgcccaccccccaaccctctcctaagggtctggcatctgtaaggaaccctggccttctactcacccctctccttgaccctcattcaaggcagcagg

SEQ ID NO: 58166 - DNA, 201 bp, Homo sapiens
aatgtctaagaccccatccagcttctacaattcctccctgtgtccggggactgtggggtcatgtgcctttattgctggatgctgaagacaagatgaggatsccagtcctggatccctctagaggctcccaggggataatgggttcaaatgggtgttctgtgtgtcacccagttctgagatgtgtatgtgtgcatgtgtgtg

SEQ ID NO: 58167 - DNA, 201 bp, Homo sapiens
gctccatgacatatcaaccacttgagattttaaggaaaagctgtgaattcctaattcgtgttctatttggaacaaagacactcagttcccccagcctgtcyttaggataagtctcagacctgtgctctgggcacgttccagcagctgacagcccccttctgactggcaatgggtctcccacaggatacttgggagttgaag

SEQ ID NO: 58168 - DNA, 201 bp, Homo sapiens
gagccagccctagctcttctgtgttggagtcacacagacctgggtttgaatctgccgctaactggctgtgtaaacataggcaggccacttagcctctcacytcctcagtttccacccttgtaaagtggaatgctaatgctgcaccttgaagagctgttatcaagtcagagacgctgtatataaagtgccacgcttgatgct

SEQ ID NO: 58169 - DNA, 201 bp, Homo sapiens
caatcttgactcactgcaacctccgcctcccaggttcaagcgattctcctgcctcagcctcccaagtagctgggaccacaggcatgcaccactatgcccgrctaatttttgtatttttagtagagatggggtttcgccatgttgcccaggatggtctcaaactcctgggcttgagcaatccatctaccttggcatcccaaa

SEQ ID NO: 58170 - DNA, 201 bp, Homo sapiens
tggtaaaaccaggttcctgccttcaccagcctcaggagtgcccaggggcctgagagggcactagaagccaaatagcagaggaggccatggccctgggcgckggggggggctgattagccaggaaggagccacaggaagcccccacaggtgcgatccagttcccccaggagagaaatggctttgttgtgggcactcagccct

SEQ ID NO: 58171 - DNA, 201 bp, Homo sapiens
gagattgctgcactgagtcctcctcctgtgtcaattctggagccccttttactcaactcccctttgattccgcatgttcaaatacaaacacttgttctccragtgccagtaagactttagagatcatctagtgcttctccactttatatttggtgcttgaactctctgttgtctcacagaaagatatttggtctttggtac

SEQ ID NO: 58172 - DNA, 201 bp, Homo sapiens
gacccttgggattacatttaggagctacatggataatccaatattgtctccccatttcaagagcctttatctttttttgttttttgtttttttttttgacrgagtcttgctttgttgcccaggctggagtgcagtggcgcatctctgctcactgcaagctccgcctcctgggttcatgccattctcctgcctcagcctccc

SEQ ID NO: 58173 - DNA, 201 bp, Homo sapiens
ttgacggagtcttgctttgttgcccaggctggagtgcagtggcgcatctctgctcactgcaagctccgcctcctgggttcatgccattctcctgcctcagmctcccctgtagctgggactactggctcccacgaccacacccggctaattttttgtattttttttttttagtagagatggggtttcaccatgttagccagg

SEQ ID NO: 58174 - DNA, 201 bp, Homo sapiens
atatcctttcctaaagcgatcagttggcccatattctgtctctcttccttccttctttctttccttcttttttccctttcttccctccttctttcttttcttttttttcccctccctccttccctccctctctccctcccttccttccttccttccttccttccttgtttccttctttcctcctctcatttatttattcaa

SEQ ID NO: 58175 - DNA, 201 bp, Homo sapiens
agcgtgtggacccaggaatccaagtgccacctgattgagaccaacatcagggaccaggaggagctgaagggcaagaaggtgccccagtacccatgcctgtgggtcaacgtgtcagctgccggcaggtgggctgtgctgtaccacacggaggacactcgggaccagaaccagcaggtactgaactggagggatggggacaca

SEQ ID NO: 58176 - DNA, 201 bp, Homo sapiens
gtacatgtcccgagagcgtgtggggggaactcgagcccccgtctatgacttagccttgaacatcgtgctgtgtccttctaccatattctactattgaggcmcttacgaagctccacccagggtgaaggggaagagacatcaatgcccctcttgatggtggagtgttgatgccacactgtgaaaagggcacatggaatggga

SEQ ID NO: 58177 - DNA, 201 bp, Homo sapiens
tcctaaagcgatcagttggcccatattctgtctctcttccttccttctttctttccttcttttttccctttcttccctccttctttcttttcttttttttcccctccctccttccctccctctctccctcccttccttccttccttccttccttccttgtttccttctttcctcctctcatttatttattcaacagccatt

SEQ ID NO: 58178 - DNA, 201 bp, Homo sapiens
tggcagcttactgtatgatcgaggtgatttttaatgtctcagagcagccccagggtcagcagagacagaccaagctgtgccatctggaagggccagcttcraatctagttctggcccctagggttgcaccagtgacttcaagcctccaagtctcagtttcaggttctttgattcttgggtcaagtgaagggtggagataag

SEQ ID NO: 58179 - DNA, 201 bp, Homo sapiens
tctctcttccttccttctttctttccttcttttttccctttcttccctccttctttcttttcttttttttcccctccctccttccctccctctctccctcccttccttccttccttccttccttccttgtttccttctttcctcctctcatttatttattcaacagccattgagcacctcctgtgtcaagcctgtaggact

SEQ ID NO: 58180 - DNA, 201 bp, Homo sapiens
ccccaggttgttgcaagagtagccaaggttgagaaccagtcatatagataatgtctaagaccccatccagcttctacaattcctccctgtgtccggggacygtggggtcatgtgcctttattgctggatgctgaagacaagatgaggatcccagtcctggatccctctagaggctcccaggggataatgggttcaaatggg

SEQ ID NO: 58181 - DNA, 201 bp, Homo sapiens
ctctcttccttccttctttctttccttcttttttccctttcttccctccttctttcttttcttttttttcccctccctccttccctccctctctccctcccttccttccttccttccttccttccttgtttccttctttcctcctctcatttatttattcaacagccattgagcacctcctgtgtcaagcctgtaggactc

SEQ ID NO: 58182 - DNA, 201 bp, Homo sapiens
caataatcaacgtcagaattaaatgtgtgtcatgctctgctggcacaaaactcttttcaatgcattctttctttcctttggatcccagtgtcaaatacccrcttgccaacatagtttgtttgctgtacacaggttgaaactgcaaaggttttcaattttaaatttagctaatattttactttttttttttttttgaaatgg

SEQ ID NO: 58183 - DNA, 201 bp, Homo sapiens
tctcttccttccttctttctttccttcttttttccctttcttccctccttctttcttttcttttttttcccctccctccttccctccctctctccctcccttccttccttccttccttccttccttgtttccttctttcctcctctcatttatttattcaacagccattgagcacctcctgtgtcaagcctgtaggactca

SEQ ID NO: 58184 - DNA, 201 bp, Homo sapiens; identical to SEQ ID NO: 11074

SEQ ID NO: 58185 - DNA, 201 bp, Homo sapiens
agttttttcatctataaaagaaggactctttctggatagttgggagggctgaaggaatgtttgacacatcataggtgtttaaaatggcaactatagttttktttgtttgttttgtgtgtgtgtttttttcttaactttcattttaagttgcagggtacacgttcaggtttgttacataggtacacttgtgtcaagggagtt

SEQ ID NO: 58186 - DNA, 201 bp, Homo sapiens
ctcttccttccttctttctttccttcttttttccctttcttccctccttctttcttttcttttttttcccctccctccttccctccctctctccctcccttccttccttccttccttccttccttgtttccttctttcctcctctcatttatttattcaacagccattgagcacctcctgtgtcaagcctgtaggactcaa

SEQ ID NO: 58187 - DNA, 201 bp, Homo sapiens
ggctgtctctgctccacattctctgaggcctcagctgggaggctggcaggctgggggctggaactgtctgcaggcttgttctctcccatgcccggtgagakttgctagctgttggctgagatctgagctgaggctgtcagctggagcacggggcctcggcttcctacaacatggtggctggttcccaggtacatgtcccga

SEQ ID NO: 58188 - DNA, 201 bp, Homo sapiens
gcggagcttgcagtgagccgagatcgcgccacggcactccagcctgggtaacagagcaagactctgtctcaaaaaaaaaaaaaaaaaaaaaaaaaaaagawtaagtcatgaatactcagaaacttccagaagttatactgacaatgttatctggcatgtatgggtgcttatttattctgtgccaggcactgtactaattag

SEQ ID NO: 58189 - DNA, 201 bp, Homo sapiens
cagcacaggctgttatgtgagaatatccagtattctttgaattggtcttgtgtttgggggagtttgaattctatgaaatatttaagaagacactgtttgarcaaagtgccaccttcctgtacctcaccagccattgccctgtcacatggaagggaaagaaaatgaccaaagaaagatcagagagacatggagaaattcact

SEQ ID NO: 58190 - DNA, 201 bp, Homo sapiens
caaaagctgcttccctggagacgggcggggaggccaaacttcctgctgaagctctgtggcctcttttggggtgggggcgggggtccaggcagaaagaaacygtctgctgctcaagacccacaggacgccgggaagactgtgagtaccgggcctgaaagcacttgggaagtgatttctctgaagaccgggctggagggagac

SEQ ID NO: 58191 - DNA, 201 bp, Homo sapiens
tagagaggtgggacaaaaatagattcatcaagaggggtccagacttctgctccaaactttcagggtttccttcgttagtagtaatagctaatatttactgrgggctgatttggggctaggtgctatgatacatgtctgatactcaatatggcatttgatctttagctgaactctctgaggcaggtaccatggttctcgttt

SEQ ID NO: 58192 - DNA, 201 bp, Homo sapiens
cttcctttgtccttctccatcttctctgaatctatcccagatctcaagtgacctttctaaatgggaagatatatcctggaacttcagagatatttagaaaygctcaaaactgggaagttcttcttacagtctaactgaaatccctcctatgatagctgaaacccacttcttccttttctttctgtcccttgggggatattg

SEQ ID NO: 58193 - DNA, 201 bp, Homo sapiens
tttccagacttctctgtgacagggaagcctctcctttcctttccttctgagctcctaaaactggtaaaaccaggttcctgccttcaccagcctcaggagtrcccaggggcctgagagggcactagaagccaaatagcagaggaggccatggccctgggcgctggggggggctgattagccaggaaggagccacaggaagcc

SEQ ID NO: 58194 - DNA, 201 bp, Homo sapiens
ttcctttccttctgagctcctaaaactggtaaaaccaggttcctgccttcaccagcctcaggagtgcccaggggcctgagagggcactagaagccaaatascagaggaggccatggccctgggcgctggggggggctgattagccaggaaggagccacaggaagcccccacaggtgcgatccagttcccccaggagagaaa

SEQ ID NO: 58195 - DNA, 201 bp, Homo sapiens
atagcagaggaggccatggccctgggcgctggggggggctgattagccaggaaggagccacaggaagcccccacaggtgcgatccagttcccccaggagakaaatggctttgttgtgggcactcagccctaggcttccaagatgggatttcccattggcttcaaatgatttatgtctcacagtatctggggtggggccaag

SEQ ID NO: 58196 - DNA, 201 bp, Homo sapiens
tcaggagcctagcaggggagggtggaatctttgcttgcattggggtggagtcaatgtccaggggaaaaacaaggagttgctgcctaaagaaagaggagagraggaaagcaaccaccagcagaatgtgcccattctgctttgtcccaggtggcttcaagccctgaaataagaaagcagtcgctgaggccaccatgatgcctt

SEQ ID NO: 58197 - DNA, 201 bp, Homo sapiens
aagcaaccaccagcagaatgtgcccattctgctttgtcccaggtggcttcaagccctgaaataagaaagcagtcgctgaggccaccatgatgccttctttsttctttctttgcttgaagtaggggaatgttccttacaaaaaaaaaaaacaccggaatatggtaaacctcctgcctctcctgacaacctgcagctgccttc

SEQ ID NO: 58198 - DNA, 201 bp, Homo sapiens
caccccccaaccctctcctaagggtctggcatctgtaaggaaccctggccttctactcacccctctccttgaccctcattcaaggcagcagggtcaagacratgctcattcttaggttctagggttcaagtgcagggaaggtaggatgaactgagccccactggtctgagattctaggacctggtggtaacagacacatga

SEQ ID NO: 58199 - DNA, 201 bp, Homo sapiens
aaatagcaaagaatcagagcaaaggttccagtgcaagtttgatcccaggaggaatcagagaattgcagatgtttacagctcagctgcataattctctcccytctgaagcctccctgtcaggtgggcatccagcctcctgatgaatacctcaagagacggggagctccttgcctcactgaacatacatttcatgtttgaggt

SEQ ID NO: 58200 - DNA, 201 bp, Homo sapiens
agttctgagatgtgtatgtgtgcatgtgtgtggtctcctcagcgtgtggacccaggaatccaagtgccacctgattgagaccaacatcagggaccaggagragctgaagggcaagaaggtgccccagtacccatgcctgtgggtcaacgtgtcagctgccggcaggtgggctgtgctgtaccacacggaggacactcggga

SEQ ID NO: 58201 - DNA, 201 bp, Homo sapiens
gggatgttttccagctgacaatgatgggggtatcagaaaggctcttggtgagattgcaccattgcactccagcctggcaacaagagtgaaactccatctcaaaaaaaaaaaaaaaaaaaagaaaggctcttggattaggcttttaacatcaggcaggcgcaggatgcaaggcatagagaatgaggtgatataggaagcggg

SEQ ID NO: 58202 - DNA, 201 bp, Homo sapiens
gtgggcacctgtggtcccagctactcaggaggctgaggcaggagaatggcgtgaacccggggttcggagcttgcagtgagccgagattgtgccactgcactccagcctggtgatagaacaagactccgtctcaaaaaaaaaacaaaaaacaaaaaatgaaaaacaaccctctggaggaaaggtcatgatatagaggaggat

SEQ ID NO: 58203 - DNA, 201 bp, Homo sapiens
ctgaggcaggagaatggcgtgaacccggggttcggagcttgcagtgagccgagattgtgccactgcactccagcctggtgatagaacaagactccgtctcaaaaaaaaaacaaaaaacaaaaaatgaaaaacaaccctctggaggaaaggtcatgatatagaggaggatttgttatttaaattgagggtatggactctggc

SEQ ID NO: 58204 - DNA, 201 bp, Homo sapiens
ggccgggcgtggtggctcacacctgtaatcccagcactttgggaggccgaggtgggcagatcacgaggtcaggagatcgagaccatcctggctaacacggkgaaaccctgtctctactaaaaaatagaaaaaatcatagccgggcgtggtggtagccgcctgtagtcccagctgctcaggaggctgaggcagaagaatggc

SEQ ID NO: 58205 - DNA, 201 bp, Homo sapiens
tctggcatctttgccagcccacagagacagagagaagaagaaatatttccaaatataccaggctgatctttcgtagtttctcagtcttgctgtctgttgtygtttgaaatctgtttcccacgagactctgggaagatggaggtgcagggcttgggtaacagctgccttcctcagggctgggtacctgctctccgagtctgt

SEQ ID NO: 58206 - DNA, 201 bp, Homo sapiens; identical to SEQ ID NO: 11076

SEQ ID NO: 58207 - DNA, 201 bp, Homo sapiens
aaaaacaccggaatatggtaaacctcctgcctctcctgacaacctgcagctgccttctggggccctcctctcctttccctgcctgtgcccggcccagctarccctgccacagaactgtttctgggcagaaatactccaagtatccctgtgagataagtgccgtggaaggaggtgcatggatgatgcacatgtactgctcgc

SEQ ID NO: 58208 - DNA, 201 bp, Homo sapiens
acccatgatggggtgtatgcagctggaaaaggctgtcagggcagactaaggtctgttcccagaggcctttgatcaccacaatatggaattaaaatgtgagygtgtatgtctcaagatatgtcaactttggctatgcattagaaccctgtaagagtcttaaaaaacaaaactagggtccaacactagacatatcaaggtgga

SEQ ID NO: 58209 - DNA, 201 bp, Homo sapiens
gggcatgatcagagtttcagagttgggctgggaagatggagcctacaggtgtgtgggtccagttactagacagaggagccaaggccgcagcaagcactcasgaccaagatgtggcctgcagcaggggagatgctgacagtccggacttgatggctgatgggacgggaaggggcagggtgcctgggatggggcgtggaggct

SEQ ID NO: 58210 - DNA, 201 bp, Homo sapiens
atgctgacagtccggacttgatggctgatgggacgggaaggggcagggtgcctgggatggggcgtggaggctgggggatcttgagagtgctgaaggtcaakgagaagtgggtctgggcagtgcaggatggtcaggtgttctgtcatcgctagtatgactcggccccacccggtggagagaggtctcagggcccactggagg

SEQ ID NO: 58211 - DNA, 201 bp, Homo sapiens
gatggctgatgggacgggaaggggcagggtgcctgggatggggcgtggaggctgggggatcttgagagtgctgaaggtcaatgagaagtgggtctgggcartgcaggatggtcaggtgttctgtcatcgctagtatgactcggccccacccggtggagagaggtctcagggcccactggaggcagctcctacccatgaccc

SEQ ID NO: 58212 - DNA, 201 bp, Homo sapiens
tggtcctgagattgccagctcagaggagcatcccctgaatgaactgtcagcaggatgtgaaggaaggacatgctggagccactgctgtcctctcccctgcygcccaggcttgaccaggtgtggtgctgatagcaggctgcaggagctgggaggaagcagtggaaatgcccttcgtgtttttgccaagcagctgggttgtgg

SEQ ID NO: 58213 - DNA, 201 bp, Homo sapiens
cttgggaaaaagctggttggtttcagatcattcagataactcaggcttagctggacccaggacaggagagaaaggatgcattcaggccccggcttctgggkttggccatgaagagtgaattcctgcccagtgtcttgccaaacaggcccagcataaaagatccagaggaaccctgagcaggcagaggatacactaggccca

SEQ ID NO: 58214 - DNA, 201 bp, Homo sapiens
agtgcagcatctgcatttcccaggctgtgagaactacagtgcaaccctcctctgtgttgctggagtgaatgccctcagggcaggcagcttccagggtggcrcctcatataaatccagggagtggccgaggcctgcaaggaatctggctcaacacctgccatttgggtctcagttttacacattttgatcttgcacatgatt

SEQ ID NO: 58215 - DNA, 201 bp, Homo sapiens; identical to SEQ ID NO: 11080

SEQ ID NO: 58216 - DNA, 201 bp, Homo sapiens
ctacaattcctccctgtgtccggggactgtggggtcatgtgcctttattgctggatgctgaagacaagatgaggatcccagtcctggatccctctagaggmtcccaggggataatgggttcaaatgggtgttctgtgtgtcacccagttctgagatgtgtatgtgtgcatgtgtgtggtctcctcagcgtgtggacccagg

SEQ ID NO: 58217 - DNA, 201 bp, Homo sapiens
attcctccctgtgtccggggactgtggggtcatgtgcctttattgctggatgctgaagacaagatgaggatcccagtcctggatccctctagaggctcccmggggataatgggttcaaatgggtgttctgtgtgtcacccagttctgagatgtgtatgtgtgcatgtgtgtggtctcctcagcgtgtggacccaggaatcc

SEQ ID NO: 58218 - DNA, 201 bp, Homo sapiens
cagtgcaaccctcctctgtgttgctggagtgaatgccctcagggcaggcagcttccagggtggcacctcatataaatccagggagtggccgaggcctgcarggaatctggctcaacacctgccatttgggtctcagttttacacattttgatcttgcacatgatttcactagggcaaaattaagtgcatgaaggaatcaca

SEQ ID NO: 58219 - DNA, 201 bp, Homo sapiens
tgagcacatgatctcgatttcaaatacacagcccacttggcctgtgtccctccctggtttccttagatagctctgtgtgaagtccttctttcataatatcytttgaaaccgatattcacccatttaagtgatgaagcttcagggctcagaaagagtgagaaatttgccaaaaattctacagccaatccaagcagagccagg

SEQ ID NO: 58220 - DNA, 201 bp, Homo sapiens
gatctcgatttcaaatacacagcccacttggcctgtgtccctccctggtttccttagatagctctgtgtgaagtccttctttcataatatcctttgaaacygatattcacccatttaagtgatgaagcttcagggctcagaaagagtgagaaatttgccaaaaattctacagccaatccaagcagagccaggactccaagg

SEQ ID NO: 58221 - DNA, 201 bp, Homo sapiens
catttaagtgatgaagcttcagggctcagaaagagtgagaaatttgccaaaaattctacagccaatccaagcagagccaggactccaaggtaggacctgcrcccaggtgtgtagcctgtaccccgagcagctccagcaccgccatccacacacaagacacaaatgagagcgtgctctccagacctgtacagcgcatggcct

SEQ ID NO: 58222 - DNA, 201 bp, Homo sapiens
gcagagccaggactccaaggtaggacctgcgcccaggtgtgtagcctgtaccccgagcagctccagcaccgccatccacacacaagacacaaatgagagcrtgctctccagacctgtacagcgcatggcctgccaagctttagaccaaagccccgactccaatccaggggcccgactacaaagctggtatttttctttact

SEQ ID NO: 58223 - DNA, 201 bp, Homo sapiens
caaagccccgactccaatccaggggcccgactacaaagctggtatttttctttactccatatcaagcccttggctaagaaatggggatttccaagcccacrgctgctcttgtttctccccacagtgctcctacatcccaggcagcgtggacaattaccagacggcccgggccgacgtggagaaggtcagagccaaattcca

SEQ ID NO: 58224 - DNA, 201 bp, Homo sapiens
ttttctttactccatatcaagcccttggctaagaaatggggatttccaagcccacagctgctcttgtttctccccacagtgctcctacatcccaggcagcstggacaattaccagacggcccgggccgacgtggagaaggtcagagccaaattccaagagcagcaggtcttctactgcttctccgcacctcgggggaacga

SEQ ID NO: 58225 - DNA, 201 bp, Homo sapiens
taaagtgccatatatatttttaattccaatattaataaatgtatgccaaacaacaatcagctgcaaggaaacacatgagaactcatcaaaattttagcggygggatggtggttaatttctgttttcttccttatcccctttttatttttgctgcttttctaaatttttgattataggaagggtgtgtttcgtttgctttta

SEQ ID NO: 58226 - DNA, 201 bp, Homo sapiens
aaatacaaaaaattagccaggcgtggtggtgggcacctgtggtcccagctactcaggaggctgaggcaggagaatggcgtgaacccggggttcggagcttkcagtgagccgagattgtgccactgcactccagcctggtgatagaacaagactccgtctcaaaaaaaaaacaaaaaacaaaaaatgaaaaacaaccctctg

SEQ ID NO: 58227 - DNA, 201 bp, Homo sapiens
aagcggtggaattcagaggcaaggggccacctgagctccagaactggggtggaaagaaccctgggggacatcctaacagtgccaggtctcagacagagctkcagctcatcagtccaagctgcaaccagaggaggaaagaaatgagggtttcttctatttatgaagatctcagaggactggaatttcacttcacttttatga

SEQ ID NO: 58228 - DNA, 201 bp, Homo sapiens
gcccgactaatttttgtatttttagtagagatggggtttcgccatgttgcccaggatggtctcaaactcctgggcttgagcaatccatctaccttggcatsccaaagtgctgggattatgggcgtgggccactgtgcctgccctttgttgctgatttttaatccttacttccactttacagatgaagaagcagagatctaa

SEQ ID NO: 58229 - DNA, 201 bp, Homo sapiens
aaggaaaataaagtattctaccataaagagacctgcacttgtacatttattgccgcactattcacaatagcaaaggtgtggaaacaaccttggtgcccaasaacagcagattagataaagacagtgtgctacgtatacaccttggaatattacacagccataacaaaggatgaaatcatgtcctttacagcaagatggata

SEQ ID NO: 58230 - DNA, 201 bp, Homo sapiens
tctctgaggcaggtaccatggttctcgtttcacagtcatgtggttgctaagtgtaagtggcagagccaggatttgattccatgtctgaggacctcagaatygccctgtccacaccccaccaaactgttcaacaatgtactctattccttgtccttctaaggaaaaggatgtcgacccagctatcaggtcacccaggacact

SEQ ID NO: 58231 - DNA, 201 bp, Homo sapiens
ttgcctgcttcaccctctgacaataccttcatgagccctgtaggcaattgagcacatgatctcgatttcaaatacacagcccacttggcctgtgtccctcmctggtttccttagatagctctgtgtgaagtccttctttcataatatcctttgaaaccgatattcacccatttaagtgatgaagcttcagggctcagaaag

SEQ ID NO: 58232 - DNA, 201 bp, Homo sapiens
gaggccaaacttcctgctgaagctctgtggcctcttttggggtgggggcgggggtccaggcagaaagaaaccgtctgctgctcaagacccacaggacgccsggaagactgtgagtaccgggcctgaaagcacttgggaagtgatttctctgaagaccgggctggagggagacaggggaaagcagcctgccacggggcaggg

SEQ ID NO: 58233 - DNA, 201 bp, Homo sapiens
gctgggaggaagcagtggaaatgcccttcgtgtttttgccaagcagctgggttgtgggctagctgctccttccgcctatgtccatcataggggttcaagtrgctggggctccaggctagctgggtgtcctctggaatcactgtgaagggccaagaagactctcatcccaccctccaactctgaaggtaggggccatagtct

SEQ ID NO: 58234 - DNA, 201 bp, Homo sapiens
cgataggagtgtcttttttccagtgagataactcttggtgggcctgtaaatagcttcggcatgggagctgcttgccagaaggaccaagccatgattagagrgttagaaccttcagctctacccggcaacctctgcagagggaagaggggctggaggttgagtttaatcaccaatggccagtggtttaacaatcatgcctat

SEQ ID NO: 58235 - DNA, 201 bp, Homo sapiens; identical to SEQ ID NO: 11065

SEQ ID NO: 58236 - DNA, 201 bp, Homo sapiens
agagggaagaggggctggaggttgagtttaatcaccaatggccagtggtttaacaatcatgcctatgtagtgaaatcttcataaaaccccctaaataatarggtttggggggcttctgggttggtgaacacgtcaaggtgctgggagagggcccggaaactctgcacctccaccctgcatccctcataccttgccctgtgt

SEQ ID NO: 58237 - DNA, 201 bp, Homo sapiens
atgatcagagtttcagagttgggctgggaagatggagcctacaggtgtgtgggtccagttactagacagaggagccaaggccgcagcaagcactcacgacyaagatgtggcctgcagcaggggagatgctgacagtccggacttgatggctgatgggacgggaaggggcagggtgcctgggatggggcgtggaggctgggg

SEQ ID NO: 58238 - DNA, 201 bp, Homo sapiens
ggtcaatgagaagtgggtctgggcagtgcaggatggtcaggtgttctgtcatcgctagtatgactcggccccacccggtggagagaggtctcagggcccastggaggcagctcctacccatgacccctgcctctgcgttggcattcagtagcccttgatttatcccaatgcaagaaacaaattttcaataactggtaacat

SEQ ID NO: 58239 - DNA, 201 bp, Homo sapiens
gcgtgaccttgggaaaatcactttgccttgtgcttttacagaaagaacaaggccttttgtgggggattgtggagaggaatgtccatgtgtatgtgtatgtrtatgtattgcatatctatgtggtcattccctggtacatagtaggtgcttcataaacaaaaataccctcccatatcactgcccttctattccatttgtgcc

SEQ ID NO: 58240 - DNA, 201 bp, Homo sapiens
gctgtctctgctccacattctctgaggcctcagctgggaggctggcaggctgggggctggaactgtctgcaggcttgttctctcccatgcccggtgagatwtgctagctgttggctgagatctgagctgaggctgtcagctggagcacggggcctcggcttcctacaacatggtggctggttcccaggtacatgtcccgag

SEQ ID NO: 58241 - DNA, 201 bp, Homo sapiens
tccttccccttcggcttcccaaagtgttaggattacaggtgtgatctggtttctaacttctcttaaagtgttggaggtctggctattatagatcttctggmtggcctgacatccattgcctggagggagtggtgactgcctgtctggaggcagctggctctctccctattgacaggccctgccacaccctggcaattcttc

SEQ ID NO: 58242 - DNA, 201 bp, Homo sapiens
gctagtctactttgttaaggaaaaccagcttgcacggaggttacagtggacctgtttcttgtttgagtttccagtagttcagtgtcatcccccaggatttrtgtggtttttgcagtggtcaaactggtgaattaaatggagatacgatagagaccatcccctgtgtcctccagctttttaaggatgtcatttctctcagga

SEQ ID NO: 58243 - DNA, 201 bp, Homo sapiens
aagggtctactttgtcaatggaaacaaggtaggaaaagaaaaagcaaaacatagatcaatgaagggagaaggtggggcggccagtccagatctaaagacgstgcggggggatttggcaacacgtgtgtgcaagacagacagacgggaggccccgcggcgcgttttcctaggaatgaaagggacccgcggggcgagcacccc

SEQ ID NO: 58244 - DNA, 201 bp, Homo sapiens
gacgtgcaccaaactgttagaaccctaaaaattgtgctggcactgcaggccctttaattgcatagggcatgggtcttaccaaagaccgcactgtcctggcyactcctcgttgctcattcagtctgatagcacgatgcccctgatagagtaggctagtgtggtgctttgcaggtgttccacatttattcagactcttataac

SEQ ID NO: 58245 - DNA, 201 bp, Homo sapiens
acatacatgcatcccatgaagacagcgggaaagccctggctcctaaggtaagaaattagtaccttaacctcagcattgttaactcatactctttgtttcaytagaaaaaacagtgttgtctcacccacatcattcattactatcataagaaaatttatgctgttcttgaattttaaaatctctattgcaagagcagaaaac

SEQ ID NO: 58246 - DNA, 201 bp, Homo sapiens
tcttgatttccccaacacagaaacataccacattgttaattgtggttatttatatggctggtgtacctttctttctatatcaggagtcagtaaactctatraaggtccagatagtaaatattttaggctttgcaggcctactcaacgctgctgttatgaataatatgtacacaagtggacttgactgtcttttaataaaac

SEQ ID NO: 58247 - DNA, 201 bp, Homo sapiens
taaaatctctattgcaagagcagaaaactgtttacttccatgtactctttaactagtgtgtgtattttctgaatgtataaagcatgaattttatatagtayggtctttgcttgtcctattcatggaaaagaagaccttttatgttgatattcttggtacattggcctggggaggggtggagaactgtctaggaagtattta

SEQ ID NO: 58248 - DNA, 201 bp, Homo sapiens
tacatgcatagaattactcaaggaaaataaaatgtgaagctctgcattattactccatccataagagcatgaaatagtattattttagatattttatttasctagtctttgtgtccttaaatttaaactttattgtgcattaattatgtatttgggttctctaggtctcggtgattcagaatacacctacttttgcaatgg

SEQ ID NO: 58249 - DNA, 201 bp, Homo sapiens
tgtccttcggacagttattttatttcgttttaattttttccttaagcaaaagcataatcacagatgtctctgtctcatcagtgtgttcaccatttcgtagrcactttacacattctgcctttaacagccctgagccacttttccatagtacaagttcatttattcataaaattgctattaatgttattgaatgtagagctc

SEQ ID NO: 58250 - DNA, 201 bp, Homo sapiens
acattgcataatagctaatttctccccacaggcagtgtatggtaccctgaagtttttctaacctgcttaaaataagtttccagagcaggcagtctttgaaygcagggctaagccctctttctgttgagtggctgtttggagttccacatggacttttcttacaaaaaccacacccttactgcagctattaccagttttaat

SEQ ID NO: 58251 - DNA, 201 bp, Homo sapiens
aagatggaaaatatttcaagcctaagcattttcagtaattcttgaaagagtagcctttaatctttttgggatcatgactttattttaaatctgaaaactgsgcacctccctgcagaaaactgcacatatacctagtaagggtttgctgagctcctcacctctgaagccaacttatggacccattcctagaagcctttgctt

SEQ ID NO: 58252 - DNA, 201 bp, Homo sapiens
tagtttctaagcctaatgaagttccagctgtctctttaggcactccaccacatctcgcaggaagagtttactcaaggtgcgtcacaacgtggatgtgactrctccaggggcaaaattttgtccttactgtgaaccatcctctaacctagtgactggacatgctatttcagagttaagcctcaggcatcaccctagggcctt

SEQ ID NO: 58253 - DNA, 201 bp, Homo sapiens
acgagatgcctgtgcctgcttgttggatctcctcctcgctttcccttcttgccagccaccactcagtctcctgctcggtgagtagtcgctttcacaagcaycttggtggctgttcgtgcactggtaggcgggccacctttctgtagtaaagaaaatttgctgctcttgtcttaccctttgtatcctatgcctaaagaatat

SEQ ID NO: 58254 - DNA, 201 bp, Homo sapiens
ggccagtggactggagctgatggtgagagtgtggctctaaggttcagggtcctgtgtgttggccgcacagatgcctggggctcagctgcgcatcaaggtcygggaacacaggcatacgctggtattgctagtttcttaactttcatgttaattgcactgaataagaagataatggatgttctaattattggacatttgtgg

SEQ ID NO: 58255 - DNA, 201 bp, Homo sapiens
gtactcaaccactgagtgtacaattctaattctcagactttttcagcttgacaaccttttagtgatccattatatattatatttcagaaaagagctcagayatttccttaagcatgggatcttaactcatctaaaggtttccttctcaagagatgctcctgttggggaggaggaagccccagcaaagtatgtgcaagacaa

SEQ ID NO: 58256 - DNA, 201 bp, Homo sapiens
gaaaataattgaaatgagtgaatagcacgttttccagctttctaaataaagcagaggcatttggtggcaaataattgagtttcccaaatggttccattaasgcagaaatctgacgaggtgaaaatttttctgtttggcaaacaaaagtttctgccactgcattgaggatgggttttgaaagaatcagttctctactgcagt

SEQ ID NO: 58257 - DNA, 201 bp, Homo sapiens
taatccactagatgtcagtattgtaccaggaactgtttttttaaaactacttgtaactgatttcttctaaccagctcccggaagtggccattaatggatamaatttttcaaatgtgccttgccacacttgtattgtcagtgagcataaagagtgttgtaattaggccgccatctccccagtgtggttttcgtgtcgtttta

SEQ ID NO: 58258 - DNA, 201 bp, Homo sapiens
tttaccttatagaaagggcattccaggactgaggctaagaaaagttgggtcagttgtgcccgactcaatgtgtccaaatgagattctttacctgaaacagwaagcatcccagtcatagttacgtctgaattgaggtatgtatgagagaacatcatgaacattcaacatcaatttacacactccagacagaagtattctatt

SEQ ID NO: 58259 - DNA, 201 bp, Homo sapiens
gtcgttttattaatgtgtttattgcatttctagtcttgggtgagtaaagtactttagagagaggctcagctctctaaataaatatatgtatatttatatawatatagatttatatatatatatattccatcttcctttcctggtaatcagctcgagatgtaatttgagtatttagaattaatttactgtaatgaaagctta

SEQ ID NO: 58260 - DNA, 201 bp, Homo sapiens
agatactctaaactatgattcagagtcaagtagagagaagcagagagagaatgtcatagtctggtgtgctatttctgattctacataaggaatgtgatagrtaataggataaatctttataggtctttatgggaagagcgaactctagataaactaaactctattagataaaagtgaaatttctggcttggcttaaaaata

SEQ ID NO: 58261 - DNA, 201 bp, Homo sapiens
aaagagttttaatggatactatggatacaccattatttgttgatgtaattatgggcaattgagtcattttcgctttttcactattaaaaaaggcaaacttycttgtactgtattaatttttgaacacttacttgaagtatatttgtaaaacaaattccttggagtagaattgctgttttaaaaatatttacattttaaatt

SEQ ID NO: 58262 - DNA, 201 bp, Homo sapiens
agtaacacaaattaaagagactactaacacactgcaatagaagtggaggagacatggccaccttcattcattgctggggaaatgtgacatctgtaactatwagggaaaaaaaatctgccagtatccatcaaaaattaatccactaatcacatttttgggaatctagtttatatatgaaaaaaaccaaaaaggctctagtat

SEQ ID NO: 58263 - DNA, 201 bp, Homo sapiens
gctaaatgtctaaaaatgagcttcctataaaattttctttttcaaagctaacgaacatcatatttaattgaaagaggctgatgcagtctgtgctgtgtgcrgaatgcagaaatgcccccatctgagcaagtccagatcgagggtccttcaagagcaaaaggggactgtgtcgtaccagtgcaaatcaacatactcatggta

SEQ ID NO: 58264 - DNA, 201 bp, Homo sapiens
acaggcaaaggccatcgcagaagaaatatgtgagcaagctgtggtacatggattttctgcagatcttcactgtattagtgaatccgataaggttagagccrttacagtggattttaccgttttgtgctttgaagaattttggttgggaagtgatatttatgaaacaaaaggacactaataccaccacatagtctttgtttt

SEQ ID NO: 58265 - DNA, 201 bp, Homo sapiens
ttgggaagtgatatttatgaaacaaaaggacactaataccaccacatagtctttgttttttaacagaaatgtgtttgttcaatggtatagtaagatatcascagcatttttttaatatagaagtgtgtagttgaattagactaaatggtctcaaaaattgaaacaagtaacaactcaactgtaaatgacagaagtagcata

SEQ ID NO: 58266 - DNA, 201 bp, Homo sapiens
tctcggtgattcagaatacacctacttttgcaatggggggaagataattgataaacgacttcaagagcttggagcccggcatttctatgacactggacatrcagatgactgtgtagggtaagggcagtgttctctgtttactccaataagccctctatacatgatggaagttgatttgtaaaacatgtcagcttttcactt

SEQ ID NO: 58267 - DNA, 201 bp, Homo sapiens
ttttccccaaaagaaaggccttgccgtgcgtgttagagttcctcctgatgaaggaccgcctagattcttttgtgaaatagaatttaaagtagtagtgtaargatctggaaaaaactcggctgcttcttcagggactagttgtttatgttcagtctctgcagaagttcctaccttagggtatatgcaactttaccatcttgt

SEQ ID NO: 58268 - DNA, 201 bp, Homo sapiens
ggactagttgtttatgttcagtctctgcagaagttcctaccttagggtatatgcaactttaccatcttgtgttcttttatttagtttgctgcctccagatyatactatttcagacaattcaggcgataacagttggcaggggctttataccacaagatgatttgccagccgctaagcagttaaaattcacttcaacatttc

SEQ ID NO: 58269 - DNA, 201 bp, Homo sapiens
accttagggtatatgcaactttaccatcttgtgttcttttatttagtttgctgcctccagattatactatttcagacaattcaggcgataacagttggcargggctttataccacaagatgatttgccagccgctaagcagttaaaattcacttcaacatttcagagactgtcctgccagtgctctctcacccaagtgcac

SEQ ID NO: 58270 - DNA, 201 bp, Homo sapiens
gttcctgtgaccatctacacacatgttgcattcttaaacatctgtcacattcttcaagatctctccttcctgaaacatttgcagacattctgtttcccttkatgtagtttattaggaaaactactagatctttacatgaacatgccagtatttttattttctatttgtatttcagaaattctaatgtctaatagataaagc

SEQ ID NO: 58271 - DNA, 201 bp, Homo sapiens
gtggtgactttttcagcccatgtttgctcacaaccagtatcgagccagatagtgtaatgttttatacttaaggaaataaagtaccctttcctgtcccctamaggaaaagagtaaagtaaggagaagaaaattgaaaaccaatgcatttgaccataattagtttcttttggtcataatgtatgttttcgtgtgtgtgtgcat

SEQ ID NO: 58272 - DNA, 201 bp, Homo sapiens
ttgggtgcatccctaggcagacatttaactgaatattctaatagctctacccacaaattgtgtcacaatttaaggcgggctcctttttgtaggcatttttrcgagcccttgtggactataccagtgacagtgctgaaaagcgcaggctacaggagctgtgcagtaaacaaggggcagccgattatagccgctttgtacgag

SEQ ID NO: 58273 - DNA, 201 bp, Homo sapiens
gtaggcatttttgcgagcccttgtggactataccagtgacagtgctgaaaagcgcaggctacaggagctgtgcagtaaacaaggggcagccgattatagcygctttgtacgagatgcctgtgcctgcttgttggatctcctcctcgctttcccttcttgccagccaccactcagtctcctgctcggtgagtagtcgctttc

SEQ ID NO: 58274 - DNA, 201 bp, Homo sapiens
gctaagaaaagttgggtcagttgtgcccgactcaatgtgtccaaatgagattctttacctgaaacagaaagcatcccagtcatagttacgtctgaattgakgtatgtatgagagaacatcatgaacattcaacatcaatttacacactccagacagaagtattctatttttaaatgacactatgaaatgaacttgttagaa

SEQ ID NO: 58275 - DNA, 201 bp, Homo sapiens
cctgtcgcagtcagatacttgagagaacactggtccaccgagtggatgaaggtcatttccatttttcgaatgaaactttttacaatgggcatgatggaatytgaccccgaaaggctcaggttgtcgtgaacacaaccaagggcacagacgctccttgactaccttgtgaacatgatttagaggtttattttttaaagcagc

SEQ ID NO: 58276 - DNA, 201 bp, Homo sapiens; identical to SEQ ID NO: 11109

SEQ ID NO: 58277 - DNA, 201 bp, Homo sapiens
atccatctctcctcgaacaacaaattctttccacttaccagatgacccctcaatccccatcataatggtgggtccaggaaccggcatagccccgtttattrggttcctacaacataggtatgttctttttttggctaatgggaaaatgtattcctgagtaaccgtttttgtttctttagtcattttgaggataattggact

SEQ ID NO: 58278 - DNA, 201 bp, Homo sapiens
ggttcttcctcaaggtgattaatgccataccatcagattctcaatttgataactaaattaaaaaatttaaaaacacatggttaaatacattgagaacatgrttgacccaacatcaatgtttatgaaactacaaacgagtatctggaaaaaaaaaaaaaaaaaaaaggatggttaacatataaacaccagaggggcaaagtc

SEQ ID NO: 58279 - DNA, 201 bp, Homo sapiens; identical to SEQ ID NO: 11111

SEQ ID NO: 58280 - DNA, 201 bp, Homo sapiens
agacatgggccttctttgacattggtgtttgaattagcagctcactgccacacccatcatttccttatcctgtgtaattttgcttcctaagacattgggamgtcattacccatcattctgtggatatatgtgataatgtgtatgtttattttcttttccttccactagaatgtaagttccgtaaagacaggggcgttgttt

SEQ ID NO: 58281 - DNA, 201 bp, Homo sapiens
ttaagcatgggatcttaactcatctaaaggtttccttctcaagagatgctcctgttggggaggaggaagccccagcaaagtatgtgcaagacaacatccarcttcatggccagcaggtggcgagaatcctcctccaggagaacggccatatttatgtgtgtgggtgagtcattatcgtgcctaagtcgggtaggagagggc

SEQ ID NO: 58282 - DNA, 201 bp, Homo sapiens; identical to SEQ ID NO: 11116

SEQ ID NO: 58283 - DNA, 201 bp, Homo sapiens
cagaatagcaaatacagcaccattatctggaatatttggagcagcccctcaatttctttttaaggtgcctgacttttatttaaaatttttcaacctcatcrtgatgctaatctttattgtcttcatatttagggtacatttctccataatatatactattgtctgcccaccagaaagcagatcttatccatagaccaagaa

SEQ ID NO: 58284 - DNA, 201 bp, Homo sapiens
agtttaaagttgtccacaagaatggttgaaataaagcaacatttcaggctttatcatgaagtcctctttcttcatagtaatgaagaaatcagtgattcacktggagtgttgtcttaggagaagtttggtttctttattagagttgaaaggttcatagacctcaatagtggggattaggacttcttgggatatacttgagag

SEQ ID NO: 58285 - DNA, 201 bp, Homo sapiens
ctctctcccttgctggcaagaaatgtgagcttgtgtcattgtgagaggctcctccccagagccctggcctgcatctgtatcactctggggcttagaggcartgggcctagtaatagacttgacttgggaagtggtgactttttcagcccatgtttgctcacaaccagtatcgagccagatagtgtaatgttttatacttaa

SEQ ID NO: 58286 - DNA, 201 bp, Homo sapiens
tagtacagttattcacagattaaccctgccactgatgttcagcctggctgtgtgaacagaaggacatctgccacatctaagcaggagcactaagcctgtgrgcgtggtgtagcttggctctcttcttcctatctgccatgatattctctccacatagaccctcaagtgaagcagtcccacagccttcgaggaagagagccc

SEQ ID NO: 58287 - DNA, 201 bp, Homo sapiens
tttctcattttttcttgggtaattgggtgcatccctaggcagacatttaactgaatattctaatagctctacccacaaattgtgtcacaatttaaggcggrctcctttttgtaggcatttttgcgagcccttgtggactataccagtgacagtgctgaaaagcgcaggctacaggagctgtgcagtaaacaaggggcagcc

SEQ ID NO: 58288 - DNA, 201 bp, Homo sapiens
ctgagtcgttgtttttggtcaatgctgagtttggcacttggaggaacacgtgtaatttgttagtgtccaggtattttagacagagattcttcagccaaacytttggaaacctgtgactcctttgggaacagtgattttgtcctccctgttaaggaagtccaggacacaatcatcttgagccatggaatttaaagtagcagt

SEQ ID NO: 58289 - DNA, 201 bp, Homo sapiens
gctaatttaatacctttatataatttgtaaagataaaatcactgtaactagaatacccatcaccttaaatattggtcttttctttatgctagaaacattcmaattattcccttctgactattttgaaatatttaatagatgattgtaaactatgctaaccctactgatctatcaatcactaggttttatttattctaacaa

SEQ ID NO: 58290 - DNA, 201 bp, Homo sapiens
atgtgaatatacaaaaattaatttttgtaaatatgcagaagttacagatcaaaagcagatactataatataattcgcagtggtttaagaccaatatgtagktgtaagtttcccttgttttcccaaaaaacacattagtgcaattaaaaagaatttatcgctttttgtctttaaaattttttaaatttatcccaataaatat

SEQ ID NO: 58291 - DNA, 201 bp, Homo sapiens
gctgcaggcataaggatagggattatctattcaggtattgtacaattccagtattgtactcaaccactgagtgtacaattctaattctcagactttttcascttgacaaccttttagtgatccattatatattatatttcagaaaagagctcagacatttccttaagcatgggatcttaactcatctaaaggtttccttct

SEQ ID NO: 58292 - DNA, 201 bp, Homo sapiens
ctccccagtgtggttttcgtgtcgttttattaatgtgtttattgcatttctagtcttgggtgagtaaagtactttagagagaggctcagctctctaaatawatatatgtatatttatatatatatagatttatatatatatatattccatcttcctttcctggtaatcagctcgagatgtaatttgagtatttagaattaa

SEQ ID NO: 58293 - DNA, 201 bp, Homo sapiens
tgaatgaatcctttacatgaagatccttagggcatattagattttataaatatcatctagtcctagtgcaagcaaataaaattggaaactttcttgaatawcaaaatgtagggtgtgagagtgtgaaggttgggggcagtttttaattacgtaataatggctttcctctgtgaggatttggaaggtagattagagcctata

SEQ ID NO: 58294 - DNA, 201 bp, Homo sapiens
acctgtatttcaccagccatatttcagcagccatatgaacagcattgccccacactagggggttcctgtgaccatctacacacatgttgcattcttaaacrtctgtcacattcttcaagatctctccttcctgaaacatttgcagacattctgtttcccttgatgtagtttattaggaaaactactagatctttacatgaa

SEQ ID NO: 58295 - DNA, 201 bp, Homo sapiens
ttatttaggattgattaaacaaatttagaatatgccctttgcagtcttaaaaaatgtgatcttgatagcatgtttttaatattagttcccaagggtgtgtrctatcatcgtaactatcatctatgaatctttttatgttgtatttgcatttaaatttttgttttctattgaaatgagggcttaaatagggctttttcttag

SEQ ID NO: 58296 - DNA, 201 bp, Homo sapiens
atgaaatagtattattttagatattttatttacctagtctttgtgtccttaaatttaaactttattgtgcattaattatgtatttgggttctctaggtctyggtgattcagaatacacctacttttgcaatggggggaagataattgataaacgacttcaagagcttggagcccggcatttctatgacactggacatgcag

SEQ ID NO: 58297 - DNA, 201 bp, Homo sapiens
caaataaaattggaaactttcttgaataacaaaatgtagggtgtgagagtgtgaaggttgggggcagtttttaattacgtaataatggctttcctctgtgmggatttggaaggtagattagagcctataaggaaatatttctaaactgaataaaaggattggtttgacccatatgtgtagtagtactgatatcgagttcaa

SEQ ID NO: 58298 - DNA, 201 bp, Homo sapiens
tttctggagcttattgtaaaatgtgatttttatgaatctctgaaaaactcatcctcgtacttaagactttttccaagtcttcatacatctatgactccacrtgaaaaaaacttttcaaaattaaaatttaagaagtttttcaattcgagtgaagaaagctgataaattctcttaaatatccatagaatgtgaatatacaaa

SEQ ID NO: 58299 - DNA, 201 bp, Homo sapiens
atatatattgtatttttatttgatagcttgggatttaaaacatctctgttgaaggcttttgatccttttgagaaataaagatctgaaagaaatggcataaycttaaaacttggtaagtttttgtggctgtgtaatctcttcattattatatattttataatagaaaccaatctaaaaatatgggataggaaaatatactaa

SEQ ID NO: 58300 - DNA, 201 bp, Homo sapiens
agagatgtttgaaaactattataatccatcctgaagaaagaaaaacatgaacagtatttcaatttctggagcttattgtaaaatgtgatttttatgaatcwctgaaaaactcatcctcgtacttaagactttttccaagtcttcatacatctatgactccacgtgaaaaaaacttttcaaaattaaaatttaagaagtttt

SEQ ID NO: 58301 - DNA, 201 bp, Homo sapiens
actttagaagctttcacccagtgtaatagaaacttatgatgaattttctggtgaaaatatcttaggggaatttcttctattgcagagatgtttgaaaactrttataatccatcctgaagaaagaaaaacatgaacagtatttcaatttctggagcttattgtaaaatgtgatttttatgaatctctgaaaaactcatcctc

SEQ ID NO: 58302 - DNA, 201 bp, Homo sapiens
ctaccttgtgaacatgatttagaggtttattttttaaagcagccagagctctatgcatctgaaaatcagataaacgataaaggttcttcctcaaggtgatwaatgccataccatcagattctcaatttgataactaaattaaaaaatttaaaaacacatggttaaatacattgagaacatgattgacccaacatcaatgtt

SEQ ID NO: 58303 - DNA, 201 bp, Homo sapiens
ttcctttctgtgcttcagacttatacagtgtttgtggattattctaaagtgagttacactgttgtactgaaacaatcattctattgagtcataaactaccrgaaaaaaaaagaatttggatttcactgcaaactatatgacatatatgctacacccaacaaactgggcacccatgttgatttcaaatacacttgaaccatt

SEQ ID NO: 58304 - DNA, 201 bp, Homo sapiens
tttctaagcctaatgaagttccagctgtctctttaggcactccaccacatctcgcaggaagagtttactcaaggtgcgtcacaacgtggatgtgactactmcaggggcaaaattttgtccttactgtgaaccatcctctaacctagtgactggacatgctatttcagagttaagcctcaggcatcaccctagggccttgct

SEQ ID NO: 58305 - DNA, 201 bp, Homo sapiens
tcatttttaggataaaggagctgtggtacggatcatttggggagcttgtctacagggttgcacttaggaaacacagattcaagcccaagtagtttcgagcsgatcatctgatttctgagccatggaattagagtttcattcgtacactctccttaatttgatgaattcttatttaggctcatttgagattagtgctgaaaa

SEQ ID NO: 58306 - DNA, 201 bp, Homo sapiens
ctagtttctaagcctaatgaagttccagctgtctctttaggcactccaccacatctcgcaggaagagtttactcaaggtgcgtcacaacgtggatgtgackactccaggggcaaaattttgtccttactgtgaaccatcctctaacctagtgactggacatgctatttcagagttaagcctcaggcatcaccctagggcct

SEQ ID NO: 58307 - DNA, 201 bp, Homo sapiens
aaaaatgtgatcttgatagcatgtttttaatattagttcccaagggtgtgtgctatcatcgtaactatcatctatgaatctttttatgttgtatttgcatktaaatttttgttttctattgaaatgagggcttaaatagggctttttcttagtctaaatagggctttttctttgtcttacttttactagttattaactacg

SEQ ID NO: 58308 - DNA, 201 bp, Homo sapiens; identical to SEQ ID NO: 11096

SEQ ID NO: 58309 - DNA, 201 bp, Homo sapiens; identical to SEQ ID NO: 11098

SEQ ID NO: 58310 - DNA, 201 bp, Homo sapiens; identical to SEQ ID NO: 11099

SEQ ID NO: 58311 - DNA, 201 bp, Homo sapiens; identical to SEQ ID NO: 11100

SEQ ID NO: 58312 - DNA, 201 bp, Homo sapiens
catagtagagtcttgtctgacacttcgcttcattcagcaaacacctgagtgctggctaagtgcttggggcatattcagatgtcgatagatacgaggatatrttagtttttctgttgaggaatacctgagactaaagaaaagagatttaatgggctcacggtttaggctgtagaggaaacatggtgccggcacctgcttctg

SEQ ID NO: 58313 - DNA, 201 bp, Homo sapiens
gtgctttacttgtcacatttgtgaaatgcacttggaagcattaatagcagtggtcagagggctcagaaggaaaccctggggcacttgaacattgatcgtcygtcagggaagcaggaacaaagtagacagaaggaacagccactgaagaagcaaaattgtcccaaagccaagagggtgctgtttcagagagggagcctgtac

SEQ ID NO: 58314 - DNA, 201 bp, Homo sapiens
tcggtggtcaaatacaggctggagttttagagatgcacctctaaatagtagaggcagagttcattgtacagatcacagatatctggtcattgagaacttgragaatatcttaaatgtccagactcctaaaacattattccagaaatagctcctcccaatcactggtgctttacttgtcacatttgtgaaatgcacttggaa

SEQ ID NO: 58315 - DNA, 201 bp, Homo sapiens
cattcctaggatttaacacattctctaagtcaggttcttttttttttcaactgtaatgtagaagacaaaatactggcatcgtgacccagaacatatggatraagataattgaaacaagtttcatgaaacaaagcaacgttttctgtttagtttttataacacattctgatcatttctcttccattttatttagtttgcttt

SEQ ID NO: 58316 - DNA, 201 bp, Homo sapiens
atctaaaggtttccttctcaagagatgctcctgttggggaggaggaagccccagcaaagtatgtgcaagacaacatccagcttcatggccagcaggtggcragaatcctcctccaggagaacggccatatttatgtgtgtgggtgagtcattatcgtgcctaagtcgggtaggagagggccatcagtgatgtctgtagaag

SEQ ID NO: 58317 - DNA, 201 bp, Homo sapiens
agctcagacatttccttaagcatgggatcttaactcatctaaaggtttccttctcaagagatgctcctgttggggaggaggaagccccagcaaagtatgtrcaagacaacatccagcttcatggccagcaggtggcgagaatcctcctccaggagaacggccatatttatgtgtgtgggtgagtcattatcgtgcctaagt

SEQ ID NO: 58318 - DNA, 201 bp, Homo sapiens
ttttttttccacttagagagaaactccaagaacaacacccagatggaaattttggagcaatgtggttgttttttggctgcaggcataaggatagggattayctattcaggtattgtacaattccagtattgtactcaaccactgagtgtacaattctaattctcagactttttcagcttgacaaccttttagtgatccatt

SEQ ID NO: 58319 - DNA, 201 bp, Homo sapiens
tccttcggacagttattttatttcgttttaattttttccttaagcaaaagcataatcacagatgtctctgtctcatcagtgtgttcaccatttcgtagacrctttacacattctgcctttaacagccctgagccacttttccatagtacaagttcatttattcataaaattgctattaatgttattgaatgtagagctctc

SEQ ID NO: 58320 - DNA, 201 bp, Homo sapiens
tagatactatttgtcagatagtagagtcctgtccttcggacagttattttatttcgttttaattttttccttaagcaaaagcataatcacagatgtctctstctcatcagtgtgttcaccatttcgtagacactttacacattctgcctttaacagccctgagccacttttccatagtacaagttcatttattcataaaat

SEQ ID NO: 58321 - DNA, 201 bp, Homo sapiens
tgatatgaaataagtaaaataaaattgtacttctgtttatatttgtgaagtaatgagcaagtcttagatactatttgtcagatagtagagtcctgtccttyggacagttattttatttcgttttaattttttccttaagcaaaagcataatcacagatgtctctgtctcatcagtgtgttcaccatttcgtagacacttta

SEQ ID NO: 58322 - DNA, 201 bp, Homo sapiens
tttctccccacaggcagtgtatggtaccctgaagtttttctaacctgcttaaaataagtttccagagcaggcagtctttgaatgcagggctaagccctctwtctgttgagtggctgtttggagttccacatggacttttcttacaaaaaccacacccttactgcagctattaccagttttaatttcttgttttttttaatg

SEQ ID NO: 58323 - DNA, 201 bp, Homo sapiens
agctttatttaggattgattaaacaaatttagaatatgccctttgcagtcttaaaaaatgtgatcttgatagcatgtttttaatattagttcccaagggtrtgtgctatcatcgtaactatcatctatgaatctttttatgttgtatttgcatttaaatttttgttttctattgaaatgagggcttaaatagggctttttc

SEQ ID NO: 58324 - DNA, 201 bp, Homo sapiens
tttgcagctcaagtttatttcacccaggaaagctccattttgtcttcaacattgtggaatttctgtctactgccacaacagaggttctgcggaagggagtrtgtacaggctggctggccttgttggttgcttcagttcttcagccaaacatacatgcatcccatgaagacagcgggaaagccctggctcctaaggtaagaa

SEQ ID NO: 58325 - DNA, 201 bp, Homo sapiens
ccacaacagaggttctgcggaagggagtatgtacaggctggctggccttgttggttgcttcagttcttcagccaaacatacatgcatcccatgaagacagygggaaagccctggctcctaaggtaagaaattagtaccttaacctcagcattgttaactcatactctttgtttcattagaaaaaacagtgttgtctcaccc

SEQ ID NO: 58326 - DNA, 201 bp, Homo sapiens
cagccaaacatacatgcatcccatgaagacagcgggaaagccctggctcctaaggtaagaaattagtaccttaacctcagcattgttaactcatactcttkgtttcattagaaaaaacagtgttgtctcacccacatcattcattactatcataagaaaatttatgctgttcttgaattttaaaatctctattgcaagagc

SEQ ID NO: 58327 - DNA, 201 bp, Homo sapiens
acactgggaaccacattttaacataaagatttggagagggcacacatccaaactggatcagaggataagtgagttacacttcctaccctcaaacaacttaytccctggtgagaaagctacatataaacagacgtttctaacgtcggaagtgttccagagaggactgcaagagcacccaggaggggtaccgcccccttcttg

SEQ ID NO: 58328 - DNA, 201 bp, Homo sapiens
gtaaggtggagttttttactgtattcattttggggaatttttttggctgaataaacattgccacaagtcatgttgcactttgatgcgctgtaaagtactamagtaattgtgttttggggagtgtgtaaaacattttattcttcatcttctatgtcatgaacccctttcccgtctttacctgaaaaggagctaccttacccc

SEQ ID NO: 58329 - DNA, 201 bp, Homo sapiens
aatactgagtagccaggaagttttgtaagcccctgtggatcttgcgtagtcactaattgaaagaagggtataattgaaaattgcacttacgttttgtcacrtttgtttttcaaggaggaaagccaagtatctgtgacttcagcagatccagtttttcaagtgccaatttcaaaggcagttcaacttactacgaatgatgcc

SEQ ID NO: 58330 - DNA, 201 bp, Homo sapiens
ttgcatttaaatttttgttttctattgaaatgagggcttaaatagggctttttcttagtctaaatagggctttttctttgtcttacttttactagttattractacgtagcacattccacagtgatggaggtgactgcagttgaccttgtgttacccagctacacattgctgctccttctttaattggtgacagaaagcta

SEQ ID NO: 58331 - DNA, 201 bp, Homo sapiens
gttcctacaacataggtatgttctttttttggctaatgggaaaatgtattcctgagtaaccgtttttgtttctttagtcattttgaggataattggacttygtaaaatttttatttaaaaaattattattcaatgtgcgataacataatttgtcaccatgggaaaagtaaacacaatgttgtagagattgtgctttgtact

SEQ ID NO: 58332 - DNA, 201 bp, Homo sapiens
ccaggaaccggcatagccccgtttattgggttcctacaacataggtatgttctttttttggctaatgggaaaatgtattcctgagtaaccgtttttgtttytttagtcattttgaggataattggactttgtaaaatttttatttaaaaaattattattcaatgtgcgataacataatttgtcaccatgggaaaagtaaac

SEQ ID NO: 58333 - DNA, 201 bp, Homo sapiens
cgtcattacttcctacagtcgtccttgagttaaaagttaaaatgtatacagttacaccaccatgcaaggtggaggggaatcctgtcattcttaaatcttgrtatcagtatgacttttgcatatgacagtgaaactggaagtgaaacatactcagattgattcagaaatatcttttgaaattttaacaaaaagattttgata

SEQ ID NO: 58334 - DNA, 201 bp, Homo sapiens
gatatgaaggatataatttaaaactatctgaaattacctgtgcttgtgttgtgttttattacaaattatacagaatgttgacttttgcaagacctatcacmcaccctgccctactatggcggatagtacagttattcacagattaaccctgccactgatgttcagcctggctgtgtgaacagaaggacatctgccacatct

SEQ ID NO: 58335 - DNA, 201 bp, Homo sapiens
aacagtttaaagttgtccacaagaatggttgaaataaagcaacatttcaggctttatcatgaagtcctctttcttcatagtaatgaagaaatcagtgattsacttggagtgttgtcttaggagaagtttggtttctttattagagttgaaaggttcatagacctcaatagtggggattaggacttcttgggatatacttga

SEQ ID NO: 58336 - DNA, 201 bp, Homo sapiens
ttgactggatggcattcattaagtgaacatgaatgaagaagtttcaataatgatttgggtggaaaataattgaaatgagtgaatagcacgttttccagctktctaaataaagcagaggcatttggtggcaaataattgagtttcccaaatggttccattaacgcagaaatctgacgaggtgaaaatttttctgtttggcaa

SEQ ID NO: 58337 - DNA, 201 bp, Homo sapiens
cctaaggtaagaaattagtaccttaacctcagcattgttaactcatactctttgtttcattagaaaaaacagtgttgtctcacccacatcattcattactrtcataagaaaatttatgctgttcttgaattttaaaatctctattgcaagagcagaaaactgtttacttccatgtactctttaactagtgtgtgtattttc

SEQ ID NO: 58338 - DNA, 201 bp, Homo sapiens
gccttcattccattgcacagcctctaccgttttcccgtctggctctctgttttgcctttcagtaataatacaagaaggtgcaccattcttttggttgaaargggaattaagaatgaactcaagttctttcgcattatttaccgtgtaatgtgaaaagaaatctacttttgtagggatgtcttttaaagatgtttttacttt

SEQ ID NO: 58339 - DNA, 201 bp, Homo sapiens
ctctcaggaagggattgaaaatgcttgctaggggtgaagactaagcgctttataggacttcaaagcctttattactttcttgtgcttgtaactttgtcatstcctttcccatagtggtaagtagttatgcctttaacatttgcatttttctttggtgacaccaaaatgtatattgtcctttttactcttgggccagcaaga

SEQ ID NO: 58340 - DNA, 201 bp, Homo sapiens
gggcttttgtaaaaaatgtgtcatggtgcccaaaatatatgaacgcctccaagactctcctaagctcctcgttagtgaaatgtgggacatgcctcacgacrtatttgcccaattttataatcagaggaaatgcttgactttgatcaagaaccaccagggcagtgagcatttggctaatcaatttaggactcaggttggaaa

SEQ ID NO: 58341 - DNA, 201 bp, Homo sapiens
aaactcatcctcgtacttaagactttttccaagtcttcatacatctatgactccacgtgaaaaaaacttttcaaaattaaaatttaagaagtttttcaatkcgagtgaagaaagctgataaattctcttaaatatccatagaatgtgaatatacaaaaattaatttttgtaaatatgcagaagttacagatcaaaagcaga

SEQ ID NO: 58342 - DNA, 201 bp, Homo sapiens
gctctactatcctagtttctaagcctaatgaagttccagctgtctctttaggcactccaccacatctcgcaggaagagtttactcaaggtgcgtcacaacktggatgtgactactccaggggcaaaattttgtccttactgtgaaccatcctctaacctagtgactggacatgctatttcagagttaagcctcaggcatca

SEQ ID NO: 58343 - DNA, 201 bp, Homo sapiens
atttaaactttattgtgcattaattatgtatttgggttctctaggtctcggtgattcagaatacacctacttttgcaatggggggaagataattgataaaygacttcaagagcttggagcccggcatttctatgacactggacatgcagatgactgtgtagggtaagggcagtgttctctgtttactccaataagccctct

SEQ ID NO: 58344 - DNA, 201 bp, Homo sapiens
atatgcttagctttatttaggattgattaaacaaatttagaatatgccctttgcagtcttaaaaaatgtgatcttgatagcatgtttttaatattagttcscaagggtgtgtgctatcatcgtaactatcatctatgaatctttttatgttgtatttgcatttaaatttttgttttctattgaaatgagggcttaaatagg

SEQ ID NO: 58345 - DNA, 201 bp, Homo sapiens
tgtgtcacaatttaaggcgggctcctttttgtaggcatttttgcgagcccttgtggactataccagtgacagtgctgaaaagcgcaggctacaggagctgygcagtaaacaaggggcagccgattatagccgctttgtacgagatgcctgtgcctgcttgttggatctcctcctcgctttcccttcttgccagccaccact

SEQ ID NO: 58346 - DNA, 201 bp, Homo sapiens
gtatctttgcagctcaagtttatttcacccaggaaagctccattttgtcttcaacattgtggaatttctgtctactgccacaacagaggttctgcggaagrgagtatgtacaggctggctggccttgttggttgcttcagttcttcagccaaacatacatgcatcccatgaagacagcgggaaagccctggctcctaaggt

SEQ ID NO: 58347 - DNA, 201 bp, Homo sapiens
tgggcgtcgtgggcctccgtagcaaacgcggggcgggagcacgactcagggcggcgcaatgtgattggcccaggtccccttcggagctttctattggtccygggtaccgagcatgggcgctgcgtcagtgcgcgctggcgcaaggttggtggaagtcgcgttgtgcaggttcgtgcccggctggcgcggcgtgggtaagct

SEQ ID NO: 58348 - DNA, 201 bp, Homo sapiens
cttctttaattggtgacagaaagctaatgagagcgtaggattccccccaaccaccacttgccacttcctacagttgttaagatctactttgtgtaatactmcataactatttattgctgtaacagaaagcttcaggaaaaatggaagggttttggtaggtaataatcaattattatgtgaacttggaggtagaataatcca

SEQ ID NO: 58349 - DNA, 201 bp, Homo sapiens
gatggccatgatatactgcgcataaaagcaaattgtactttgattagtgagtctcattccttgaaaagagaaaaaaaatagacagtgtttatgtatctgtwtacatttgggcgtagaaactgcttttaatactgttcctttagaaatggtaagagatcggggttaactattatttatctttatataacttagtactgtcta

SEQ ID NO: 58350 - DNA, 201 bp, Homo sapiens
agagaaaagggagcttcctggaggagactgccagtcagcagactctgtcattctacagtaacttaagttcagattgcagtgccacatgatgaagtatctgratctgttactttggacaaaaccaaagccatcagtatcataaaactagtcctgatttggccccttgtggttgacctcagtaagttgatcagcaggtgtttt

SEQ ID NO: 58351 - DNA, 201 bp, Homo sapiens
tgccctaacagtgattctgaggtacaaagcctactccaaagactgcagcttgaagataaaagagagcactgcgtccttttgaaaataaaggcagacacaargaagaaaggtaacagccctgatgctgtgacgttggggtgttgtgggccagtggactggagctgatggtgagagtgtggctctaaggttcagggtcctgtg

SEQ ID NO: 58352 - DNA, 201 bp, Homo sapiens
cttcctcaaggtgattaatgccataccatcagattctcaatttgataactaaattaaaaaatttaaaaacacatggttaaatacattgagaacatgattgrcccaacatcaatgtttatgaaactacaaacgagtatctggaaaaaaaaaaaaaaaaaaaaggatggttaacatataaacaccagaggggcaaagtctctg

SEQ ID NO: 58353 - DNA, 201 bp, Homo sapiens
taaatcaagaatctgtatatttcaggatggaaagagttttaatggatactatggatacaccattatttgttgatgtaattatgggcaattgagtcattttygctttttcactattaaaaaaggcaaacttccttgtactgtattaatttttgaacacttacttgaagtatatttgtaaaacaaattccttggagtagaatt

SEQ ID NO: 58354 - DNA, 201 bp, Homo sapiens
tctgcattcctgacttgtgacctatgttgttttatctttgaggattattttttggagagggtatctagcaaggatgggttgagtataataaataactgatyagaaatttgagattgtaaccctggcaatgatctgtcatatataacatgttcaagagagtatttcacagtatttataattttttttttaccttaagttttt

SEQ ID NO: 58355 - DNA, 201 bp, Homo sapiens
gaattgagcttctcttctgaaaagctagctccatatatctgccctcattcatttaccttggaaatgaatactgagtagccaggaagttttgtaagcccctrtggatcttgcgtagtcactaattgaaagaagggtataattgaaaattgcacttacgttttgtcacatttgtttttcaaggaggaaagccaagtatctgtg

SEQ ID NO: 58356 - DNA, 201 bp, Homo sapiens
ttaaggatgtcatttctctcaggatgctattttgtttctcttgttctatcttggtgtttagggaggaggatggcgtcaaattcagagacttcttcttggcyctccccatgatgatagatcttaacgtcataggccaataattcggtgttgccctgtgccagctgctgagtggccactggaggtcctgggccaggacgccat

SEQ ID NO: 58357 - DNA, 201 bp, Homo sapiens
tcctgtgaccatctacacacatgttgcattcttaaacatctgtcacattcttcaagatctctccttcctgaaacatttgcagacattctgtttcccttgaygtagtttattaggaaaactactagatctttacatgaacatgccagtatttttattttctatttgtatttcagaaattctaatgtctaatagataaagcgt

SEQ ID NO: 58358 - DNA, 201 bp, Homo sapiens
cccttgctggcaagaaatgtgagcttgtgtcattgtgagaggctcctccccagagccctggcctgcatctgtatcactctggggcttagaggcaatgggcytagtaatagacttgacttgggaagtggtgactttttcagcccatgtttgctcacaaccagtatcgagccagatagtgtaatgttttatacttaaggaaat

SEQ ID NO: 58359 - DNA, 201 bp, Homo sapiens
aaggaggtgtgggcaggggtaaggtgtgacctaagaatgctgaagtgtttctttcaggtggcagaggtagtcattgtcagcactgccatagcctttgcagraggcagtcttcttaggggtacatctcagtacccccacattatggctcccagacacccagaactgaccttcatcccagctttcccatatagccacttatcc

SEQ ID NO: 58360 - DNA, 201 bp, Homo sapiens
ttttatttcgttttaattttttccttaagcaaaagcataatcacagatgtctctgtctcatcagtgtgttcaccatttcgtagacactttacacattctgsctttaacagccctgagccacttttccatagtacaagttcatttattcataaaattgctattaatgttattgaatgtagagctctctctagatctcacagt

SEQ ID NO: 58361 - DNA, 201 bp, Homo sapiens
cttcagagttgtcctgagttggaacgaagaggctggacctttgtagtctttgatgagacattggatgtgggttgcctctgaaaggaggtgtgggcaggggyaaggtgtgacctaagaatgctgaagtgtttctttcaggtggcagaggtagtcattgtcagcactgccatagcctttgcagaaggcagtcttcttaggggt

SEQ ID NO: 58362 - DNA, 201 bp, Homo sapiens; identical to SEQ ID NO: 11108

SEQ ID NO: 58363 - DNA, 201 bp, Homo sapiens
ggctttctctgccttcactgtcatgggctgcatgagatgactgtgtctttctaagctcctgaggatgtcccctggcttagttctattttagttttacttasttcttaattggtgatttgtcctttaagctttttgcattttttttcaagtgcgagtgaattttagcagtagccccccaagtcccaccagtcttctcttctg

SEQ ID NO: 58364 - DNA, 201 bp, Homo sapiens
catgtgccttgctgtcatagatgagctatgctgatgctttgggtccctgggtaacaacattcatttgaaccccctcttaacagaccctggaatgtttgcayattccccttagcccagtgtacatttcccctttgggagaaggactgcagaagccattgtcaagtacagtttctatagtgtctcacagtccctcctcctagg

SEQ ID NO: 58365 - DNA, 201 bp, Homo sapiens
ctcccaggtatggaatgtgctacccacagatcctgaagagacttagcagtggttctgcttctctctagaagtgaggtacaaggtgcactagtgtggccttyacttgggaggggatgtcctgacgtgcaccaaactgttagaaccctaaaaattgtgctggcactgcaggccctttaattgcatagggcatgggtcttacca

SEQ ID NO: 58366 - DNA, 201 bp, Homo sapiens; identical to SEQ ID NO: 11114

SEQ ID NO: 58367 - DNA, 201 bp, Homo sapiens
ttctctgacacctaggaaatccttggcctactgtcgggacctggagcctgtggaggattgggagctgtagaaccgtgtggtcagctctgtctcctagaacrgtcactgtaggcaaaggcctggcctgggcatgagtgaggctgggagatctgtgtgagatgttctgagaagacggagggaagaactatggtggtacagtca

SEQ ID NO: 58368 - DNA, 201 bp, Homo sapiens
ggcaagagagggagcaagaggcagggggaggtgccacacactcaaatagccagatctctcaggaactcagagggagaactcactcattacagcgagcatarcatcaagccattcatgaggcatctgcccccatgacccagacgcctcccaccaagccccacttctaacactgggaaccacattttaacataaagatttgga

SEQ ID NO: 58369 - DNA, 201 bp, Homo sapiens
tacttttttccaactgtcagaatttataaccaactcaccttgcagccgttgaaggaaaagaggcttgaatatttttgccagaaagttgactggatggcatycattaagtgaacatgaatgaagaagtttcaataatgatttgggtggaaaataattgaaatgagtgaatagcacgttttccagctttctaaataaagcaga

SEQ ID NO: 58370 - DNA, 201 bp, Homo sapiens
tctttttaaggtgcctgacttttatttaaaatttttcaacctcatcgtgatgctaatctttattgtcttcatatttagggtacatttctccataatatatrctattgtctgcccaccagaaagcagatcttatccatagaccaagaaacatgatttgattatctatttagagttctacctcaaagacaccatgcctatcat

SEQ ID NO: 58371 - DNA, 201 bp, Homo sapiens
ctcaccctcttcagtgaagtcttcgagaaccatcagcaggaataggatgacagaacacagggtggggagttctaagtagtattagaaagttctcttatcgyatactaatttatttcaattcttttcgtagattttttgttaccttttagaatgttagaatgtttgtaacaataccacattacgtagttatataaaaaaatt

SEQ ID NO: 58372 - DNA, 201 bp, Homo sapiens
cgatgcccagtacaattaaaggcacccttctttgcaagtcagggcctgatttctcctcctttttcttagtgttttttccacttaggacctccccaaaatgstaagaccgtgttgctgaatgaggctgctcttctcaccatcctgtcctcaggctggccctctcaccctcttcagtgaagtcttcgagaaccatcagcagga

SEQ ID NO: 58373 - DNA, 201 bp, Homo sapiens
acctttctgtagtaaagaaaatttgctgctcttgtcttaccctttgtatcctatgcctaaagaatatatctaaatgaatggtggtgattggtaagtaaacrtcttatatcttgtcttcagggtgctgtgacatctgtgtgcccttccagaagtcacagaattccccttccagacttttggttttcttttttttccttccag

SEQ ID NO: 58374 - DNA, 201 bp, Homo sapiens
cgtggagcctttggattgggctctttacatggagggagcctggtgagccacacttcgctgttagagaacacaggtctgtgggccttcgctgcaggctgcaktgcttggcgtgctcttaccgtctgaacggccatttgccaccatgccaatcagacgtttacagacgcatactttatcttttcattacttttatttttgttt

SEQ ID NO: 58375 - DNA, 201 bp, Homo sapiens
tactatagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaa

SEQ ID NO: 58376 - DNA, 201 bp, Homo sapiens
ctatagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaatt

SEQ ID NO: 58377 - DNA, 201 bp, Homo sapiens
tatagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaatta

SEQ ID NO: 58378 - DNA, 201 bp, Homo sapiens
atagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaattaa

SEQ ID NO: 58379 - DNA, 201 bp, Homo sapiens
tctctagaatacagacttttcctatcagcctggagatgccttcagcgtgatctgccctaacagtgattctgaggtacaaagcctactccaaagactgcagsttgaagataaaagagagcactgcgtccttttgaaaataaaggcagacacaaggaagaaaggtaacagccctgatgctgtgacgttggggtgttgtgggcc

SEQ ID NO: 58380 - DNA, 201 bp, Homo sapiens
atactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaattaaggatg

SEQ ID NO: 58381 - DNA, 201 bp, Homo sapiens
ttgataactaaattaaaaaatttaaaaacacatggttaaatacattgagaacatgattgacccaacatcaatgtttatgaaactacaaacgagtatctggaaaaaaaaaaaaaaaaaaaaggatggttaacatataaacaccagaggggcaaagtctctgcatcctagagttagaagagtggctgacattgaacaataaca

SEQ ID NO: 58382 - DNA, 201 bp, Homo sapiens
actattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaattaaggatgca

SEQ ID NO: 58383 - DNA, 201 bp, Homo sapiens
ctattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaattaaggatgcac

SEQ ID NO: 58384 - DNA, 201 bp, Homo sapiens; identical to SEQ ID NO: 11085

SEQ ID NO: 58385 - DNA, 201 bp, Homo sapiens
tattttgtttcattatatctgctacttttatattgtaaaatagaagaaaactgcctacatgcatagaattactcaaggaaaataaaatgtgaagctctgcattattactccatccataagagcatgaaatagtattattttagatattttatttacctagtctttgtgtccttaaatttaaactttattgtgcattaatta

SEQ ID NO: 58386 - DNA, 201 bp, Homo sapiens
tgtgaatacaaatccatttggtcagtgttaacagtggaaggtatttgagttaccagcagtgaatctgtatgggtctgcagcaacctcaattcttgcctctraagaaagaattcaactgaggggcataaggcagaaaaagaccaaggcaagtttcagagcaggagtggaagtttatttaaaaggctgtagagcagggaagaa

SEQ ID NO: 58387 - DNA, 201 bp, Homo sapiens
ctgttcgagtcaatgttaggcctaagcgtggaaccactcatttctcacccttttgtagagaaagaacatggagatgcctgcacaactgagggatttaagctttttttttttttttttttttacaccatgagacatagaagcaattcttgatttccccaacacagaaacataccacattgttaattgtggttatttatatgg

SEQ ID NO: 58388 - DNA, 201 bp, Homo sapiens
tacctttctgccatgtggaagtattacctctaataaccagagggtcttctgggttgtgtggtagagcggcaggacctgttaacgagcactgtcacttggayctgctgtagagccctctcctgctctgggccccacgcaaagctggtggccttttctgtcacctggtatttgggtctcagcagtcctcccaggtatggaatg

SEQ ID NO: 58389 - DNA, 201 bp, Homo sapiens
ctcaacgctgctgttatgaataatatgtacacaagtggacttgactgtcttttaataaaactttatttacaaagaaaggcagtgcatggtatttgtcccaraagctatggttggctgacccctgctcagtatcagaaaaaatgtacagatgacagatattgtggttttgcaacctgtctgatccttgttttaagatttcta

SEQ ID NO: 58390 - DNA, 201 bp, Homo sapiens
aacaaaggcctcagtcagctcctctccatatggtacctttctgccatgtggaagtattacctctaataaccagagggtcttctgggttgtgtggtagagcrgcaggacctgttaacgagcactgtcacttggatctgctgtagagccctctcctgctctgggccccacgcaaagctggtggccttttctgtcacctggtat

SEQ ID NO: 58391 - DNA, 201 bp, Homo sapiens
tatatatatatatatatatatatatatatatatatatatatatgggtttttttcaaaaatagtatgctcattggaaaaattctggatacagaaataacccrggaaaccaaagtattttataatcaaaccctctgagttaacacttgaattttgttttcctgaggaaaatatgggtatccatattatatgtgctgttccata

SEQ ID NO: 58392 - DNA, 201 bp, Homo sapiens; identical to SEQ ID NO: 11086

SEQ ID NO: 58393 - DNA, 201 bp, Homo sapiens
aaaaggagttttgaagtaagaaattcactttttcatccaaacacattcctaggatttaacacattctctaagtcaggttcttttttttttcaactgtaatrtagaagacaaaatactggcatcgtgacccagaacatatggataaagataattgaaacaagtttcatgaaacaaagcaacgttttctgtttagtttttata

SEQ ID NO: 58394 - DNA, 201 bp, Homo sapiens; identical to SEQ ID NO: 11088

SEQ ID NO: 58395 - DNA, 201 bp, Homo sapiens
ctttgagtcctcacttacccgttcggtacccccactctcacaagcctctctgaatattcctggtttacccccagaatatttacaggtacatctgcaggagwctcttggccaggtaaggaagtttttctttatgctatagatgctatttaatcatggatgtttgctttgggcttttaaattattattacattagaagagagg

SEQ ID NO: 58396 - DNA, 201 bp, Homo sapiens
tatcttcttaaaataaagtttaccaattctggaatattaggaggaattctattcctgtcatcctattactagaatatcttcctatccctcttcatttcttytacctttatacatactcatgttttcagctacggtgctaatgaacacataatatatcctgcttgttaaaacttaatcatgaagtattttttgtattccgaa

SEQ ID NO: 58397 - DNA, 201 bp, Homo sapiens
accatattcgtgtgcaaggtactactatttattcacgtaatatatagcattgtttctccaaaatcttagactcaggcttccagatcattagagtttactartttattcagtgaaaacttacctgctttatggaagacagtaccaggcataataaagcagaagaagaatcatagagctcctgtcctctgggacttcatagaa

SEQ ID NO: 58398 - DNA, 201 bp, Homo sapiens
gcattaatccatagtgatttcttggtgatattttaatctgtaggaaacagatcagtagatcagtaaattggctaggcaaaaaaaaaaaaaaaaaaggtgcwtttgatggatggaatgagcatttgcagcattatggtagccttggattttggttaagttctgttagcattagtatgcctatttaaaattatatcttcttaa

SEQ ID NO: 58399 - DNA, 201 bp, Homo sapiens
acttgagtccaatacctgggttcaaatccttgatcccccacttactgactgagatcttggttgaattagttaagctttttgttccttggtttttgcctctrtgcaatagataacagtaatctatttactgtgtaagcttcgtaggagggtcaaacggattaatacatgtcgtcctcttagaagagtgcctgtcgtcatgta

SEQ ID NO: 58400 - DNA, 201 bp, Homo sapiens
accagatgacccctcaatccccatcataatggtgggtccaggaaccggcatagccccgtttattgggttcctacaacataggtatgttctttttttggctratgggaaaatgtattcctgagtaaccgtttttgtttctttagtcattttgaggataattggactttgtaaaatttttatttaaaaaattattattcaatg

SEQ ID NO: 58401 - DNA, 201 bp, Homo sapiens
gatttggccccttgtggttgacctcagtaagttgatcagcaggtgttttggcagtcagatgaatggtgaattttttttttaacaccaagatagtcatgctrtttatcctccctggctgatggtttcgtctagctgttcataatctaatatccttcctatttcacatagtccttttcaaggtactgacattacttatacaaa

SEQ ID NO: 58402 - DNA, 201 bp, Homo sapiens
ttatgtgaacttggaggtagaataatccactagatgtcagtattgtaccaggaactgtttttttaaaactacttgtaactgatttcttctaaccagctccyggaagtggccattaatggataaaatttttcaaatgtgccttgccacacttgtattgtcagtgagcataaagagtgttgtaattaggccgccatctcccca

SEQ ID NO: 58403 - DNA, 201 bp, Homo sapiens
ctctgcagaacctcttgagtagcattttaattaaggatgcacctcagatgcagccatgaaacattttcagaatagcagtggctgggcctcatcctaaacckactgaaacagtccttgaagaagcaacccctcatgccattcctccatttagaaaagcagaacaaaacaaaacactcccaatgattttgataacttctctaa

SEQ ID NO: 58404 - DNA, 201 bp, Homo sapiens
tatgaatctttttatgttgtatttgcatttaaatttttgttttctattgaaatgagggcttaaatagggctttttcttagtctaaatagggctttttcttwgtcttacttttactagttattaactacgtagcacattccacagtgatggaggtgactgcagttgaccttgtgttacccagctacacattgctgctccttc

SEQ ID NO: 58405 - DNA, 201 bp, Homo sapiens
tgccacatttaaaaaatctatttatgatgaattcaactttcccaaaggagggttgctttttttttctcctgttgtcagcctccctgggaattttactaaartaaaaaaataaataaaggctttaactatttatttagtccaaggacttggcattaatccatagtgatttcttggtgatattttaatctgtaggaaacagat

SEQ ID NO: 58406 - DNA, 201 bp, Homo sapiens
tgtagaaccgtgtggtcagctctgtctcctagaacggtcactgtaggcaaaggcctggcctgggcatgagtgaggctgggagatctgtgtgagatgttctsagaagacggagggaagaactatggtggtacagtcaaaaggaattagacttgtgaattaaggaggatttactaaaaatgcctgtttgtaagcagtcatctt

SEQ ID NO: 58407 - DNA, 201 bp, Homo sapiens
tgtcaggatgtgcagaaagagttgtgtggtgcttggttatatatgctgagtggtgtgctgcttggttacatatgctgagttgtgtgcggcttggttacatrtgctgagttgtgtggtgcttggttacatatgctgagttgtgtggtgcttggttacatatgctgagttgtgtggtgcttggttacatatgctgagttgtgt

SEQ ID NO: 58408 - DNA, 201 bp, Homo sapiens
ttttctgagttcacatattaaaatcataatattgaaaactatatttttgttaccctacagcttaaactatgtaacacgtataatgtatttttttttttttcattttggctcttctctagaatacagacttttcctatcagcctggagatgccttcagcgtgatctgccctaacagtgattctgaggtacaaagcctactcc

SEQ ID NO: 58409 - DNA, 201 bp, Homo sapiens
atgtaagatggaaaatatttcaagcctaagcattttcagtaattcttgaaagagtagcctttaatctttttgggatcatgactttattttaaatctgaaamctgggcacctccctgcagaaaactgcacatatacctagtaagggtttgctgagctcctcacctctgaagccaacttatggacccattcctagaagccttt

SEQ ID NO: 58410 - DNA, 201 bp, Homo sapiens
taattttcctttcttttatttggcctatcttgaatttatagtcttcttatgtttttgtaaggtggagttttttactgtattcattttggggaatttttttggctgaataaacattgccacaagtcatgttgcactttgatgcgctgtaaagtactacagtaattgtgttttggggagtgtgtaaaacattttattcttcat

SEQ ID NO: 58411 - DNA, 201 bp, Homo sapiens
gatgtcagtattgtaccaggaactgtttttttaaaactacttgtaactgatttcttctaaccagctcccggaagtggccattaatggataaaatttttcaratgtgccttgccacacttgtattgtcagtgagcataaagagtgttgtaattaggccgccatctccccagtgtggttttcgtgtcgttttattaatgtgtt

SEQ ID NO: 58412 - DNA, 201 bp, Homo sapiens
aaacctcctaagaaatcttaaacagcaggaaattgttccttcaagaacaagaacacaaaaatggggtccatttatcaaagaaaagcctatctggtggcaamtgactccaagtaaatgaaattctgctttttcaggttattgagacagatcagaagtaaaggaacttaaaaggaaactgcacccatggggaaataaagccac

SEQ ID NO: 58413 - DNA, 201 bp, Homo sapiens
taaacttgttttcacaaaggctcctcagggcagctctaatgtgtaaccacattttgagtagtgtaccacatgagcacctcccgagcacagtgaaatgacarcctgagtcataatgacacacgggcctgaaatctgcctcctcttggtattcatttcgctttaggaattagaatttaattgatcctcctttgagctgtgatt

SEQ ID NO: 58414 - DNA, 201 bp, Homo sapiens
gccggaggcaggggagacagaaaagttccactataaaacatttgatgagtccgggcgtggtgactcactcctgtaatcccagcactttgggaggccgaggygggcggatcatgaggtcaggagatcaagaccatcctggctaacacggtgaaaccccgtctctactaaaaatacaaaaaattagccgggcgtggtggcagg

SEQ ID NO: 58415 - DNA, 201 bp, Homo sapiens
agacagtctcattttatgtttaagatgtatactgcctctcaaataagtagttttacattgggagtctgagggcaactaaagattaattttatattgtccarttttggctagtagggtccccgcatccctgtttttctgcttttgttatctgtggtgtctgacatctgaacttgtgccattattgagaagacatatggctgt

SEQ ID NO: 58416 - DNA, 201 bp, Homo sapiens
tgaacccgggaggcggagcttgcagtgagccaagatcgagccactgcactccagcctgggcgacagtgataccctgtctcaaaaaaataaaaaaaaagaayatttgatgagcactggcttataggattctccctgtggccttcattccattgcacagcctctaccgttttcccgtctggctctctgttttgcctttcagta

SEQ ID NO: 58417 - DNA, 201 bp, Homo sapiens
taaaacattgaccatgaactaagccataaaggaaaactcagcaaattacatgaaataaagcgttgttcactgactctaataaaaaaccaactgcaaaaaawcccacaaaggccacagtgaaacattttaaacacatgcagatgattcatagcttaaattattaaatgtgcacatggaattcaggcgaaacaatacccaggg

SEQ ID NO: 58418 - DNA, 201 bp, Homo sapiens
agtgtggctctaaggttcagggtcctgtgtgttggccgcacagatgcctggggctcagctgcgcatcaaggtccgggaacacaggcatacgctggtattgstagtttcttaactttcatgttaattgcactgaataagaagataatggatgttctaattattggacatttgtggacatgaaaactgagtgtaaatgtagtt

SEQ ID NO: 58419 - DNA, 201 bp, Homo sapiens
gattttcaacctaactaccttacttgaatttttcctttttctgaaatgaagatattttcaagacattcttgcttgatgtgccaccacactaaatggggttrcgaatgcacacttgagtccaatacctgggttcaaatccttgatcccccacttactgactgagatcttggttgaattagttaagctttttgttccttggtt

SEQ ID NO: 58420 - DNA, 201 bp, Homo sapiens
cctttaacatttgcatttttctttggtgacaccaaaatgtatattgtcctttttactcttgggccagcaagatccttttcgatgcccagtacaattaaagrcacccttctttgcaagtcagggcctgatttctcctcctttttcttagtgttttttccacttaggacctccccaaaatggtaagaccgtgttgctgaatga

SEQ ID NO: 58421 - DNA, 201 bp, Homo sapiens; identical to SEQ ID NO: 11107

SEQ ID NO: 58422 - DNA, 201 bp, Homo sapiens
aatgtaatgcttgtgtcatccattaggcccatcactcatccatatttcacttctcttcaaaggctttcattttctctgttgatttattggtgtaagtattraaatgcttgactgtatatttcagtagactatagtgcttagattttcaacctaactaccttacttgaatttttcctttttctgaaatgaagatattttcaa

SEQ ID NO: 58423 - DNA, 201 bp, Homo sapiens
actgaataatctgtttatgagaaaattacaaattcagcaaatgtcttgcttttcggcatactgtatttctgctgaactcacccctgtgcccacttcttccrtctttcccttcagctctgatgccatgggttttttccatatcgccagcacacatattcttcctgattgtgacaaagctttgtgacatttccttgggaattc

SEQ ID NO: 58424 - DNA, 201 bp, Homo sapiens
gccaggcagagaaccatcatcccatttcagatgaagagtaacccatttttttgcccagagtgactcttctagtcctcatactccaacagaagagacctcarcattgtccctgagcagtcgatgtcctaggacctctctgtggctctcaggaagggattgaaaatgcttgctaggggtgaagactaagcgctttataggact

SEQ ID NO: 58425 - DNA, 201 bp, Homo sapiens
tgttaatttaattttcactcactatgttactgaataatctgtttatgagaaaattacaaattcagcaaatgtcttgcttttcggcatactgtatttctgcygaactcacccctgtgcccacttcttccgtctttcccttcagctctgatgccatgggttttttccatatcgccagcacacatattcttcctgattgtgaca

SEQ ID NO: 58426 - DNA, 201 bp, Homo sapiens
agggagcctggtgagccacacttcgctgttagagaacacaggtctgtgggccttcgctgcaggctgcattgcttggcgtgctcttaccgtctgaacggccrtttgccaccatgccaatcagacgtttacagacgcatactttatcttttcattacttttatttttgtttttacaagtcagtatttcacccattgtgccacc

SEQ ID NO: 58427 - DNA, 201 bp, Homo sapiens; identical to SEQ ID NO: 11112

SEQ ID NO: 58428 - DNA, 201 bp, Homo sapiens
catttttcagtttcactgttacatgccttgaagtgatgaggaggtttctgttactatatgctacacagcagggacaggcaaaggccatcgcagaagaaatrtgtgagcaagctgtggtacatggattttctgcagatcttcactgtattagtgaatccgataaggttagagccgttacagtggattttaccgttttgtgct

SEQ ID NO: 58429 - DNA, 201 bp, Homo sapiens
tattgtttattcactcattcagataacttatcgagtaccagtttcatgccaggtgccgttctgggcggttcattcaccgaaagccaagcttttggtttggrtttcagtttaaatctgtctctgcaaattgacagcccaccaattttagccgttagatgagtatggaaaaaaatctgtgagtgtcgtttgttttactactgc

SEQ ID NO: 58430 - DNA, 201 bp, Homo sapiens
gtagtgttttcatattgtttattcactcattcagataacttatcgagtaccagtttcatgccaggtgccgttctgggcggttcattcaccgaaagccaagmttttggtttgggtttcagtttaaatctgtctctgcaaattgacagcccaccaattttagccgttagatgagtatggaaaaaaatctgtgagtgtcgtttg

SEQ ID NO: 58431 - DNA, 201 bp, Homo sapiens; identical to SEQ ID NO: 11117

SEQ ID NO: 58432 - DNA, 201 bp, Homo sapiens
tgtaggtattctattaacttacacagattcagtacttttactatcattttacacgaggaagaagttgaagcacaaagttactttgcccagtttatgcaggkggttaagtggcagagctagggttcaaactcaggcaatgtagctcttaagggtggcccttaaatgttggttgaaggaagaaattgcatttggatagaaatc

SEQ ID NO: 58433 - DNA, 201 bp, Homo sapiens
aaaagaaaagaaatagaacccagacaggcaggttagggttaattcctcagagcagtggttttgatttcttgagaatctggaaaaaattatggactctcccraaaaatgattacacttgtcccttagtatcttcgaaggatttgtcccaggacccctttcagatacccaaatcctcaaagctcaagtcccttatgtaaaatg

SEQ ID NO: 58434 - DNA, 201 bp, Homo sapiens
tcttttttcccccatttttcagtttcactgttacatgccttgaagtgatgaggaggtttctgttactatatgctacacagcagggacaggcaaaggccatygcagaagaaatatgtgagcaagctgtggtacatggattttctgcagatcttcactgtattagtgaatccgataaggttagagccgttacagtggatttta

SEQ ID NO: 58435 - DNA, 201 bp, Homo sapiens
atcagaggaaatgcttgactttgatcaagaaccaccagggcagtgagcatttggctaatcaatttaggactcaggttggaaactattgatagggaaaagtygtttatcttatttaaaaatgtttggtgttcatccactttttcagtacatgcctgcaagattctataaagggccacaatatcctccggggtaaatgtttcc

SEQ ID NO: 58436 - DNA, 201 bp, Homo sapiens
tgctattttgtttctcttgttctatcttggtgtttagggaggaggatggcgtcaaattcagagacttcttcttggccctccccatgatgatagatcttaaygtcataggccaataattcggtgttgccctgtgccagctgctgagtggccactggaggtcctgggccaggacgccatttaccgcctggcccccatgtgcct

SEQ ID NO: 58437 - DNA, 201 bp, Homo sapiens
taggtctcctccaggagcacctaatccgggggagacagagccggatgagagcttggaaccctactaagttaggactgagcaggggaagggacggcctaggrggagtggagcagccgggcactccggtaacaggaaccgtggtttgcccccacgctccttcctcctcacgcccaccaactcgcagcaggacccttgcccccc

SEQ ID NO: 58438 - DNA, 201 bp, Homo sapiens
  misc_feature (1)...(201): n = A,T,C or G, or insertion/deletion polymorphism (see Tables 1-2)
atccccagaattgcaagcagtatccatctctctgacattcatgaagacgccctggcgggagggagtgggagagatttgcccagggactgagtgggtgtgtnctcgtgcttctgagtttggcatgagaccaccagtggcgccggtcaggccagggaggcctagtcttgcatcacactctccgcctaggctaggcaagtggtg

SEQ ID NO: 58439 - DNA, 201 bp, Homo sapiens
agcaagactgtgtcaaaaaaaaaaaattcaataatcaagatccataatgcagttttttgttgttgttggtttgttttttttaagagacagagttttgctaygttgcccaggctggacttgaacttctgggctcaagcaatctttctccctcagcctcccaaatagctgggaatataggcatgtgccatcatacctggctat

SEQ ID NO: 58440 - DNA, 201 bp, Homo sapiens
gccccgccgccaggtgccattggccaggccggtcagctgacacggcctggccccgcccctcccggggagcccgaccacagggccccgcccccactgggcgmgctggccccgcccctccagcagagcgcagaagtaaatattttgcatgaatcctctcagaagtaaggcagcatcgttcagccccattttgcagatgaagaa

SEQ ID NO: 58441 - DNA, 201 bp, Homo sapiens
tcaggtctggggccagcagggcagaaccccctagaaccctgacttgctccaaagtcagacttgctccagagtctgtggccgccaccatcaccaccaccacrgagctgacttcctgggtttctctttcactttgacttgccttagggatgggctgtgacactttactttttttcttttttcttttttttcagtcttttctcc

SEQ ID NO: 58442 - DNA, 201 bp, Homo sapiens
tgcgcctacccctcctctgtgccctcccttttaggtcctggtgggttcaaacctgcagggaaggcacacagcgggtgtctaaggcccagagaggtgttgcygcttactcaatgtcatacagaggtagggacagggtgaggttcggagcctctcacccatatgggtctggaacctcttgctggcatcctgagctcagttcca

SEQ ID NO: 58443 - DNA, 201 bp, Homo sapiens
agcttcctctcacactccaggagccttgcccatgcaggcccttccctgcctcctgcctggaatgtttgttttccacacggtccaactcctattcgtccttsaaaactcagctcaaaagttccctcctccagcaagacttctctgcctccttctggccatgcccttgtttacaactgtcccttctccctggtctgacactgc

SEQ ID NO: 58444 - DNA, 201 bp, Homo sapiens
ccaacaggaggttctttctgggcctctgcttacccgtctataaaataggaagggatttggagtccttttctcaatgggcccagcaagtttgcttagctgggccctggcctggtatttattgagcaactgctatgcaactattactccagggctcctcagagcagccattgcctcagcttctcccagcagctccaggagtca

SEQ ID NO: 58445 - DNA, 201 bp, Homo sapiens
taatgaatctcacatcccaaggtgtttgttaaatattcaaccgcgccagggaaggtggcagttcgcgagatgctggtggcaaattaatgagcagtctttarggaaaggggggccgtgaggctcaggtggcctctcactctcccgcttcctgctctgggccttgccagagccccagaaagcctcagcctcagcctgttcctt

SEQ ID NO: 58446 - DNA, 201 bp, Homo sapiens
tgcttattgagtgactgactggactgactgaatgaatgaatgcagtttttctgtggttaacacacacacacacacacacacgcacacacacaagtatatawatatatatatttgtgtttttttgttttttgtttttgagacaaaagtccagctctgttggccaggctgaagtgcagtggagcaatctcggctcactgcaac

SEQ ID NO: 58447 - DNA, 201 bp, Homo sapiens
gcccaccaccatgccgggctaattttttgtatttttagtagagacggggtttcaccgtgttagccaggatggtctcaatctcctgacctcatgatctaccygtctcggcctcccaaagtgctgggattagaggcgtgagcccccgtgcccggcctctcaaattccttttctaaggaaaaattttctgcttgaggtaactgg

SEQ ID NO: 58448 - DNA, 201 bp, Homo sapiens
caggagaatcgcttgaacccagaaggcagagattgcagtgagccgagatcgcaccagtgcactccagcctaggtaatagagtgagacttcgtctcaaaaarcaaacgaacaaacaaacaaacaaaaaaccttaggcaacatgagattacaggtggcagttatccctggggatgcaaattgtgttaatttttcttccttcag

SEQ ID NO: 58449 - DNA, 201 bp, Homo sapiens
cacagagacccaagttaccctcagtggcctgcgggctggtgtagcctacacggtgcaggtgcgagcagacacagcgtggctgaggggtgtctggagccagycccagcgcttcagcatcggtgagtggagggggtaggacccagttatttacccagcatgcactgcactgcgcttcccacaatgatcttagcagccctgccc

SEQ ID NO: 58450 - DNA, 201 bp, Homo sapiens
tcccactgcagagcatcccgtgcagcccacagagacccaagttaccctcagtggcctgcgggctggtgtagcctacacggtgcaggtgcgagcagacacarcgtggctgaggggtgtctggagccagccccagcgcttcagcatcggtgagtggagggggtaggacccagttatttacccagcatgcactgcactgcgctt

SEQ ID NO: 58451 - DNA, 201 bp, Homo sapiens
cctgggcaacagagtgagactccatctcaaaaaaaaaaaaaatcttgagatgaatgggcgcattaagagaagagattttaggttgggcttggtggctcacrcctgtaatcccagcactttgggaggccgaggtgggcagatcacgaggtcaggagatcgagaccatcctggctaacacagtgaaaccccgtctctactaca

SEQ ID NO: 58452 - DNA, 201 bp, Homo sapiens
ggaccagagctgttttttttcttttgagatggggtctcgttctgtcgcccaggctggagtgcagtggcgtgaccacagcgcactgcagcctcgacctctcrggctcaactgttcctccttcctcagcctcctgtgcagctagaaccacaggcacgtgccaccacgctcagcttagtttatttgattatttgtagagacaga

SEQ ID NO: 58453 - DNA, 201 bp, Homo sapiens
agtagctgggactacaggtgtctgcaaccacgcccggttaattttttgtattttttagtagagacggggtttcaccatgttagccaggatggtctcaatckcctgacctcgtgatctgccctcctcggcctcccaaagtgctgggattacaggcgtgagccaccgcgcccggcctactgctattttttgttttgttttgag

SEQ ID NO: 58454 - DNA, 201 bp, Homo sapiens
ctcggccttcccaaagtgctgggatacaggcatgagaccacatttctaccaaaaactgaaaaaaaaaaaaaaaaagctggatggtcgaggggcggtggctyacgccggtaatcccagccctttgggaggccgaggccagcagatcacttaaggtcaggcatttgagaccagcctggacaacatggtgaaaccccatctcta

SEQ ID NO: 58455 - DNA, 201 bp, Homo sapiens
ggagtttcaccatgttgaccaggctggtctcaaactcttgacctcaggtgaatcacccgccttggcctcccaaagggctgggattacaggtgtgagccacygtgtccggcctcgctcaggctggtttcaaacttctggcctcaaactatcctcccaccttggcctcccaaagtgctgggattagtcatgagcacccagctg

SEQ ID NO: 58456 - DNA, 201 bp, Homo sapiens
ctcagaaggctgaggcgggaggatcacttgaggccagtggtttgagaccagcccgggcaacatagtgagaccccatctctaaaaaataaaataaaatgggkctgggcgtggtggctgatgcctgtaatcccagcactttgggaggctgaggcgggcagatcacttgaggtcaggagttcgagaccagcctggccaacatgg

SEQ ID NO: 58457 - DNA, 201 bp, Homo sapiens
atggtggcacatgcctgtaattctagctacacgggaggctgaggcaggagaatcgcttgaacccaggaggcggagattgcagtgagccgagattgtaccastgcactccagcctgggtgacagagtgagactctgtctcagaaaaaacaaaaacgaaaacaaacaaacaaaaaacaaaaacaagagaattagacttgaggg

SEQ ID NO: 58458 - DNA, 201 bp, Homo sapiens
gacggggtttcgccatgtgggccaggctggtctcaaactcctcaggtgatccgcccaccttggccttccaaagtgctgggaatacaggcatgaaccaccaygccttgctcccactaaaattttttaaaataaattttttcttttggaataaccttcgattttcagaaaagttactatataaactggtgcagagaacgccca

SEQ ID NO: 58459 - DNA, 201 bp, Homo sapiens
atgcctggctaatttttatgtagagatgagggggtctcactatgttgcccaggctggtctcgaactcctgggcttaagtgatcttcctgccttggcctccyaaaatactggaattacagggtgagccaccgtatgtggcttgtgtataaatcttgactttttgatcataatataccaggcttagctgggacctgcaagtgt

SEQ ID NO: 58460 - DNA, 201 bp, Homo sapiens
atggggttgggggtgttgcatagggaagagatcttggaggaggggatattggtgcaagggctttgaaacatgagtaggagttttctgggggttcctggcaratggcacagccagtgcaaaggtgcagaggtgggaacacaatctactgaatggcctggcctttgcttatccttccagcaacctacagctggagtcgagagt

SEQ ID NO: 58461 - DNA, 201 bp, Homo sapiens
caaaagtgcccgtctcttcacagccttgccagcaatgggtgttaatattttaaagttatcttcactaacaggatcctgtgtataaatctttattaaaaatkatttatttttaaattttaatttaattttaatttgttttgagacagagtcttgctctgtcacccaggccggagggcagtggtgggatcttgtctaactaca

SEQ ID NO: 58462 - DNA, 201 bp, Homo sapiens
cgcgccagggaaggtggcagttcgcgagatgctggtggcaaattaatgagcagtctttagggaaaggggggccgtgaggctcaggtggcctctcactctcycgcttcctgctctgggccttgccagagccccagaaagcctcagcctcagcctgttccttgaagaatacacagcctgaggagacagaactggacacggaac

SEQ ID NO: 58463 - DNA, 201 bp, Homo sapiens
ggaggctgaggtgggtggatcacaaggtcaagagatcgagaccatcctggtcaacatggtgaaaccccatctctattaaaaatacaaaaattagccaggartggccacgcgcgcctgtagtcccagctactggggagactgaggcaggagaatcgcttgaacccgggaggtggaggttacagtgagctgagattgagccac

SEQ ID NO: 58464 - DNA, 201 bp, Homo sapiens
acgtggctgtcatctcctcgaaccaatttggtcctggcctgaaccagacgtggcacattcctgccgacacccacacaggtgcctcctctgggtggggaggkcggtatgagggcccctcagagctgagcacctactctgagcctcagctagaccagggtgagaggagcgaggcagaaaattttaaaggagtgcctgatttag

SEQ ID NO: 58465 - DNA, 201 bp, Homo sapiens
ctgcacccggcctcagttccctgtttgatgaagccactttgagtccttcttctgtccctagaaaatgaccaacaggaggttctttctgggcctctgcttayccgtctataaaataggaagggatttggagtccttttctcaatgggcccagcaagtttgcttagctgggccctggcctggtatttattgagcaactgctat

SEQ ID NO: 58466 - DNA, 201 bp, Homo sapiens
tttctctctgctagccataatgctgccaagacctggttgggttcttattatctgttctcatgactcgacatcatgtattttgccgggtgcggtggatcacrcctgtaatcccagcactttgggaggctgaggtgggtggatcacaaggtcaagagatcgagaccatcctggtcaacatggtgaaaccccatctctattaaa

SEQ ID NO: 58467 - DNA, 201 bp, Homo sapiens
aaaaagaattggctggacacagtggctcatgcctataatcccagcactttgggagcccgaggtgggcggatcacccccaagagacaggcacttttgtaaaktgcttaccagaattgattaccctctggcaagcaatttacaaaagtgcccgtctcttcacagccttgccagcaatgggtgttaatattttaaagttatctt

SEQ ID NO: 58468 - DNA, 201 bp, Homo sapiens
caggctcgtcttgaactccagacctcaagtgatccacccgcctcggcctcccaaactgctgggattgcaggtgtgagccctggaggcccctggagttggcygcaaacccacccctatgcacagtcccttgggtgcgagaagtaggagacaggcaatgtttactggcagcagctgggacttttgccagagtgcatggggaag

SEQ ID NO: 58469 - DNA, 201 bp, Homo sapiens
tcacaccattctcctgcctcagcctccccagtagctgggactacaggcgcccgccaccgcgcccggctaagtttttgtatttttagtagagacggggtttmaccgtggtctcgatctcctgacctcatgatccacccgcctcagcctcccaaagtgctgggattacaggcgtgagccaccgcgcccatcccacttacatgt

SEQ ID NO: 58470 - DNA, 201 bp, Homo sapiens
cccgcctcagcctcccaaagtgctgggatgacaggtgtgagccactgcacccgtccaggtctcaggatgttagagaatttaaccagcagtgacctggtccrttccatcctgctgtggatgggaagtagagctctgctcacagctgtggccctaccctccctctgcagacttggcagtggatcaacccagtggacttccagg

SEQ ID NO: 58471 - DNA, 201 bp, Homo sapiens
gccgctgcccacaccctgtgccagctccgccattgagttccctggagggaaggaggtaaggatgccttttctaattccaagtctttttattgggtgcacaygctggacaagggttacgcattagctcattttattctctcccaattcatcaaggtaaggactccaaaaccagtgctccataccccttcccattttaaagac

SEQ ID NO: 58472 - DNA, 201 bp, Homo sapiens
tttcaccatgttggccaggatggtctcgatctcctgacctcgtgatccgcctgccccgtcctcccaaagtgctgggattataggcgtgagccaccgcgccyggcgggctagggttttattcttgggttgtggggtcctggagctggagagtcaggtcctgacgggtgagaggttcagagtttattctggctgcagttcagc

SEQ ID NO: 58473 - DNA, 201 bp, Homo sapiens
cattcattcatttaagaaatcagggtccggcgcggtggctcacacctgtaatcccagcactttgggaggccaaggcgggccgatcgcttgagctcaggagytcgaggccagcctggccaacatggtgaaaccccgtctctactaaaaatacaaaaattagccaggtttggtggcacatgcctgtagtctcagctacttggg

SEQ ID NO: 58474 - DNA, 201 bp, Homo sapiens
cacgagccactgagccccagccttattcctctttttttttttttttttagatggaatctcactctgtcgcccaggaggctggagtgcagtggcgtgatctyggctcactgcaaccccacctcctgggttcaagcaattcttctgcctcagcctctggagtagctgggactgcaggcacccaccaccaagcatgcatggcta

SEQ ID NO: 58475 - DNA, 201 bp, Homo sapiens
tacgtgtgggctgcccctcgccaatccctacctctgcttccagttaaatatgagcctcctctgggagacatcaaggtgtccaagttggccgggcagctgcrtatggagtgggagaccccggataaccaggttggtgctgaggtgcagttccggcaccggacacccagcagcccatggaagttggtgagtttgtttcccaag

SEQ ID NO: 58476 - DNA, 201 bp, Homo sapiens
agccactgcgctcagcccactacagggctttatcaagtgagaatcatcaggctgaacctcacggtgtctcaaggacaatgtcacctgcaggtggcagggtktactaaacagctgctgccctgagcctgggcaacaggaaaatgagtgagagggtttcaaaccatgcagaaaggcctggcgctgtggtttatgcctgtaatc

SEQ ID NO: 58477 - DNA, 201 bp, Homo sapiens
gggtgatcctggaggccctaagaggacagggcctggcctgcttctgctgagcccccaggacccagcacgtggctctgtacacagttggagctcaataagcrcatgatggttaagtgactggtgccaagtcctggacaattcttacggcctgatgttcgacctgcctctccccagagtcctgcctctgccccctggagatga

SEQ ID NO: 58478 - DNA, 201 bp, Homo sapiens
agctgggattacaggtgtccgccaccatgcctggctaatttttgtatttttagtagagaaggggttttgccatgttggccaggctggtcttgaactcctgrcctcaaatgacttacccacctcggcctcccaaagtgctgggattacaggtgcgagccactgtgccaggcctcgaccagcattcttggtgttgactatgac

SEQ ID NO: 58479 - DNA, 201 bp, Homo sapiens
aaataattattaatttttaaaatttagttataataattttttactgctttatatgttcctaaagaaggtttgaacctagagaaggttctctagtaattaaygatagaaataatccctggaagtatggtctttaatttaaaaaaatttagcgaggtgcggtggctcacgcctgtaatcccagtgctttgggaggccgagttg

SEQ ID NO: 58480 - DNA, 201 bp, Homo sapiens
ggaatgtcttttttctgctcccagattcaatccaggatcccacattgtgtttagtaaaataattattaatttttaaaatttagttataataattttttacygctttatatgttcctaaagaaggtttgaacctagagaaggttctctagtaattaacgatagaaataatccctggaagtatggtctttaatttaaaaaaat

SEQ ID NO: 58481 - DNA, 201 bp, Homo sapiens
atcatacctcttaaatttatacaatgatataaaaaaagaatcaggccgggtatgaccacggtgcagcaagactattttatgctaatttatgtctctccttrggtcaggttccttgaaatagatctaaaaactaagtacgatttccctgatagttctaaacaaacaaacaaacaaaaaaagaattggctggacacagtggct

SEQ ID NO: 58482 - DNA, 201 bp, Homo sapiens
gctgcctgcagaaccagtgagtgctgttttcaggacccgccatatccggatgcagactcaggttcggggcagttcctcattgttggctgaggattatgtakggctctgcctgaccccatccacagcggcccctcccatggcctccaccaccaggccaaagacccagccctgcctgtggtcttgggagtccccaccccacca

SEQ ID NO: 58483 - DNA, 201 bp, Homo sapiens
gagatggagtttcgctctgtcgcccaggctggagtgcagtggcgcgatctcggctcactgcaagctctgcctcctgggttcacaccattctcctgcctcarcctccccagtagctgggactacaggcgcccgccaccgcgcccggctaagtttttgtatttttagtagagacggggtttcaccgtggtctcgatctcctga

SEQ ID NO: 58484 - DNA, 201 bp, Homo sapiens
tgaggacaagttaggaggctgaggattcggaataggttgaggtgagagacggcaggggatgaggtaggaaggacgcggggagggtttaggctgaggtgacrctgaaagatgtaagcatcacaaagatttgtcttaggcacgaagacccctccagactctggtctgttcccaagcctacaggatctcttccaggctcggcct

SEQ ID NO: 58485 - DNA, 201 bp, Homo sapiens
ggatgggtagatgggtgcatggatggatgaatacatggatggatgaatacatggatggatgggtgaatgggtggatggtgaggtggatggatggatggatrgatgggtggatggatgaatgaatacatggatggttggatagatggatgggtagatgagtggatggatggatgagtacatggatggatggatgggtagatg

SEQ ID NO: 58486 - DNA, 201 bp, Homo sapiens
ggatggatggatggatggatggatgggtagatgggtgcatggatggatgaatacatggatggatgaatacatggatggatgggtgaatgggtggatggtgrggtggatggatggatggatagatgggtggatggatgaatgaatacatggatggttggatagatggatgggtagatgagtggatggatggatgagtacatg

SEQ ID NO: 58487 - DNA, 201 bp, Homo sapiens
ggtggggtggatggatggatggatggatggatggatggatgggtagatgggtgcatggatggatgaatacatggatggatgaatacatggatggatgggtraatgggtggatggtgaggtggatggatggatggatagatgggtggatggatgaatgaatacatggatggttggatagatggatgggtagatgagtggatg

SEQ ID NO: 58488 - DNA, 201 bp, Homo sapiens
gtagcagattattgctttaagtcccaaaacaacccattaagtgcagtctgattagtttacagagagggaaactgaggcatagagggagtatctctgttgaracaaaactgacaaatactccactcgttgactttaccatagtcatcttagtcaggtccctaatgggctgttactataaggctgtagcaaaaatcctttatt

SEQ ID NO: 58489 - DNA, 201 bp, Homo sapiens
caatggttccaggaccctctgcagataccaaaatccaaagatgctcaagttcctgatataaaatggtaaagtatttgcatataacctatgcacatccttcyggatactttacttatttatttatttatttatttatttatttatttatttatttatttactgaggtagggtctcactctgtgtcccaggctggagtgcagt

SEQ ID NO: 58490 - DNA, 201 bp, Homo sapiens
ctggatggtcgaggggcggtggcttacgccggtaatcccagccctttgggaggccgaggccagcagatcacttaaggtcaggcatttgagaccagcctggmcaacatggtgaaaccccatctctactacaaatacaaaaattagctgggtgtggtggtgcatgtctgtaatcccagctactcaggaggctgaggcaggaga

SEQ ID NO: 58491 - DNA, 201 bp, Homo sapiens
tgcctcctgcctggaatgtttgttttccacacggtccaactcctattcgtccttcaaaactcagctcaaaagttccctcctccagcaagacttctctgccyccttctggccatgcccttgtttacaactgtcccttctccctggtctgacactgcggggttggggtagatgtgtcaaggtatctgggggctcttggggagg

SEQ ID NO: 58492 - DNA, 201 bp, Homo sapiens
gagaattcctacactgaactgcctcctgaacaacccctcagtgggcaagaaggagtgcttattgagtgactgactggactgactgaatgaatgaatgcagwttttctgtggttaacacacacacacacacacacacgcacacacacaagtatatatatatatatatttgtgtttttttgttttttgtttttgagacaaaag

SEQ ID NO: 58493 - DNA, 201 bp, Homo sapiens
ggctcatgtctgtaatcccagcactttgggaggctgaggtgggtggatcatctgaggtcaggagtttgagaccagcctgggcaacatggtgaaaccgcgtytctactaaaactacaaaaattaagggggcgtaatggggcacgcctgtaatccccgctactcggggggctgaggcaggagaatcacttgaacctgggaggc

SEQ ID NO: 58494 - DNA, 201 bp, Homo sapiens
tttccctgatagttctaaacaaacaaacaaacaaaaaaagaattggctggacacagtggctcatgcctataatcccagcactttgggagcccgaggtgggyggatcacccccaagagacaggcacttttgtaaattgcttaccagaattgattaccctctggcaagcaatttacaaaagtgcccgtctcttcacagccttg

SEQ ID NO: 58495 - DNA, 201 bp, Homo sapiens
acgatttccctgatagttctaaacaaacaaacaaacaaaaaaagaattggctggacacagtggctcatgcctataatcccagcactttgggagcccgaggygggcggatcacccccaagagacaggcacttttgtaaattgcttaccagaattgattaccctctggcaagcaatttacaaaagtgcccgtctcttcacagc

SEQ ID NO: 58496 - DNA, 201 bp, Homo sapiens
aatttatgtctctccttgggtcaggttccttgaaatagatctaaaaactaagtacgatttccctgatagttctaaacaaacaaacaaacaaaaaaagaatkggctggacacagtggctcatgcctataatcccagcactttgggagcccgaggtgggcggatcacccccaagagacaggcacttttgtaaattgcttacca

SEQ ID NO: 58497 - DNA, 201 bp, Homo sapiens
accatgtcgcccaggctggtcttgaactcctgagctcaggtgatggtgagccacctgcctcagcctcccaaagtgctgggattccaggaatgagccaccgygcccggccatattgtcggaacatttatgctcctaatgcaccctgaaaagggtctgaacactaagcagacacgctgtccattcttttgtttgataacgatt

SEQ ID NO: 58498 - DNA, 201 bp, Homo sapiens
tgtcacactctgggtggaatcctgggccaggaaccagacagagaagtctcctgaggtgaccctgcagctctacaactcaggttagcaccttgttctccccmcgtccgttttttacccagagaggccatcaggctgcaaggctggagctagagaggattcctggcccttggcaagggacttgatactactagccattgtcac

SEQ ID NO: 58499 - DNA, 201 bp, Homo sapiens
tggatggatgggtagatgggtggatggtggggtggatggatgatggatgaatacatggatggatggatggatggatggatggatggatgggtgaatggatraattcatgggtggatggatgggtagatggtggacggatgaataaatacatggatggatgggtagatgggcagataaatacatgggcagatggatggatgg

SEQ ID NO: 58500 - DNA, 201 bp, Homo sapiens
gcctgatcacagctcactgccacctccaccttccaggttcaagctattctccagcctcagccttccaagtagctgggattacaggtgttagccaccacacscggctaatttttgtatttttagtagagaccaggtttcaccatgtcgcccaggctggtcttgaactcctgagctcaggtgatggtgagccacctgcctcag

SEQ ID NO: 58501 - DNA, 201 bp, Homo sapiens
ggtagatgcgtggatggatggatgaatacatggatggataaatacatggatggatgggtaaatgggtggatggtggggtggatggatggatggatggatgsatggatggatgggtagatgggtgcatggatggatgaatacatggatggatgaatacatggatggatgggtgaatgggtggatggtgaggtggatggatgg

SEQ ID NO: 58502 - DNA, 201 bp, Homo sapiens
tgcatggattaatacatggattgatggatggatggatggatggatggatggatggatagatggatggggggtggatggatggatggatgaatacgtggatrgatggacggatggtggggtggatggatggatgtatgaatacgtggatggatggatggtggggcagatggatggatgagtagatggatgaatgaacacatg

SEQ ID NO: 58503 - DNA, 201 bp, Homo sapiens
gcgatctgcccaccttggcctcccaaagtgatgggattacaggcgtgagtcactgcgcccggccattcctccttttttaagatacattcacacaccatacrattcaccctcttaaagtgtacagttgacactgagcgtggtggctcatgcctgcaatcccagcattttgagaagccgaggcaggaggatcacttgagccca

SEQ ID NO: 58504 - DNA, 201 bp, Homo sapiens
tatatatatttttaagagatggggtcttgctgtgttggccagggtggtcttgaactcctgggctcaaatgatcctcctgtcttggcctcccaaagtgcttygagtacaggcgtgggcccctgtgcctggccatggatatgttaaattccttactgtagtaatcatttcactatggatatgtatatcaaaccatcatacctc

SEQ ID NO: 58505 - DNA, 201 bp, Homo sapiens
tggagtgcagtggcgtgatctcggctcactgcaaccccacctcctgggttcaagcaattcttctgcctcagcctctggagtagctgggactgcaggcaccyaccaccaagcatgcatggctaatttttgtatttttgctagggacggagtttcaccatgttggccaggctggtctcaaactcctgacctcaggcgatctgc

SEQ ID NO: 58506 - DNA, 201 bp, Homo sapiens
ctcccgaatagctggaattacaggcacatgtcaccaggcctggcaaatttttgtatttttagtagagacagggtttcgccttgttggccaggctggtctcraactcctgacctcaggtgatccgcccacctcggcctcccaaagtgttggaattacagatgtgaaccactgcacccagcccagcattatgtttttgagggt

SEQ ID NO: 58507 - DNA, 201 bp, Homo sapiens
tctcagctcactgcaacctctacctcccaggttcaagtaattctctctgcctcagcctcccgaatagctggaattacaggcacatgtcaccaggcctggcraatttttgtatttttagtagagacagggtttcgccttgttggccaggctggtctcaaactcctgacctcaggtgatccgcccacctcggcctcccaaagt

SEQ ID NO: 58508 - DNA, 201 bp, Homo sapiens
ctctgcccctcccccaggcctcacacatccatcccccagctgaccctggcctgggccccggggccagagaaggctgtcctgtatggggtcacagggcccccgtccccactgtgccaggcccaggacactgagtctttgtccctaactcactgacctcatagcctgctgggcgcctgaccctggccagctcagctgcccctc

SEQ ID NO: 58509 - DNA, 201 bp, Homo sapiens
ggtttcaccatgtttgccaggctggtctcaaactcctgacctcaggcgatccacccacctcagcctcccaaagtgctaggattacaggcatgagccactgygcccggcctaacatctatatattcttcaaaatccacttcaaattctctttgagaagtatcagaggaccttgtattgaatgaacaaatacattttattctt

SEQ ID NO: 58510 - DNA, 201 bp, Homo sapiens
agtggctctgaatatcagcgtcggaaccaacgggaccaccatgtattggccagcccgggctcagagcatgacgtattgcattgaatggcagcctgtgggcyaggacgggggccttgccacctgcagcctgactgcgccgcaagacccggatccggctggaatgggtaatggcctggaatggcctgcgcctacccctcctct

SEQ ID NO: 58511 - DNA, 201 bp, Homo sapiens
aacccaggaggcagaggttgcagtgagccgagattgcagcactgcattccagcctgtgtggcagagcaagactctatctcaataataataataataaataractttccttctctgtacactggggatcagcggggtgctgactttttcaatggctcttgagatgcactgagtgcctgtagaatgcccacagcagtgctggc

SEQ ID NO: 58512 - DNA, 201 bp, Homo sapiens
tccttgctcagcttcaatgtgttccggagtggggacggggtggctgaacctcgcaggtggcagagaggctcccctggggctgtggggctctacgtggatcygatggagccgctggtgacctgggtggtccccctcctcttcctcttcctgctgtccaggcagggcggtgagtcccctgaccctggcatggcggctcctctt

SEQ ID NO: 58513 - DNA, 201 bp, Homo sapiens
accaccaccacggagctgacttcctgggtttctctttcactttgacttgccttagggatgggctgtgacactttactttttttcttttttcttttttttcwgtcttttctccttgctcagcttcaatgtgttccggagtggggacggggtggctgaacctcgcaggtggcagagaggctcccctggggctgtggggctcta

SEQ ID NO: 58514 - DNA, 201 bp, Homo sapiens
tcttttttctgagacggagtttggctcttgttgctggagtgcaatggcgcgatcttggctcacggcaacctcccgggttcaagcgattctcctgcctcagyctcccaagtagctgggattacaggcgcccgccaccctgaccagctaaaatgtgtttgtatttttagtagaaacagggtttcaccatgttggccaggctcg

SEQ ID NO: 58515 - DNA, 201 bp, Homo sapiens
cccctctgtgcctcagttttctcatttggaaaatggcccagtgacatagggtccctggaggaatcaatgagtagcaagctcagagcctggtgctgggggaracttggatggatgggagtcaagacaatgatcaagacgtgaataataaccaccagttgaaagttgcttccaaaagacaaaaagatgtgaatattttgtttg

SEQ ID NO: 58516 - DNA, 201 bp, Homo sapiens
gcctctccagggcaccttcacccccaaatcagtctcaccatctctgcatctgtccccgctcccaaccagcccccactctagcccctgaggtggtttttttytttttctttttttttttctgagacggagccttgctctgtcgcccaggctggagtgcagtggcatgatctcagctcactgcaacctctgcctcccgggttc

SEQ ID NO: 58517 - DNA, 201 bp, Homo sapiens
cagggcaccttcacccccaaatcagtctcaccatctctgcatctgtccccgctcccaaccagcccccactctagcccctgaggtggtttttttctttttcyttttttttttctgagacggagccttgctctgtcgcccaggctggagtgcagtggcatgatctcagctcactgcaacctctgcctcccgggttcaagcgat

SEQ ID NO: 58518 - DNA, 201 bp, Homo sapiens
gcgggactgcccccccaccaacaccacgctgctcgccaatcccgccccgccccctcctttccgcccaagtcccccactcttgcctctggcctcagcgcctycagttctgccccacccccgcgcggccagagaccgggtgtctctgatctgcagctcagcccgtgccttccctgaccactcccgacctggcttcccatcacc

SEQ ID NO: 58519 - DNA, 201 bp, Homo sapiens
gtggaggttgcagtgagccgagattgcgccactggactccagcctgggtaacagagcatgattctttctcaaaaaaaaaaaaaagagagagagagagagawccttctgcctcagcctccttgagtagctgggactacagtcatgagccaccacacctggtacacttagactttcattccatgctccttcctggcttcctgc

SEQ ID NO: 58520 - DNA, 201 bp, Homo sapiens
ctcaaactcctgggctcaagagatccttcttggctgggcgcggtggctcacgcctgtaattctagcactttgggaggccgaggtgggcggatcacctgagrtcaggagtttgataccagcctggccaacatggcgaaaccccgtctctactaaaaatacaaaaattagccgggcgtggtgacatgtgcctgtaatcccagc

SEQ ID NO: 58521 - DNA, 201 bp, Homo sapiens
tatttttatttttgagatagggtctcgtgatcatggctcactatagcctcaaactcctgggctcaagagatccttcttggctgggcgcggtggctcacgcytgtaattctagcactttgggaggccgaggtgggcggatcacctgagatcaggagtttgataccagcctggccaacatggcgaaaccccgtctctactaaa

SEQ ID NO: 58522 - DNA, 201 bp, Homo sapiens
ctgattggctggggtgctcctggaccattaacaaggtttccagtcaaaagagaccccaaactggggctgatgaagacaacaccttcacgtgccagattggytagaatttctctggcttcctggtgggtacttccctctttgggcctcagtttcttcctttgaaaagtggaactaataatagcactgaccactcgggctgtt

SEQ ID NO: 58523 - DNA, 201 bp, Homo sapiens
ggagtgcagtggcctgatcacagctcactgccacctccaccttccaggttcaagctattctccagcctcagccttccaagtagctgggattacaggtgttmgccaccacacgcggctaatttttgtatttttagtagagaccaggtttcaccatgtcgcccaggctggtcttgaactcctgagctcaggtgatggtgagcc

SEQ ID NO: 58524 - DNA, 201 bp, Homo sapiens
gcctgggcaagaagagcgaaagagtgaaactccgtttcaaaaaaaaaaggccaggcgcagtggctaacacctgtaatctcagcactttgagaggccgaggygggaggatcacgaagtcagcagatggagaccatcctggctaacacggtgaaagcccgtctctgctaaaaatacaaaaaattagccgggtgtggtggcagg

SEQ ID NO: 58525 - DNA, 201 bp, Homo sapiens
tggagtgcagtggcctgatcacagctcactgccacctccaccttccaggttcaagctattctccagcctcagccttccaagtagctgggattacaggtgtyagccaccacacgcggctaatttttgtatttttagtagagaccaggtttcaccatgtcgcccaggctggtcttgaactcctgagctcaggtgatggtgagc

SEQ ID NO: 58526 - DNA, 201 bp, Homo sapiens
gtcctaggttcccagtctggctcccccactcctgcactgtgtgacccgacaagtgacttaacccctctgtgcctcagttttctcatttggaaaatggcccrgtgacatagggtccctggaggaatcaatgagtagcaagctcagagcctggtgctgggggagacttggatggatgggagtcaagacaatgatcaagacgtg

SEQ ID NO: 58527 - DNA, 201 bp, Homo sapiens
ttggagtgcagtggcctgatcacagctcactgccacctccaccttccaggttcaagctattctccagcctcagccttccaagtagctgggattacaggtgytagccaccacacgcggctaatttttgtatttttagtagagaccaggtttcaccatgtcgcccaggctggtcttgaactcctgagctcaggtgatggtgag

SEQ ID NO: 58528 - DNA, 201 bp, Homo sapiens
ctcacggcgtttagttcaagcagtcatggtgatggaaccatcaccaccatcaccgtggccattagggtctccttcttccccttccaatagttgtgggaatwttttttttttttttttttttttttttttttttgagacagcgtctggctatgtcgcccagactggaatgcagtggtgcaatcttggctcactgcaacctcc

SEQ ID NO: 58529 - DNA, 201 bp, Homo sapiens
cctgtaattccagctactcgggaggctgaggcaggagaattgcttgaacccgggaggcagaagttgcagtgagtggagatcatgccaccacactccagccygggcgacagagcagggctccatctcaaaaaaaaaaaaaaaaattggctagagagggccagagacctggccaagtgcatggaaccacaggtggcccatggg

SEQ ID NO: 58530 - DNA, 201 bp, Homo sapiens
tgaatacatggatggatgggtgaatgggtggatggtgggatggatggatggatggatggatggattaatacatggatggatggatgaatggacgaatggayggataaatgggtggatggtggggtggatgcatggattaatacatggattgatggatggatggatggatggatggatggatggatagatggatggggggtg

SEQ ID NO: 58531 - DNA, 201 bp, Homo sapiens
agcctgctgggcgcctgaccctggccagctcagctgcccctcggagccaggcttcttgaaggagggacctcctcccaggaagctgaaccgcattgcacaamcctggccacttgggcctcagtttccacagatgctcatccccaggagagaccctctccttctccctcctcagtgcccctggactctaagaatatttctttt

SEQ ID NO: 58532 - DNA, 201 bp, Homo sapiens
acacacacacacacacacacacgcacacacacaagtatatatatatatatatttgtgtttttttgttttttgtttttgagacaaaagtccagctctgttgsccaggctgaagtgcagtggagcaatctcggctcactgcaacctccgcctcctggattcaagcaattctcctgcgctcagcctcccgagtagctggaatta

SEQ ID NO: 58533 - DNA, 201 bp, Homo sapiens
tcctgtatggggtcacagggcccccgtccccactgtgccaggcccaggacactgagtctttgtccctaactcactgacctcatagcctgctgggcgcctgrccctggccagctcagctgcccctcggagccaggcttcttgaaggagggacctcctcccaggaagctgaaccgcattgcacaaacctggccacttgggcct

SEQ ID NO: 58534 - DNA, 201 bp, Homo sapiens
tcctgagtagctgggattacagacacccgccaccactcccagctaatttttgcatttttagtagagacgggggtttcaccatgttggccaggctggtctcraactcctgacctttaagtgatccatccaccttggcctcccgaaaggctgggattgcaggtgtgagctaccgccccctgcctttgtggatatattttggtt

SEQ ID NO: 58535 - DNA, 201 bp, Homo sapiens
ggaacatgggggaaagactaagttgcatctcttaaatttttttttttttttttttaagagacaggatcttgctctgttacccagactggagtgcagtggcrcaatcacgattcactgcagcctcaacctcctgggttcaagccattctcccacctcagcctcctgagtagctgagaatacagatgtgtgccaccacgactg

SEQ ID NO: 58536 - DNA, 201 bp, Homo sapiens
ccccagcccatcaccccacagaaacccagacccactgtgtccatcttggtggtccccaaagcacctcctctggacttttgcctctgctgtggcctctgccrgagatgccctgtaattctatacattctagctcaagtgtccctcctccaggcagtcctccctgctccacttcagggcacccggcctccatctgttcctgat

SEQ ID NO: 58537 - DNA, 201 bp, Homo sapiens
ccaggctgatctcaaaatcttgggctcaagcgatcctcctgccttggcttcccaacgtgctgggattacaggcatgagccactgcgcccagcaactctatrttttaaatttgtaaaagacaaccaggctgttttccaaagcaaacacccagttaaatttaaatttccataaacaatgaatgttttttcagtgtaagtatgc

SEQ ID NO: 58538 - DNA, 201 bp, Homo sapiens
ctccctagtagctgggactacaggtgcccaccaccacaccaggctgattttttgtatttttggtagagatgaggtctcaccatgttggccaggcttgtctygaactcctggcctcaggtgattcacccaccttagcctcccaaagttctgggattgcaggccaaagagttttggtgttttgcctggccaaaacactaaaac

SEQ ID NO: 58539 - DNA, 201 bp, Homo sapiens
actcagctactgtctgcctctgtacatttgcctattttggatattttatataagtggaatcatacagtgtgtgcctttcctgtccatcttcgtccacccakcatgatgggtttttttttttgtgtatgtgtgtttttttttttttgagatggagtctcactctgtcacccaggctggagtgcagtggcacgatctcagctc

SEQ ID NO: 58540 - DNA, 201 bp, Homo sapiens
cttcattccgtttcatgaccaaataatattccattgtatatatgtacatgtacattttgttgatccactcatttgttggtggtcacttggattttttcacrttttggtagctattctgaatagagctgctataaacattggcatacaactttttgcatagatttatttctttatttatttattttgagatgaagtgttgct

SEQ ID NO: 58541 - DNA, 201 bp, Homo sapiens
gggttcaaacctgcagggaaggcacacagcgggtgtctaaggcccagagaggtgttgctgcttactcaatgtcatacagaggtagggacagggtgaggttyggagcctctcacccatatgggtctggaacctcttgctggcatcctgagctcagttccaggcagatcacacacatacaggtaatgaatctcacatcccaag

SEQ ID NO: 58542 - DNA, 201 bp, Homo sapiens
aacataaaattaatgaaaacatttatgatgaacaaaacatcaaaacttttattttttattttatttttagagacggggatctcactatgttgcccaggctsgtcttgaactcctggcctcaaaagatccttctgcctaggcctcccaaagtgttgggattacaggtgtcagccaccgcatatggccaaaacaccaaaactt

SEQ ID NO: 58543 - DNA, 201 bp, Homo sapiens
ccccgtctctacttaaaatacaaaaattagctggatgtggtggcaggcgcctgtagtcccagctactcggtaggccgaggcaggagaatcccttgaacccsggaggcggaggttgcagtgagccaagaccacaccattgtactccagcctgggtgacagaatgagactccgtctcaaaaaaaaaaaaaaaaaaggtggccg

SEQ ID NO: 58544 - DNA, 201 bp, Homo sapiens
ccacaaggggtggtttgaatccatctcttcatctccagctggggcctcaggtggtctgagtgcccctggactcagtttcccaatctgtgaaataaggcaartgagggactctccaggaattggtggagttgggagggtctcaggatggtcaggagggggccatgactttcctctgatctctacctatttcctccacctttc

SEQ ID NO: 58545 - DNA, 201 bp, Homo sapiens
tctcagacgagcttctggggcagctgggtggggccataaggggcccacagggcctcttggcaggcctagagacggagggaaggaggtgggcttgccaagaygtggcaaggggaaggtgggatgtggggaacttcagagggagtgtcaggttgtgacttcaataaggggagaaataccacttcacctttgtctggggtaccc

SEQ ID NO: 58546 - DNA, 201 bp, Homo sapiens
ccctcgtgactcgatccttcctgcttcacccgcccccgagtctgtggggcacctgaaagtggggcagccctgggaacttatctcagacgagcttctggggmagctgggtggggccataaggggcccacagggcctcttggcaggcctagagacggagggaaggaggtgggcttgccaagatgtggcaaggggaaggtggga

SEQ ID NO: 58547 - DNA, 201 bp, Homo sapiens
cctacactgaactgcctcctgaacaacccctcagtgggcaagaaggagtgcttattgagtgactgactggactgactgaatgaatgaatgcagtttttctrtggttaacacacacacacacacacacacgcacacacacaagtatatatatatatatatttgtgtttttttgttttttgtttttgagacaaaagtccagct

SEQ ID NO: 58548 - DNA, 201 bp, Homo sapiens
ataatattccattgtatatatgtacatgtacattttgttgatccactcatttgttggtggtcacttggattttttcacgttttggtagctattctgaatasagctgctataaacattggcatacaactttttgcatagatttatttctttatttatttattttgagatgaagtgttgctctgatgcccaggctggagtgca

SEQ ID NO: 58549 - DNA, 201 bp, Homo sapiens
gactacaggcatgagccactgtgcctggcttagcacctgcattttttctttccctgggactcgcactttctctgcagccgcagttgtcttcggctgccccrctgtacagtgtggacactggagtatgctttcaggctcgaggggaccctaggaagggtcactgggcctgactgtccatgaggtactgtagaattgcatcaa

SEQ ID NO: 58550 - DNA, 201 bp, Homo sapiens
gacgccatcggcccctacagccaattggagggggccggaagctgctgggctgccggatgacccagctgggagggcaaggtctcccgggagaggcggggaarggtcgcgggggtgtggcgttaccccaggcctgacttcagctgctctgcgctcagaaaaccaagctgtcacgatgggaggagaataatctacccctcgaag

SEQ ID NO: 58551 - DNA, 201 bp, Homo sapiens
ggctgcagttctccgaccaggctggggtgtctgtgctgtacactgtcacactctgggtggaatcctgggccaggaaccagacagagaagtctcctgaggtvaccctgcagctctacaactcaggttagcaccttgttctccccccgtccgttttttacccagagaggccatcaggctgcaaggctggagctagagaggatt

SEQ ID NO: 58552 - DNA, 201 bp, Homo sapiens
aagcagtcctcccatctcggcctcccaaaacgctggattacaggcatgagccactgtgcctggcctgaagatgtttttttaaagtggcagagagaggtgargcaaaatcggcagctccctgcaaaggctcccggggaagctggaccacacagaactctcctggcaccactcccggacccttcggtccccgcaccatctgct

SEQ ID NO: 58553 - DNA, 201 bp, Homo sapiens
tctgcctcagcctcccaagtaagctgggattacaggcgcccaccaccacgcttggctgattttgtatttttagtagagataggatttcaccatgttggtcwggctggtcttgacctcctgacctcaagcagtcctcccatctcggcctcccaaaacgctggattacaggcatgagccactgtgcctggcctgaagatgttt

SEQ ID NO: 58554 - DNA, 201 bp, Homo sapiens
aacttcccaagaccacagcctagtggaagagatagacaacaggcaaacaaatgtctatcacaaatgtgatgatgtgttttgaagaaccagaggaggaaagytggggccctggggaccccccaaaaaaaaacaccagaggagggtgagggatagagagagaggtggcaggacatctggcctctgtgaggacaagttaggagg

SEQ ID NO: 58555 - DNA, 201 bp, Homo sapiens
aattagctggatgtggtggcaggcgcctgtagtcccagctactcggtaggccgaggcaggagaatcccttgaaccccggaggcggaggttgcagtgagccragaccacaccattgtactccagcctgggtgacagaatgagactccgtctcaaaaaaaaaaaaaaaaaaggtggccgggcgcagtggctcatgcctgtaat

SEQ ID NO: 58556 - DNA, 201 bp, Homo sapiens
ccaattggagggggccggaagctgctgggctgccggatgacccagctgggagggcaaggtctcccgggagaggcggggaagggtcgcgggggtgtggcgtyaccccaggcctgacttcagctgctctgcgctcagaaaaccaagctgtcacgatgggaggagaataatctacccctcgaaggtctctctgactgcttgaat

SEQ ID NO: 58557 - DNA, 201 bp, Homo sapiens
gtgatcctccagcctcagcctcaggctcaagccttgttgccaaggttttgccatgttgcccaggctggtctcgaactgctgagctcaaatgatccacctgmcttggcctcccaaagtgctgggattacaggcatgagccactgcacccggcctcagttccctgtttgatgaagccactttgagtccttcttctgtccctag

SEQ ID NO: 58558 - DNA, 201 bp, Homo sapiens
tttttttttttaatttatgagacgagtctctctgttgcccagactagaatgcagtggcatgatctcggcaacccctgcctcctgggttcaagctattctcrtgcctcagcctccctagtagctgggactacaggtgcccaccaccacaccaggctgattttttgtatttttggtagagatgaggtctcaccatgttggcca

SEQ ID NO: 58559 - DNA, 201 bp, Homo sapiens
acaccaaaactttttttttttttttttaatttatgagacgagtctctctgttgcccagactagaatgcagtggcatgatctcggcaacccctgcctcctgrgttcaagctattctcatgcctcagcctccctagtagctgggactacaggtgcccaccaccacaccaggctgattttttgtatttttggtagagatgaggt

SEQ ID NO: 58560 - DNA, 201 bp, Homo sapiens
ttgagctcaggagttcgaggccagcctggccaacatggtgaaaccccgtctctactaaaaatacaaaaattagccaggtttggtggcacatgcctgtagtytcagctacttgggaggctgagggctgaggtgggagaatcacctgagcctggggaggtcaaggttgcagtgagctgagatcgcgccactgcactccagcct

SEQ ID NO: 58561 - DNA, 201 bp, Homo sapiens
tgaatcctccctctttctgcccacactgccccacctccctcgcgttctgcagccgcctccccctgatccccactgcggtctgagccgaggtgtgggggggsgctcctgaaatcccaccccagccctggcgattagcgggtagtccagattctccccatggccaccaggtggcaacagcggcgcgcgtttccccggccgggc

SEQ ID NO: 58562 - DNA, 201 bp, Homo sapiens; identical to SEQ ID NO: 11160

SEQ ID NO: 58563 - DNA, 201 bp, Homo sapiens
ctgggcgcggtggctcacgcctgtaattctagcactttgggaggccgaggtgggcggatcacctgagatcaggagtttgataccagcctggccaacatggygaaaccccgtctctactaaaaatacaaaaattagccgggcgtggtgacatgtgcctgtaatcccagctactcgggaggctgaggcagggagaattacttg

SEQ ID NO: 58564 - DNA, 201 bp, Homo sapiens
ctggacaattcttacggcctgatgttcgacctgcctctccccagagtcctgcctctgccccctggagatgaatgtggcccaggaattccagctccgacgayggcagctggggagccaaggaagttcctggagcaagtggagcagccccgtgtgcgttccccctggtaagatcactctgagtacaggaacaggggcaagcat

SEQ ID NO: 58565 - DNA, 201 bp, Homo sapiens
ttttttttttgagacagcgtctggctatgtcgcccagactggaatgcagtggtgcaatcttggctcactgcaacctccgcctccagagtagctgggattgkgggcatgtgccaccacacccggctaatttttgtattttttatagagatgaggtttcaccatgttgcccaggctggtcttgaactcctggtctcaagtgat

SEQ ID NO: 58566 - DNA, 201 bp, Homo sapiens
gtggcctttctgtctgttcttttgtgaaagaaactcagatgtttttgaaacgcatcctcattatagtgtgtgtcagggtttcgttctttttgatggctgartagcattccattgtgtggatgtgtcactatttatttatccactcagccatcaatggacatttcggtggtttccattttctggctattgtggatagcgcag

SEQ ID NO: 58567 - DNA, 201 bp, Homo sapiens
cctctccttctccctcctcagtgcccctggactctaagaatatttcttttttctgtagatgcatctcacgtaacctaaaattcatctttttttttttttttgagacatagtctcactctctcacccaggtgggagtgcagtggtgtgatctcggctcactgcaacctctgcctcccgggttcaagcgattctcctgcctca

SEQ ID NO: 58568 - DNA, 201 bp, Homo sapiens
caccactcagccttgtttgcctccctttaatcctggccctggtgccaataaaactttacttacaaaagcaggtagccgctgcagttgtcagtttcttttttgaggatgattgcctttttgccctaagtgtctcataaacaccatctctcacagatatttgaagataattgttctactccattttgcaggaggggaaactga

SEQ ID NO: 58569 - DNA, 201 bp, Homo sapiens
ctggaacccagagaacaaaagagtcagggttggtggggggcaggcaggcctgggtccaggggcagccacatgtgccctatgtgcaggctcctggaattacrgagtctttttttatctttttgagacagattttccctcttattgccgaggctggaatgcaatgatgcgatctcggctcactgcaacctccgcctcccgagt

SEQ ID NO: 58570 - DNA, 201 bp, Homo sapiens
acagagtgagactctgtctcagaaaaaacaaaaacgaaaacaaacaaacaaaaaacaaaaacaagagaattagacttgagggtcttttttttttttttttwaattttatagacagggactcactctgtgcccaggctggagtgcagtggtgccatcatagctcacagcagcctcaacctcctgggctcaagcgatcctccc

SEQ ID NO: 58571 - DNA, 201 bp, Homo sapiens
cactgacctcatagcctgctgggcgcctgaccctggccagctcagctgcccctcggagccaggcttcttgaaggagggacctcctcccaggaagctgaacmgcattgcacaaacctggccacttgggcctcagtttccacagatgctcatccccaggagagaccctctccttctccctcctcagtgcccctggactctaag

SEQ ID NO: 58572 - DNA, 201 bp, Homo sapiens
tgtttttagtagagacggtgtttcaccatgttggccaggatggtctcgatctcctgacctcgtgatccgcctgccccgtcctcccaaagtgctgggattayaggcgtgagccaccgcgcctggcgggctagggttttattcttgggttgtggggtcctggagctggagagtcaggtcctgacgggtgagaggttcagagtt

SEQ ID NO: 58573 - DNA, 201 bp, Homo sapiens
gacagagtgagaccctgtctcaaaaaaaaaaaaaaaaaaagtacaattcagtggtttttgtacaatcacaaggttgtgcagccatcactcatacctaattstagaacattttcatctccccaaaaagaaaaccttgtgccatcagtagccactccccgttcccctcccccagcccctggcagccactaatctgcttcctgt

SEQ ID NO: 58574 - DNA, 201 bp, Homo sapiens
cccaagaggttgaggctgcagtgaaccgtaattgcaccactgcactccagcctgagtgacagagtgagaccctgtctcaaaaaaaaaaaaaaaaaaagtayaattcagtggtttttgtacaatcacaaggttgtgcagccatcactcatacctaattctagaacattttcatctccccaaaaagaaaaccttgtgccatca

SEQ ID NO: 58575 - DNA, 201 bp, Homo sapiens
ccatgcccggctaatctttttctgtttttagtagagacggtgtttcaccatgttggccaggatggtctcgatctcctgacctcgtgatccgcctgccccgkcctcccaaagtgctgggattataggcgtgagccaccgcgcctggcgggctagggttttattcttgggttgtggggtcctggagctggagagtcaggtcct

SEQ ID NO: 58576 - DNA, 201 bp, Homo sapiens
agaggggccagaagagggagtgcaaaggccctgaggttgctggtggggaatggacgggggatgggggaagaggttgtagcccacgtgaggctgggggcatrtggaccagagctgttttttttcttttgagatggggtctcgttctgtcgcccaggctggagtgcagtggcgtgaccacagcgcactgcagcctcgacctct

SEQ ID NO: 58577 - DNA, 201 bp, Homo sapiens
ccaccatgcccggctaatctttttctgtttttagtagagacggtgtttcaccatgttggccaggatggtctcgatctcctgacctcgtgatccgcctgccycgtcctcccaaagtgctgggattataggcgtgagccaccgcgcctggcgggctagggttttattcttgggttgtggggtcctggagctggagagtcaggt

SEQ ID NO: 58578 - DNA, 201 bp, Homo sapiens
ggcgcccgccaccatgcccggctaatctttttctgtttttagtagagacggtgtttcaccatgttggccaggatggtctcgatctcctgacctcgtgatcygcctgccccgtcctcccaaagtgctgggattataggcgtgagccaccgcgcctggcgggctagggttttattcttgggttgtggggtcctggagctggag

SEQ ID NO: 58579 - DNA, 201 bp, Homo sapiens
tggagtgcagtggcgcgatctaggctcactgcaagctctgccttccgggttcacgccattctcctgcctcagcctcccgagtagctaggactacaggcgcycgccaccatgcccggctaatctttttctgtttttagtagagacggtgtttcaccatgttggccaggatggtctcgatctcctgacctcgtgatccgcctg

SEQ ID NO: 58580 - DNA, 201 bp, Homo sapiens
caccatgcctggctaatttttgtatttttagtagagaaggggttttgccatgttggccaggctggtcttgaactcctggcctcaaatgacttacccacctyggcctcccaaagtgctgggattacaggtgcgagccactgtgccaggcctcgaccagcattcttggtgttgactatgacaatggtactggttgcagcctca

SEQ ID NO: 58581 - DNA, 201 bp, Homo sapiens
gatccttccacctcagcctctggagtagctgggactacagacatgcaccaccacacctggttaattttttatttttattttttgtagagacaggtgtctcyctacgttgcccaggctggtctcgaactcctgggctcaagtgatccacccatctccacctcccaaagtgctaggattacaggcgtgagccaccgtacccag

SEQ ID NO: 58582 - DNA, 201 bp, Homo sapiens
cgtctctactaaaaatacaaaaattagccaggtttggtggcacatgcctgtagtctcagctacttgggaggctgagggctgaggtgggagaatcacctgarcctggggaggtcaaggttgcagtgagctgagatcgcgccactgcactccagcctgggtgacaaggtgagaccctgtctcaaaaaaaaaaaaaaaaaagcc

SEQ ID NO: 58583 - DNA, 201 bp, Homo sapiens
agaattggctgggcgcagtggctcacgcctgtaatcccagcactttgggaggccaaggcgggcggatcacctgaggtcaggagttcaagaccagcctgacmaacttggagaaaccccgtctctcctaaaaatacaaaattagccgggcatggtggcacatgcctgtaattctagctacacgggaggctgaggcaggagaat

SEQ ID NO: 58584 - DNA, 201 bp, Homo sapiens
gcgcccaccatcatgcctggctaatttttgtagttttagtagaaacagggtttccccatgttcctcaggctagtctcgaactcctgaccttaagtgatctrcccaccttggcctcccaatatgctgggattgcaggcatgagccatcgtggctgggctttttttttttttaaagacagggtcttgctctgttgcccaggct

SEQ ID NO: 58585 - DNA, 201 bp, Homo sapiens; identical to SEQ ID NO: 11165

SEQ ID NO: 58586 - DNA, 201 bp, Homo sapiens
tcctggtcataaggggctcttagctgggtggggaaggcagacactaatctaattatcactcagagagttatgagaaaccgtaagagtgatgagtggggatrtgaggagtagccagtgagggagggcttcctggaggaggcaatgctaggaccaaggtggtaaagaggggccagaagagggagtgcaaaggccctgaggttg

SEQ ID NO: 58587 - DNA, 201 bp, Homo sapiens
gatactactagccattgtcacttcacgtagtgtcacgcaaacactattgtgacaaagcagtctttcatggtccccttaccaatcccctattcgtgggcacktagattgcttctggtttctctctgctagccataatgctgccaagacctggttgggttcttattatctgttctcatgactcgacatcatgtattttgccgg

SEQ ID NO: 58588 - DNA, 201 bp, Homo sapiens
tagccagtgagggagggcttcctggaggaggcaatgctaggaccaaggtggtaaagaggggccagaagagggagtgcaaaggccctgaggttgctggtggrgaatggacgggggatgggggaagaggttgtagcccacgtgaggctgggggcatatggaccagagctgttttttttcttttgagatggggtctcgttctgt

SEQ ID NO: 58589 - DNA, 201 bp, Homo sapiens
gcagacactaatctaattatcactcagagagttatgagaaaccgtaagagtgatgagtggggatgtgaggagtagccagtgagggagggcttcctggaggrggcaatgctaggaccaaggtggtaaagaggggccagaagagggagtgcaaaggccctgaggttgctggtggggaatggacgggggatgggggaagaggtt

SEQ ID NO: 58590 - DNA, 201 bp, Homo sapiens
ttagctgggtggggaaggcagacactaatctaattatcactcagagagttatgagaaaccgtaagagtgatgagtggggatgtgaggagtagccagtgagrgagggcttcctggaggaggcaatgctaggaccaaggtggtaaagaggggccagaagagggagtgcaaaggccctgaggttgctggtggggaatggacggg

SEQ ID NO: 58591 - DNA, 201 bp, Homo sapiens
attagcgggtagtccagattctccccatggccaccaggtggcaacagcggcgcgcgtttccccggccgggcccgccctgcctcctcccaccgcgtttgctmaacagacttttccggtttcagacagaggaggggagttaaaaagcccagaactactgaattttgtggcaaaaaaaggatgagacctctcggggagagaccc

SEQ ID NO: 58592 - DNA, 201 bp, Homo sapiens; identical to SEQ ID NO: 11173

SEQ ID NO: 58593 - DNA, 201 bp, Homo sapiens; identical to SEQ ID NO: 11174

SEQ ID NO: 58594 - DNA, 201 bp, Homo sapiens
gtcacatgaccattgctagagctgaggtggggtcactgcactgtcaaccacaccatctgtgaaaagagggagggaaatttcccaaagacagatgggagtgytcttcctaagaggggctgaatgggagtcagtgcggcagactccatcctcaaatcggtctcaggatatatggagtctcgctctgtcacccagcctggagtg

SEQ ID NO: 58595 - DNA, 201 bp, Homo sapiens
gtgtattggattcatccatgggaagctgcccctcacatgtagcagcagctgaactctcatcaagcagggatgactgtctccattccacagatgaggaaacyaaggcctggaggggggatctgatgagggacaggaaagcccacaaaacagggtttagccaggagggtttttggctttccccaggaaagagttcaagtgcat

SEQ ID NO: 58596 - DNA, 201 bp, Homo sapiens
gtgaccctgggcaccttgccgtccttctctgggccttggttatcaaacccttaaaacaagagaattggctgggcgcagtggctcacgcctgtaatcccagyactttgggaggccaaggcgggcggatcacctgaggtcaggagttcaagaccagcctgaccaacttggagaaaccccgtctctcctaaaaatacaaaatta

SEQ ID NO: 58597 - DNA, 201 bp, Homo sapiens
gtgggaacacaatctactgaatggcctggcctttgcttatccttccagcaacctacagctggagtcgagagtctggggcaatggggcaggaaaagtgttaytacattaccatctttgcctctgcgcaccccgagaagctcaccttgtggtctacggtcctgtccacctaccactttgggggcaatggtaagtgacccaaac

SEQ ID NO: 58598 - DNA, 201 bp, Homo sapiens; identical to SEQ ID NO: 11158

SEQ ID NO: 58599 - DNA, 201 bp, Homo sapiens
gctggaatgggtaatggcctggaatggcctgcgcctacccctcctctgtgccctcccttttaggtcctggtgggttcaaacctgcagggaaggcacacagygggtgtctaaggcccagagaggtgttgctgcttactcaatgtcatacagaggtagggacagggtgaggttcggagcctctcacccatatgggtctggaac

SEQ ID NO: 58600 - DNA, 201 bp, Homo sapiens
tgggcaacatagcaagaccccgtctctacagaaagaaaaaagtttgccagccatggtggcatgtgcctgtagtcccaactactcaggaggctgaggtggtmagatcacttgatcccaggagtttgaggctgcagtgagctatgattgcaccactgcaatcatacaacctctgcctcccgggttcaagccattctccttcct

SEQ ID NO: 58601 - DNA, 201 bp, Homo sapiens
cctcagcctcccaaatagctgggaatataggcatgtgccatcatacctggctattatgcattattaaagaacaacaacaaaaactagctgagccactgcgytccaccctggttgatagagctacactctttttcaaaaaagaaaaaagagagaaagaaagaaaaaaggctagagttgaccctgtgtttatttaagatctaa

SEQ ID NO: 58602 - DNA, 201 bp, Homo sapiens
ctgggcaacatagcaagaccccgtctctacagaaagaaaaaagtttgccagccatggtggcatgtgcctgtagtcccaactactcaggaggctgaggtggkaagatcacttgatcccaggagtttgaggctgcagtgagctatgattgcaccactgcaatcatacaacctctgcctcccgggttcaagccattctccttcc

SEQ ID NO: 58603 - DNA, 201 bp, Homo sapiens
ccactttgggggcaatggtaagtgacccaaacctgcaggtttacattattttttctttttaaataatttaaaaaaatagaggctgggcacagtgactcacrcatgtaatcccagcactttgggaggccaaggtgggtggatcacctgaggtcaggagtttgaaaccagcctggccaatgtggcgaaaccctgtctctacta

SEQ ID NO: 58604 - DNA, 201 bp, Homo sapiens
attccctaccaaatccctacaaccaccccctgaaaggaaccatgactgttgtactttacagatgtgatcgttgaggctcagagagggtgagtgactcgccygaggctacgtagcacacacaggagtcacatttggacccaaataacccagagctcctccaggctccagtgcacctgcctcctctctgccccgtgcctgttg

SEQ ID NO: 58605 - DNA, 201 bp, Homo sapiens
ggaggtcaggagttcgagaccagcctgggcaacacggtgaaaccccatctccaccaaaaaataataataaattagccaggaaatggtggcgcatgcctgtrgtcccagctactcaggaggctgaggcaggagactcatttgaacccgggaggctgaggttgcagggagccgagatcatgccactgcactccagcctgggcg

SEQ ID NO: 58606 - DNA, 201 bp, Homo sapiens
cgtgagccactgtacccgtgggctaggtttttttttttttttgagatggagtctcgctctgttgcccaggctggagtgcagtggcgcgatctaggctcacygcaagctctgccttccgggttcacgccattctcctgcctcagcctcccgagtagctaggactacaggcgcccgccaccatgcccggctaatctttttctg

SEQ ID NO: 58607 - DNA, 201 bp, Homo sapiens
gaagctctcatggtgaatatcctggcaaggagacagcagttaggctggaggaggactcagctcattcaaacaccacctgctgactggatgcggcggattaygcctgtaatcccagcactttgggaagccaaggcaggtggatcactggaggtcaggagttcgagaccagcctgggcaacacggtgaaaccccatctccacc

SEQ ID NO: 58608 - DNA, 201 bp, Homo sapiens
gagattgtgccactacactccagcctgggcgacagagcgagactccgtctcaaaaaataaataaataaataaataaataaataaatatttttttttatttwttgtttcttttttgagacagggtctcactctgttgcccaggctggagtgcagtagcaccatcttggctcactgcaacctccacttcctaggatcgagtga

SEQ ID NO: 58609 - DNA, 201 bp, Homo sapiens
agatggagtttcaccatgttgcccaggctggtctcaaactcctgccctcaggtgatccacccacctcagcctctcaaagtgctgggattacaggtgtgagycactgtggccgacctactatttttattatttttgagctaggttctcagtctgttggcagactggagtgcaatcatggctcactgcagccttgaactccca

SEQ ID NO: 58610 - DNA, 201 bp, Homo sapiens
gtgagccgagattgtgccactacactccagcctgggcgacagagcgagactccgtctcaaaaaataaataaataaataaataaataaataaatattttttwttattttttgtttcttttttgagacagggtctcactctgttgcccaggctggagtgcagtagcaccatcttggctcactgcaacctccacttcctaggat

SEQ ID NO: 58611 - DNA, 201 bp, Homo sapiens
gccaccatacccggctaattttgtatttttagtagagacggggtttcaccacgttggccaggctggtctcgaactcctgacctcaagtgatccacctgccwtggcctcccaaagtgttgggattataggcgtgagccaccatgcccagcctaatttttgtatttttagtagagatggagtttcaccatgttgcccaggctg

SEQ ID NO: 58612 - DNA, 201 bp, Homo sapiens
tttgagacaagcccggccaacatggtgaaaccccgtctctactaaaaatacaaaaattagctgggcgtggtggcaagcgcctataatcccagctacttggkaggctgaggcgggagaatcgcttgaacctggaagggggtggttgcagtgagccgagattgtgccactacactccagcctgggcgacagagcgagactccg

SEQ ID NO: 58613 - DNA, 201 bp, Homo sapiens
acttgggaggctgaggcaggagaatcgcttgaacccaggagccagaggttgcagtgagccaaaattgtgccattgcactccagcctgggcaacaaagagcragactgtgtcaaaaaaaaaaaattcaataatcaagatccataatgcagttttttgttgttgttggtttgttttttttaagagacagagttttgctatgtt

SEQ ID NO: 58614 - DNA, 201 bp, Homo sapiens
tctgagagaggagcctgcagggaggacagcagcaccgagatgaagcattagttcctggatccagccatacctgaaacccaatattttccatctggttcctstttttaaaaaatattttaggccgggcatggtggctcacgcctgtaatcccagcactttgggaggcagaggcgggctgatcacctgaggtcaggagtttga

SEQ ID NO: 58615 - DNA, 201 bp, Homo sapiens
acctactctgagcctcagctagaccagggtgagaggagcgaggcagaaaattttaaaggagtgcctgatttaggggtgtatcaaaaattcagtaatcagcyaggcacggtggctcacacctgtaatcccagcactttgggaggctaagacaggtgaatcacctgaggtcagcagttcgagaccagtctggccaacgtggtg

SEQ ID NO: 58616 - DNA, 201 bp, Homo sapiens
tcctcctttcttttttctgagacggagtttggctcttgttgctggagtgcaatggcgcgatcttggctcacggcaacctcccgggttcaagcgattctccygcctcagcctcccaagtagctgggattacaggcgcccgccaccctgaccagctaaaatgtgtttgtatttttagtagaaacagggtttcaccatgttggc

SEQ ID NO: 58617 - DNA, 201 bp, Homo sapiens
agagacggggtttcaccgtgttagccaggatggtctcaatctcctgacctcatgatctacccgtctcggcctcccaaagtgctgggattagaggcgtgagmccccgtgcccggcctctcaaattccttttctaaggaaaaattttctgcttgaggtaactgggttaaaagatggaaacatttttgttttcctgaatgtcag

SEQ ID NO: 58618 - DNA, 201 bp, Homo sapiens
aaatcatacaatatgtggcctttctgtctgttcttttgtgaaagaaactcagatgtttttgaaacgcatcctcattatagtgtgtgtcagggtttcgttcyttttgatggctgaatagcattccattgtgtggatgtgtcactatttatttatccactcagccatcaatggacatttcggtggtttccattttctggctat

SEQ ID NO: 58619 - DNA, 201 bp, Homo sapiens; identical to SEQ ID NO: 11176

SEQ ID NO: 58620 - DNA, 201 bp, Homo sapiens
gggcctcacctggagcccgcggcgccgcaggaggctcgactcgtccatggcccgggagtccgcgccgccaggcccgcccccggccccgccccggcctgccmggccccgccgccaggtgccattggccaggccggtcagctgacacggcctggccccgcccctcccggggagcccgaccacagggccccgcccccactgggc

SEQ ID NO: 58621 - DNA, 201 bp, Homo sapiens
cacctgtaatcccagcactttgggaggccgaggtgggcagatcacgaggtcaggagatcgagaccatcctggctaacacagtgaaaccccgtctctactamaaatacaaaaaattagctgggcgtggtggcgggcgcctgtagtctcagctactcgggaggctgaggcaggagaatggtgtgaacccaggaggcagagctt

SEQ ID NO: 58622 - DNA, 201 bp, Homo sapiens
atttattgagcaactgctatgcaactattactccagggctcctcagagcagccattgcctcagcttctcccagcagctccaggagtcaggatggtgttagyccccatttcacagctcagtttcattcattcatttaagaaatcagggtccggcgcggtggctcacacctgtaatcccagcactttgggaggccaaggcggg

SEQ ID NO: 58623 - DNA, 201 bp, Homo sapiens
ttttttgagacaggatctcactctgtcacccaggctgcagtgcagtggcgtgatctcggatcactgcaacctctgcctcccgggttcaagcgatcatcctygtgcttcagcttcccaagtagctgggattacaggctcttgccaccatgcccggctaatttttgtatgtttactagagacagagtttcaccatgttggcca

SEQ ID NO: 58624 - DNA, 201 bp, Homo sapiens
cactgcagcctcgacctctcgggctcaactgttcctccttcctcagcctcctgtgcagctagaaccacaggcacgtgccaccacgctcagcttagtttatytgattatttgtagagacagagtctcaccatattgcctgggctgatctcaaactcctaggctcaagtgatcctcctgtcttggcctctcaatgtgctggga

SEQ ID NO: 58625 - DNA, 201 bp, Homo sapiens
ctgggggcatatggaccagagctgttttttttcttttgagatggggtctcgttctgtcgcccaggctggagtgcagtggcgtgaccacagcgcactgcagsctcgacctctcgggctcaactgttcctccttcctcagcctcctgtgcagctagaaccacaggcacgtgccaccacgctcagcttagtttatttgattatt

SEQ ID NO: 58626 - DNA, 201 bp, Homo sapiens
ttgcctcagcttctcccagcagctccaggagtcaggatggtgttagcccccatttcacagctcagtttcattcattcatttaagaaatcagggtccggcgyggtggctcacacctgtaatcccagcactttgggaggccaaggcgggccgatcgcttgagctcaggagttcgaggccagcctggccaacatggtgaaaccc

SEQ ID NO: 58627 - DNA, 201 bp, Homo sapiens
agccattgcctcagcttctcccagcagctccaggagtcaggatggtgttagcccccatttcacagctcagtttcattcattcatttaagaaatcagggtcyggcgcggtggctcacacctgtaatcccagcactttgggaggccaaggcgggccgatcgcttgagctcaggagttcgaggccagcctggccaacatggtga

SEQ ID NO: 58628 - DNA, 201 bp, Homo sapiens
gaggtggcaggacatctggcctctgtgaggacaagttaggaggctgaggattcggaataggttgaggtgagagacggcaggggatgaggtaggaaggacgyggggagggtttaggctgaggtgacgctgaaagatgtaagcatcacaaagatttgtcttaggcacgaagacccctccagactctggtctgttcccaagcct

SEQ ID NO: 58629 - DNA, 201 bp, Homo sapiens
gtttgatgaagccactttgagtccttcttctgtccctagaaaatgaccaacaggaggttctttctgggcctctgcttacccgtctataaaataggaagggrtttggagtccttttctcaatgggcccagcaagtttgcttagctgggccctggcctggtatttattgagcaactgctatgcaactattactccagggctcc

SEQ ID NO: 58630 - DNA, 201 bp, Homo sapiens
  misc_feature (1)...(201): n = A,T,C or G, or insertion/deletion polymorphism (see Tables 1-2)
tctggaacctcttgctggcatcctgagctcagttccaggcagatcacacacatacaggtaatgaatctcacatcccaaggtgtttgttaaatattcaaccncgccagggaaggtggcagttcgcgagatgctggtggcaaattaatgagcagtctttagggaaaggggggccgtgaggctcaggtggcctctcactctccc

SEQ ID NO: 58631 - DNA, 201 bp, Homo sapiens
tctgaatatcagcgtcggaaccaacgggaccaccatgtattggccagcccgggctcagagcatgacgtattgcattgaatggcagcctgtgggccaggacsggggccttgccacctgcagcctgactgcgccgcaagacccggatccggctggaatgggtaatggcctggaatggcctgcgcctacccctcctctgtgccc

SEQ ID NO: 58632 - DNA, 201 bp, Homo sapiens
gccagagaaggggactggggagagagatggcaactgtctcgatgcgtctctcccctctccttccagaaccagtggctctgaatatcagcgtcggaaccaaygggaccaccatgtattggccagcccgggctcagagcatgacgtattgcattgaatggcagcctgtgggccaggacgggggccttgccacctgcagcctga

SEQ ID NO: 58633 - DNA, 201 bp, Homo sapiens
tacttgaacccgggaggtggaggttgcagtgagccgagattgcgccactggactccagcctgggtaacagagcatgattctttctcaaaaaaaaaaaaaaragagagagagagagatccttctgcctcagcctccttgagtagctgggactacagtcatgagccaccacacctggtacacttagactttcattccatgctc

SEQ ID NO: 58634 - DNA, 201 bp, Homo sapiens
tgcgtctctcccctctccttccagaaccagtggctctgaatatcagcgtcggaaccaacgggaccaccatgtattggccagcccgggctcagagcatgacrtattgcattgaatggcagcctgtgggccaggacgggggccttgccacctgcagcctgactgcgccgcaagacccggatccggctggaatgggtaatggcc

SEQ ID NO: 58635 - DNA, 201 bp, Homo sapiens
tcgatgcgtctctcccctctccttccagaaccagtggctctgaatatcagcgtcggaaccaacgggaccaccatgtattggccagcccgggctcagagcaygacgtattgcattgaatggcagcctgtgggccaggacgggggccttgccacctgcagcctgactgcgccgcaagacccggatccggctggaatgggtaat

SEQ ID NO: 58636 - DNA, 201 bp, Homo sapiens
acaattcttacggcctgatgttcgacctgcctctccccagagtcctgcctctgccccctggagatgaatgtggcccaggaattccagctccgacgacggcrgctggggagccaaggaagttcctggagcaagtggagcagccccgtgtgcgttccccctggtaagatcactctgagtacaggaacaggggcaagcattaga

SEQ ID NO: 58637 - DNA, 201 bp, Homo sapiens
ctccaaagaaaaaacaaaaaaaaacaaacgccatctgctacccactttgtgcctggccccaaggcagcctccagtgcagggaaacagccaaacacagacayccctggccctgtagggtcaggggtatagacgagagggtgggagagaggctgcaggagccagagaaggggactggggagagagatggcaactgtctcgatg

SEQ ID NO: 58638 - DNA, 201 bp, Homo sapiens; identical to SEQ ID NO: 11175

SEQ ID NO: 58639 - DNA, 201 bp, Homo sapiens
aatggcctggaatggcctgcgcctacccctcctctgtgccctcccttttaggtcctggtgggttcaaacctgcagggaaggcacacagcgggtgtctaagkcccagagaggtgttgctgcttactcaatgtcatacagaggtagggacagggtgaggttcggagcctctcacccatatgggtctggaacctcttgctggca

SEQ ID NO: 58640 - DNA, 201 bp, Homo sapiens
cttttctttttttttttttttttttgagacaggatctcactctgtcacccaggctgcagtgcagtggcgtgatctcggatcactgcaacctctgcctcccrggttcaagcgatcatcctcgtgcttcagcttcccaagtagctgggattacaggctcttgccaccatgcccggctaatttttgtatgtttactagagacag

SEQ ID NO: 58641 - DNA, 201 bp, Homo sapiens
ctgaagtcaggagtttgagaccagcctggccaacaaggtgaaaccccatctctactaaaaatacaaaaattagccaggcatggtggtacacatctgtaatsccagctactcaggaggctgaggcaggagaatcccttgaaactgggaagcagaagttgcagtgagctgagatcgtgccactgtactccagcctgggtgaca

SEQ ID NO: 58642 - DNA, 201 bp, Homo sapiens
tgaggcaggagaatggcgtgaacccaggaggcagagtttgcagtgaaccgagatcgcgccactgcactctggcctgggcaaaagagcgagactccacctcaaaaaaaaaaaaaaatacaaaaggtagctgggtgtggtggcaggcacctgtaatcccagctacttgggaggctgaggcagcagaatcacttgaacccggcg

SEQ ID NO: 58643 - DNA, 201 bp, Homo sapiens
cagtggctcatgcctgtaatccccacactttagaggcagaggccgacggatgacttgaggtcaagagttcgagacctgcctggccaacatggtgaatcacygtctctactaaaaacacaaaaattagccaggtgtggtggcgcatgactgtaatcccagctactcagtaggctgaggcaggaggcggaggttgcagtgagc

SEQ ID NO: 58644 - DNA, 201 bp, Homo sapiens
gaggctgaggcaggagagtcgcttgaaccagggaggctgaggttgcagtgaactgagatcgcgccactgcactccagtctgggtgatagaatgagactccrtctcaaaaaaaaaaaaaccccacaaaataaatacagttaccatcacctcctcttccaggaagccctcctggctacctaggcatctcctctgactcctaca

SEQ ID NO: 58645 - DNA, 201 bp, Homo sapiens
gagagggtggatgggtatgtgtggggccccctctgtgtcttctgtgcccagcacagtgccagggacacagtagggaagcaataaactgctgggaggagagstgagtgctgtgggtccactcctgaggccagccaggggctcagcaaggcaccaatgcctcctcccaggagtgaaagatgctggaatcaccaggctcctcct

SEQ ID NO: 58646 - DNA, 201 bp, Homo sapiens
ccttctggaggctgtcaggactcagaatgtgatactccaaagtatggctccttggcaaaaactttgtggtttttgtttttagagacagggtcttgctctgycacccaggctggggtgcagtggtacaatgatagctcactgcagcctctacctcctgggctcaagcaatcctcccacctcagcctcccaagtagctgggac

SEQ ID NO: 58647 - DNA, 201 bp, Homo sapiens
tgggtaacagagccaaaccctgtctctaaaacaaacaaaaacagaaacaaaaagtacactacttactgtcctgcttctcaccattccagcctggtagtccttttttttttttttgagacagggtcttgctcagttgctcaggctggagtgcagaagcgtaatcacagctcactgcagccttgatctccaaaaagactacca

SEQ ID NO: 58648 - DNA, 201 bp, Homo sapiens
aatccggattaaatttcccttccctgggcacaagtgcctcatgagggcccggggctgctggttgggagggaaagcatccccgtttttgcagtgaggaggcyggccgagggctggggttccacttagacccttggcagaatggctgttgaggggcaggcgctgcccagtgcccacgtctggaaagctaattcccgggtggac

SEQ ID NO: 58649 - DNA, 201 bp, Homo sapiens
ggtggccgatgcctgtcatcccagcactttgggagaccaacgtcggaggatcacttgaggtcaggagttccagaccagcctgggcaacgtggtgagacccsgtctctacaaaaaaatttaaaaattagctggacaggggccaggcgcagtggcttacgcctgcaatcccatcactttgggaggccgaggcctggatgacag

SEQ ID NO: 58650 - DNA, 201 bp, Homo sapiens
cccacgcaccctgagccagcagcctcatcagcctcgaagcatttattgagcactgcctgtacatccacaggagggtgatgacaggattggcacagtgaccstcctgtccccttgttgggggtctctcctcttccccctctaggagctgagggagctgaggagcggcatgagggacagggagggggcggcagagcttcctgg

SEQ ID NO: 58651 - DNA, 201 bp, Homo sapiens
taatcctacctactcgggaggctgaggcaggaaaattgcttgaacctgggagatggaggttgcaatgagccgagatcgcgccactgcacgacagcctaggygacagagcaagactccatctcaaaaaaaaaagaaaaagaaaaaaagaagaaactctcattgatggagtgttcattgatggagcactttttgggagtgggt

SEQ ID NO: 58652 - DNA, 201 bp, Homo sapiens
ctaagattctaagtagggaatatgaatgatacacaaggaaataaaatagggtgcttcctattttaggcaggctggaaggaagaggaggagccagccatackgagattcaggagattcaaggggagaaatgcccttttttttttttttttttttttttttgagagggagtcttcctctgttgcccaggctggagtgcagtgg

SEQ ID NO: 58653 - DNA, 201 bp, Homo sapiens
aagtagctgtggactgggcacagtggctcacacctgtaatcccagcactttgggagaccaaggtgggcagatcacctgaagtcaggagtttgagaccagcytggccaacaaggtgaaaccccatctctactaaaaatacaaaaattagccaggcatggtggtacacatctgtaatcccagctactcaggaggctgaggcag

SEQ ID NO: 58654 - DNA, 201 bp, Homo sapiens; identical to SEQ ID NO: 11234

SEQ ID NO: 58655 - DNA, 201 bp, Homo sapiens
tgaagcaggagaattgcttgaacccgggaggcggagattgtagtgagttgagatcgcacaactgcactccagcctgggcaacagagcgagactccaatccaaaaaaaagaaaaaaatcccctaggacagggctgtggctgagaccctgagggctggaggcttggctggccttgcacagcagcgggtgcatgctggggtggg

SEQ ID NO: 58656 - DNA, 201 bp, Homo sapiens
cagcctctcgagtagctgggattacaggcatgtaatcccaccaccaagcccagctaattttgtatatttagtagagacagggtttctccatgttggtcagrctagtctagaactcttgacgtcagatgatccacgtgcctcggcctcccaaagtgctgggattacaggcgagagccaccgtgcccggcgcagaattctttt

SEQ ID NO: 58657 - DNA, 201 bp, Homo sapiens
aactcttgacgtcagatgatccacgtgcctcggcctcccaaagtgctgggattacaggcgagagccaccgtgcccggcgcagaattcttttttttagagaygaggtattgccatcttgcccagacttgtctcgaactcctgggctcaaacaatccacccacctcggcctcccaaagtgctgagattactgacataagccac

SEQ ID NO: 58658 - DNA, 201 bp, Homo sapiens
gagtaactgcaataacacccagtttatcaagtgcctcctatgtgtctggccctgtgctttacccctcatttgaccacctctccagtgagagtctcagtccyttttttcctggtgaggaaacaggcatggcagagaggcatgacacatcaaggttgcccttcctggctccatctagcccgttctcctctgcttcctttgttt

SEQ ID NO: 58659 - DNA, 201 bp, Homo sapiens
tgcaacctccaccgccccgattcaagccattcttctgcctcagcctcccgagtagctgggatcacaggcgccagccaccatgcccagctaatttttggtakttttagtagaagcgggcgtttcaccatattggccacatatcggccaggctggtcttgaactcctgacctcaagtgatccacctgcatcggcctcccaaag

SEQ ID NO: 58660 - DNA, 201 bp, Homo sapiens
cggtaggcctgtgggtgaccagcttccctatctgtcttcccacagtgcggctgggatccggcggccacctgcacctgcgtatctctcgggccgcccttccygaggggctccccgaggcctcccgccttcaccgggctctgttccggctgtccccgacggcgtcaaggtcgtgggacgtgacacgaccgctgcggcgtcagc

SEQ ID NO: 58661 - DNA, 201 bp, Homo sapiens; identical to SEQ ID NO: 11244

SEQ ID NO: 58662 - DNA, 201 bp, Homo sapiens
accccaaactgctccccctcccccaaattccctttctcctcctgctctttctccccgctgtgcctcccccagttacccacagaagtgcctgcctctccagygctcacagaacacacaaaaagggacaggaattggtcactgggtagtggccgtggctcctgacgatccagaccagcgtctggcccaagccattcagaggtg

SEQ ID NO: 58663 - DNA, 201 bp, Homo sapiens
actcaggaggctgaggcaggagaatcacttgaacccaggaggcggaggttgcagtgagctgagaccgcagcattgcactccagcctgggtgacagagtgasactcagtttcaaaaacaaacaaacaaacaacaacaacaaaaaaaaacagggatgggaggtggggagcaatttgggagtctcagatggagacttggtctta

SEQ ID NO: 58664 - DNA, 201 bp, Homo sapiens
ccccgtggctgtcccagtcattcaggaagtgtccactgtgggctgagccctggactggggacacagcaaggatcaggcagctgggagtacagcctggaggwccccccttgggatgagggctgcacaggcagttaaagggtccaaggatcatcccaggatatggctgagaggctgcaagaggctccatcccctagaggcccc

SEQ ID NO: 58665 - DNA, 201 bp, Homo sapiens
agcctctgtgagagggtggatgggtatgtgtggggccccctctgtgtcttctgtgcccagcacagtgccagggacacagtagggaagcaataaactgctgrgaggagaggtgagtgctgtgggtccactcctgaggccagccaggggctcagcaaggcaccaatgcctcctcccaggagtgaaagatgctggaatcaccag

SEQ ID NO: 58666 - DNA, 201 bp, Homo sapiens; identical to SEQ ID NO: 11235

SEQ ID NO: 58667 - DNA, 201 bp, Homo sapiens
gtgtcttgagggacagagtacccacttccagcagtgaggtgtatctgctgggaatgccatcacccacaggccaacctgaatgactgcaggttccccttaaygtattcagtgagtgcccactttatgccaggccccggacacagctgtaaaaagacacacaaggaccaccccactttgcggagcctggttgagtgaagggga

SEQ ID NO: 58668 - DNA, 201 bp, Homo sapiens; identical to SEQ ID NO: 11237

SEQ ID NO: 58669 - DNA, 201 bp, Homo sapiens
gtgtgtttgacaaaggcgttgataactgagagctggtagtggaggggggagattttgggagattggggccctgccaggtggacggactggcctgacctccrgcccctgtgctctgtttacttccatcccagctccacctctggggacccatggaagctgtcggtgaggaacacaggatccgacctgctgagctcatctctg

SEQ ID NO: 58670 - DNA, 201 bp, Homo sapiens
gacaaaggcgttgataactgagagctggtagtggaggggggagattttgggagattggggccctgccaggtggacggactggcctgacctccggcccctgygctctgtttacttccatcccagctccacctctggggacccatggaagctgtcggtgaggaacacaggatccgacctgctgagctcatctctggccacctg

SEQ ID NO: 58671 - DNA, 201 bp, Homo sapiens
caggcgcagtggcttacgcctgcaatcccatcactttgggaggccgaggcctggatgacagtgagagactctgtctaaaaaaaaaaggacaggtgcggtgsttcgcgcctgtaatcccaacactttgggaggccaaggcagatggatcacctgaggtcaggagttcgaaaccagcctggccaacatggtgaaaccccatct

SEQ ID NO: 58672 - DNA, 201 bp, Homo sapiens
acctgaggtcaggagttcgaaaccagcctggccaacatggtgaaaccccatctctactaaaaatacaaaaattagccaggtgtggtggcgcatgcctgtcrtcccagctacttgggaggctgaggcaggagaatcacttgaacccgggaggcagaggttgcagtgagccgagatcgtgccattgcactccaggctaggtga

SEQ ID NO: 58673 - DNA, 201 bp, Homo sapiens
gtgatactccaaagtatggctccttggcaaaaactttgtggtttttgtttttagagacagggtcttgctctgtcacccaggctggggtgcagtggtacaaygatagctcactgcagcctctacctcctgggctcaagcaatcctcccacctcagcctcccaagtagctgggactacaggcatgcgccaccacacctggcta

SEQ ID NO: 58674 - DNA, 201 bp, Homo sapiens
ggtgggcatggtggcgggcacctgtagtcccagctactcgggaggctgaggcaggagaatggcgtgaacccgggaggcggagcttgcagtgagctgagatygtgccacggcactccagcctgggcgacagagcgagaccctgtctcaaaaaaaaaataaaataaataaaataaataaataaataaataaacctgttcccca

SEQ ID NO: 58675 - DNA, 201 bp, Homo sapiens
aaaataaataaataaataaataaacctgttccccaaatatatatatgaaattaaaacatgcgtggtcatgatcaagttctaattacagacaaagacttccwtgagattggggagaacctgccttggactacggggaccacttcaactctcttgggaatgatttttctttaggtgggtgctggataggggtgtttgtgattt

SEQ ID NO: 58676 - DNA, 201 bp, Homo sapiens
ctctccagtgagagtctcagtcctttttttcctggtgaggaaacaggcatggcagagaggcatgacacatcaaggttgcccttcctggctccatctagccygttctcctctgcttcctttgtttttcaccatctttagcctttgaccccaaccaaaaagagaagagaggaaatcccatgggcatagacagccacctcttaa

SEQ ID NO: 58677 - DNA, 201 bp, Homo sapiens
taaataaataaataaacctgttccccaaatatatatatgaaattaaaacatgcgtggtcatgatcaagttctaattacagacaaagacttccttgagattrgggagaacctgccttggactacggggaccacttcaactctcttgggaatgatttttctttaggtgggtgctggataggggtgtttgtgattttattatta

SEQ ID NO: 58678 - DNA, 201 bp, Homo sapiens
ttgtctggaatttttcacatagtaacaatgtctttttttcctccaaaaagactcccaggctggaatggtgtcctcatatcgaggaagaggatactgaggcycagaaatgtgccctagctttactaggagcgcccccacctaaagatcctccccctaaatacacccccagaccccgcccagctgtggtcattggagtgttta

SEQ ID NO: 58679 - DNA, 201 bp, Homo sapiens
cctcaagcaatcctcctgctttggcctcccaaagtgctaggattacatgcctgagccactgtgttcagccagggtgtcccttttctgagactgcattcttyccaccttgcccaagtattgcaggagaaccacaggccccatgctgtgctggcgaaaatctcatctcatgctggcctgttagggtggccatatcctctcatt

SEQ ID NO: 58680 - DNA, 201 bp, Homo sapiens
gaggctgaggcaggagaatcgctggaacccgggaggcagaggctgcagtgagccaagattgcaccactgcactccagcctgagtgacagagcgaaactccrtctcagagaaaaaaaaaaaaaaaaaagatatgtccaagtcctaacgctcagtatctgtgaccttatttggaaagaaggtctttgcaaatgtaattaaact

SEQ ID NO: 58681 - DNA, 201 bp, Homo sapiens
taacgctcagtatctgtgaccttatttggaaagaaggtctttgcaaatgtaattaaactaaagatcttgtactgagatcattctgaattaagaatggaccygtggctgggcacagtggctcacacctgtaatcccagcactctgggaggctgaggtgggcagatcacctgagatcaggagttcaaaaccagcctggccaac

SEQ ID NO: 58682 - DNA, 201 bp, Homo sapiens
caaggaaataaaatagggtgcttcctattttaggcaggctggaaggaagaggaggagccagccatactgagattcaggagattcaaggggagaaatgcccytttttttttttttttttttttttttgagagggagtcttcctctgttgcccaggctggagtgcagtggcacgatcttggctcactgcaacctccaccgccc

SEQ ID NO: 58683 - DNA, 201 bp, Homo sapiens
gaaggggttctgggtggaggttaggacatcttaggctcagtgcccggggatcacgtactcctcttcatccattggggcctggcccagtgactgcaggttayagtagacaggctgggaagccaggtcgatgtccttgtagttgatgtaaaagtcattgtcctctgaagggtgagccctggggggacagacagaccaggggta

SEQ ID NO: 58684 - DNA, 201 bp, Homo sapiens; identical to SEQ ID NO: 11238

SEQ ID NO: 58685 - DNA, 201 bp, Homo sapiens; identical to SEQ ID NO: 11239

SEQ ID NO: 58686 - DNA, 201 bp, Homo sapiens
ggctgaggcaggaggcaggagaatcacttgaacccgggaggtgaaggttgcagtgagccgagatcatgccattgcactctagcctgggcgacagagcgggaaaaaaaaaaaggcaaaagggctactttgtgttaacagcatctatcagtcaattatactctagtacgaattgcccaccaacccctaagtggttgtaggggg

SEQ ID NO: 58687 - DNA, 201 bp, Homo sapiens; identical to SEQ ID NO: 11240

SEQ ID NO: 58688 - DNA, 201 bp, Homo sapiens; identical to SEQ ID NO: 11241

SEQ ID NO: 58689 - DNA, 201 bp, Homo sapiens
tgtcttgagggacagagtacccacttccagcagtgaggtgtatctgctgggaatgccatcacccacaggccaacctgaatgactgcaggttccccttaacrtattcagtgagtgcccactttatgccaggccccggacacagctgtaaaaagacacacaaggaccaccccactttgcggagcctggttgagtgaaggggac

SEQ ID NO: 58690 - DNA, 201 bp, Homo sapiens
caacctgaatgactgcaggttccccttaacgtattcagtgagtgcccactttatgccaggccccggacacagctgtaaaaagacacacaaggaccaccccmctttgcggagcctggttgagtgaaggggacaaatgagtaaatcctaagaaagtagttgattgcagtaagatttgtgctggggattcaacccatcagttca

SEQ ID NO: 58691 - DNA, 201 bp, Homo sapiens
ggcatgagggacagggagggggcggcagagcttcctggggcctcaaggacaatcctttcctgtccccattcttcagatggggaaactgaggccatggaggmgttaggacgccctgagtcacccagcagggactgaaggggttctgggtggaggttaggacatcttaggctcagtgcccggggatcacgtactcctcttcat

SEQ ID NO: 58692 - DNA, 201 bp, Homo sapiens
acgccctgagtcacccagcagggactgaaggggttctgggtggaggttaggacatcttaggctcagtgcccggggatcacgtactcctcttcatccattgrggcctggcccagtgactgcaggttacagtagacaggctgggaagccaggtcgatgtccttgtagttgatgtaaaagtcattgtcctctgaagggtgagcc

SEQ ID NO: 58693 - DNA, 201 bp, Homo sapiens; identical to SEQ ID NO: 11245

SEQ ID NO: 58694 - DNA, 201 bp, Homo sapiens
cctctgaagggtgagccctggggggacagacagaccaggggtaagtgtgggagggggaggactcaggggacaggcacatgagctttgagaaagtccagagygggccaggtgctctgactcacgcctgtaatccagcactttgggaggctgaggtgggtggatcacctgagatcatgagttcaagaccagcctggacaacat

SEQ ID NO: 58695 - DNA, 201 bp, Homo sapiens
cacatgagctttgagaaagtccagagtgggccaggtgctctgactcacgcctgtaatccagcactttgggaggctgaggtgggtggatcacctgagatcakgagttcaagaccagcctggacaacatgatgaaacctcgtctctactaaaaatacaaaaattatccaggcatggtggcacaggcctgtagtcccagctact

SEQ ID NO: 58696 - DNA, 201 bp, Homo sapiens; identical to SEQ ID NO: 11246

SEQ ID NO: 58697 - DNA, 201 bp, Homo sapiens
ggggtgcagggcactggatgaggtctgggctgtggtgggacccaggagggggcaggcagaggggcacactcttagcccgccctaaacccatctgtgccgtrtgactccggcaaacctctcacccttgctaagcctagcaactaggttaaggcaccctcaaaccccagtctccccagtctccctaacacttgtaccagcctg

SEQ ID NO: 58698 - DNA, 201 bp, Homo sapiens; identical to SEQ ID NO: 11236

SEQ ID NO: 58699 - DNA, 201 bp, Homo sapiens
agcctggcatgcagtaggtgcttcataaatacacactgtggacagtagaattatgatgggagcgagcgtgtgaactgggttgctaatgtggagcgtgaagrgggaggcccagggttactcggccaatgggttccgggcagcaagcacgtgggggaagcctcagctgaccacttcctggccagtttatgcaggaactcgcac

SEQ ID NO: 58700 - DNA, 201 bp, Homo sapiens
cccccgccctagaacttttgccagtgccttttctgaaactcctgtgtcccgggccccccaggcggagaaggatatgccggattctgcctggggctgggctytaggagaccccaaatttgacaccacagaaagcaaataaaacacttgaaatacgcatacatttcctgtgtgtccttttgtggggctggagttcagctgggt

SEQ ID NO: 58701 - DNA, 201 bp, Homo sapiens
tcccaggactgagggtacttgtctctagttctatctcccccaggttggaggattgggctgggaccagctgataggaaacccagttgaggcatgagcctgamaaaactcttgaaatacagacatctgtgagtcattaactctgcctgagaagaaaccagggacagcttctcaaaggaggtggcattgcaccagggtcttgaa

SEQ ID NO: 58702 - DNA, 201 bp, Homo sapiens
tttctaggaaaaaacccttccctgccaaaggtgactgtgttttctgccgccgaaggagggcccggtccctccaggctcagtgtggcttctccctgaccccygccctagaacttttgccagtgccttttctgaaactcctgtgtcccgggccccccaggcggagaaggatatgccggattctgcctggggctgggctctagg

SEQ ID NO: 58703 - DNA, 201 bp, Homo sapiens
aaaacaacaacaaaacccgcggacctttgttccaacacacagggaggttgaggaacttgcctgtggtaacacaggcactggggtttgagcgatgatctgcrtcaacctccagggcatacaaaatccccatcatggctgggcacggaggctcacgcctgtaatcccagcactttgggaggctgaggccggtggatcacctga

SEQ ID NO: 58704 - DNA, 201 bp, Homo sapiens
agggacagcttctcaaaggaggtggcattgcaccagggtcttgaaagattttctcagaatattagagctaaaggaatatatacatttttttattttggggktggtgtgggctgctctggaggccaagcctggagatcagggacctgggaaggggccctgagaggggcagaagggaggaatgtgcctgggcgcagtggccac

SEQ ID NO: 58705 - DNA, 201 bp, Homo sapiens
ttattttgggggtggtgtgggctgctctggaggccaagcctggagatcagggacctgggaaggggccctgagaggggcagaagggaggaatgtgcctgggygcagtggccacgcctgtaatcccagcacttcaggaggccgaggcgggcagatcgcttgaggtcaggagttcgagaccagcctggccaacatggcgaaacc

SEQ ID NO: 58706 - DNA, 201 bp, Homo sapiens
ttttgggggtggtgtgggctgctctggaggccaagcctggagatcagggacctgggaaggggccctgagaggggcagaagggaggaatgtgcctgggcgcrgtggccacgcctgtaatcccagcacttcaggaggccgaggcgggcagatcgcttgaggtcaggagttcgagaccagcctggccaacatggcgaaacccca

SEQ ID NO: 58707 - DNA, 201 bp, Homo sapiens
agtgaaccgagatcgcgccactgcactctggcctgggcaaaagagcgagactccacctcaaaaaaaaaaaaaaatacaaaaggtagctgggtgtggtggcrggcacctgtaatcccagctacttgggaggctgaggcagcagaatcacttgaacccggcgggtggaggtttccgtgagctgagatcacgccactgcactcc

SEQ ID NO: 58708 - DNA, 201 bp, Homo sapiens
gatcagggacctgggaaggggccctgagaggggcagaagggaggaatgtgcctgggcgcagtggccacgcctgtaatcccagcacttcaggaggccgaggygggcagatcgcttgaggtcaggagttcgagaccagcctggccaacatggcgaaaccccatctctattataaatacaaaaattagctcggcatggtggcgg

SEQ ID NO: 58709 - DNA, 201 bp, Homo sapiens
gctctctgagaataaacttttgacaccaaagggacttggacaacagttaggaagatgtcctggagcaagtggaccccgtgggttgggggaacttcttggastcacagaggactgagggttcttgcacccccagtggaggtattcatatctgggtggtctttcccatagggtcgactcttattattgttatttaatgtagag

SEQ ID NO: 58710 - DNA, 201 bp, Homo sapiens
cgagatcgtgccattgcacttcagcctgggagacagagcaagactctatctcagaaggaaaaaaaaaaagaaagcttcagagtggctcagtccaccccgartatttacatatggggaaactggcacgggctagcgttctgactcctagccaaccccacctctctctgaggaggctgcgggagggcagtgatttagggaagg

SEQ ID NO: 58711 - DNA, 201 bp, Homo sapiens
gattacaggcacccacgaccatgcccggctaatttttgtatttttagtagagacagggtttcaccatattggccaggctggtctcgaactcctgacctcgkgatcctcctgccttggcctcccaaagtgttgggattacaggcatgagccaccgtgcccggcctaatttttgtattttttagtagaaacagggttccacca

SEQ ID NO: 58712 - DNA, 201 bp, Homo sapiens
aaagtaaaaataaatcttataaagtagctgtggactgggcacagtggctcacacctgtaatcccagcactttgggagaccaaggtgggcagatcacctgargtcaggagtttgagaccagcctggccaacaaggtgaaaccccatctctactaaaaatacaaaaattagccaggcatggtggtacacatctgtaatcccag

SEQ ID NO: 58713 - DNA, 201 bp, Homo sapiens
gcctaatttttgtattttttagtagaaacagggttccaccatgttggtcaggctggtcttgaggtcctgaccacaggtgatctgacctcgccttggcctcraaaagtgctgggattataggcatgagccaccgcaccccacaccaacctagaaaagttcaactcatttgtctaagcccagcaaaatcatccagaagccggt

SEQ ID NO: 58714 - DNA, 201 bp, Homo sapiens
ccttccctgtatggtgctgataagggcgtggggaggcagagacaggcagagatagacatgatgagagacaggcagaaatggagggagagccagggagagakagacacaaagagaaaaagtggaaattctccagatattttgtttagggtgaggacacggagacacagagagggacttagccagctgaggatgacgatttgg

SEQ ID NO: 58715 - DNA, 201 bp, Homo sapiens
cccaggcggagaaggatatgccggattctgcctggggctgggctctaggagaccccaaatttgacaccacagaaagcaaataaaacacttgaaatacgcawacatttcctgtgtgtccttttgtggggctggagttcagctgggtgcccggggatagaggggaccccgtgtcactgggtttctattctcggtggtgctggg

SEQ ID NO: 58716 - DNA, 201 bp, Homo sapiens
gctgaggcaggagaatcgcttgaacccgggaggcggaggtcacagtgagccaagatcgcaccactgcactccagcctgggcaacagtgtgagactcagtcycaaaaaacaacaacaaaacccgcggacctttgttccaacacacagggaggttgaggaacttgcctgtggtaacacaggcactggggtttgagcgatgatc

SEQ ID NO: 58717 - DNA, 201 bp, Homo sapiens
ggggccttgctgtgtgaccccctagtgagtccttgtgtctcttacccacgcatgcctgtcacatgcagacacccacacacacccagtatctgccggacagrgcagcccttcctctccgcagccaggaagctggacataggcacaagggctgacgcctggggccaggaatcctgcctgagcattaggagaaggtctggaacc

SEQ ID NO: 58718 - DNA, 201 bp, Homo sapiens
gcagtatagcgagaatccatctctaccaaaaatgtttaaaaaaaattagccagacatgatggtgtgtgcctgtagtctcagttattcaggaggctgaggcrggaggagcacttgaatccaggagattgaggctgcactgagccatgagtgccccactgcactccagcctgggtaacagcaagaccataataaataaataaa

SEQ ID NO: 58719 - DNA, 201 bp, Homo sapiens
catgttggtcaggctggtcttgagctcctgacctcaggggatccacctgcctcagcctcccaaagtgctaggattacaggcgtgagccaccgcgcccagcsaagacagttattttaaagtatttgtctagtgagtctgatgtgtgggcttccttagggatggtttctgtctgttaattttgttccttaaaatgcgccacac

SEQ ID NO: 58720 - DNA, 201 bp, Homo sapiens
cctcttccccctctaggagctgagggagctgaggagcggcatgagggacagggagggggcggcagagcttcctggggcctcaaggacaatcctttcctgtmcccattcttcagatggggaaactgaggccatggaggagttaggacgccctgagtcacccagcagggactgaaggggttctgggtggaggttaggacatct

SEQ ID NO: 58721 - DNA, 201 bp, Homo sapiens
gctgggaagccaggtcgatgtccttgtagttgatgtaaaagtcattgtcctctgaagggtgagccctggggggacagacagaccaggggtaagtgtgggasggggaggactcaggggacaggcacatgagctttgagaaagtccagagtgggccaggtgctctgactcacgcctgtaatccagcactttgggaggctgagg

SEQ ID NO: 58722 - DNA, 201 bp, Homo sapiens
cccacacacacccagtatctgccggacagggcagcccttcctctccgcagccaggaagctggacataggcacaagggctgacgcctggggccaggaatccygcctgagcattaggagaaggtctggaaccccagggggaagggcactcctggggcatcccctgcccctctaccatctggtggctggactctacaccagcct

SEQ ID NO: 58723 - DNA, 201 bp, Homo sapiens
aggtgactgtgttttctgccgccgaaggagggcccggtccctccaggctcagtgtggcttctccctgacccccgccctagaacttttgccagtgccttttytgaaactcctgtgtcccgggccccccaggcggagaaggatatgccggattctgcctggggctgggctctaggagaccccaaatttgacaccacagaaagc

SEQ ID NO: 58724 - DNA, 201 bp, Homo sapiens
caccgccccgattcaagccattcttctgcctcagcctcccgagtagctgggatcacaggcgccagccaccatgcccagctaatttttggtatttttagtaraagcgggcgtttcaccatattggccacatatcggccaggctggtcttgaactcctgacctcaagtgatccacctgcatcggcctcccaaagtgctgggat

SEQ ID NO: 58725 - DNA, 201 bp, Homo sapiens
taaaaattcaaaaattagctgggcatggtggtgcatgcctgtaatcccagctactcgggaggctaaggcaggagaatcgtttgaacccaggaggtggagaytgcagtgagtcgagatggcgccattgcactccagcctgggcaacaagagtaaatctccatctcacaaaaaaaaaaaaaaaaaaaaagcaaggcacagtgg

SEQ ID NO: 58726 - DNA, 201 bp, Homo sapiens
agagcaccagttagacaaggagagccaggaggagctgggccccaacctcatccaaaagcacaggtgagctctgagacctccacccccaggacagcccccaygtctattttctttttctttaaagatgttcttatttgggggccaggcgtggtggctcatgcctgtaatcccagcactttgggaggccgaggcaggcggatc

SEQ ID NO: 58727 - DNA, 201 bp, Homo sapiens
cctgtgactccactgggggccttgctgtgtgaccccctagtgagtccttgtgtctcttacccacgcatgcctgtcacatgcagacacccacacacacccastatctgccggacagggcagcccttcctctccgcagccaggaagctggacataggcacaagggctgacgcctggggccaggaatcctgcctgagcattagg

SEQ ID NO: 58728 - DNA, 201 bp, Homo sapiens
tcctagggccacccaatgaggagataggagggaacctcaaatccatttccaggaggaggagtttggggccatataaatgtatatatacaaatatatatatwttttttaagatggagtcagccggccgtggtggctcacgcctctaatcccaatactttgggaggccgaggccggcggatcacaaggtcaggagattgagac

SEQ ID NO: 58729 - DNA, 201 bp, Homo sapiens
agtagagacagggtttcatcatgttggtcaggctggtctcgaactcctgacctcaggtgatccgcccgccttggcctcccaaagtgctgggattacaggcrtgagccactgcacctggccaggggctagagttttaatttttaaggattttggagtgggctgaagtgtggaggtcattgcttggtgaaagagtgcaggagg

SEQ ID NO: 58730 - DNA, 201 bp, Homo sapiens
acatttgagctgagacctggaggaagaaaaggagtcggggagggggtagttgagggtggacattgcaagtaaatgcaaacagcaagtgcaaaggccctgakatgggagcaggctcacttcagtcacagcaaagctgttgaaaatgggcacctaggaggcttcaaaattaaactcaataccaaaaggcagcagatggtgtca

SEQ ID NO: 58731 - DNA, 201 bp, Homo sapiens
agcaaattgctatattaagtttaatggttcactgattttttataatcagtcaattaatagttgtttattgaacatttttgtgttggaaactgctaagcttycttgagacagcaagaggagtcagcctggtccctgatttcaggaaaattattacctagctggggagttaagacaggaatatagaaagaaaaaaatcagaaa

SEQ ID NO: 58732 - DNA, 201 bp, Homo sapiens
agtgtcctatttatcattgcatctttgggatccacaaaatgcctgtatatatgaggcacttgcttgtgagcctgaattgaattggacaatttaattttttwaaaaagcaatgtttgtaaacaataaagaattaaaaccaaaatacatttaaatgtcaaccaactgaaatagatctatagatctaactcatttcacttgatc

SEQ ID NO: 58733 - DNA, 201 bp, Homo sapiens
aataaaatagaacaaaacaaaactgtgcatcagttctgatgtaaatttgaagtaatttttcatctatgtctgagaaacctgttacctcagacagggttagyagacatatgtgttttattctgattattaagaaagttgtaagcaccacctcaaaggctataaatgtgtggtttaagagtatacatctaaatataattttgt

SEQ ID NO: 58734 - DNA, 201 bp, Homo sapiens
aaaggtacttgtaggctcccaaacctacacggtgaaaagctagagagcatgggctctcttcaggggttaacttcaggaagtgccactaacaaggacgtccrctaggtggtgagcaaggaaagacggaggtgaaggaaccgaaacgagtcaagtccactgcttagctctactgaagttttgcaaacatcataaatatgtctg

SEQ ID NO: 58735 - DNA, 201 bp, Homo sapiens
attcccaaccatgtctcttactagttatgtgactaaggcaactttctttttttaaactttttttaaattatactttaatttctgggatacatgagcagaaygtgcaggtttgttacataggtatacatgtgccatggtggtttgctgcattcatcaacctgtcatctacattaggtatttctcctaatgctgttcctcccc

SEQ ID NO: 58736 - DNA, 201 bp, Homo sapiens
tccatttacactggcaattacaaaaatattatttatcagtccctaattgcgtgccactctgatcttatctttcatttaaatttgagaatagtgggtgctargtaagttttctaaccaatccagaaagacaaagtgtgtgaggggggtggggattgttgatatgcaagaacttcattagctatgtataacctgagagcactg

SEQ ID NO: 58737 - DNA, 201 bp, Homo sapiens
tgttcaaattcccaaccatgtctcttactagttatgtgactaaggcaactttctttttttaaactttttttaaattatactttaatttctgggatacatgwgcagaacgtgcaggtttgttacataggtatacatgtgccatggtggtttgctgcattcatcaacctgtcatctacattaggtatttctcctaatgctgtt

SEQ ID NO: 58738 - DNA, 201 bp, Homo sapiens
ccctgtccatttacactggcaattacaaaaatattatttatcagtccctaattgcgtgccactctgatcttatctttcatttaaatttgagaatagtgggygctaggtaagttttctaaccaatccagaaagacaaagtgtgtgaggggggtggggattgttgatatgcaagaacttcattagctatgtataacctgagag

SEQ ID NO: 58739 - DNA, 201 bp, Homo sapiens
tatgctttccaaccatccgtcactggagaggaaaagagaaggaggactgccttgagaagttaacatctgctgcccagattatcactccctttaccttaagrcatgagtgtgtctcagctttaaagtgtgagcaacccactagcctgcagcaggccttgggtgtatggtgccacatttggccaaactcacctggaagaacca

SEQ ID NO: 58740 - DNA, 201 bp, Homo sapiens
acttagaaaaaagtaagtctagatacttctttcagggtatagtgggagcactggcactttcacaagtctccctggctccacgtttttccccattttaccaygtcttccaagttcctgccataagttcagcttaatgatcaagagcatggatttggaactgattggcctctgttcaaattcccaaccatgtctcttactagt

SEQ ID NO: 58741 - DNA, 201 bp, Homo sapiens
aaaaaaattagtcgagggttggggcatgtgcctgtagtcttagctacatgggaggctgagggagaaggggcactagaccctaggattccttgagtgcaatragctatgatcgcaccactgcactctagcctgagtgacagagcagcattcccatctcttagagaaagagagagagagattgagagaattagaggagaggac

SEQ ID NO: 58742 - DNA, 201 bp, Homo sapiens
atttttgctaatgccttttctctattttctattttcaggcaagaaatccaagagaaggtaagttttattagtggcgaggagtttccacatctgctgattcrttctctacttccttaagttacttcctgctctagctagacacattaaccccatagtagtttatttacctggggtcctcatccaaatgaccagataaggtga

SEQ ID NO: 58743 - DNA, 201 bp, Homo sapiens
gaaataattgcatgcagaaatgattgaggtcaggtcatcatttaaccttctcactcattaaaaacaagtaatttcaagagtttcaaggtatgccactaagyttcctataagtgttacagaatattagtattggtaatttcattccaaaagcaaataaatgcctatgactatatgcttagtgtattttatacgtaaaaattt

SEQ ID NO: 58744 - DNA, 201 bp, Homo sapiens
cctcaattataaaggaataatgttaattaagaaatctctgttaaggtacttacaatctgtaccaaatatttagcacctcattttctattttttattcatarttcagtgtacattaatgtcatttctacaattacaatacgagcttattaagggacgggggtttatcattttttggtccttctcccattgttgtgacaaatt

SEQ ID NO: 58745 - DNA, 201 bp, Homo sapiens; identical to SEQ ID NO: 11254

SEQ ID NO: 58746 - DNA, 201 bp, Homo sapiens
cgtggagatctatatcaagagaaacaaagatgcaggcaaatggaacgatgacgcctgccacaaactaaaggcagccctctgttacacaggtagggagtgasaagacggctatgctgcctcagactcaggaagggccacggttaagagaatactcagatttaccccatggaaaggtggggggatgagaacagcttctggttc

SEQ ID NO: 58747 - DNA, 201 bp, Homo sapiens
tggcatggcagggtctaaaatgtgaaaactttgatttccaagtcttaaatttacctattgtaccaccaatcagaacagggaaatagatacagtttctggakagggttgtcaaaatcaaaagagttaaaattctggaactgagctagaatagaagacagaattgaggtcaaaatgcttcctagacttttatattctctcctt

SEQ ID NO: 58748 - DNA, 201 bp, Homo sapiens
ccctcaattataaaggaataatgttaattaagaaatctctgttaaggtacttacaatctgtaccaaatatttagcacctcattttctattttttattcatmgttcagtgtacattaatgtcatttctacaattacaatacgagcttattaagggacgggggtttatcattttttggtccttctcccattgttgtgacaaat

SEQ ID NO: 58749 - DNA, 201 bp, Homo sapiens
ttcatctatgtctgagaaacctgttacctcagacagggttagtagacatatgtgttttattctgattattaagaaagttgtaagcaccacctcaaaggctrtaaatgtgtggtttaagagtatacatctaaatataattttgtatttcatttgcagatatttccatggaaatgtcagagcacccagagggacttatggaac

SEQ ID NO: 58750 - DNA, 201 bp, Homo sapiens
ggagcaggaggaaaaagaagaggaagaagaacagcaacaacaatgagtgaaggaggaggagggtaaggaaagatgcataggagaatggaaggaaggatagmaaggagggaaggaagagagaatctagtcacattactttctgatcagcagttcatttttgtctcagtgggaggcaatagaggccagtctaggaaaggggtg

SEQ ID NO: 58751 - DNA, 201 bp, Homo sapiens
cgtccactaggtggtgagcaaggaaagacggaggtgaaggaaccgaaacgagtcaagtccactgcttagctctactgaagttttgcaaacatcataaataygtctgaaatgcagttttgatttgtagtatttgcaatttccaagggccatttaccacaggtagccaagagttagtttagcatttatgaaaaagatagggga

SEQ ID NO: 58752 - DNA, 201 bp, Homo sapiens
gtttgccgtattttattgagtattttcgcaatgatgttcatcagggatattggcctgaaattttctttttttgttgtgtctctgccaggttttagtatcasgatgatgctggcctcataaaatgagtgagggaggagttcctctttttctattctctggaatagtttcagaaggaatggtaccagcacctctttgtacctc

SEQ ID NO: 58753 - DNA, 201 bp, Homo sapiens
cctgacatttctatcttcttatattaataagaaaaataaaacgaaatagtggtaaagtgttggggcagtgaaaatttttgggggtggtgtggagagataaygggcgatgtttctcagggctgcttcgagcaggattaggggtggcgtgagaacctagagtgggagagattaagctgaaggaagattttgtggtaaggggtg

SEQ ID NO: 58754 - DNA, 201 bp, Homo sapiens
cattcagtatgctattggctgtgggtttgtcataaatagctcttattattttgagatacgttccatcaatacctagtttattgagagtttttagcatgaargggtgttgaattttatccaaggccttttctgcatctattgagataatcacgtggtttttgtgattggttctgtttacgtaatggattctgtttattgatt

SEQ ID NO: 58755 - DNA, 201 bp, Homo sapiens
ttgacttcctctcttctatttgaatacactttatttctttctcttgcctgattgccctggccagaacttccaatactatgttgaacaggagtggtgagagrggcatacttgtcttgtgccagtttttaaagggaacgctttcagtttttgcccattcagtatgctattggctgtgggtttgtcataaatagctcttattat

SEQ ID NO: 58756 - DNA, 201 bp, Homo sapiens
catgtcatctgcaaacagacacaatttgacttcctctcttctatttgaatacactttatttctttctcttgcctgattgccctggccagaacttccaataytatgttgaacaggagtggtgagagaggcatacttgtcttgtgccagtttttaaagggaacgctttcagtttttgcccattcagtatgctattggctgtgg

SEQ ID NO: 58757 - DNA, 201 bp, Homo sapiens
tttattctctttgtagcaatcgtgaatgggagttcactcatgatttggctctctgtttgtctattattgctgtataggaattcttgtgattttttcacatkgattttgtaacctgagactttgctgaagttgctgatcagtttaaggagattttgggctgagacaatgggattttctaaatatacaatcatgtcatctgca

SEQ ID NO: 58758 - DNA, 201 bp, Homo sapiens
tctgtaaaatcttctacaattccaaaacagccagcattttccaagtgatgttttaataatgaaccatagttaatttggtctcttataaattggactctacygttttagcaaatttggactttttaatctttgatttctataaagaaagggattgccaagaaataattgcatgcagaaatgattgaggtcaggtcatcattt

SEQ ID NO: 58759 - DNA, 201 bp, Homo sapiens
gctcacatcacctcagttttcacattgtgaagtagagagtgtggtgctgcgtgcttccttcttggtctaaccttatataattttatataaaaattgcactrtctttggtgtatgaatatttctgtaaaatcttctacaattccaaaacagccagcattttccaagtgatgttttaataatgaaccatagttaatttggtct

SEQ ID NO: 58760 - DNA, 201 bp, Homo sapiens
taccaaatatttagcacctcattttctattttttattcatagttcagtgtacattaatgtcatttctacaattacaatacgagcttattaagggacggggstttatcattttttggtccttctcccattgttgtgacaaattttatatctgattcttgaagactctccagcaatagctttgaacttggtttttcatttcct

SEQ ID NO: 58761 - DNA, 201 bp, Homo sapiens
gcttggccaatgtggtgaaaccccatctctactaaaaatacaaaaattagctgggtgtgctggcacgtgcctgtattcccagctactcaggaagttgaggyggaagaatcgcttgaacccaggaggccgtggttgcatgagctgcctccgtgccactgcactccggactgggcaacagagtgagactccatctcaaaaata

SEQ ID NO: 58762 - DNA, 201 bp, Homo sapiens
ttctattctctggaatagtttcagaaggaatggtaccagcacctctttgtacctctggtagaatttggctgtgaatccatctggtcctgggctttttttarttggtaggctattaattgctgccttaatttcagaacttgttattagtctattcagggatttgacttcttcctggtttagtcttgggagggtgtatgtgtc

SEQ ID NO: 58763 - DNA, 201 bp, Homo sapiens
tcttctatatgtttcatataaatggaatcagacaacatgtaaccttttgtatctggcttcttttggaacaggaattaaaagaaattaaataatgtgtaagyggaaactcagttgtatgtaacaaaacccaactccccctgagaaagagaaagagctggagccctttaaaaattaactgcctgtttttctgtggctagtgag

SEQ ID NO: 58764 - DNA, 201 bp, Homo sapiens
ggcaagacaatttggttgataaggcacagatcctgaactaacctgtaaggcatgtccagtttttggacaggtaaaatgggggaattgtaaggagagtttayaggctttaaaaggacatgttgtaacaggcaagtgataacaggctttaatccctttaaagcctgttgtgggatgggatactggcgttgacccaggtaaggg

SEQ ID NO: 58765 - DNA, 201 bp, Homo sapiens
atggaacgatgacgcctgccacaaactaaaggcagccctctgttacacaggtagggagtgacaagacggctatgctgcctcagactcaggaagggccacgsttaagagaatactcagatttaccccatggaaaggtggggggatgagaacagcttctggttcattctaaaatacatctagccctctatataatcttgcatc

SEQ ID NO: 58766 - DNA, 201 bp, Homo sapiens
agaaggtaatgtggagtgggtagcctctgcattgattaagaaggggacggacttaccctccactgtaagagttaccaaaagcatctgtgatggtccaggakgcttctgaggcgatcaggcagcatcagtcttcagccactaagccaagaagatctgggaaggagtcagtcagagagccttgggccagagttccaggggctc

SEQ ID NO: 58767 - DNA, 201 bp, Homo sapiens
agcctgttgtgggatgggatactggcgttgacccaggtaagggtgattaggttttaatgggatagtaatgagggtgtgatttgttgccagggagggagtakaggtgtcccatacctgtgggttaaggtagggggatatgagaggaagtggcaaaggagttgccacttttgggttgggaagaagggcagcaatgagatgtgg

SEQ ID NO: 58768 - DNA, 201 bp, Homo sapiens
attgtaaggagagtttacaggctttaaaaggacatgttgtaacaggcaagtgataacaggctttaatccctttaaagcctgttgtgggatgggatactggygttgacccaggtaagggtgattaggttttaatgggatagtaatgagggtgtgatttgttgccagggagggagtagaggtgtcccatacctgtgggttaag

SEQ ID NO: 58769 - DNA, 201 bp, Homo sapiens
caaatggtttttctagttatagatccttgagaaatcgccacattgtcttccacaatgattgaactaatttacacttccaccaacactgtaaaaagcattcytatttctccacatcctctccagcatctgttgtttcctgactttttaataatcgccattctaactggcatgagatggcatctcattgtggttttgatttgc

SEQ ID NO: 58770 - DNA, 201 bp, Homo sapiens
aagactcatgtctcaaaaaccgagctctccgagtgaacaattccttttcctcttaagggcttacaactctaagggggtctgcgtgagagggtcatgactgmttgagcaagcagggggagcaagcagggggtacatgactaggggctgcgtgtactggtaattagaggaacagaacaagacagggattttcacagtgctttt

SEQ ID NO: 58771 - DNA, 201 bp, Homo sapiens
aacgggcgatgtttctcagggctgcttcgagcaggattaggggtggcgtgagaacctagagtgggagagattaagctgaaggaagattttgtggtaagggktgatattatggggttgttagatgaaactgtagcaggacaagacacagacaaaacccctcagacactgagttaaagaaggaagggctttattcagctggga

SEQ ID NO: 58772 - DNA, 201 bp, Homo sapiens
aagatttcataagtcagcatgaagtttcgattcacttctcaacaagtctttttgagtaccacaagaagcacagtgttgggataaaagctgtcagggttacmataaggaattagcatggtagattcccgctctcaagaagctcacgatctaatgagcttgttagattaattagaactctaaggtctggaagaaactatgcca

SEQ ID NO: 58773 - DNA, 201 bp, Homo sapiens
tagaaagaagcaagaaagaggcttcttgtccaaattgcactgtggaaaatgaataaatgtattctttagacatctatatttttccccttaaacttcctccyatctgccagttgacttctctgtacagttctttctccaaagttctttgcattgccctctttcaacttcagcaatttgatttttcccttctgttcaaatgtc

SEQ ID NO: 58774 - DNA, 201 bp, Homo sapiens
tgaaatggggatcccattatcttcgtcacatgattgtgctccacattttatgaaataactcctcctatgctttactcagagtaccaagttcatgaaattgwcagagtcccaggaacacagaattattcattccttctgatttgttcacccaagatcaatgtgcctgggctgtattattgtagtttcctacagaaatagttc

SEQ ID NO: 58775 - DNA, 201 bp, Homo sapiens; identical to SEQ ID NO: 11249

SEQ ID NO: 58776 - DNA, 201 bp, Homo sapiens
gagcatggaatgtttttccattcatttgtgtcctctcttatttccttgagcagtggtttgtagttctccttgaataggtccttcacattccttgtaagttsgattcctaggtattttattctctttgtagcaatcgtgaatgggagttcactcatgatttggctctctgtttgtctattattgctgtataggaattcttgt

SEQ ID NO: 58777 - DNA, 201 bp, Homo sapiens; identical to SEQ ID NO: 11250

SEQ ID NO: 58778 - DNA, 201 bp, Homo sapiens
tcagtagtagcttgatggggatagcactgaatctataaattaccttgggcagtatggtcattttcatgatattgattcttcctacccatgagcatggaatrtttttccattcatttgtgtcctctcttatttccttgagcagtggtttgtagttctccttgaataggtccttcacattccttgtaagttggattcctaggt

SEQ ID NO: 58779 - DNA, 201 bp, Homo sapiens
attaattcagatttgattccccctgctcaagtgcacttggtcatcagcaggctgaattttagaagaaaagatttcaaatagtagtctttaatactttaaakgattaaaacagtaatgcaacactgtctacgtgctaggacctgaactaaatacttggaaatattttattttatcaacccaatgaggatgatacaattatta

SEQ ID NO: 58780 - DNA, 201 bp, Homo sapiens
ccatacctacgtcctgaatggtattgcctaggttttctcctagaatttttatggttttaggtcttccatttaagtctttaatccatcttgagttaattttyatataaggtgtaaggaagggatccagtttcagttttctgcatatggctagccagttttcccaacatcatttattaaatggggaatcctttcccaattgct

SEQ ID NO: 58781 - DNA, 201 bp, Homo sapiens
gttcctttttcttcaaaatgaaactctctcagtaggaacagattcttactcatctattgctgttaggttcatcatccctaaaaaaaatatttatgtgaagytaaccagaatctgaaattaattcagatttgattccccctgctcaagtgcacttggtcatcagcaggctgaattttagaagaaaagatttcaaatagtagt

SEQ ID NO: 58782 - DNA, 201 bp, Homo sapiens
tgatttataatcctttgggtatatacccagtaatgggattgctgggtcaaatggtttttctagttatagatccttgagaaatcgccacattgtcttccacratgattgaactaatttacacttccaccaacactgtaaaaagcattcttatttctccacatcctctccagcatctgttgtttcctgactttttaataatcg

SEQ ID NO: 58783 - DNA, 201 bp, Homo sapiens
tatggctgtatagtattccatgatgtatatgtgccacatcatctttatccagtttatcattggtgggcatttgggttggttccaactctttgctgttgtgmatagtgcctcaataaacataagtgtgcatgtgtctttatcgtagaatgatttataatcctttgggtatatacccagtaatgggattgctgggtcaaatgg

SEQ ID NO: 58784 - DNA, 201 bp, Homo sapiens
agagcatggatttggaactgattggcctctgttcaaattcccaaccatgtctcttactagttatgtgactaaggcaactttctttttttaaactttttttwaattatactttaatttctgggatacatgagcagaacgtgcaggtttgttacataggtatacatgtgccatggtggtttgctgcattcatcaacctgtcat

SEQ ID NO: 58785 - DNA, 201 bp, Homo sapiens
ggtgagagcagtctcagggaattggtgtggctgaaagcctgattggacaagcttcaagacagaattacagcctgagcaacatagtgagatcctgtctctayaaaaataaaaaataaaaaaattagtcgagggttggggcatgtgcctgtagtcttagctacatgggaggctgagggagaaggggcactagaccctaggatt

SEQ ID NO: 58786 - DNA, 201 bp, Homo sapiens
gttcctcttaactcttccccatactgtttctttccctattgaagtgattcagtgtgagcctttggaggccccagagctgggtaccatggactgtactcacyctttgggaaacttcagcttcagctcacagtgtgccttcagctgctctgaaggaacaaacttaactgggattgaagaaaccacctgtggaccatttggaaa

SEQ ID NO: 58787 - DNA, 201 bp, Homo sapiens
taaatggtattcaaagtcaagagtgtgaattggaccaccaagttagtgaggttagacacagaagagcaaagcggtgatctctggagtactccaagggtttsgaggttggggagatgagggagaatcaacacatgatacagaagaaatagccagtgaagtaggaggaaaaccaggagctccctggtgaagtaagatgaggat

SEQ ID NO: 58788 - DNA, 201 bp, Homo sapiens
tggcttcttactgaaaggttaccctgtaacatgcaattttgcatttgaataaagcctgctttttaagtgttaactagtttgcctagtttgttattttgaaattatcatatgttttgttttctccccagtgagattacatgctccttcagggcagagtttgtgtcagatccctggagtatctagtgcattacttgacactca

SEQ ID NO: 58789 - DNA, 201 bp, Homo sapiens
tgaattttatccaaggccttttctgcatctattgagataatcacgtggtttttgtgattggttctgtttacgtaatggattctgtttattgatttgtgtaygttgaaccagccttgcattccagggatgaagccaacttgattgtggttgataagctttttgatgtgctgctggattcagtttgccgtattttattgagta

SEQ ID NO: 58790 - DNA, 201 bp, Homo sapiens
tgcacctaaataataaatatcctcctgaaccccatcggtctctctgatttcttaaaaaatcccgcaatatttccactaccaaaatttgttgacacattggrtatgacttgtgaaaaaaaagagaggtgtctcagttaactccaaaagttttggtctgagtaactggaaggatggagttataatccactgagatggaaaggc

SEQ ID NO: 58791 - DNA, 201 bp, Homo sapiens
gaatttttggtgtgtaagatttgtccctgtgcacaaaagctatacccctaaatcaagttacatcaaaatgatagatctacgtaggaagtacagaggaagarctagacaatcagtgcctttgataataaggcaggggaggagaagctgacagctggggccagttggaaacttaggctcacatcacctcagttttcacattgt

SEQ ID NO: 58792 - DNA, 201 bp, Homo sapiens
accctgtaacatgcaattttgcatttgaataaagcctgctttttaagtgttaactagtttgcctagtttgttattttgaaattatcatatgttttgttttytccccagtgagattacatgctccttcagggcagagtttgtgtcagatccctggagtatctagtgcattacttgacactcaataaatgaatgttcaaataa

SEQ ID NO: 58793 - DNA, 201 bp, Homo sapiens; identical to SEQ ID NO: 11247

SEQ ID NO: 58794 - DNA, 201 bp, Homo sapiens
catacctacgtcctgaatggtattgcctaggttttctcctagaatttttatggttttaggtcttccatttaagtctttaatccatcttgagttaatttttrtataaggtgtaaggaagggatccagtttcagttttctgcatatggctagccagttttcccaacatcatttattaaatggggaatcctttcccaattgctt

SEQ ID NO: 58795 - DNA, 201 bp, Homo sapiens
tcgcttgaacccaggaggccgtggttgcatgagctgcctccgtgccactgcactccggactgggcaacagagtgagactccatctcaaaaataaataaatwaataaattaaattaaattaaattaaaataaacataaatttaaaaaatcaatctacactgtccttcagactcattagatctggagacaaagaccgtatgca

SEQ ID NO: 58796 - DNA, 201 bp, Homo sapiens; identical to SEQ ID NO: 11248

SEQ ID NO: 58797 - DNA, 201 bp, Homo sapiens
tattaggcttttagctcttctctgtgtttcagagttccagtcattgaacaagtccatggagctaaatacaacgatgaccattcttgccaacatttttaggkgcattttcaggaactctatgaaccacaaatctgggcattgagattctgtaggcattagactagcaaggctggtccagtctttgcctatgctgtagactca

SEQ ID NO: 58798 - DNA, 201 bp, Homo sapiens
tggcaaaatagggctttcacctgggtaggatgattctagaatgccactttacagccactgaaatatattgcctcccaaatgattctttctgctcaaagagwtttttttaagttatctacttatttatattctgcttttttcaaaaagaatgtgagaacagtacaaaatgtgttcagtatagcaaattaaaattaattaaaa

SEQ ID NO: 58799 - DNA, 201 bp, Homo sapiens
ctagccactctgagaaatgggaagttttgatcagaaagctctgctttcacaatattgttacctttccgtaaagatttcataagtcagcatgaagtttcgaytcacttctcaacaagtctttttgagtaccacaagaagcacagtgttgggataaaagctgtcagggttaccataaggaattagcatggtagattcccgctc

SEQ ID NO: 58800 - DNA, 201 bp, Homo sapiens
ggcatttacaaggataaaagtaaaaagtcataaatctctatgtgtgtgtttaggtgtgtgtgtgtgtctatgtgtgtgtgtatatgtatatatatacacasagagagagagagagagagagagaatttataggctttttgggttctaatagttagaaaaagggcacaggtaactatttagagcatggtagccaatgaagtg

SEQ ID NO: 58801 - DNA, 201 bp, Homo sapiens
atcattggcttttatttttcctgaagttgtattaggcttttagctcttctctgtgtttcagagttccagtcattgaacaagtccatggagctaaatacaaygatgaccattcttgccaacatttttaggtgcattttcaggaactctatgaaccacaaatctgggcattgagattctgtaggcattagactagcaaggctg

SEQ ID NO: 58802 - DNA, 201 bp, Homo sapiens
aagattttagttgtaggttggtcctttaaaacatgaagagtatttttcctatggaggcaatggtagaaataatggctacattcccaggctaaatctaagasaaaatatagttaatggcatttacaaggataaaagtaaaaagtcataaatctctatgtgtgtgtttaggtgtgtgtgtgtgtctatgtgtgtgtgtatatg

SEQ ID NO: 58803 - DNA, 201 bp, Homo sapiens
tttcctttgactggtgaattatccagttcagatcattggcttttatttttcctgaagttgtattaggcttttagctcttctctgtgtttcagagttccagwcattgaacaagtccatggagctaaatacaacgatgaccattcttgccaacatttttaggtgcattttcaggaactctatgaaccacaaatctgggcattg

SEQ ID NO: 58804 - DNA, 201 bp, Homo sapiens; identical to SEQ ID NO: 11253

SEQ ID NO: 58805 - DNA, 201 bp, Homo sapiens
ataaataaataaattaaattaaattaaattaaaataaacataaatttaaaaaatcaatctacactgtccttcagactcattagatctggagacaaagaccktatgcaccacaaaaatttctccaagtggggtctgtgcgccagtggcataagcatcactaaagagcttgttaggggtgcagaatctcaggctccactcaga

SEQ ID NO: 58806 - DNA, 201 bp, Homo sapiens
tagtatggagactttccctcctttcttttaggaaaggaataaggaacagttccagaaacatgtgtccttgtgcatgggctcatctagacacattttgtgcwccaggcattatcattttctgattagtcactaccattggccctgtttggtaaataaggaaaccagggcaatgatgttttaggccaaatctcaaaaatacca

SEQ ID NO: 58807 - DNA, 201 bp, Homo sapiens
gcttatgaagaatagataggatttaggtatatggagaaaagcaggaaaggaaggcagtctgtaggaaggaaattgtgtaagcagtggtatggtagtgagamtatgaaagcatttttcaggggccactgagcagaactttcttgagcccatggcttattgaggagttgtggagttgaagttggaaaggaaggctggccccaa

SEQ ID NO: 58808 - DNA, 201 bp, Homo sapiens
acatgtaaatcagcccaggacacaccttcattaaaacaggttggctgattttcgcttttcatctgataaacttttaaaaatgtctattaccttcaaggcarcttgctaggctgataacaactaagtgagatattctaatggttctttgctcttatgtaattctttaatacttttttttttttgagacagagcctcactctg

SEQ ID NO: 58809 - DNA, 201 bp, Homo sapiens
atctcatctcatatagtttccaaatacaaaaattcttctgattccttgagtccattcttccttgaagtctctagagcaaggtagcaataatggcttaaatytgacagatgaggaataagacatgaaagttgtactgtttactaaatggcatggcagggtctaaaatgtgaaaactttgatttccaagtcttaaatttacct

SEQ ID NO: 58810 - DNA, 201 bp, Homo sapiens
gtgaaatctaagctcttcaagccccagagtaatgcttgatatataatagatactctttaaatcaatgaaaaaagataacattttctcttagttcccatgtytctccctaatctcatctcatatagtttccaaatacaaaaattcttctgattccttgagtccattcttccttgaagtctctagagcaaggtagcaataatg

SEQ ID NO: 58811 - DNA, 201 bp, Homo sapiens; identical to SEQ ID NO: 11258

SEQ ID NO: 58812 - DNA, 201 bp, Homo sapiens
atttctacctaccattttgtcctacagggtgaaatctaagctcttcaagccccagagtaatgcttgatatataatagatactctttaaatcaatgaaaaaagataacattttctcttagttcccatgtttctccctaatctcatctcatatagtttccaaatacaaaaattcttctgattccttgagtccattcttccttg

SEQ ID NO: 58813 - DNA, 201 bp, Homo sapiens
gttgcatgagctgcctccgtgccactgcactccggactgggcaacagagtgagactccatctcaaaaataaataaataaataaattaaattaaattaaatwaaaataaacataaatttaaaaaatcaatctacactgtccttcagactcattagatctggagacaaagaccgtatgcaccacaaaaatttctccaagtggg

SEQ ID NO: 58814 - DNA, 201 bp, Homo sapiens
ttgccagccctggtcatgcagtggccatggagaatgtgtagaaatcatcaataattacacctgcaactgtgatgtggggtactatgggccccagtgtcagyttggtaagtctctttcctttctttgcttcttcttaggtaaagtcacaggaatcattatagcttatcatgaagctggttggaacaaaatgatactagccac

SEQ ID NO: 58815 - DNA, 201 bp, Homo sapiens
gcttgaacccaggaggccgtggttgcatgagctgcctccgtgccactgcactccggactgggcaacagagtgagactccatctcaaaaataaataaataawtaaattaaattaaattaaattaaaataaacataaatttaaaaaatcaatctacactgtccttcagactcattagatctggagacaaagaccgtatgcacc

SEQ ID NO: 58816 - DNA, 201 bp, Homo sapiens
agaaggtctaggttctacttcaaatctgcaaacaactattctgtgatcctgagatggtcacatacactcttaggctctgtttcctcatctctaagtgtctrgctcagcctggagtagtgctaggttctttttagctgtaacattatgtaagtctgcataggtcacactgatgtcttgcagatttcctggcacatcatggaa

SEQ ID NO: 58817 - DNA, 201 bp, Homo sapiens
cttattatgcttctcccataggtacatatgtgttggccttcaagaaatgattccaggattaaaaagtatacgtaaattgtatagttatatgatattacackgtaattagttgtaaatcattaacagctacaaagaaaaagaaatatgaatgtctaaaatatgttggttaaatttcacctgaaataattttgagaaaaaaat

SEQ ID NO: 58818 - DNA, 201 bp, Homo sapiens
aaagtcataaatctctatgtgtgtgtttaggtgtgtgtgtgtgtctatgtgtgtgtgtatatgtatatatatacacagagagagagagagagagagagagaatttataggctttttgggttctaatagttagaaaaagggcacaggtaactatttagagcatggtagccaatgaagtgactagagccttcacccctattct

SEQ ID NO: 58819 - DNA, 201 bp, Homo sapiens
aaaagtcataaatctctatgtgtgtgtttaggtgtgtgtgtgtgtctatgtgtgtgtgtatatgtatatatatacacagagagagagagagagagagagagaatttataggctttttgggttctaatagttagaaaaagggcacaggtaactatttagagcatggtagccaatgaagtgactagagccttcacccctattc

SEQ ID NO: 58820 - DNA, 201 bp, Homo sapiens
ttggctttaaggattctcactacagataatgctgaagataataatatgaagactagctaatgtttacttagaatttctgatgagtcaggctttgttctaasgtccttgacttatgctaattgaattacatttagtttccatatcaatttgataaagataacacaatttcattattcctcttatatagatgaagaaactgaa

SEQ ID NO: 58821 - DNA, 201 bp, Homo sapiens
aaaaagtcataaatctctatgtgtgtgtttaggtgtgtgtgtgtgtctatgtgtgtgtgtatatgtatatatatacacagagagagagagagagagagagagaatttataggctttttgggttctaatagttagaaaaagggcacaggtaactatttagagcatggtagccaatgaagtgactagagccttcacccctatt

SEQ ID NO: 58822 - DNA, 201 bp, Homo sapiens
gcatgcagaaatgattgaggtcaggtcatcatttaaccttctcactcattaaaaacaagtaatttcaagagtttcaaggtatgccactaagtttcctatargtgttacagaatattagtattggtaatttcattccaaaagcaaataaatgcctatgactatatgcttagtgtattttatacgtaaaaattttagcatatg

SEQ ID NO: 58823 - DNA, 201 bp, Homo sapiens
taaaaagtcataaatctctatgtgtgtgtttaggtgtgtgtgtgtgtctatgtgtgtgtgtatatgtatatatatacacagagagagagagagagagagagagaatttataggctttttgggttctaatagttagaaaaagggcacaggtaactatttagagcatggtagccaatgaagtgactagagccttcacccctat

SEQ ID NO: 58824 - DNA, 201 bp, Homo sapiens
agcatggatttggaactgattggcctctgttcaaattcccaaccatgtctcttactagttatgtgactaaggcaactttctttttttaaactttttttaaattatactttaatttctgggatacatgagcagaacgtgcaggtttgttacataggtatacatgtgccatggtggtttgctgcattcatcaacctgtcatct

SEQ ID NO: 58825 - DNA, 201 bp, Homo sapiens
tcagtgggaaccctgcctctgtctccgtgatgtgaccctggccagttgttactctctctgaacttcagatttatttatgaaatggggatcccattatcttygtcacatgattgtgctccacattttatgaaataactcctcctatgctttactcagagtaccaagttcatgaaattgtcagagtcccaggaacacagaatt

SEQ ID NO: 58826 - DNA, 201 bp, Homo sapiens
aatgatcaagagcatggatttggaactgattggcctctgttcaaattcccaaccatgtctcttactagttatgtgactaaggcaactttctttttttaaamtttttttaaattatactttaatttctgggatacatgagcagaacgtgcaggtttgttacataggtatacatgtgccatggtggtttgctgcattcatcaa

SEQ ID NO: 58827 - DNA, 201 bp, Homo sapiens
tggtggatatcacattcaaactctttttgtagttgaactaattaagtaagttttctataggccttgagcaagtgacagagttagttacaataatcataaamctttatcaaatattaattccatgttgtatactgttatgaatggtttacatgtcttaaatcatgaaatatgcctttaagtctgtgggagaagggtctatga

SEQ ID NO: 58828 - DNA, 201 bp, Homo sapiens
tatgaaagcatttttcaggggccactgagcagaactttcttgagcccatggcttattgaggagttgtggagttgaagttggaaaggaaggctggccccaayaacataagtcttgaatgcttcaccagatggtctagaaaggcctagcaaagaagaattatttgcccagctctcatttattgaccaaggctgtattaattca

SEQ ID NO: 58829 - DNA, 201 bp, Homo sapiens
agtcaggcatggtagcatgcacatgtagtcccagctacccaggagactgaggtgggaggatcacttgaacccaggaggtcaaggctgcagtaagccatgasagcaccactgcactccacaacagagtgaggccctgtctcaaaaaaaaaaaaaaaaaaagtcttcatttataaaacaacatcttccattttcaccaactta

SEQ ID NO: 58830 - DNA, 201 bp, Homo sapiens
gtccttgaggcacaggaggagagactggctggaagaatattagcaaaaagctaattaccatgctaagcaaattgctatattaagtttaatggttcactgawtttttataatcagtcaattaatagttgtttattgaacatttttgtgttggaaactgctaagctttcttgagacagcaagaggagtcagcctggtccctga

SEQ ID NO: 58831 - DNA, 201 bp, Homo sapiens
caaaaaattagtcaggcatggtagcatgcacatgtagtcccagctacccaggagactgaggtgggaggatcacttgaacccaggaggtcaaggctgcagtragccatgacagcaccactgcactccacaacagagtgaggccctgtctcaaaaaaaaaaaaaaaaaaagtcttcatttataaaacaacatcttccattttc

SEQ ID NO: 58832 - DNA, 201 bp, Homo sapiens
tatatgtttcatataaatggaatcagacaacatgtaaccttttgtatctggcttcttttggaacaggaattaaaagaaattaaataatgtgtaagcggaarctcagttgtatgtaacaaaacccaactccccctgagaaagagaaagagctggagccctttaaaaattaactgcctgtttttctgtggctagtgagactta

SEQ ID NO: 58833 - DNA, 201 bp, Homo sapiens
tgaaactgaacacatgcccccttagttcctttttcttcaaaatgaaactctctcagtaggaacagattcttactcatctattgctgttaggttcatcatcmctaaaaaaaatatttatgtgaagctaaccagaatctgaaattaattcagatttgattccccctgctcaagtgcacttggtcatcagcaggctgaatttta

SEQ ID NO: 58834 - DNA, 201 bp, Homo sapiens
atatacctgttttggccaggtgtggtggctcatgcctgtaatcccagcactttgggaggccgaggcgggcggatcatgagctcagcagttcaagaccagcytggccaacatggtgaaaccctgtctctactaaaaatacaaaaattagccaggcgtggtggcgggcacctgtaatcccagctactcgggaggctgagacag

SEQ ID NO: 58835 - DNA, 201 bp, Homo sapiens
aagagtgtgaattggaccaccaagttagtgaggttagacacagaagagcaaagcggtgatctctggagtactccaagggtttggaggttggggagatgagsgagaatcaacacatgatacagaagaaatagccagtgaagtaggaggaaaaccaggagctccctggtgaagtaagatgaggatggagaataggctgtttgt

SEQ ID NO: 58836 - DNA, 201 bp, Homo sapiens
attagtctattcagggatttgacttcttcctggtttagtcttgggagggtgtatgtgtccaggaatttatccatttcttctagattttctagtttatttgygtaaagatgtttatagtaatctctgatggtagtttgtatttctacgggatcagtggtaatatcccctttaccattttttattgtgtctattgattcttct

SEQ ID NO: 58837 - DNA, 201 bp, Homo sapiens
agtttcctcatctgtcaaatggcatcaaatgggctactactgggagatgtaaggaggaaaaaagtcaaatatcatgagatagactaaggaaataatgctgrtggtctcatgctatgtgccttactgatttctctttcagaattggacaaaagtttctcaatgattaaggagggtgattataaccccctcttcattccagtg

SEQ ID NO: 58838 - DNA, 201 bp, Homo sapiens
ggaggagttcctctttttctattctctggaatagtttcagaaggaatggtaccagcacctctttgtacctctggtagaatttggctgtgaatccatctggwcctgggctttttttagttggtaggctattaattgctgccttaatttcagaacttgttattagtctattcagggatttgacttcttcctggtttagtcttg

SEQ ID NO: 58839 - DNA, 201 bp, Homo sapiens
tttgtgaatcatctggaatctggtcaaatcctagtccaatatgtcaaagtgagtaagtttgtcctggaaaactgaaatcttaacgatggagctgatggatragcagatatgaggaaagacatacataaacatttacatgttgttttgctaagaatatgtggcctagaaataaatttgtatgcttaactcactgtaaaatct

SEQ ID NO: 58840 - DNA, 201 bp, Homo sapiens
tgggaagaagaaaaccatttgtgaatcatctggaatctggtcaaatcctagtccaatatgtcaaagtgagtaagtttgtcctggaaaactgaaatcttaaygatggagctgatggatgagcagatatgaggaaagacatacataaacatttacatgttgttttgctaagaatatgtggcctagaaataaatttgtatgctt

SEQ ID NO: 58841 - DNA, 201 bp, Homo sapiens
agttggacttgcttcagtgaattgggatgtttttcaaaatgcttgggtagatatcagaacagatgaaacggcagagattctctgagaatatcccataagarcccttgatgcagaggccatatggcatggtacttccagcagaaggggagggtcaccttagctagggcagcagcctggagtagctactcctctccccacagc

SEQ ID NO: 58842 - DNA, 201 bp, Homo sapiens
gctcaaaaaggtatttctttttattaaaaaaagaaatacttttctttcctggtgtctggctatctaattttttttttttttaggtatttgaggcattgacycattatgatcaagagtgaggctataacattaaatataagcatcaatagttaattaagcagcaacaatactttaaaaaatatacatagtaaatattaaata

SEQ ID NO: 58843 - DNA, 201 bp, Homo sapiens
aactgtcaacccacctactggaatttacggaagttggacttgcttcagtgaattgggatgtttttcaaaatgcttgggtagatatcagaacagatgaaacrgcagagattctctgagaatatcccataagagcccttgatgcagaggccatatggcatggtacttccagcagaaggggagggtcaccttagctagggcagc

SEQ ID NO: 58844 - DNA, 201 bp, Homo sapiens
tggttaacttttctacaagtatgctcctgatgcattagtttaagtagtttaattcttagaagtgctatcaaaatcccttattgaaattataaaactgtcarcccacctactggaatttacggaagttggacttgcttcagtgaattgggatgtttttcaaaatgcttgggtagatatcagaacagatgaaacggcagagat

SEQ ID NO: 58845 - DNA, 201 bp, Homo sapiens
ccatatgggagaaaaccaatgtcatctgaacttacgaagttttggttaacttttctacaagtatgctcctgatgcattagtttaagtagtttaattcttaraagtgctatcaaaatcccttattgaaattataaaactgtcaacccacctactggaatttacggaagttggacttgcttcagtgaattgggatgtttttca

SEQ ID NO: 58846 - DNA, 201 bp, Homo sapiens; identical to SEQ ID NO: 11283

SEQ ID NO: 58847 - DNA, 201 bp, Homo sapiens
gggttaataatagtagctattgcattaagccactggggaaaggcacaaagataataatgtatgtaaagcccattgcccaggttataataagcactgaatcracattggctatgattatttttgattaatgaaggggagggggttatggcactggaagattttaagtaggaaaaggacatgatctcatccctgggtcaggtg

SEQ ID NO: 58848 - DNA, 201 bp, Homo sapiens
ctccttgggggcctattcttcgggctaactctttgcatgttctgcagggagccaaacaagccgctcctacacttcgctggtcctgggcgtcctggtgggcrgtttcatcattgctggtgtggctgtaggcatcttcctgtgcacaggtggacggcgatgttaattactctccagccccgtcagaaggggctggattgatgg

SEQ ID NO: 58849 - DNA, 201 bp, Homo sapiens
tgttttttaaatttctcattgagttaaattcagaatcctcaaaatgacattcaaggccttgcacaatgtggccccaacctaattttctaatttaattttawttttattttattttattttattttattttgagatggagtctcactctgtcacccaggctggagtaaagtggtgcgatctctgctcactgcaacctccacc

SEQ ID NO: 58850 - DNA, 201 bp, Homo sapiens
cacaatccccgtaacttcagtctccccctcagagaggcagcaaataataaccagtattcaatgagtgctcactatggttaatacatgtattgacccatttmacttgcacaaacccctaaaggtgggtaatattattactatctccattttatgaggaggaaactgggtcacagagtagttaaggaccatgtctagggttat

SEQ ID NO: 58851 - DNA, 201 bp, Homo sapiens
tgaacccaagaggcagaggttgcaatgagctgagatctcgccactgcactccagcctgggcaacaagagcaaaattccatctcaaataaataaataaatayataaataagaaaaaaaagacttgccgttcagctatagggggaatagccagcagatagcttccgcttgcttcagttctttcaatgtctgcctcagctgtag

SEQ ID NO: 58852 - DNA, 201 bp, Homo sapiens
gagaaagaaaccagcagagagggtaggagaatcagccccagggagaggggagaaaggggaactgagggtgatggtagataggggtacatctaggggagacrggaagaggctcagaagagaagagaaatggagggaatgggaagaccctgggaaaactgatggaagaagtgggggaagagtggggcagagagaggttagggg

SEQ ID NO: 58853 - DNA, 201 bp, Homo sapiens
gaatctcttgaacccaagaggcagaggttgcaatgagctgagatctcgccactgcactccagcctgggcaacaagagcaaaattccatctcaaataaatawataaatacataaataagaaaaaaaagacttgccgttcagctatagggggaatagccagcagatagcttccgcttgcttcagttctttcaatgtctgcctc

SEQ ID NO: 58854 - DNA, 201 bp, Homo sapiens
tgccattgcactccagcctgggcaacaagagtgaaacaccgtctcaaaaaaaaaaaaaaaaaaagagaaaaaaaaattaaaaaaaaaaaagaaataatacyaattgagataatgagcattggtaccaggtgagacaactggaccactgaaacagaatagacatatttactgtaagtcagagatgccactgcagatcagtaa

SEQ ID NO: 58855 - DNA, 201 bp, Homo sapiens
aaggaataggttgataaacataaccaccttaaaattaggaacttttgtttatctaaagacatgataaagaaagtgcaaagcggctgggcgcggtggctcaygcctgcaatcccagcactttgggaggctaaggtgggaggatcacttgagcccagaagtttgagaccagcctgggcagcatagcaagacctcatctctaca

SEQ ID NO: 58856 - DNA, 201 bp, Homo sapiens
gagcccagaagtttgagaccagcctgggcagcatagcaagacctcatctctacaaaaataaggttttttaaaaaaaaaaaaactgtgacggtaaaaccacytactcaagactcagcaatggtggatgccctacgacacctaggtggcgtagcctactatacccctaggctccttggtatagcctattgctcctaggctaca

SEQ ID NO: 58857 - DNA, 201 bp, Homo sapiens
taggttgataaacataaccaccttaaaattaggaacttttgtttatctaaagacatgataaagaaagtgcaaagcggctgggcgcggtggctcatgcctgyaatcccagcactttgggaggctaaggtgggaggatcacttgagcccagaagtttgagaccagcctgggcagcatagcaagacctcatctctacaaaaata

SEQ ID NO: 58858 - DNA, 201 bp, Homo sapiens
agacacactgtgtctcgtggggcatcagaaaaaaatttccaagaagagggcaactgagctgggtctttttttctttgcttttctttcttttttcttttttytttttttttttttttttgagatggagtcttgtgctgtcacccaggctggaatgcagtggcacaatttcagctaactgtaacctccaactcccaggttcag

SEQ ID NO: 58859 - DNA, 201 bp, Homo sapiens
gatcatgcccatcccagggctgccctcactcggtgcctaagcaaggcaggggtataaaagttcggtcattttggccaactgcaggacaactctgagaatargttggattgacaagggctagccagggctggaaatattcactccagagctccctgccagggaggctgggtctttgtcagatctgcattgccgtttgacttc

SEQ ID NO: 58860 - DNA, 201 bp, Homo sapiens
tgataaacataaccaccttaaaattaggaacttttgtttatctaaagacatgataaagaaagtgcaaagcggctgggcgcggtggctcatgcctgcaatcycagcactttgggaggctaaggtgggaggatcacttgagcccagaagtttgagaccagcctgggcagcatagcaagacctcatctctacaaaaataaggtt

SEQ ID NO: 58861 - DNA, 201 bp, Homo sapiens
agaccaccctggccaacatggtgaaaccccgtctctactcaaaatacaaaaattagctgggtatagcagtgggggcctgtaatcccagctactcaggaggytggggcaggagaatcacttgaacccaggaggtggagcttgcagtgagctgagattgcaccactgcactccagcctggacgacagggcgagactccgtctc

SEQ ID NO: 58862 - DNA, 201 bp, Homo sapiens
gatcacttgagcccagaagtttgagaccagcctgggcagcatagcaagacctcatctctacaaaaataaggttttttaaaaaaaaaaaaactgtgacggtwaaaccacctactcaagactcagcaatggtggatgccctacgacacctaggtggcgtagcctactatacccctaggctccttggtatagcctattgctcct

SEQ ID NO: 58863 - DNA, 201 bp, Homo sapiens
cacccaggaagtgcaagaggttaggggatatcccccctagccaagggaagcggtgagggactgtgccctgggaaatggtgcactacggcccagatactgcrcttttcccaaggtcttcgccacctgtagaccaggagattccctctggtgcctacgccaccagggccctgggtttcaagcacaaaactgggcggccatttg

SEQ ID NO: 58864 - DNA, 201 bp, Homo sapiens
ggtcttcgccacctgtagaccaggagattccctctggtgcctacgccaccagggccctgggtttcaagcacaaaactgggcggccatttgggcagacaccragctagctgcaggagttttcttttttttttttcataccccagtggtgcgtggaacgccagcaagatagaatcgttcactctgcaggctgggcgcggtggc

SEQ ID NO: 58865 - DNA, 201 bp, Homo sapiens
aggtggagcttgcagtgagctgagattgcaccactgcactccagcctggacgacagggcgagactccgtctcaaaaaaaaaacaaaaaaaaaaaaacaggwttgttcaatccgctggaaagggggctgaagccagggagccaagtggtctggctccatgggtcccacccccacagagctcagcaagctaagatccactggc

SEQ ID NO: 58866 - DNA, 201 bp, Homo sapiens
acctgcacattctgcacatgtaccccaaacttaaagtataataaaaattaaaaaaagaaatctaaacacagaaaaggtacagtaaaaatatggtatagtcsattttaaaaggtacacctgtagagtgtgtacttcatgcatggagcttgaaggacttggtgttgctctgagtgggtcagtgagtgagtggtgagcaaatgt

SEQ ID NO: 58867 - DNA, 201 bp, Homo sapiens
cctgcacattctgcacatgtaccccaaacttaaagtataataaaaattaaaaaaagaaatctaaacacagaaaaggtacagtaaaaatatggtatagtcgwttttaaaaggtacacctgtagagtgtgtacttcatgcatggagcttgaaggacttggtgttgctctgagtgggtcagtgagtgagtggtgagcaaatgtg

SEQ ID NO: 58868 - DNA, 201 bp, Homo sapiens
aggttgcggtgagctaagatcctgccattgcactccagcctgggcaacaagagtgaaacaccgtctcaaaaaaaaaaaaaaaaaaagagaaaaaaaaattwaaaaaaaaaaagaaataataccaattgagataatgagcattggtaccaggtgagacaactggaccactgaaacagaatagacatatttactgtaagtcag

SEQ ID NO: 58869 - DNA, 201 bp, Homo sapiens
ggaagcggtgagggactgtgccctgggaaatggtgcactacggcccagatactgcgcttttcccaaggtcttcgccacctgtagaccaggagattccctcyggtgcctacgccaccagggccctgggtttcaagcacaaaactgggcggccatttgggcagacaccgagctagctgcaggagttttcttttttttttttca

SEQ ID NO: 58870 - DNA, 201 bp, Homo sapiens
gaggttgcggtgagctaagatcctgccattgcactccagcctgggcaacaagagtgaaacaccgtctcaaaaaaaaaaaaaaaaaaagagaaaaaaaaatwaaaaaaaaaaaagaaataataccaattgagataatgagcattggtaccaggtgagacaactggaccactgaaacagaatagacatatttactgtaagtca

SEQ ID NO: 58871 - DNA, 201 bp, Homo sapiens
tgggtccctgacccctatgtatcctgactgggagacacctcccataggggccaacagacacctcatacagaagagctctcgctggcatctggtgggtgccyctctgggacaaagcttctagaggaaggaacaggcagcaatctttgctgttctgcggcctccagtggtgatacccaggcaaacagggtctggagtggacct

SEQ ID NO: 58872 - DNA, 201 bp, Homo sapiens
ccgggaggcagaggttgcggtgagctaagatcctgccattgcactccagcctgggcaacaagagtgaaacaccgtctcaaaaaaaaaaaaaaaaaaagagraaaaaaaattaaaaaaaaaaaagaaataataccaattgagataatgagcattggtaccaggtgagacaactggaccactgaaacagaatagacatattta

SEQ ID NO: 58873 - DNA, 201 bp, Homo sapiens
gtctgcctcagctgtagaggacagtcctgcacaagatcatgcccatcccagggctgccctcactcggtgcctaagcaaggcaggggtataaaagttcggtyattttggccaactgcaggacaactctgagaataggttggattgacaagggctagccagggctggaaatattcactccagagctccctgccagggaggctg

SEQ ID NO: 58874 - DNA, 201 bp, Homo sapiens
actctgagagataccaaaaaagatgtaaacaaatgaaaaaaatacaccctatcatgcactggatgattcaatattgtgaagatgtcaattcttcccagtcatttacatgctaaatgcaataccaaccaaaacttcatcaacgtgataaaaaagattccaaaatttaggtgtagacgttcaaatattcaaaaatagctaaga

SEQ ID NO: 58875 - DNA, 201 bp, Homo sapiens
catttgttcaagagtcaatatcctgagtggaagcagccaaatgaccaagccttgatcatgttgcttttgccttagctgcaagtgcaggggggaaaaggaaractttagatacctttgacttctcttgtgggaggtgagaacctgtctcccattaagactcacacagaggaagagatttcagatgctgggcaaccaaaacag

SEQ ID NO: 58876 - DNA, 201 bp, Homo sapiens
tggagtgcagtggtgcgatctcagctcactgcagcctcagcctcctgggctcaagtgatcctcccacctcagcctcccgagttgctaggactacaggcacrcgtcaccacgcctggctaatttttgtattttttgcagagcccagatgaactcctgggctcaagcaatcctcccacctcagcctcccaaagtgctgggatt

SEQ ID NO: 58877 - DNA, 201 bp, Homo sapiens
aactctgagagataccaaaaaagatgtaaacaaatgaaaaaaatacaccctatcatgcactggatgattcaatattgtgaagatgtcaattcttcccagtcatttacatgctaaatgcaataccaaccaaaacttcatcaacgtgataaaaaagattccaaaatttaggtgtagacgttcaaatattcaaaaatagctaag

SEQ ID NO: 58878 - DNA, 201 bp, Homo sapiens
cttctgagataccatacttcaatttttaaaactgttctgtctactttttttcaatccctttgactatgtcatcttacacgattcaccctggaaatgctggyttccttagaattccattttttggttccttttgttcctgtttgaactataccctttctaggtgacctactgaccttcatggctgcaaatactatctacctg

SEQ ID NO: 58879 - DNA, 201 bp, Homo sapiens
aaactctgagagataccaaaaaagatgtaaacaaatgaaaaaaatacaccctatcatgcactggatgattcaatattgtgaagatgtcaattcttcccagtcatttacatgctaaatgcaataccaaccaaaacttcatcaacgtgataaaaaagattccaaaatttaggtgtagacgttcaaatattcaaaaatagctaa

SEQ ID NO: 58880 - DNA, 201 bp, Homo sapiens
agccactgcgcctggtcttctcactcattcttagacccagtgcaatctgacttctctataaactactctaagatcaccagtaacctctaattgtcaaaccrtcaccctacatggtatctgcaaatttgcggactagaactctctttttgccttaacttctgagataccatacttcaatttttaaaactgttctgtctactt

SEQ ID NO: 58881 - DNA, 201 bp, Homo sapiens
gaaactctgagagataccaaaaaagatgtaaacaaatgaaaaaaatacaccctatcatgcactggatgattcaatattgtgaagatgtcaattcttcccagtcatttacatgctaaatgcaataccaaccaaaacttcatcaacgtgataaaaaagattccaaaatttaggtgtagacgttcaaatattcaaaaatagcta

SEQ ID NO: 58882 - DNA, 201 bp, Homo sapiens
cctgggaggtggaggttgcagtgagccgagatcatgccactgcactccagccagggtgacagagcgagactctgtctcaaaagaaaaaaaaaaaaaaaaaagaaatacccaattctttcacagaaaatatgttcttactggctggcggggagaggggtggttggtaaatgggaaaagggtgcttcctttgctgatatccaa

SEQ ID NO: 58883 - DNA, 201 bp, Homo sapiens
ccctccactattgtcccatgaccctgccaaatccccctctgtgagaaacacccaagaattatcaataaaaaaataaatttaaaattaaaaaaaaaaaaaaattaaaaagtgaggctgggcacagtgcctcaagcctgtaattccagcactttgggaggctgaggcgggtggattgcttgagcccaggaatttgagaccagc

SEQ ID NO: 58884 - DNA, 201 bp, Homo sapiens
gcaatatctagtaaaactgaagatgcatatactttattactcagaaattccactgtcaagtttgcacctacaaaaactcccacatatgcacaaggactcghgtatgagaatgttcataccagcactgtttgtaatagcaaaaaactggaaaaaacttaagtgttcagcaacaagagaatggatacataaataatgatctat

SEQ ID NO: 58885 - DNA, 201 bp, Homo sapiens
ctatttcattttttaaaaatggtaaccatgacctgctaaattgatttcattgtccactaataaattatgacctcagtttcaaaaagattgctttaggtaascaatcatcttctgagatttatacagattgctcataattctctcctattttttaaaaacatgctgcagtgaactgctttacactcattttatgactacttc

SEQ ID NO: 58886 - DNA, 201 bp, Homo sapiens
ctgttttttaaatttctcattgagttaaattcagaatcctcaaaatgacattcaaggccttgcacaatgtggccccaacctaattttctaatttaattttwattttattttattttattttattttattttgagatggagtctcactctgtcacccaggctggagtaaagtggtgcgatctctgctcactgcaacctccac

SEQ ID NO: 58887 - DNA, 201 bp, Homo sapiens
cacccaggtcacctccggagtggtcaccttcaccctgcagcagctcaatgcctacaaccgcactcggtatgaactgcgggaattcctggaggacacctgtstgcagtatgtgcagaaacatatttccgcggaaaacacgaaaggtatgatgggacggggcccaggcctgcaagctggggagagggcgggttccagacaaat

SEQ ID NO: 58888 - DNA, 201 bp, Homo sapiens
ttcctattatattcttttgtaccttcttcaccctgtacttgaaacaactttttcctcacccctacttgccccttaggcattatcggggttttttgtttttktttttttctttgtttgtttgtttttgagacagggtcttgctctgtcacccaggctggagtgcagtggtgcgatctcagctcactgcagcctcagcctcct

SEQ ID NO: 58889 - DNA, 201 bp, Homo sapiens
ttttccattgactataaaaactcaagttcttttttcttttttttgagacaggtctcacattgttgcccaggctggagtgcagtggttcgaacacggctcastacagtcttgacctcccacatcccaggctcaagtgatcttgcctcagtccctcaagtagctgggactataggcatgtgccaccatggccagctaattttt

SEQ ID NO: 58890 - DNA, 201 bp, Homo sapiens
tgactcctgcttacctcctcatatcacttcttccttcctatcacctactcctatttggccatacttaagtattactgctttctcaagtatgttatattctytctcctttcctattatattcttttgtaccttcttcaccctgtacttgaaacaactttttcctcacccctacttgccccttaggcattatcggggtttttt

SEQ ID NO: 58891 - DNA, 201 bp, Homo sapiens
agtggttcacgcctataatcccagcactttgggaggccgaggtgggcagatcacctgaggtcaggagtttgagagcagcctggccaacaaaccccatctcyactaaaaatacaaaaattagccagctgtgttggtgagcgcctgtaatcccagctacttgggaggctgaggcatgagaattgcttgaacctgggaggtgga

SEQ ID NO: 58892 - DNA, 201 bp, Homo sapiens
ggctatttcttcagactgccctccctccctccttttctgtctccctccctccctcccttcctccctccctctttcccccttcttcttttcttttctttctytctttctttcttttcttctttccttctttcttttttctttctccttctttccttccttccctcctctctctctctctttatttctgtctgcctgtctttc

SEQ ID NO: 58893 - DNA, 201 bp, Homo sapiens
accttccctccactattgtcccatgaccctgccaaatccccctctgtgagaaacacccaagaattatcaataaaaaaataaatttaaaattaaaaaaaaawaaaaattaaaaagtgaggctgggcacagtgcctcaagcctgtaattccagcactttgggaggctgaggcgggtggattgcttgagcccaggaatttgaga

SEQ ID NO: 58894 - DNA, 201 bp, Homo sapiens
gaccttccctccactattgtcccatgaccctgccaaatccccctctgtgagaaacacccaagaattatcaataaaaaaataaatttaaaattaaaaaaaawaaaaaattaaaaagtgaggctgggcacagtgcctcaagcctgtaattccagcactttgggaggctgaggcgggtggattgcttgagcccaggaatttgag

SEQ ID NO: 58895 - DNA, 201 bp, Homo sapiens
ttatctgctgaccttccctccactattgtcccatgaccctgccaaatccccctctgtgagaaacacccaagaattatcaataaaaaaataaatttaaaatwaaaaaaaaaaaaaaattaaaaagtgaggctgggcacagtgcctcaagcctgtaattccagcactttgggaggctgaggcgggtggattgcttgagcccag

SEQ ID NO: 58896 - DNA, 201 bp, Homo sapiens
tttatctgctgaccttccctccactattgtcccatgaccctgccaaatccccctctgtgagaaacacccaagaattatcaataaaaaaataaatttaaaawtaaaaaaaaaaaaaaattaaaaagtgaggctgggcacagtgcctcaagcctgtaattccagcactttgggaggctgaggcgggtggattgcttgagccca

SEQ ID NO: 58897 - DNA, 201 bp, Homo sapiens
tagaaaaaattagctgggcatggtggtgtgggcctgtagttccagttactcaagaggctgaggtaagaggattgcttgagcccagaaggttgaggctgcaytgagccatgatcgtgccaccacactgcagcctggcaacagaccaagaaaaaaaaaaaaagatagtgtatgtatagtcagtaaatacagcagtggcttctg

SEQ ID NO: 58898 - DNA, 201 bp, Homo sapiens
ggaggctgaggtgggcagttcacctgaggtcaggtgttcgagaccagcctggccaacatggtgaaaccgtctctactaaatatacaaaaattagccaggcmtggtggcacgtgcctgtagttccagctactcaggaggctaaggaaggagagtagcttgcacccaggaggcagatgttgcagtgagttgagatcgtgccac

SEQ ID NO: 58899 - DNA, 201 bp, Homo sapiens
ccagactccgcccctcccagacggtcctcacttctcttttccctagactgcagccagcggagcccgcagccggcccgagccaggaacccaggtccggagcytcaacttcaggatgttgacaacattgctgccgatactgctgctgtctggctgggccttttgtagccaagacgcctcagatggtgagtcgggggcacatct

SEQ ID NO: 58900 - DNA, 201 bp, Homo sapiens
cacctcagccacccaggccagatgcagtgtaggccatggctccaacagcagcatttctcttttcttccccacccccatccctgggtttagaatgagaaaakgctcaagttgcccccctcccaacttccctacccgcaacactctttttattttctctgttcccagctccatacttccatgctttttttttttttttttttt

SEQ ID NO: 58901 - DNA, 201 bp, Homo sapiens
tcaggaaaccaggaggaatggatttggctgaaactggaatacatggatagataaggctagagagataggcaggagccaagccaacaatactaggctcccaycaattgctggggcaggcaagagcaggcatcatcctgagtgtttggagcttcttttcatgttccctaagttggggggtgttggggggatgatacaggggga

SEQ ID NO: 58902 - DNA, 201 bp, Homo sapiens
gatggatcacttgaggtcaggaattcgagaccagcctggccaacatgatgaaaccctatctctactaaaaatgcaaaaattagccaggcatggtggcaccygcctgtaatcccagctacttgggaggctgaggcaggagaattgcttgaatccaggaggtggaggttgcagtgagcagagatcataccattgcactccagt

SEQ ID NO: 58903 - DNA, 201 bp, Homo sapiens
cacaacccatcacacccagctaattttattttttttgtagagatgggggtctcactatgttgcccaggctggtcttgaactcctgggctcaaatgatccayccacctcggcctcccaaagtgctgggataatacctccccagccggaatattttaaagcagtgaaaatgaatggtctacacatagccacatgaatgaatct

SEQ ID NO: 58904 - DNA, 201 bp, Homo sapiens
tccctcacccactggggctgcaccagcactggccccagctcagcttcctgtctcccttatcttcctccagcatgtgctctctggagtaggaaacaccaccrcttgcttccttcatttccctttgctcaacgggaccctcattctttaggtctcagtcaaatcccagctgctggcctggtgcccactctgtgattttctaca

SEQ ID NO: 58905 - DNA, 201 bp, Homo sapiens
ctgtaacctccaactcccaggttcaggcgattctcctgcctcagcctcctgagtagctgggactacaggcatgtaccaccacgcctggctaatatttgtayttttagtacagatggggtttcgccatgttggccaggctggtcttgaatccctgacctcaagtgatccgcccgcctcggcctcccaaagtgctgggattac

SEQ ID NO: 58906 - DNA, 201 bp, Homo sapiens
cagtggctcctgcctataccagaggattgcttgagtgcaggagttcaagaccagcctgggcaacatagcgagaccacatctctagtaaaaataaaaaaaaatagctaggcgtggtggcacagtggcacgtacctttagtctcagctactcgggtggttgaggtgggagaatcacttgagcccgggaggtcaagcctacaat

SEQ ID NO: 58907 - DNA, 201 bp, Homo sapiens
aatatttgtacttttagtacagatggggtttcgccatgttggccaggctggtcttgaatccctgacctcaagtgatccgcccgcctcggcctcccaaagtrctgggattacaggcatgagccaccgcgcccagtctctgagctgggtcttaaatcatgaataaacttcgccaggcagaaaaagggaggcagagcaatcctg

SEQ ID NO: 58908 - DNA, 201 bp, Homo sapiens
tgacaagggctagccagggctggaaatattcactccagagctccctgccagggaggctgggtctttgtcagatctgcattgccgtttgacttctctcttakctcagccctacttcttccccctggtaagcatcttgcacctcaaactctgtctcagcctctgcttccagataacccaacttgtgtgtgtgtgtctctctct

SEQ ID NO: 58909 - DNA, 201 bp, Homo sapiens
actcccctctcctcacagcactgactcttgccttctcatgttcttttccccttggtgggcctcgccccacacctggcaccctctctgcacagtcccctgaycctgactgtctatccacagttcctctgaccatccgctgcttcctgggctgtgagctgcctcccgagggctctagagcccatgtcttcttcgaagtggctg

SEQ ID NO: 58910 - DNA, 201 bp, Homo sapiens
ttttatctttaagagcatgtgttttgtcggccaggcgcggtggctcacgcctgtaatcccagcactttgggaggccgaggcgagaggatcacttgaggtcrggagttcaagacaagcctggccaacacagtgaaaccctatctctactaaaaatacaaaaattagctaagtttggtggcacgcgcctgtaatcccagctac

SEQ ID NO: 58911 - DNA, 201 bp, Homo sapiens
tcggcctccccaagtgctgggattagacgtgagccactgcgcctggtcttctcactcattcttagacccagtgcaatctgacttctctataaactactctragatcaccagtaacctctaattgtcaaaccgtcaccctacatggtatctgcaaatttgcggactagaactctctttttgccttaacttctgagataccat

SEQ ID NO: 58912 - DNA, 201 bp, Homo sapiens
tcgatgcagaaggtgggtgatttctgcatttccaactgaggtacccggtttatctaattgggactggatgggcaatgggtgcagcccacggagggcaagcmgaagcagggtggggcgtcgcatcacccaggaagtgcaagaggttaggggatatcccccctagccaagggaagcggtgagggactgtgccctgggaaatgg

SEQ ID NO: 58913 - DNA, 201 bp, Homo sapiens
cctcggcctccccaagtgctgggattagacgtgagccactgcgcctggtcttctcactcattcttagacccagtgcaatctgacttctctataaactactstaagatcaccagtaacctctaattgtcaaaccgtcaccctacatggtatctgcaaatttgcggactagaactctctttttgccttaacttctgagatacc

SEQ ID NO: 58914 - DNA, 201 bp, Homo sapiens
tccactcatgacccgaactcttcccccaaagaccccaagttcttctctcaaagccccactccttccccgtcacaaccctaactccttcttctcaaagaccscaatttcttttctcaaagcaccaagcaccactccgtcccccttcccccaccatcatggcctttaactcctttctctcctagtcccccaccccaccccctt

SEQ ID NO: 58915 - DNA, 201 bp, Homo sapiens
gcagagcttgcagtgagccgagatcacgccactgcactccagccttggcgacagagtgagactccatctcaaaaaaaaaaaaaaaaaaaaaaatgccaaaygcaatgactggctcacacctgtaatcccaacactttgggaggcagaggcaggaggattgcttgagctcaggggtttgagaccagcctagacaacatagtg

SEQ ID NO: 58916 - DNA, 201 bp, Homo sapiens
ttaacctttatttactccctcttatttatccccatctaccaactacagtatctataaaacacattcactcctttctaccccattgcttttgttcaagataycataattcctctctttctttgtggtaaacatgaaggtgtaccatccagttctacctccaaagaaagacttcctgttggccgggcatgatggttcacgctt

SEQ ID NO: 58917 - DNA, 201 bp, Homo sapiens; identical to SEQ ID NO: 11288

SEQ ID NO: 58918 - DNA, 201 bp, Homo sapiens
agggctagccagggctggaaatattcactccagagctccctgccagggaggctgggtctttgtcagatctgcattgccgtttgacttctctcttagctcakccctacttcttccccctggtaagcatcttgcacctcaaactctgtctcagcctctgcttccagataacccaacttgtgtgtgtgtgtctctctctctttc

SEQ ID NO: 58919 - DNA, 201 bp, Homo sapiens
aaaaaaatagctaggcgtggtggcacagtggcacgtacctttagtctcagctactcgggtggttgaggtgggagaatcacttgagcccgggaggtcaagcytacaattagctgtgattgcttcactgcactatagcctgggcaacagagctagaccctgtctcaaaaaaataataataaattttatatatatatatgagga

SEQ ID NO: 58920 - DNA, 201 bp, Homo sapiens
tcaaatgcaaacacagacaggacccactcacacacacagatttacaaccccggactcatccaaatgtgctctgggcatcaactctgtgccagcctcttttytgggtgtaggaagcagagattaccaagcatggttccatagcctagaggagtccagtgtggcctgtgtgtgtttggagacagccaggtagtatcccgtgag

SEQ ID NO: 58921 - DNA, 201 bp, Homo sapiens
ttacaccttatacaaaaattaactccagatggattaaagacttaaacataagacctaaaaccataaaaaccctagaagaaaacctaggcaataccattcargacataggcatgggcaaagatttcatgactaaaacaccaaaagcaatggcaacaaaagccaaaattggcaaatgggacctaattaaactaaagagcttct

SEQ ID NO: 58922 - DNA, 201 bp, Homo sapiens
aaagggaggcagagcaatcctgacatgctattcatgtgtcagccaaaggcagcatgaggaatcccaactagtttgatatataagcagcgggaagcggccaraaaaggcagcaggggccaggtctctagcagccttgaatgccaggctaaagactctggacttgatcctgtggggaggcagtgtagcagaatggctgagtgc

SEQ ID NO: 58923 - DNA, 201 bp, Homo sapiens
tatgagccaccggacccggcctggaaagcattcctttttaaaccaggaaaatggcaagaatattctcttatattctctatcactttttttttttttttttyctggagacagagtcttgctctgttgcccaggctggagtgcagtggcacgatctcggctcactgcagcctccgcctcctgggttcaaacgattctcctgcc

SEQ ID NO: 58924 - DNA, 201 bp, Homo sapiens
ggctggcggggagaggggtggttggtaaatgggaaaagggtgcttcctttgctgatatccaaagcagatactttctctgcctatttgatgatacaaaactmgccctaccacaccaggctaagggagagaagaggatccgtgtcctacagaattccccctattagcctacctgccccatagcccccaaactctgctgctaat

SEQ ID NO: 58925 - DNA, 201 bp, Homo sapiens
ctgcctggtagagaagataatcccaaaggttatgatattattactctgtaggacattaacccatttagtatttaatttagcaatcttacttcaatattttycttttccattgactataaaaactcaagttcttttttcttttttttgagacaggtctcacattgttgcccaggctggagtgcagtggttcgaacacggctc

SEQ ID NO: 58926 - DNA, 201 bp, Homo sapiens
aaggagcccagtcttttcttgggaagataaaacatacaaaagagaacaacacaaggcaagatgcattgtataactagaagaaacacacaaataaaaatgtkatgttatgtggccgggcatggtggctcacgcctgtaatcccagcactttgggaggctgaggtgggcagttcacctgaggtcaggtgttcgagaccagcct

SEQ ID NO: 58927 - DNA, 201 bp, Homo sapiens
caaaaataaggttttttaaaaaaaaaaaaactgtgacggtaaaaccacctactcaagactcagcaatggtggatgccctacgacacctaggtggcgtagcytactatacccctaggctccttggtatagcctattgctcctaggctacaaacctgtagaacatgttatgatcctgaatactttaggcaactgtaacacaac

SEQ ID NO: 58928 - DNA, 201 bp, Homo sapiens
aggaggcagatgttgcagtgagttgagatcgtgccactgcactccagcctgggcgacagagcgagactccgtctcaaaaaaaaaaaaaaaaaaaaaaaaarggaaagaaagaaagaaaaatgttatgctctgatttactcttgtagctatcatttacatattgctatatagtttttggaattctgtaacttgcgtttatca

SEQ ID NO: 58929 - DNA, 201 bp, Homo sapiens
tatgtgttttgtcatcagacttaagttttacttctttgaactagaaatttaacttcttcaagtctcagttttttttttttttttttttttttttgagacgragtctcgctctgtcgcccaggctggagtgcagtggcgggatctcggctcactgcaagctccgcctcccgggttcacgccattctcctgcctcagcctccc

SEQ ID NO: 58930 - DNA, 201 bp, Homo sapiens
gaaaaaaaggcagcagccccagtcagggacttacagataaaacccctggccagcacggtggctcacgcctgtaatcccagcactttgggaggccgagacgrgtggatcatttgaggtcaggagtttgagactagcctgactaacatggtgaaacaccatctctactaaaatacaaaaaaaatgagccaggcgtggtggcag

SEQ ID NO: 58931 - DNA, 201 bp, Homo sapiens
aaattagccagctgtgttggtgagcgcctgtaatcccagctacttgggaggctgaggcatgagaattgcttgaacctgggaggtggaggttgcagtgagcygagatcatgccactgcactccagccagggtgacagagcgagactctgtctcaaaagaaaaaaaaaaaaaaaaaagaaatacccaattctttcacagaaaa

SEQ ID NO: 58932 - DNA, 201 bp, Homo sapiens
ctcattgagttaaattcagaatcctcaaaatgacattcaaggccttgcacaatgtggccccaacctaattttctaatttaattttaattttattttatttwattttattttattttgagatggagtctcactctgtcacccaggctggagtaaagtggtgcgatctctgctcactgcaacctccacctcctgggttcaagc

SEQ ID NO: 58933 - DNA, 201 bp, Homo sapiens
tagtttatgaagggtcgagaaggcgggcggccagcctcgaggtagggggttattatcttccgctgcccgccgccccctcccacgccggcccaggctgaagytgactctgcccgcaggcctccaaagacttcatatgctccagatctcctacttccgcgacccctatcacgtgtggtaccagggcaacgcgtcgctgggggg

SEQ ID NO: 58934 - DNA, 201 bp, Homo sapiens
tgccactgcactccagcctgggcgacagagcgagactccgtctcaaaaaaaaaaaaaaaaaaaaaaaaaaggaaagaaagaaagaaaaatgttatgctctsatttactcttgtagctatcatttacatattgctatatagtttttggaattctgtaacttgcgtttatcatttaatactctctttggtcttgtaagataga

SEQ ID NO: 58935 - DNA, 201 bp, Homo sapiens
acattggctatgattatttttgattaatgaaggggagggggttatggcactggaagattttaagtaggaaaaggacatgatctcatccctgggtcaggtgraggtcggaatagagaacggggagatgaagtagaaagttactaccccagtctagatgagacggatgaatcctgaatcagggcagtggaagaggagatggag

SEQ ID NO: 58936 - DNA, 201 bp, Homo sapiens
ataagcactgaatcgacattggctatgattatttttgattaatgaaggggagggggttatggcactggaagattttaagtaggaaaaggacatgatctcayccctgggtcaggtggaggtcggaatagagaacggggagatgaagtagaaagttactaccccagtctagatgagacggatgaatcctgaatcagggcagtg

SEQ ID NO: 58937 - DNA, 201 bp, Homo sapiens; identical to SEQ ID NO: 11287

SEQ ID NO: 58938 - DNA, 201 bp, Homo sapiens; identical to SEQ ID NO: 11289

SEQ ID NO: 58939 - DNA, 201 bp, Homo sapiens
agggactgtgccctgggaaatggtgcactacggcccagatactgcgcttttcccaaggtcttcgccacctgtagaccaggagattccctctggtgcctacrccaccagggccctgggtttcaagcacaaaactgggcggccatttgggcagacaccgagctagctgcaggagttttcttttttttttttcataccccagtg

SEQ ID NO: 58940 - DNA, 201 bp, Homo sapiens
aggcgtgagctgccgcccctgccccagcctcaccccctgttttttttttctattacagttgaacaaggcctgacaattcccttttttcatcacagtccctrgccccttctttcttagcctctaacaggctaaccccaaacccctcctcacagccccaggcccttctccccatagttccctgacctagactcccctctcctc

SEQ ID NO: 58941 - DNA, 201 bp, Homo sapiens
cccaatttcttttctcaaagcaccaagcaccactccgtcccccttcccccaccatcatggcctttaactcctttctctcctagtcccccaccccacccccytttttttttttttttttttttttgagacggagtcttgctctgtcgtccaggctggagtgcagtggcgcgatctcggctcactgcaacttccgcctcccgg

SEQ ID NO: 58942 - DNA, 201 bp, Homo sapiens
acagaaaaccaaacactgcatgttatcactcataagtgggaggtgaacaatgagaacacatggacacagggaggggaatatcacataccagggcctgtcarggggtagggggctaggggagggatagcattaggagaaatacctaatgtagatgacgggttgatgggtacagcaaaccaccatgacaagtgtatacctgcg

SEQ ID NO: 58943 - DNA, 201 bp, Homo sapiens
ttggccgggcatgatggttcacgcttgtaatcgcagcactttgggaggccgaggtggggggatcacctgaggtcaggagttggagaccagcctggccaacrtggcgaaaccctgtctctactaaaaatacaaaaattagccgggcgcggtgatgcacgcttgtaatcccagctactagcaggggctgaggcaggagaatct

SEQ ID NO: 58944 - DNA, 201 bp, Homo sapiens
ccgtcacaaccctaactccttcttctcaaagaccccaatttcttttctcaaagcaccaagcaccactccgtcccccttcccccaccatcatggcctttaaytcctttctctcctagtcccccaccccacccccttttttttttttttttttttttttgagacggagtcttgctctgtcgtccaggctggagtgcagtggcg

SEQ ID NO: 58945 - DNA, 201 bp, Homo sapiens
agtgaactgctttacactcattttatgactacttctgagaccaagatcccggattatgtaattgttatttacttaaaattctggtaaaatgtagccattayactggaaaactaaattttaatcttggatctgtcaccaccatgatatataaactttgggcaagtccctgcacctctctggacctcaatctccccatcagca

SEQ ID NO: 58946 - DNA, 201 bp, Homo sapiens
cgaacacggctcactacagtcttgacctcccacatcccaggctcaagtgatcttgcctcagtccctcaagtagctgggactataggcatgtgccaccatgsccagctaatttttgtatcttttcgtatagacggggttttgccatgttgcgcaggctggtctcaaactcctggctaagcgatccacccaccttggcctccc

SEQ ID NO: 58947 - DNA, 201 bp, Homo sapiens
gactggtcttgaactcctgacttcaagtgatccatccactttggcctcccaaagtgccgggatttacaggagtgagccactgcgcctggccaagaattacrtttttaacatgctgacagttgtccttgacactaagtgtcagaccctggattaagtaatttatagacccatgatactcctttgagatagtttttgtcccca

SEQ ID NO: 58948 - DNA, 201 bp, Homo sapiens
ctaaaaatacaaaaattagccaggtgtggtggcaggtgactgtaatcccagctacttgggaggctgaggcaggagaatcgcttgaatctgggaggtggagkttgcagtgagccgagatcacgccactgcattacagcaagactccatctcaaaaaaaagaaaaaaaaaaagaaaaaagaaatgtttcataatttttaataa

SEQ ID NO: 58949 - DNA, 201 bp, Homo sapiens
accctggattaagtaatttatagacccatgatactcctttgagatagtttttgtccccattttccagatgagaaagtgaaggcacaaaaagataaaagaawttttctcagtgccagttttgtgccaggagctttactaagttacagtttttttctccttccctcgaagtcctgtttatctattcattgattaaaaaaaaaa

SEQ ID NO: 58950 - DNA, 201 bp, Homo sapiens
cctgtgagtaggcgcgcagcgggggcggggtctgggcggggctagtgggggcggggcctggcgggtgggggcggggcctggcggatggaggcgggctgggrcttgcagggacccggcagccactggagctcggtggcgcctgggcctttgaagattgctgggtgggggctggagagaggcagttgtccccgctaagaaagc

SEQ ID NO: 58951 - DNA, 201 bp, Homo sapiens
caaaacttcatcaacgtgataaaaaagattccaaaatttaggtgtagacgttcaaatattcaaaaatagctaagacactcttgaagaacaaagaggaaagrcttgatctacaagatataaatacattatgaaataatactaatcgagggccaggcactgtggctcacgcctgtaatcccagcactttggaaggccaaggca

SEQ ID NO: 58952 - DNA, 201 bp, Homo sapiens
tggtggaaatgtaaaatccaagtcatatggcagtgatcaattattaatcaattaataatattaataaatttcttatatttaaggcattgttatctcctccmctttgcaaaatttctggaaaagtaacctatacccatttcttctgcttccttatttctcactcattcttttttttttttttttttttttttgagacagagt

SEQ ID NO: 58953 - DNA, 201 bp, Homo sapiens
caaagtgctgggataatacctccccagccggaatattttaaagcagtgaaaatgaatggtctacacatagccacatgaatgaatcttattaatacattaartgaaaaaagcaaaaggtacagaggaatacatacattttaataccatttatataaagctcaaaatatgtgaaataccactatctattgtttagggatatat

SEQ ID NO: 58954 - DNA, 201 bp, Homo sapiens
catcttgcacctcaaactctgtctcagcctctgcttccagataacccaacttgtgtgtgtgtgtctctctctctttcaaaattgagaaattttctcaatcytgtctggaccatggcagcagcctcctcctaagaaattgcctctaatttctccatattttaattcatcttctacatggcagtaagaaacacagatctaatt

SEQ ID NO: 58955 - DNA, 201 bp, Homo sapiens
agtctcactctgtcacccaggctggagtaaagtggtgcgatctctgctcactgcaacctccacctcctgggttcaagctattctcctacctcagcctcccragtagctgggattgcaggcatgtgccaccacgcccggctaatttttgtatttttagtagtgacggggtttcaccatgttggtcaggctggtcttgaactc

SEQ ID NO: 58956 - DNA, 201 bp, Homo sapiens
atagcttccgcttgcttcagttctttcaatgtctgcctcagctgtagaggacagtcctgcacaagatcatgcccatcccagggctgccctcactcggtgcytaagcaaggcaggggtataaaagttcggtcattttggccaactgcaggacaactctgagaataggttggattgacaagggctagccagggctggaaatat

SEQ ID NO: 58957 - DNA, 201 bp, Homo sapiens
cattgcttttgttcaagatatcataattcctctctttctttgtggtaaacatgaaggtgtaccatccagttctacctccaaagaaagacttcctgttggcygggcatgatggttcacgcttgtaatcgcagcactttgggaggccgaggtggggggatcacctgaggtcaggagttggagaccagcctggccaacatggcg

SEQ ID NO: 58958 - DNA, 201 bp, Homo sapiens
tctaaaaaaaaaaaaaaaaaaaaaagagtatgtgttttgtcatcagacttaagttttacttctttgaactagaaatttaacttcttcaagtctcagttttktttttttttttttttttttttgagacgaagtctcgctctgtcgcccaggctggagtgcagtggcgggatctcggctcactgcaagctccgcctcccgggt

SEQ ID NO: 58959 - DNA, 201 bp, Homo sapiens
atgagccaccggacccggcctggaaagcattcctttttaaaccaggaaaatggcaagaatattctcttatattctctatcacttttttttttttttttttytggagacagagtcttgctctgttgcccaggctggagtgcagtggcacgatctcggctcactgcagcctccgcctcctgggttcaaacgattctcctgcct

SEQ ID NO: 58960 - DNA, 201 bp, Homo sapiens
ccaatttcttttctcaaagcaccaagcaccactccgtcccccttcccccaccatcatggcctttaactcctttctctcctagtcccccaccccaccccctyttttttttttttttttttttttgagacggagtcttgctctgtcgtccaggctggagtgcagtggcgcgatctcggctcactgcaacttccgcctcccggg

SEQ ID NO: 58961 - DNA, 201 bp, Homo sapiens
tcatcacagtccctggccccttctttcttagcctctaacaggctaaccccaaacccctcctcacagccccaggcccttctccccatagttccctgacctaractcccctctcctcacagcactgactcttgccttctcatgttcttttccccttggtgggcctcgccccacacctggcaccctctctgcacagtcccctga

SEQ ID NO: 58962 - DNA, 201 bp, Homo sapiens
tgaatccaggaggtggaggttgcagtgagcagagatcataccattgcactccagtctgggcaacagagcgagactccatctcaaaaaaaaaaaaaaaaaaagaaagaaagaaaaggaaagaaagcccttgatgtaatgagctctgtgtaagataatgtggatgaaagtggacccagaccctacccgcttagatggaaggct

SEQ ID NO: 58963 - DNA, 201 bp, Homo sapiens
cagcccccagcacttcaccccccaccctccagccacttctcatacaagctgatgacttcgctcttagctccactcatgacccgaactcttcccccaaagamcccaagttcttctctcaaagccccactccttccccgtcacaaccctaactccttcttctcaaagaccccaatttcttttctcaaagcaccaagcaccact

SEQ ID NO: 58964 - DNA, 201 bp, Homo sapiens
atcgacattggctatgattatttttgattaatgaaggggagggggttatggcactggaagattttaagtaggaaaaggacatgatctcatccctgggtcargtggaggtcggaatagagaacggggagatgaagtagaaagttactaccccagtctagatgagacggatgaatcctgaatcagggcagtggaagaggagat

SEQ ID NO: 58965 - DNA, 201 bp, Homo sapiens
gaccaaaggtagataaatccatgaagatggggagaaaccagcacaaaaaggctgaaaattccaaaaaccagaatgcctcttctcctccaaaggatcacaaytccttgccagcaagggaacaaaactggaaacagagaatgagtttgaagaattgacagaagtagacttcagaaggtgggtaataacaaactcctccgagct

SEQ ID NO: 58966 - DNA, 201 bp, Homo sapiens
gcttgaatccaggaggtggaggttgcagtgagcagagatcataccattgcactccagtctgggcaacagagcgagactccatctcaaaaaaaaaaaaaaaraaagaaagaaagaaaaggaaagaaagcccttgatgtaatgagctctgtgtaagataatgtggatgaaagtggacccagaccctacccgcttagatggaag

SEQ ID NO: 58967 - DNA, 201 bp, Homo sapiens
ccaggaggtggagcttgcagtgagctgagattgcaccactgcactccagcctggacgacagggcgagactccgtctcaaaaaaaaaacaaaaaaaaaaaaacaggtttgttcaatccgctggaaagggggctgaagccagggagccaagtggtctggctccatgggtcccacccccacagagctcagcaagctaagatcca

SEQ ID NO: 58968 - DNA, 201 bp, Homo sapiens
accttttgacatcctgggctcaagccatactcctgcctcagcctcccaagtagatgggaccacaggtgtgtactaccatgcctggctaatttaaaaaaaawttttttgtagagatggagtctcatatgttgccatgctggtcactaatttacaggcatgagccactacacccaggcagctttattttatttatttttttgt

SEQ ID NO: 58969 - DNA, 201 bp, Homo sapiens
tgggtttagaatgagaaaaggctcaagttgcccccctcccaacttccctacccgcaacactctttttattttctctgttcccagctccatacttccatgcytttttttttttttttttttttttttgagatggagtcttgttctgttgcccaggctggagtgcagtggcaggatctcggcttactgcaacctccacctccc

SEQ ID NO: 58970 - DNA, 201 bp, Homo sapiens
ttgatcctgtggggaggcagtgtagcagaatggctgagtgctggacttgactgcctacgtgcaaaccttggctctgctacactatctctgtctcagtttcvcatgtagactggggttaataatagtagctattgcattaagccactggggaaaggcacaaagataataatgtatgtaaagcccattgcccaggttataata

SEQ ID NO: 58971 - DNA, 201 bp, Homo sapiens
agagattaccaagcatggttccatagcctagaggagtccagtgtggcctgtgtgtgtttggagacagccaggtagtatcccgtgagatacacactaatatrtggtggtctgggatcactgaaacagacacactgtgtctcgtggggcatcagaaaaaaatttccaagaagagggcaactgagctgggtctttttttctttg

SEQ ID NO: 58972 - DNA, 201 bp, Homo sapiens
gcggagcccgcagccggcccgagccaggaacccaggtccggagcctcaacttcaggatgttgacaacattgctgccgatactgctgctgtctggctgggcyttttgtagccaagacgcctcagatggtgagtcgggggcacatctcctgcctcaggatggttctggagaatctcagtctatctgggcacatggcaagacca

SEQ ID NO: 58973 - DNA, 201 bp, Homo sapiens
agatttatacagattgctcataattctctcctattttttaaaaacatgctgcagtgaactgctttacactcattttatgactacttctgagaccaagatcycggattatgtaattgttatttacttaaaattctggtaaaatgtagccattatactggaaaactaaattttaatcttggatctgtcaccaccatgatatat

SEQ ID NO: 58974 - DNA, 201 bp, Homo sapiens
ccccgggctctgctagaaagtgccggggtccagattcctttcaggtgactgggttgggaggagaagtcgctcagcgtaattgtcggagccgaaataaacaragactccgcggccgggcgggaccttacccggaagtcccccagaacagcactacccttcgctgaaacctcgcccgccccctccaacccagagacgaaaagg

SEQ ID NO: 58975 - DNA, 201 bp, Homo sapiens
ttgaagatgaactaaatcgtgaaagtgacagtgatgtcttcaccgttgtaattagctatgccatcatgtttctatatatttccctagccttggggcacatsaaaagctgtcgcaggcttctggtaagccggggggggggtggtgtatgttctagaggttaacagcagtgcacagtgtaacgtcatatttttgcctctttat

SEQ ID NO: 58976 - DNA, 201 bp, Homo sapiens
tgtgaagggcatcagctctccagtcaaattgaactgcttgctagcaaaatcctgcccatcttccagggccccatttcacatgctacattatctacgacatycttgtcctgttcccctaactagaatgccttccctctgaagttctgaatctttatttaaactgctgcaacagcatttgctgcctcattaaaagaccttggt

SEQ ID NO: 58977 - DNA, 201 bp, Homo sapiens
ttcgtttcctcagtggggttgcagcagtgggtgaggtggtgtgccagtgccgaggacacggctgcgaccaaggcagacatggtccttgcctttgtggcccyaccatctagtcagggtggcacagcagaaccaagtaattaatcatagctggggaggcgcgaaagcagcaggacaagagtgggaatagcagggcagggttga

SEQ ID NO: 58978 - DNA, 201 bp, Homo sapiens
actagaggctccccaaggactggctattctaaccaacacagtaaaagtctgtcattacaagaagtggtttcgtcatgcaggtaaagaccccaacttgaccktacacttcccattccaactaataatgtcaggagtcactcagcattctgagtcagggaggcagacctgtcttagcatatgagtcatcttctaagacagtga

SEQ ID NO: 58979 - DNA, 201 bp, Homo sapiens
tggtgtgcgtctgcagtcccacctacttgttaggctgaggcaggaagcttgcttgagcccagaagggtgggcttaggatgcagtgagtcgtgttcataccrctgcactgcagcctgaggaagaaagcaaagagcccatctccaaaagagagggagagagatgtggtctcactctgttgtccaggctggtctcaagcaattc

SEQ ID NO: 58980 - DNA, 201 bp, Homo sapiens
agccaggtgaagtggtgtgcgtctgcagtcccacctacttgttaggctgaggcaggaagcttgcttgagcccagaagggtgggcttaggatgcagtgagtsgtgttcataccactgcactgcagcctgaggaagaaagcaaagagcccatctccaaaagagagggagagagatgtggtctcactctgttgtccaggctggt

SEQ ID NO: 58981 - DNA, 201 bp, Homo sapiens
caactttttggtttatcttaaagtttatttcacataatccagttttttcttatttgtccagtccatcacctaagaatgcaaactcataacatgtgttgccsgagcagacctagaaatgtttacaagtcctctctgaaacacagaattgtacattcaactctaggtttaatacagccctgtaaagtaaaaaggaggaccttt

SEQ ID NO: 58982 - DNA, 201 bp, Homo sapiens
aagaagccagacagcctgggaaggagattcttaaagctgttaaaatgtatctaaaaaaaaagcaaaagcaaatgtggaacagtagataaaatgtttttccygtgagcttttatcagtccatataaacaagagttttaagttttttattttgaaatagtttcagattcacagaaagttgcaaagaaacttttatttttcctc

SEQ ID NO: 58983 - DNA, 201 bp, Homo sapiens
ctgttaaaatgtatctaaaaaaaaagcaaaagcaaatgtggaacagtagataaaatgtttttcccgtgagcttttatcagtccatataaacaagagttttmagttttttattttgaaatagtttcagattcacagaaagttgcaaagaaacttttatttttcctcttaataatgaggaaatagaagccaagagaggtgaag

SEQ ID NO: 58984 - DNA, 201 bp, Homo sapiens
cacacttaaggaaacaccatctggggacacagggagaaggtgctgtctacaagccaggaagagagccctcaccaggaaccaaataagctccccatgctgawcttgaactctctaacctctagaactgtaacagataaattcctattgtttaagtcacaccagtctttggtattttgtgcaatggcctcagacgtcactaaa

SEQ ID NO: 58985 - DNA, 201 bp, Homo sapiens
ggacaggaagttcattcttgctctttacattggggtgttgatgtttgtggttttgttgttttgttcttcatgttactcatgatgtattgatattaattaamctaaatacatatggaaatattctttcattacttagagcttatatagttcctggtgcagatgtgcaaaaatagtgctttagtaattgctaagtcactatct

SEQ ID NO: 58986 - DNA, 201 bp, Homo sapiens
acaaaataaataaaatcacagattgcatttaggtacttccatacattgctggctgcaatttctttggagggcaatttgacaacaatcaaaacttaaatacscatttcctttgatccaacaatataaaagtatttccaacagttctatttgcgcatgattgcaaagatttacatccaagaatgggccaggagtggtggctca

SEQ ID NO: 58987 - DNA, 201 bp, Homo sapiens
cctgctccaggtgtgatcccaggtgcaatccagctcaacaagcacactgagcctcaggagctcttgggatcagaacccaggactcgatcccactccgtgcygccttctcacccacccctcttccaccaagtgggtggaaatagcacttgctttgaaataagtaacgaatgatctttgtgaaaaggaacctaaacagcagtg

SEQ ID NO: 58988 - DNA, 201 bp, Homo sapiens
tgcatagagtatctgagaaaatgaggcatgcagtcgatgtttggtatttttgtttcatttatttattttactgccatgcctcgagaacaatagatgttcaktaagtatttgaatatgttagttaatgctttaggatttcctaaaggcagtggaatagaattctcactgagttcagagcttttctgataataatgtgtgctt

SEQ ID NO: 58989 - DNA, 201 bp, Homo sapiens
ctaacctttaaaaatagaaactctttagctgtgtaactactaaattctgggtagaagccaaaacaatcagcacttctcatttctgaacttagataatccarttgtactccctcagctcattgtgagttttgacaagttctgcatccatgaacaccagatgtaatacaatagggaatttcaaaggaaggattacacacctag

SEQ ID NO: 58990 - DNA, 201 bp, Homo sapiens
tctgggtggtcagtggccatgagaggtcaagtgagttgctttcggtgagtcttgtagacagccagcaaggttttctgcaagggatgtttcccaaaggagtytgaccacttggcagtggtgacaggatgaacacgcagtgttcgggagtgagagcgagctttaatgaggcctcccctctcccctccagtgtgttttatgtct

SEQ ID NO: 58991 - DNA, 201 bp, Homo sapiens
tccttttacttctatggccacttcaccttgcacaaaaatgacccacggttgaaagaacaatactgatttgcttcatttatagctttgtcactaaattgaascactgaagtagaagattaagaaaatgaggggctttttatcatctccgggggatagaaagtagttctattacaatctaatatactagttccttttaagaaa

SEQ ID NO: 58992 - DNA, 201 bp, Homo sapiens
ctcacgcctgtaatcccagcactttcggaggccgaggcgggtggatcacaaggtcaggagatcgagaccatcctggctaacacagtgaaaccctatctctrctaaaaatattctttaaaaaattagctgggtgtggtggcaggtgcctgtggtcccagctactcgggaggctgaggcaggagagtggtgtgaacccgggag

SEQ ID NO: 58993 - DNA, 201 bp, Homo sapiens
gggcacgactacacttcttccaaggggcagaacatggtgtgcggcggcatgggctgcaacaatgattccctggtgcagcagatatttaacgcggcgcagcyggacaactagtcagtaccaccttgtcttgtacttcagaagcagcggaggaggctctcagccaggcagtcagctcaggcctgaaatgtctcactgaaaata

SEQ ID NO: 58994 - DNA, 201 bp, Homo sapiens
atgttgatagttgaaaatggcatccttgagtagccactgaatccttctccacatgacactctaagcagcagctcccaaatccacaggcactcgcttacaaratgtttgccgttgttttcaaaggcagtctttctcttctgtgcacacaactcattggggaagcagccttgttaatgaccagaagctcttgactcaccacat

SEQ ID NO: 58995 - DNA, 201 bp, Homo sapiens
tttagtaacattatcccacattaaggttgcgattcttttagcctcgtcatgctccttgccagcccatccatgtatagggttatgggctatctcactccccsatccagccaggcagccagttacccacggaagccagatatatggcccaaaaatagtgatgatgaccggaagtctctggccttgatttggaagctttgggag

SEQ ID NO: 58996 - DNA, 201 bp, Homo sapiens
gtcttcaccgttgtaattagctatgccatcatgtttctatatatttccctagccttggggcacatcaaaagctgtcgcaggcttctggtaagccggggggkgggtggtgtatgttctagaggttaacagcagtgcacagtgtaacgtcatatttttgcctctttattcttattccattatgtttaaaactgccataaattc

SEQ ID NO: 58997 - DNA, 201 bp, Homo sapiens
aaagaccccatctctacaaaaaatttttaaaattagccaggcatggggatacgtctctgtagtaccagctactcaagaggctaaggcaggaggatcccttmagctgaggagttcgaggctgcagtgagctgtaatagtgccactgtactccagccgaggcaacagagagagactctatttcaaaacaggaacaaaagcaaa

SEQ ID NO: 58998 - DNA, 201 bp, Homo sapiens
caggggagaagttgcaatctgtatttaaaatttactgtgcatcagagaggaaaatgccatttctaattgttggagaagggatggtgtcagcaactgactarccataggggaaacaattgactttgatctctgacttgttcatttcaccaaaataaattccagatggataaaagattgaaatgtaagaactgggccaggcgt

SEQ ID NO: 58999 - DNA, 201 bp, Homo sapiens
ctttggagccggggatgtggaggttgcagtgagctgagatcatgtcactgcactccagcctgggagacagagcaagactctgtctcaaaaaaaaaaaaaaraaaaaaggaaaaggaaagataaatttataatgtattgccaggaccacacaaacccttcatatgtaccaggaatgcaagtagaggaattgagttattttga

SEQ ID NO: 59000 - DNA, 201 bp, Homo sapiens
acttactgttccacctgcttcctgtttctttgccgtttccagaccttccactttgccacgcaagctatctttgtaaaacagctcatgacatttctttcccrgaaatctctaattgttccccagtgcctccagaataaaaatccaaactacttaactggcactgagtccttttattttgcatttgtctgtccattactcttc

SEQ ID NO: 59001 - DNA, 201 bp, Homo sapiens
aactgcaccattttgagtgtgttaaattacttccagaacagccattccgtgctggaccacaagaaaggggacgacttctttgtgtatgccgattaccacaygcactttctgtactgcgtacggtaagtggcaagagacaatcattggtagacaccattcttgggtctgacttagggtacatgggcaaaagcttgttttatg

SEQ ID NO: 59002 - DNA, 201 bp, Homo sapiens
tgtcatggtatatcttgaaaatcttagcgtataatggcaaagctgcctttaagttaggtttcaagaaagtgaatgatgttgaacttaatggaatatttatkgttgctcacttttgtatttacttcagatagtagaccttgcctttttcttgaaattgagatgagcagagaaagaagacttcagtggcgtttctctattgag

SEQ ID NO: 59003 - DNA, 201 bp, Homo sapiens
gataaatacatatatcaaacgcatggctcaaaaatgacaacgcgtcttctttatctgccttcacgtagaacttaaaacagaccctggtccccacctcgggrtttcctcgcgcccacgggctgcgctgcgcagctgggccagcaggtggcgaggctcccgcactttttttcccgggcctggccgcaccgccaccgcccaccc

SEQ ID NO: 59004 - DNA, 201 bp, Homo sapiens
cacacctgtaatcccagcactttaggaggccaaggcaggagaatcatgaggtcaggagtccattgcaaacagccctggcgacagtgcgagactgtgtctcmccaaaaaaaaaaaaaaaaaaaaaaaagtcagagtcaaatgagcgaaatcagattcaaatctaattaaatggagtactatagtccttttagatatttgcat

SEQ ID NO: 59005 - DNA, 201 bp, Homo sapiens
cattattcagcgaaattaacgaggatctaaataaatggaaagacattccatgtttatcaatcaaaagacttaatattgtttagatatcagtattctccaarttgttttatagattcagggcaatctctgttataatcccaactgacttctttgtggaaattgacaagctgattctgaaattcacatagaagtttgagggac

SEQ ID NO: 59006 - DNA, 201 bp, Homo sapiens
ctgaccacttggcagtggtgacaggatgaacacgcagtgttcgggagtgagagcgagctttaatgaggcctcccctctcccctccagtgtgttttatgtcytctacgaacagtacctgaccatcattgacgacactatcttcaacctcggtgtgtccctgggcgcgatatttctggtgaccatggtcctcctgggctgtga

SEQ ID NO: 59007 - DNA, 201 bp, Homo sapiens
tttactaagcagtctctgtcttatgattcatttgttgttccagatagcaatatttgtgggtgttctgtcattcagcatcgcagtcctgaacaaagtagatrttggattggatcagtctctttcgatgccagatgtaagatgacttccttttttttttttttttaacttctttagctgatgatgaatacatttttcaaaaca

SEQ ID NO: 59008 - DNA, 201 bp, Homo sapiens
attggtgattgtgtctgtcgcctctctcaggtggattcgaaggtctcactaggcatcgcgggcatcttgatcgtgctgagctcggtggcttgctccttggktgtcttcagctacattgggttgcccttgaccctcattgtgattgaagtcatcccgttcctggtgctggctgttggagtggacaacatcttcattctggtg

SEQ ID NO: 59009 - DNA, 201 bp, Homo sapiens
actacacttcttccaaggggcagaacatggtgtgcggcggcatgggctgcaacaatgattccctggtgcagcagatatttaacgcggcgcagctggacaaytagtcagtaccaccttgtcttgtacttcagaagcagcggaggaggctctcagccaggcagtcagctcaggcctgaaatgtctcactgaaaatagactttc

SEQ ID NO: 59010 - DNA, 201 bp, Homo sapiens
gatcacgccactgcactccagcctgggctacagagcaagactctgtctcaaaataaaaaaaaaaagaagccagtctgggagagaacaagctaaacctttgstgttcccttatctgggggccttcttcatccctgaaatgtacagctgggtctgacctctgagtccagggtcaggtgattttgcttagcctcaagtgctcag

SEQ ID NO: 59011 - DNA, 201 bp, Homo sapiens
gctacagataatttagtcttgggtcaactttctcctctccctctacaagggaaatgttcaaaagtgtttagactttggtgatgcagcatgattgggaaagyagagggcacagaaagatgccaggctttgtggtctccaggcaagctcaggaatgtgacaaagcataccgaaaagaaaagcgggctgggagcagtggctcac

SEQ ID NO: 59012 - DNA, 201 bp, Homo sapiens
ccacttgtttaaaacgtttgtatattatattcacatatgtatgctttccactacatagaagttttctggaaggtatttctgcacatttataaagatgcacrtctaataatttcatttccccccattttctacttattgctctgaggtcaacactgaatagtccttatgaagatggtattgaatattctttcaacaaaaaag

SEQ ID NO: 59013 - DNA, 201 bp, Homo sapiens
tctcatctataacagtagaccaaggatctacaggcaagatcaaacacagatgggaaaaacaaaaacagtgaaggtatgaagtgagatgcagccgccagctmgtgggatgcagggaccctgaatttactactcctccactatcccccactactgccaccttgccctatggcaggcggcaaatctcagcgaccttattctaat

SEQ ID NO: 59014 - DNA, 201 bp, Homo sapiens
gttcaattacaggttggtaaaagtggtttctaacacagtatctcttcttttaggtgttcagtggaatcacacttacaaaatttggagggattgtggtgttsgcttttgccaaatctcaaattttccagatattctacttcaggatgtatttggccatggtcttactgggagccactcacggattaatatttctccctgtct

SEQ ID NO: 59015 - DNA, 201 bp, Homo sapiens
ccagctttatcttacatattccctgtccctgccctgcaaggagctctggttccttttattggagaatggtatgtagaaacgaagatctgggcactaggtaygctcattgctgctggaaagagtagcatgtttttgtttgtttgtttgtttttttgagatggagtcttgctctgtcaccaggctggaatgcagtggcgcgat

SEQ ID NO: 59016 - DNA, 201 bp, Homo sapiens
atattttgttcctcctgaaactcaaccactgattttagcattcattgttgggtcttgtctgcaacagttataactaaggtgtttgcctgatagtgattttyttctctttccctctcttcctctgcatttactaactggacttctgtacagaaagctatcccttctccctcatttatttactcagttatttacatcatggac

SEQ ID NO: 59017 - DNA, 201 bp, Homo sapiens
aatatcttgggggaagatgctttgagactatactaatattttgttcctcctgaaactcaaccactgattttagcattcattgttgggtcttgtctgcaacmgttataactaaggtgtttgcctgatagtgatttttttctctttccctctcttcctctgcatttactaactggacttctgtacagaaagctatcccttctc

SEQ ID NO: 59018 - DNA, 201 bp, Homo sapiens
tacttagaaaattgcaccccgccccaggagctctccgaccagtgccttttgcctcctatgtggttatcaggtacttttaatcattaaagatgagagcactygagaaggtattcatggaaaatagaacagtgtatccgtactctcagatatgagccctgcttcagataggggagcactgaggtccaagaaaagaagttgtga

SEQ ID NO: 59019 - DNA, 201 bp, Homo sapiens
gcccctcactgtcagtattttaaaatgttttacaaaaaatctggagacctattcttctaacagtcctccctgcatgtctccgccagtggttgaccctgccygcgttcgctgcaggcctctgactccggaaggcaaacagaggcctcaggggggagacttcatgagattcctgcccatgttcctttcggataaccctaaccc

SEQ ID NO: 59020 - DNA, 201 bp, Homo sapiens
gcaaaatatcgcaaggacaaaaaaccaaacaccgcatgttctcactcataggtgggaattgaacaatgagaacacatggacacaggaaggggaacgtcacrcaccggggactgttgtggggtgggggcctgggggagggatagcattaggagatatacctaatgctaaatgacgagttaatgggtacaacacatcaacatg

SEQ ID NO: 59021 - DNA, 201 bp, Homo sapiens
tggtgttggcttttgccaaatctcaaattttccagatattctacttcaggatgtatttggccatggtcttactgggagccactcacggattaatatttctycctgtcttactcagttacataggtaagagttctcatcttaaaagggtggcacaatagaaggacattactgaaagggaattctatcctgaggcattctttt

SEQ ID NO: 59022 - DNA, 201 bp, Homo sapiens
accatgcctgcatgcctgactaatttttgtatttttagtagagacggggtttcaccgtgttggccaggctgatctccaactcctgacctcaggtgatctgmccgccttggcctcccagagtgctgggattacaggagtaagccaccgtgcccagccggccactcattctttagaaagtcagagtcaaggccaggctcagtg

SEQ ID NO: 59023 - DNA, 201 bp, Homo sapiens
ggctcaaggaatcctccctcggcagcctctggagtagctggggccacaggtgtataccaccaaactcagctaattttttttttttttttttttttttttgkagagacagggttttgccatgttgtcgtccaggctggtctcgaactcctaggctcaggcaatcctcctgcttcagcctcccagagtgctgggattataagc

SEQ ID NO: 59024 - DNA, 201 bp, Homo sapiens
ccagccaactagctccctttctcctgcagaaataagaaaaagtctctctctctcatagggccatcagtaaataaagccaaaagttgtgccactgaagagcratacaaaggaacagagcgcgaacggcttctaaatttctagccctctcgcagggcatcctgactgaactgtgtctaagggtcggtcggtttaccactggac

SEQ ID NO: 59025 - DNA, 201 bp, Homo sapiens
acaactgtagcctcctgggctcaagcaatcctcctgcctcagcctccttagtagctgagactacaggtgtgtgccactatgcccagctaacttaaaaaaawttttttttttgtatagagggagtcttgctacattgccctggctgagaatttacatttctaacaagttccaaggagatgctcctgctgctggtctggggat

SEQ ID NO: 59026 - DNA, 201 bp, Homo sapiens
agctgccaagactgctctattgtctgtggccccaagccccagcccccacctcctcctgctccctggacgatccttggcttggacgccatgtatgtcatcakgtggatcacctacatggcgtttttgcttgtgttttttggagcattttttgcagtgtggtgctacaggtaagcagttttgtttgtcatccagggcaaaaag

SEQ ID NO: 59027 - DNA, 201 bp, Homo sapiens
agtgggggcaccaggagctggagcctggggagtgggaagcgagagcacagagctgactgaggaccacgaggtcgtcgtggaggacctaggctgaaggtccygaagaaatccccatagtttcactgccaggccagccaggtggacatctcagggctgaggaggtgagaaggcaagacagaaagtgaaacagcactttatagg

SEQ ID NO: 59028 - DNA, 201 bp, Homo sapiens
ttctgtagattttccagtccatgggatggagcccatgaacaatgccaccaaaggctgtgacgagtctgtggatgaggtcacagcaccatgtagctgccaavactgctctattgtctgtggccccaagccccagcccccacctcctcctgctccctggacgatccttggcttggacgccatgtatgtcatcatgtggatcac

SEQ ID NO: 59029 - DNA, 201 bp, Homo sapiens
agtgattgttctaccttagcctcctgagtagctaggactacaggcatgcactaccatgtctagctaattttatttatgtttttctttatttttttttttttgagacagactcttgctctgtcaccgaggctggagtacagtggcatgatctcagcttactgcaacctcctcccgggttcaagcgattctcctgcctcagcc

SEQ ID NO: 59030 - DNA, 201 bp, Homo sapiens
tctgcagtcatcatgtgtgccaccatcgccatggtcttggtcaacatgtttggagttatgtggctctggggcatcagtctgaacgctgtatccttggtcarcctggtgatggtgagtcctcatacagtctcagtttgtccctagctcctgtttcacttgggggaattggctgtcttagattccatgtaaaccctaaagatg

SEQ ID NO: 59031 - DNA, 201 bp, Homo sapiens
ggtgagaaggcaagacagaaagtgaaacagcactttataggatagggatgggaaggtcatctgcatcatgggactccttggggaggggttcggtcattgcbccagatgaaggtttagtcttttcatcgtaaatttgctttcactgttgggaaagagatcttcacctccattttcttaacttcaaaatggaaatgacagatg

SEQ ID NO: 59032 - DNA, 201 bp, Homo sapiens
ttgtctcctttttcctttgggtttcctcttctagcaatgtacaatgcctgccgggatgtggaggccccctcaagtaatgacaaggccctgggactcctgtrtgggaaggacgctgacgcctgtaatgccaccaactggattgaatacatgttcaataaggacaatggacaggcaccttttaccatcactcctgtgttttca

SEQ ID NO: 59033 - DNA, 201 bp, Homo sapiens
cgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacaggcat

SEQ ID NO: 59034 - DNA, 201 bp, Homo sapiens
ccacttggcagtggtgacaggatgaacacgcagtgttcgggagtgagagcgagctttaatgaggcctcccctctcccctccagtgtgttttatgtcttctrcgaacagtacctgaccatcattgacgacactatcttcaacctcggtgtgtccctgggcgcgatatttctggtgaccatggtcctcctgggctgtgagctc

SEQ ID NO: 59035 - DNA, 201 bp, Homo sapiens
acctgccttggcttcccaaagtgctgggattataggcgtgagccaccacttccagccaggatgacttttttttttttttttttttttttttggtcttctcwgctgtgtctctagaagatgaccttttgagaagcaaacctgaatgttgattcaagcccaaatttcctgggctcaggtgttaattttttaagtctttggaac

SEQ ID NO: 59036 - DNA, 201 bp, Homo sapiens
accacttacaaccataatttggtacaatcgtttcaaaactacttgaaaaacaactttgcagtacgtagtaagttgaagctaaccctcctcccagaaatttsacttatagatgcctgccttagagaaactctaaatgcatataaacctggagacccatataagaacacccactgtaacactattgtgattgtgaaaaattga

SEQ ID NO: 59037 - DNA, 201 bp, Homo sapiens
ggccatggcaccagggtcggagccacgtacttcatgacctaccacaccgtgctgcagacctctgctgactttattgacgctctgaagaaagcccgacttayagccagtaatgtcaccgaaaccatgggcattaacggcagtgcctaccgagtatttccttacaggtaaagcctgccctttttcaatggggtttacccagca

SEQ ID NO: 59038 - DNA, 201 bp, Homo sapiens
tcgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacaggca

SEQ ID NO: 59039 - DNA, 201 bp, Homo sapiens
tgctcaatactatgagtcatcagggaaatacaaatcaaaaccacaatgagataccacttcacacccaccaggatggctagaatcaaagtcacataacaagmagtgttgacaaggctgtggaaaataggaacctttattaaaaagaaatccaaaaaccaaaaacagctgggcacagtggctcatgcctataatccagcactt

SEQ ID NO: 59040 - DNA, 201 bp, Homo sapiens
tcagcctgggaagtggaggttgcagtgagctgagatcacaccattggactccagcctgagggacagagactccatctccaaaaaaaaaaaaaaaaaaaaaactcttactactcaatgataaataaataacccaatttaaaatggcaaaagatctgaatagagtagacatttctctaaggaagatatacaaatgaccaacaa

SEQ ID NO: 59041 - DNA, 201 bp, Homo sapiens
ctcgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacaggc

SEQ ID NO: 59042 - DNA, 201 bp, Homo sapiens
ctggactctcttgacacccaggattctttcctcaggggacatgctgcctatagttctgcagttaacatcctccttggccatggcaccagggtcggagccaygtacttcatgacctaccacaccgtgctgcagacctctgctgactttattgacgctctgaagaaagcccgacttatagccagtaatgtcaccgaaaccatg

SEQ ID NO: 59043 - DNA, 201 bp, Homo sapiens
tgtgtgtgtgtaagtatttttttattttttggaagagacgggcctcactgtgttggtgaggctggtcttgaactcctggccttaagtgatcctcctgcctyggcctgccaaagtgttgggactgtaggtgtgagccaccacacctggcctatagtgcattattatttttatttagtttttaaattatgccatagccagttg

SEQ ID NO: 59044 - DNA, 201 bp, Homo sapiens
cctcgacctcctgagctcaagcaatctctcaactcagcgtcccaagtagctgggactacaggcacatgccacaacccctggctaattttttaaaaatttgtttggggagatggggcttcaccatgttgcctagcctggtctcaaactcctaggctcaagcaatccaccctcctcagccttcctaagtactgggagtacagg

SEQ ID NO: 59045 - DNA, 201 bp, Homo sapiens
accgcgaaggtctgcagcttcactcctgagccagcgagatcacgaacccaccagaaggaagaaactccgaaaacatctgaacatcagaagggacagattcyagacgcgccaccttaagagctgtaacgctcaccgccagggtccgcggcttcattcttgaagtcagtgagaccaagaacccaccaattccggacacaatgt

SEQ ID NO: 59046 - DNA, 201 bp, Homo sapiens
ctattcttctaacagtcctccctgcatgtctccgccagtggttgaccctgcctgcgttcgctgcaggcctctgactccggaaggcaaacagaggcctcagbggggagacttcatgagattcctgcccatgttcctttcggataaccctaaccccaagtgtggcaaagggtaagtgctgctgccattgcagataagcatcca

SEQ ID NO: 59047 - DNA, 201 bp, Homo sapiens
ctgcttttatgagctgtaacactcaccgcgaagatctgcagcttcactcctgagcccagcgagaccacgagcccactgggaggaacgaacaactccagacrcgctgccttaagagctgtaacactcaccgcgaaggtctgcagcttcactcctgagccagcgagatcacgaacccaccagaaggaagaaactccgaaaaca

SEQ ID NO: 59048 - DNA, 201 bp, Homo sapiens
aggtcagtaaccctgtctgtcctctctagtacccgaataggcttcgccccctcgtcctggatcgacgattatttcgactgggtgaagccacagtcgtcttrctgtcgagtggacaatatcactgaccagttctgcaatgcttcaggtaccttctcctttaccaaatctttcctgttttgctgaaaaattttcaaattatca

SEQ ID NO: 59049 - DNA, 201 bp, Homo sapiens
aggattgtaaatacaccaatcggcactctgtatctagctcaaggtttgtaaacacaccaatcagcaccctgtgtttagctcaaggtttgtgagtgcaccartcgacactctgtatctagctgctctggtggggccttggagaacctgtgtgtggaaactctgtatctaactaatctgatggggacgtggagaacctttgta

SEQ ID NO: 59050 - DNA, 201 bp, Homo sapiens
actcgttaaaccaaatcaggatgagagtgcctccggggaattgtgtccttgtgcacattaacgcccctcacataggtgtggcgtcaataggaagtggtgartcaggggagagggggttccgtggactagaaaaaactctccttcgacttctatttagttctcagaaggggataggtgatgttgatccaataatggactaag

SEQ ID NO: 59051 - DNA, 201 bp, Homo sapiens
aaatacaccaatcggcagtctatctagctcaaggtttgtaaacacaccaatcagcaccctgtgtttagctcaaggtttgtgagtgctccaatcgacactctgtatctagctgctctggtgaggacgtggagaacctttatgtctagctcaaggtttgtaaacacaccaatcagcaccctgtgtttagctcaaggtttgtga

SEQ ID NO: 59052 - DNA, 201 bp, Homo sapiens
actaaagacttcctccctgtggagcaggtcagtaaccctgtctgtcctctctagtacccgaataggcttcgccccctcgtcctggatcgacgattatttcractgggtgaagccacagtcgtcttgctgtcgagtggacaatatcactgaccagttctgcaatgcttcaggtaccttctcctttaccaaatctttcctgtt

SEQ ID NO: 59053 - DNA, 201 bp, Homo sapiens
tgatggcagtgatcagctgcggccagccaggtttttcttcatctggactgtgcctctcactttcaaatttttggaacatttgctttggcaacaaaactttyaaaaaaccaactctctctggtgcaggtgttctgttggaggatttgagagaagctttaaaattttatcttattactgtcccttgcttaggtcacaagagga

SEQ ID NO: 59054 - DNA, 201 bp, Homo sapiens
cctgccaaagtgttgggactgtaggtgtgagccaccacacctggcctatagtgcattattatttttatttagtttttaaattatgccatagccagttgttytgaatagtgcagtactacaaaacagagtcaaggtctcatgctgtcacccaggctggaatacagtgatgcaatcatggctcactgcagcctcaacctccta

SEQ ID NO: 59055 - DNA, 201 bp, Homo sapiens
taaatacaccaatcggcagtctatctagctcaaggtttgtaaacacaccaatcagcaccctgtgtttagctcaaggtttgtgagtgctccaatcgacactctgtatctagctgctctggtgaggacgtggagaacctttatgtctagctcaaggtttgtaaacacaccaatcagcaccctgtgtttagctcaaggtttgtg

SEQ ID NO: 59056 - DNA, 201 bp, Homo sapiens
aattagcacccatcctcagaacggggtggctgcctagggtcttcaacaggaagagagccatcctaaaggaagtgctttatttcagagctgtggcatctccrtggagttctgcagccacataaccagagcgttcacggtgagcatgaaaggcagccgcgtggagcgcgcggaagaggcacttgcccacatgggcagctccgt

SEQ ID NO: 59057 - DNA, 201 bp, Homo sapiens
gaaatccttgtaaggaagtgtttttgttcaattacaggttggtaaaagtggtttctaacacagtatctcttcttttaggtgttcagtggaatcacacttavaaaatttggagggattgtggtgttggcttttgccaaatctcaaattttccagatattctacttcaggatgtatttggccatggtcttactgggagccact

SEQ ID NO: 59058 - DNA, 201 bp, Homo sapiens
acataaggtttctcatcctgttctaactccagcgattgcctctcaggattggtatctggccttagcttctcagaggagggcttttctttatcactttaccytgtggttttgtaggagcgtcgaggttgccctggaattttcttaataaaaacatagaagccccgggctctgaccagtcaaggccatacttgaaggaggaga

SEQ ID NO: 59059 - DNA, 201 bp, Homo sapiens
acacttacaaaatttggagggattgtggtgttggcttttgccaaatctcaaattttccagatattctacttcaggatgtatttggccatggtcttactggragccactcacggattaatatttctccctgtcttactcagttacataggtaagagttctcatcttaaaagggtggcacaatagaaggacattactgaaagg

SEQ ID NO: 59060 - DNA, 201 bp, Homo sapiens
attgtgtttaccttagggaaggggctactgtcagggaggggtaattggggagcttcaactgaatctatagagtgtgtgtgtgtgtgtaagtatttttttawtttttggaagagacgggcctcactgtgttggtgaggctggtcttgaactcctggccttaagtgatcctcctgcctcggcctgccaaagtgttgggactgt

SEQ ID NO: 59061 - DNA, 201 bp, Homo sapiens
cagcagaccgtgtgggacggcacagaaactgccatttgggatcagacctactgattcccacagcccagaacacccacagcaatagagtccaaaaggactcrgccatccctcacgtctggcagcgtaggaatggacactgtcccagcaactggccctcttcagtgcctgtctcagacctcttacccttccatgaacagctaa

SEQ ID NO: 59062 - DNA, 201 bp, Homo sapiens
ggattgtgtttaccttagggaaggggctactgtcagggaggggtaattggggagcttcaactgaatctatagagtgtgtgtgtgtgtgtaagtatttttttattttttggaagagacgggcctcactgtgttggtgaggctggtcttgaactcctggccttaagtgatcctcctgcctcggcctgccaaagtgttgggact

SEQ ID NO: 59063 - DNA, 201 bp, Homo sapiens
tgcgggtggggtgaccttaacgggttccagcaatttctcctggtcaacacaaacgtgccacagaaaaccaggcttttggctgtgtgtagagagggccccaraaagttcctggtacagtaagattggtgtgatggaggccttgtaagtccaatgggatgcttggcctcctctagcacccagggtgccctgggtaattagcac

SEQ ID NO: 59064 - DNA, 201 bp, Homo sapiens
aggattgtgtttaccttagggaaggggctactgtcagggaggggtaattggggagcttcaactgaatctatagagtgtgtgtgtgtgtgtaagtatttttttattttttggaagagacgggcctcactgtgttggtgaggctggtcttgaactcctggccttaagtgatcctcctgcctcggcctgccaaagtgttgggac

SEQ ID NO: 59065 - DNA, 201 bp, Homo sapiens
tggtgaaatccccctcatcctcggagctctgggtctgtacagtctcttcctcttggctataattttgccttttagtgtttgctccctcctctgtgcctgcrtagcgccatgcaccatgtgccattgatggcactgggctgtatttgcctgcctcttgcccagtgattctgagctcccaaaggtgagtgctgagctgtatta

SEQ ID NO: 59066 - DNA, 201 bp, Homo sapiens
caggattgtgtttaccttagggaaggggctactgtcagggaggggtaattggggagcttcaactgaatctatagagtgtgtgtgtgtgtgtaagtatttttttattttttggaagagacgggcctcactgtgttggtgaggctggtcttgaactcctggccttaagtgatcctcctgcctcggcctgccaaagtgttggga

SEQ ID NO: 59067 - DNA, 201 bp, Homo sapiens
tcaagaccagccggggcaacatggtgaaacaccgtcttaaaaacattttgtttttcttttcattgttgaggttgaggctgctgtgagctgtgatcacgccrgtgtactccagcctgggcaacagagcaagaccctgtgtcaaaacaaaaaagagagagaaataaataatagcaattatgtgccgtagagaaaatgtggcta

SEQ ID NO: 59068 - DNA, 201 bp, Homo sapiens
ttttttagagatgggatcttgctatgttgtccaggctggactcaaactcctgggttatagccatccttctgcctcagcttcctgagtacttgagattaggygtgccaccatacccggcatacaggacttgccaaaccaccatcttgctctcattccctctcactgttctctctccctccctttttcctcccacagttgtaa

SEQ ID NO: 59069 - DNA, 201 bp, Homo sapiens
tcaggattgtgtttaccttagggaaggggctactgtcagggaggggtaattggggagcttcaactgaatctatagagtgtgtgtgtgtgtgtaagtatttttttattttttggaagagacgggcctcactgtgttggtgaggctggtcttgaactcctggccttaagtgatcctcctgcctcggcctgccaaagtgttggg

SEQ ID NO: 59070 - DNA, 201 bp, Homo sapiens
attctaatcacttcaagtgactctaatcacatgaagtctcctcgttttcagcaacttccttgttttgagcattctcagtccagaagaggcggaaagctgcrgcccaccttcttttccacgaaggctgacaggacatgggtgtacacatctgactggtccagcaccgcctgggtccgcaccggcctcttgaggagcgggctg

SEQ ID NO: 59071 - DNA, 201 bp, Homo sapiens
tgagctgtgatcacgccagtgtactccagcctgggcaacagagcaagaccctgtgtcaaaacaaaaaagagagagaaataaataatagcaattatgtgccktagagaaaatgtggctattctgtttccctagagttttttaaaatttatttttaaaatttatttattttagagacaggttcttgctctgttgcccaggcgt

SEQ ID NO: 59072 - DNA, 201 bp, Homo sapiens
aaaaatgatgggggacagaggtgcgtgagccttgtgtttcctcaaagcggacgtggttcccaccagtgtggaagcggtacagggagtggcaggctcctggyggcagggacctgaattggtttgtagttatgcttgtgcgcgtcctcataaccccagtctcgccctagcgctgtcccctttcctctccctccagcttttcct

SEQ ID NO: 59073 - DNA, 201 bp, Homo sapiens
actctaatcacatgaagtctcctcgttttcagcaacttccttgttttgagcattctcagtccagaagaggcggaaagctgcggcccaccttcttttccacraaggctgacaggacatgggtgtacacatctgactggtccagcaccgcctgggtccgcaccggcctcttgaggagcgggctgcttcggctctgccctgctt

SEQ ID NO: 59074 - DNA, 201 bp, Homo sapiens
cagctctccagtcaaattgaactgcttgctagcaaaatcctgcccatcttccagggccccatttcacatgctacattatctacgacattcttgtcctgttsccctaactagaatgccttccctctgaagttctgaatctttatttaaactgctgcaacagcatttgctgcctcattaaaagaccttggtgtgggtcttgac

SEQ ID NO: 59075 - DNA, 201 bp, Homo sapiens
aacgtagaaaaggaagttaggttttaagaaaaagtactgaaactaaagacttcctccctgtggagcaggtcagtaaccctgtctgtcctctctagtacccraataggcttcgccccctcgtcctggatcgacgattatttcgactgggtgaagccacagtcgtcttgctgtcgagtggacaatatcactgaccagttctgc

SEQ ID NO: 59076 - DNA, 201 bp, Homo sapiens
atgttggccaggctggtctcgaactcctgacctcaggtgatccacctgccccggcttcccaaactgctgaaataataggcgtgagccaccgtgcccagccycaatattttttaaaataagaaacaaaataaataaaatcacagattgcatttaggtacttccatacattgctggctgcaatttctttggagggcaatttga

SEQ ID NO: 59077 - DNA, 201 bp, Homo sapiens
gaagggcacgactacacttcttccaaggggcagaacatggtgtgcggcggcatgggctgcaacaatgattccctggtgcagcagatatttaacgcggcgcmgctggacaactagtcagtaccaccttgtcttgtacttcagaagcagcggaggaggctctcagccaggcagtcagctcaggcctgaaatgtctcactgaaa

SEQ ID NO: 59078 - DNA, 201 bp, Homo sapiens
ctgtcccccaggctgaagtgtagtggtttgattgtggctcactgaagtgttgaccctgggctcaagctatccttccacctcagcctcccacgtagctgggrctgcaggtgcatgccaccatgcccaactaatttttaaattttttgtagacacaaggtcttgctgtgttgcccaaggtggtcttgaattcctgggctggag

SEQ ID NO: 59079 - DNA, 201 bp, Homo sapiens
agtgttcacactctctcctattcttttatctttctttcaggactcctacatggtggattatttcaaatccatcagtcagtacctgcatgcgggtccgcctrtgtactttgtcctggaggaagggcacgactacacttcttccaaggggcagaacatggtgtgcggcggcatgggctgcaacaatgattccctggtgcagca

SEQ ID NO: 59080 - DNA, 201 bp, Homo sapiens
tgtggaactgtacctgttggtacggctcctttttaggtggcagtgtgctgaagcaggaaaataacagacaagttaaacatgagacagctggcagtctttcycatttaaaatgcaggggagcccgggccagaacccagcgtgtgatgtgcggttggtgcctggagagtcgtcttggttcaactctacaccctggcttagcct

SEQ ID NO: 59081 - DNA, 201 bp, Homo sapiens
atgagaatctttggagccggggatgtggaggttgcagtgagctgagatcatgtcactgcactccagcctgggagacagagcaagactctgtctcaaaaaaraaaaaaagaaaaaaggaaaaggaaagataaatttataatgtattgccaggaccacacaaacccttcatatgtaccaggaatgcaagtagaggaattgagt

SEQ ID NO: 59082 - DNA, 201 bp, Homo sapiens
ggtggaccagtgttcccgtggcttgtgttgggaggctatgatggtaagtaagagaagctttgacttttccttttagataaagtcatctcggttttgtcatyagcatcaagtggtaattatgaagatttcataaattgggcagttttgttaatttcttacctcttgaatcccagaatagtatctcctttggctttgggtttg

SEQ ID NO: 59083 - DNA, 201 bp, Homo sapiens
taaatacccatttcctttgatccaacaatataaaagtatttccaacagttctatttgcgcatgattgcaaagatttacatccaagaatgggccaggagtgstggctcacgcctgtaatcccagcactttaggaggctgaggcaggcagattgcttgagcccagcagttcaagaccaatctgggcaacatggtgaaaccccg

SEQ ID NO: 59084 - DNA, 201 bp, Homo sapiens
cttctttcaggttcttgacttacaaatagccatcgaaaacattactgcctcttatgacaatgagactgtgacacttcaagacatctgcttggcccctcttycaccgtataacacgaactgcaccattttgagtgtgttaaattacttccagaacagccattccgtgctggaccacaagaaaggggacgacttctttgtgta

SEQ ID NO: 59085 - DNA, 201 bp, Homo sapiens
aggcaagcttgcaatttgttaggtaggtaggcattctttttttctctgcctatttgaaggactacctactttgaaggttgcagatcagcagcagaaaaaawttttttaaaaagctttttaaaaaaattttagaagaaatcaaaggtttttttggtaataaaattttattggcttggcatggtggttcatacctattatcca

SEQ ID NO: 59086 - DNA, 201 bp, Homo sapiens
ctcaacacaattcctttctgtagattttccagtccatgggatggagcccatgaacaatgccaccaaaggctgtgacgagtctgtggatgaggtcacagcaycatgtagctgccaagactgctctattgtctgtggccccaagccccagcccccacctcctcctgctccctggacgatccttggcttggacgccatgtatgt

SEQ ID NO: 59087 - DNA, 201 bp, Homo sapiens
ctattaccccaaaaccctagttctatcttcattttctgttattgaactttaggcttcaggttaggaactaggcaagcttgcaatttgttaggtaggtaggmattctttttttctctgcctatttgaaggactacctactttgaaggttgcagatcagcagcagaaaaaaattttttaaaaagctttttaaaaaaattttag

SEQ ID NO: 59088 - DNA, 201 bp, Homo sapiens
tctagcctgggtgacacagtgagactcagtctcaaaaaaaaaaagtagaaaactcatcaagctgtacagctaagttctgtatacctcatatatgaatattrtatcttaattaaaaggaaaagtctattaacaaaaagagttctcaaaaatgctcaacctgaacctccttagggggttggcagaagcattaactaaagctct

SEQ ID NO: 59089 - DNA, 201 bp, Homo sapiens
cttgtctcctttttcctttgggtttcctcttctagcaatgtacaatgcctgccgggatgtggaggccccctcaagtaatgacaaggccctgggactcctgkgtgggaaggacgctgacgcctgtaatgccaccaactggattgaatacatgttcaataaggacaatggacaggcaccttttaccatcactcctgtgttttc

SEQ ID NO: 59090 - DNA, 201 bp, Homo sapiens
ggatcacctacatggcgtttttgcttgtgttttttggagcattttttgcagtgtggtgctacaggtaagcagttttgtttgtcatccagggcaaaaagagsaaaattgcccactggcactttgagctttcatttgtcagagcttggttacttaggacaagaaacaaatacctccatgaataccattgcatggattattgtg

SEQ ID NO: 59091 - DNA, 201 bp, Homo sapiens
cgggctttcaccatgttggccaggctagtctcgaactcttgacctcaggtgatctgccagcctcagcctcccaaagtgctggaattacaggcataagccaytgagcccagccctaaacttactttaattcagcatgtatggaaccttagctgtaatctgatagtctccagtgtggaagaccctaatgcagtggctgggcat

SEQ ID NO: 59092 - DNA, 201 bp, Homo sapiens
gatacagagaagctccagagggcccaggcctgggaaaaagagtgagtcactcatgggtgtgagcagactgtccttgcattgtgggaagctagacacttgcrgcaagcacttaaacttcattttctaaattaaccaatggcagatctgagttacgtagttttgttcacttggtactaatgatgctaagaagaaactgtaaac

SEQ ID NO: 59093 - DNA, 201 bp, Homo sapiens
agtatgcctaagatgaaaatggtatttcagattcattaaactgtgaaagtgacatgtggctgaagcttttagataaggggaaagattatccctcactagtraggaaagtaatcgatagagaagaaagtaatgcccctcactgtcagtattttaaaatgttttacaaaaaatctggagacctattcttctaacagtcctccc

SEQ ID NO: 59094 - DNA, 201 bp, Homo sapiens
ggctcgcctggaaaaagagtactttgaccagcactttgggcctttcttccggacggagcagctcatcatccgggcccctctcactgacaaacacatttacyagccatacccttcgggagctgatgtaccctttggacctccgcttgacatacagatactgcaccaggtaacctgctgtttgaagaaataagtcactctaga

SEQ ID NO: 59095 - DNA, 201 bp, Homo sapiens
tggccctattatgtgtgagatcatgcagaatataatttacttttcctttagatgtccatcctgtttttataacctactgaacctgttttgtgagctgacaygtagccctcgacagagtcagtttttgaatgttacagctactgaagattatgttgatcctgttacaaaccagacgaaaacaaatgtgaaagagttacaata

SEQ ID NO: 59096 - DNA, 201 bp, Homo sapiens
cttcttttccacgaaggctgacaggacatgggtgtacacatctgactggtccagcaccgcctgggtccgcaccggcctcttgaggagcgggctgcttcggytctgccctgcttccaccgcctgaaagaaaaaaaccacaaactatgatcttcggcatcttagaggaagggtgctgtttacagttcatccacaaggactgaa

SEQ ID NO: 59097 - DNA, 201 bp, Homo sapiens
acacagatgggaaaaacaaaaacagtgaaggtatgaagtgagatgcagccgccagctcgtgggatgcagggaccctgaatttactactcctccactatccmccactactgccaccttgccctatggcaggcggcaaatctcagcgaccttattctaatatataggaaacaattttgcatcataattacttagaaaataccc

SEQ ID NO: 59098 - DNA, 201 bp, Homo sapiens
ggtttctaggtgatggcagtgatcagctgcggccagccaggtttttcttcatctggactgtgcctctcactttcaaatttttggaacatttgctttggcarcaaaacttttaaaaaaccaactctctctggtgcaggtgttctgttggaggatttgagagaagctttaaaattttatcttattactgtcccttgcttaggt

SEQ ID NO: 59099 - DNA, 201 bp, Homo sapiens
tccgccccgccccgccccgccgcactcgcggatcgtcacacggtcaggccaccgcgcgtcaccgccccgggctctgctagaaagtgccggggtccagattyctttcaggtgactgggttgggaggagaagtcgctcagcgtaattgtcggagccgaaataaacagagactccgcggccgggcgggaccttacccggaagtc

SEQ ID NO: 59100 - DNA, 201 bp, Homo sapiens; identical to SEQ ID NO: 11342

SEQ ID NO: 59101 - DNA, 201 bp, Homo sapiens
cagccctgtaaagtaaaaaggaggaccttttagtaacaagtgggacagacaaccctgtaactaattggtgattgtgtctgtcgcctctctcaggtggattsgaaggtctcactaggcatcgcgggcatcttgatcgtgctgagctcggtggcttgctccttgggtgtcttcagctacattgggttgcccttgaccctcatt

SEQ ID NO: 59102 - DNA, 201 bp, Homo sapiens
ggggcttcaccatgttgcctagcctggtctcaaactcctaggctcaagcaatccaccctcctcagccttcctaagtactgggagtacaggcatgagccacrgtacctgtcctcacttgctgctttcatcataattattaaaggtttcaactttccctggaattactaatagaaatagtaagtagcactctggttgaattga

SEQ ID NO: 59103 - DNA, 201 bp, Homo sapiens
ccagcagaccgtgtgggacggcacagaaactgccatttgggatcagacctactgattcccacagcccagaacacccacagcaatagagtccaaaaggactyagccatccctcacgtctggcagcgtaggaatggacactgtcccagcaactggccctcttcagtgcctgtctcagacctcttacccttccatgaacagcta

SEQ ID NO: 59104 - DNA, 201 bp, Homo sapiens
caacgaggtgcaaaagaggctgcatataactctctatccaacccccaccttgtttccatcttaaaatggcccagtgttcatctttcactggttttgcacamatcgctccagaaccacccgtcaacaattatgctttaggcctcagcattagaagccaaactaccagctctagggcctcacccaaggaaactccagtgattc

SEQ ID NO: 59105 - DNA, 201 bp, Homo sapiens
aagcatctcgtaggtgtgtctactgggttttaacttatttttctttaataaaatacattgttttcctaagttttggggttaccctatctgctttgagagacaaatacaaaagctaaatggaagagattctatctaacctgtccttatggtaactaaatgccgtcttacattgagctagaaatagacctagaagtttcatta

SEQ ID NO: 59106 - DNA, 201 bp, Homo sapiens
ttggccatggtcttactgggagccactcacggattaatatttctccctgtcttactcagttacataggtaagagttctcatcttaaaagggtggcacaatrgaaggacattactgaaagggaattctatcctgaggcattcttttcaagtatttgaactcatactaatggtcatttgataatgataaatgatactgagtaa

SEQ ID NO: 59107 - DNA, 201 bp, Homo sapiens
agatcctctgtaattattccttaaatgttattgcagggtggaggtggagatgagactaacaggcttaagtcttatcccggactctcaaactctaacctgtrgcatacagtgcagagaaagaacaccgtaactccaaaggcttaatttttcaggggctgactttatacctctcataaagtttcccaatagcaggttgctatt

SEQ ID NO: 59108 - DNA, 201 bp, Homo sapiens
aaaacacaaaaattagccaggcatggtggcgtgcacctgtttaatcccagctactcaggaggctggggcaggagaatcacttgaacctgggagaaatcctygtaaggaagtgtttttgttcaattacaggttggtaaaagtggtttctaacacagtatctcttcttttaggtgttcagtggaatcacacttacaaaatttg

SEQ ID NO: 59109 - DNA, 201 bp, Homo sapiens
gaggagaagggcaacacggggaccttgaagcggggtcgcggcggcgccccagcccgggccagggagtcccggcagcggcacctcccagaaagggcggagcygacgacgccttcttccttcctgaccggcgcgcgcagcctgctgccgcggtcagcgcctgctcctgctcctccgctcctcctgcgcggggtgctgaaacag

SEQ ID NO: 59110 - DNA, 201 bp, Homo sapiens
tgggctagtctgcctgtaatttgttattctttagagattgcacaagcctgtagcctgatgacagcaggatgttcactttttacttagaaaattgcaccccrccccaggagctctccgaccagtgccttttgcctcctatgtggttatcaggtacttttaatcattaaagatgagagcactcgagaaggtattcatggaaaa

SEQ ID NO: 59111 - DNA, 201 bp, Homo sapiens
tcccgggccgagccagactccataagtcccgcgcctggcccccggggattgcaggggctgaggagaagggcaacacggggaccttgaagcggggtcgcggsggcgccccagcccgggccagggagtcccggcagcggcacctcccagaaagggcggagccgacgacgccttcttccttcctgaccggcgcgcgcagcctgc

SEQ ID NO: 59112 - DNA, 201 bp, Homo sapiens
ctccttggccatggcaccagggtcggagccacgtacttcatgacctaccacaccgtgctgcagacctctgctgactttattgacgctctgaagaaagcccracttatagccagtaatgtcaccgaaaccatgggcattaacggcagtgcctaccgagtatttccttacaggtaaagcctgccctttttcaatggggtttac

SEQ ID NO: 59113 - DNA, 201 bp, Homo sapiens
cccggctgtaaacagaagtgacgcagagcccttctctccccgacaggagcattgtccgtgatgccagccgtgcacaccttctctctctttgcgggattggyagtcttcattgactttcttctgcagattacctgtttcgtgagtctcttggggttagacattaaacgtcaagaggtaagttggtgccaggattatagtcta

SEQ ID NO: 59114 - DNA, 201 bp, Homo sapiens
taacattttgcttaccttttaggtttattaattttgtgaaaaactacaagaatcccaatctgaccatttccttcactgctgaacgaagtattgaagatgamctaaatcgtgaaagtgacagtgatgtcttcaccgttgtaattagctatgccatcatgtttctatatatttccctagccttggggcacatcaaaagctgtc

SEQ ID NO: 59115 - DNA, 201 bp, Homo sapiens
ttacatacacctcccatccccagctttatcttacatattccctgtccctgccctgcaaggagctctggttccttttattggagaatggtatgtagaaacgragatctgggcactaggtatgctcattgctgctggaaagagtagcatgtttttgtttgtttgtttgtttttttgagatggagtcttgctctgtcaccaggc

SEQ ID NO: 59116 - DNA, 201 bp, Homo sapiens
cggctatactagtatacctgatggtgcctctgaccatggaaatgtgatttcctggcctagttctgggctagtctgcctgtaatttgttattctttagagaytgcacaagcctgtagcctgatgacagcaggatgttcactttttacttagaaaattgcaccccgccccaggagctctccgaccagtgccttttgcctccta

SEQ ID NO: 59117 - DNA, 201 bp, Homo sapiens
atcacgccactgcactccagcctgggctacagagcaagactctgtctcaaaataaaaaaaaaaagaagccagtctgggagagaacaagctaaacctttggygttcccttatctgggggccttcttcatccctgaaatgtacagctgggtctgacctctgagtccagggtcaggtgattttgcttagcctcaagtgctcaga

SEQ ID NO: 59118 - DNA, 201 bp, Homo sapiens
cggggttacatgaccagtaagtggcagggctgaggttgttcccagggcccttgccctttcctgcttcctattacacaacaggactgagtaaaccctgtacmtttgattatacatgaaaccaggtggagaaacagcagctatgtaccaaagaacccagagcaatcgagaaaagcccatctggccaggcgaagtggctcacac

SEQ ID NO: 59119 - DNA, 201 bp, Homo sapiens
gtagccaccgttcctggggagcctccagggtgccagcgtcatgccaggcactccctgacattattccatttctcatcacgcagcctatgagtaggtggtgktatacccatttacagaagaggagactggggctcagaggtggtcattttgctcggggttacatgaccagtaagtggcagggctgaggttgttcccagggcc

SEQ ID NO: 59120 - DNA, 201 bp, Homo sapiens
ccctgggcatgagaatgaacgcagattcctgtgcacattccaagcggggctgagggagaggacggcctgctggtaatccaggcctgaaggaacttggcctrttcacttgtactgatggcagctggggcgtgatcttagctttagtaacattatcccacattaaggttgcgattcttttagcctcgtcatgctccttgccag

SEQ ID NO: 59121 - DNA, 201 bp, Homo sapiens
ttcgactgggtgaagccacagtcgtcttgctgtcgagtggacaatatcactgaccagttctgcaatgcttcaggtaccttctcctttaccaaatctttccygttttgctgaaaaattttcaaattatcatttaaaaatcatttgcatcgtgcctcagtttatacctatttgtatatcaaagctgggtctccctgtgtcatc

SEQ ID NO: 59122 - DNA, 201 bp, Homo sapiens
gagtgcagtggcatgatctcagctcgctgcagcctctgccttccaggttcaagtgattctcgtgcctcagcctcccaagtagctgggattacaggcacctkccaccacgcctggctaatttttgtatttttagtagagacgggctttcaccatgttggccaggctagtctcgaactcttgacctcaggtgatctgccagcc

SEQ ID NO: 59123 - DNA, 201 bp, Homo sapiens
cccagcactttgggaggcccagacgagaggctcacttgaggccgggagttcaagaccagcctaggcaatgtttgcatgtctctaaaaaaaagaaaaaagaraatttaaaaagaaaaaaaagcgtacaattcagtagctttactatattcacgtgtatgtgcagccatcaccacagtcaattttaggaacattttcattact

SEQ ID NO: 59124 - DNA, 201 bp, Homo sapiens
gtgtccctgggcgcgatatttctggtgaccatggtcctcctgggctgtgagctctggtctgcagtcatcatgtgtgccaccatcgccatggtcttggtcawcatgtttggagttatgtggctctggggcatcagtctgaacgctgtatccttggtcaacctggtgatggtgagtcctcatacagtctcagtttgtccctag

SEQ ID NO: 59125 - DNA, 201 bp, Homo sapiens
gatcttgctatgttgtccaggctggactcaaactcctgggttatagccatccttctgcctcagcttcctgagtacttgagattaggcgtgccaccataccyggcatacaggacttgccaaaccaccatcttgctctcattccctctcactgttctctctccctccctttttcctcccacagttgtaattgtgtgagacacc

SEQ ID NO: 59126 - DNA, 201 bp, Homo sapiens
tcacttgaacctgggagaaatccttgtaaggaagtgtttttgttcaattacaggttggtaaaagtggtttctaacacagtatctcttcttttaggtgttcrgtggaatcacacttacaaaatttggagggattgtggtgttggcttttgccaaatctcaaattttccagatattctacttcaggatgtatttggccatggt

SEQ ID NO: 59127 - DNA, 201 bp, Homo sapiens
aatttggagggattgtggtgttggcttttgccaaatctcaaattttccagatattctacttcaggatgtatttggccatggtcttactgggagccactcayggattaatatttctccctgtcttactcagttacataggtaagagttctcatcttaaaagggtggcacaatagaaggacattactgaaagggaattctatc

SEQ ID NO: 59128 - DNA, 201 bp, Homo sapiens
tcaacaggaagagagccatcctaaaggaagtgctttatttcagagctgtggcatctccgtggagttctgcagccacataaccagagcgttcacggtgagcrtgaaaggcagccgcgtggagcgcgcggaagaggcacttgcccacatgggcagctccgtgagtaccctgagcagggccacgccggcagagtcgcaccacaa

SEQ ID NO: 59129 - DNA, 201 bp, Homo sapiens
acctggccaagttgtagctgatggtctgtccgaaaatgctggttcactctccactggccaactgtctgtctgcactgcactgccagttgcctcttgcctgsgccattgcgctaacatctccacttactgttccacctgcttcctgtttctttgccgtttccagaccttccactttgccacgcaagctatctttgtaaaaca

SEQ ID NO: 59130 - DNA, 201 bp, Homo sapiens
gcagaaaaaaattttttaaaaagctttttaaaaaaattttagaagaaatcaaaggtttttttggtaataaaattttattggcttggcatggtggttcatamctattatccagcactttggaggctgaggcaggaggatcactttagccagggaggtcaaggctgcagtgagctgtgatcatgccactagactacaacctgg

SEQ ID NO: 59131 - DNA, 201 bp, Homo sapiens
agtgcagctgcctctcaccctttacctcgtgcctgggtcgctaacacagtgtcatgtatcacaccccccacaagatttaaagatagaagagcctttggtgycttttgttctgtctcagatatatagcccagtcccctgtagtgccccagctatttgggaggcagcctccctctgaggagttgaggcagtataggtctgcag

SEQ ID NO: 59132 - DNA, 201 bp, Homo sapiens
tttctggtgaccatggtcctcctgggctgtgagctctggtctgcagtcatcatgtgtgccaccatcgccatggtcttggtcaacatgtttggagttatgtrgctctggggcatcagtctgaacgctgtatccttggtcaacctggtgatggtgagtcctcatacagtctcagtttgtccctagctcctgtttcacttgggg

SEQ ID NO: 59133 - DNA, 201 bp, Homo sapiens
atatttctggtgaccatggtcctcctgggctgtgagctctggtctgcagtcatcatgtgtgccaccatcgccatggtcttggtcaacatgtttggagttaygtggctctggggcatcagtctgaacgctgtatccttggtcaacctggtgatggtgagtcctcatacagtctcagtttgtccctagctcctgtttcacttg

SEQ ID NO: 59134 - DNA, 201 bp, Homo sapiens
ttctgcagttaacatcctccttggccatggcaccagggtcggagccacgtacttcatgacctaccacaccgtgctgcagacctctgctgactttattgacrctctgaagaaagcccgacttatagccagtaatgtcaccgaaaccatgggcattaacggcagtgcctaccgagtatttccttacaggtaaagcctgccctt

SEQ ID NO: 59135 - DNA, 201 bp, Homo sapiens
ccagccatcccattactgggtatatacccaaaggattataaatcatgctgctataaagacacatgcacacgtatgtttatagcggcactattcacaatagyaaagacttggaaccaacctaaatgtccaacaacgatagactggattaagaaaatgtggcacatacacaccatggaatactctgcagccataaaaaatgat

SEQ ID NO: 59136 - DNA, 201 bp, Homo sapiens
caaaatggtagaatttatgtgtatccttaacccagtttccccgatgatacaacttacataactcatagtacatctagaactagaaataccatttgacccakccatcccattactgggtatatacccaaaggattataaatcatgctgctataaagacacatgcacacgtatgtttatagcggcactattcacaatagcaaa

SEQ ID NO: 59137 - DNA, 201 bp, Homo sapiens
aacatgacaaaatcccatctctacataaatacaaaaattagccagcaatggtggtgcacacctttagtcccagctactgggaggctgaggcaggaggattrattgagttcgggtggtcaaggccacaaaaagccgcgattgcaccactgtacttcagcctgggcaacagaacaagacactgtccccctgtcaggcccccac

SEQ ID NO: 59138 - DNA, 201 bp, Homo sapiens
tcaggtaactagttcatagtttctcccagtaagagaggtaactggtacatttatcctgctgtggctaatttagggggtgctgggagtgggaatggaggagsaaatgaattgccttcaggcattgctgtcataattgaaagaataagcagttaaaaagggggtgggaggcagcttttctagagctctgctatagtattagct

SEQ ID NO: 59139 - DNA, 201 bp, Homo sapiens
attactgataatagccaaactgtggaaacaactcagatatttatcacctgatatatggataaacaaaacatatgtccttgcaatgaaatgttgttcggccrtaaaaagaaatgaagtattgatacatgccacaatatgcatgaaccttgagaacattatgctaaatgaaagaagccggtcatgaaagaccacatattatat

SEQ ID NO: 59140 - DNA, 201 bp, Homo sapiens
tgcagtgagctgagatcacaccattggactccagcctgagggacagagactccatctccaaaaaaaaaaaaaaaaaaaaaactcttactactcaatgatarataaataacccaatttaaaatggcaaaagatctgaatagagtagacatttctctaaggaagatatacaaatgaccaacaagcacatgagagatgctcaat

SEQ ID NO: 59141 - DNA, 201 bp, Homo sapiens
aagaacacccactgtaacactattgtgattgtgaaaaattgaagacctcaagaacgagaagacaagacacagactgggagaaagtatttgcaaaagacatrttagtaaggactgttattcaaaatatacaaataactcctaaaactcaataagaaagcaaacagcccaattgaaaaatggacaaaacaacctgaacagata

SEQ ID NO: 59142 - DNA, 201 bp, Homo sapiens
aggcacctgccaccatgcccggctaattttttgtatttttagtagagacggggtttcactgtgttaggcaggatggtctcgatctcctgacctcgtgatcygcccacctcggcctcccaaagtgctgggattacaggcatgagccactgcacctggcctagaaggggcttttttttaacctttcctgaactgttcctatcg

SEQ ID NO: 59143 - DNA, 201 bp, Homo sapiens
ttgcttaccttttaggtttattaattttgtgaaaaactacaagaatcccaatctgaccatttccttcactgctgaacgaagtattgaagatgaactaaatygtgaaagtgacagtgatgtcttcaccgttgtaattagctatgccatcatgtttctatatatttccctagccttggggcacatcaaaagctgtcgcaggct

SEQ ID NO: 59144 - DNA, 201 bp, Homo sapiens
tgggctgtgagctctggtctgcagtcatcatgtgtgccaccatcgccatggtcttggtcaacatgtttggagttatgtggctctggggcatcagtctgaaygctgtatccttggtcaacctggtgatggtgagtcctcatacagtctcagtttgtccctagctcctgtttcacttgggggaattggctgtcttagattcca

SEQ ID NO: 59145 - DNA, 201 bp, Homo sapiens; identical to SEQ ID NO: 11306

SEQ ID NO: 59146 - DNA, 201 bp, Homo sapiens
tcggtgagtcttgtagacagccagcaaggttttctgcaagggatgtttcccaaaggagtctgaccacttggcagtggtgacaggatgaacacgcagtgttygggagtgagagcgagctttaatgaggcctcccctctcccctccagtgtgttttatgtcttctacgaacagtacctgaccatcattgacgacactatcttc

SEQ ID NO: 59147 - DNA, 201 bp, Homo sapiens
catcagcacggctatcacaaatttatgaggcatctcctagggagaaaaaaatgtggtcttacaaataccaacgaggtgcaaaagaggctgcatataactcyctatccaacccccaccttgtttccatcttaaaatggcccagtgttcatctttcactggttttgcacacatcgctccagaaccacccgtcaacaattatgc

SEQ ID NO: 59148 - DNA, 201 bp, Homo sapiens
cagagtgttcacactctctcctattcttttatctttctttcaggactcctacatggtggattatttcaaatccatcagtcagtacctgcatgcgggtccgyctgtgtactttgtcctggaggaagggcacgactacacttcttccaaggggcagaacatggtgtgcggcggcatgggctgcaacaatgattccctggtgca

SEQ ID NO: 59149 - DNA, 201 bp, Homo sapiens
gacctggactctcttgacacccaggattctttcctcaggggacatgctgcctatagttctgcagttaacatcctccttggccatggcaccagggtcggagycacgtacttcatgacctaccacaccgtgctgcagacctctgctgactttattgacgctctgaagaaagcccgacttatagccagtaatgtcaccgaaacc

SEQ ID NO: 59150 - DNA, 201 bp, Homo sapiens
gggatggtgtcagcaactgactagccataggggaaacaattgactttgatctctgacttgttcatttcaccaaaataaattccagatggataaaagattgraatgtaagaactgggccaggcgtggtggctcacgcctgtaatcccagcactttcggaggccgaggcgggtggatcacaaggtcaggagatcgagaccatc

SEQ ID NO: 59151 - DNA, 201 bp, Homo sapiens
tacaaaaaatctggagacctattcttctaacagtcctccctgcatgtctccgccagtggttgaccctgcctgcgttcgctgcaggcctctgactccggaargcaaacagaggcctcaggggggagacttcatgagattcctgcccatgttcctttcggataaccctaaccccaagtgtggcaaagggtaagtgctgctgcc

SEQ ID NO: 59152 - DNA, 201 bp, Homo sapiens
gacttcctccctgtggagcaggtcagtaaccctgtctgtcctctctagtacccgaataggcttcgccccctcgtcctggatcgacgattatttcgactggrtgaagccacagtcgtcttgctgtcgagtggacaatatcactgaccagttctgcaatgcttcaggtaccttctcctttaccaaatctttcctgttttgctg

SEQ ID NO: 59153 - DNA, 201 bp, Homo sapiens
agagcccttctctccccgacaggagcattgtccgtgatgccagccgtgcacaccttctctctctttgcgggattggcagtcttcattgactttcttctgcmgattacctgtttcgtgagtctcttggggttagacattaaacgtcaagaggtaagttggtgccaggattatagtctatttaatttgagtctagaatctaga

SEQ ID NO: 59154 - DNA, 201 bp, Homo sapiens
ggcgcgatatttctggtgaccatggtcctcctgggctgtgagctctggtctgcagtcatcatgtgtgccaccatcgccatggtcttggtcaacatgtttgkagttatgtggctctggggcatcagtctgaacgctgtatccttggtcaacctggtgatggtgagtcctcatacagtctcagtttgtccctagctcctgttt

SEQ ID NO: 59155 - DNA, 201 bp, Homo sapiens
gatgtccatcctgtttttataacctactgaacctgttttgtgagctgacatgtagccctcgacagagtcagtttttgaatgttacagctactgaagattaygttgatcctgttacaaaccagacgaaaacaaatgtgaaagagttacaatactacgtcggacagagttttgccaatggtaagtaaacttttaattattcct

SEQ ID NO: 59156 - DNA, 201 bp, Homo sapiens
acaagtgggacagacaaccctgtaactaattggtgattgtgtctgtcgcctctctcaggtggattcgaaggtctcactaggcatcgcgggcatcttgatcrtgctgagctcggtggcttgctccttgggtgtcttcagctacattgggttgcccttgaccctcattgtgattgaagtcatcccgttcctggtgctggctgt

SEQ ID NO: 59157 - DNA, 201 bp, Homo sapiens
atcatgcagtccttcctctccccccatgctttgctttgcacatcattcttgtccctccctctggtgaagggttgtgatagagtcaggtcctcagtagagcyggcctcggggagctgttaaaaattttgttctgctgtagctggctggttttgtcaaacttagttttttatctgttctgttggctatgaccctgagcagtga

SEQ ID NO: 59158 - DNA, 201 bp, Homo sapiens
tgtaactaattggtgattgtgtctgtcgcctctctcaggtggattcgaaggtctcactaggcatcgcgggcatcttgatcgtgctgagctcggtggcttgstccttgggtgtcttcagctacattgggttgcccttgaccctcattgtgattgaagtcatcccgttcctggtgctggctgttggagtggacaacatcttca

SEQ ID NO: 59159 - DNA, 201 bp, Homo sapiens; identical to SEQ ID NO: 11327

SEQ ID NO: 59160 - DNA, 201 bp, Homo sapiens
agacagactcttgctctgtcaccgaggctggagtacagtggcatgatctcagcttactgcaacctcctcccgggttcaagcgattctcctgcctcagcctscccagtagctgggactgcaggcacatgccaccacacctagctaagttttatatttttagtagaggtggggtttcaccatgttggccaggctggtctcaaa

SEQ ID NO: 59161 - DNA, 201 bp, Homo sapiens
taagtaagtagtaaaaaaaagaaaaaaagtccgtctatacactgtaaagtgctgtgtaaatgttcataattactatcactgtcttcttcatagttgatggrgggaaggctggatacataaaaaaatggtaatacagtaagaagtgctcagataagaataaagataaaatgttatggagagtccatttttgagctgagctat

SEQ ID NO: 59162 - DNA, 201 bp, Homo sapiens
aatctgaccatttccttcactgctgaacgaagtattgaagatgaactaaatcgtgaaagtgacagtgatgtcttcaccgttgtaattagctatgccatcakgtttctatatatttccctagccttggggcacatcaaaagctgtcgcaggcttctggtaagccggggggggggtggtgtatgttctagaggttaacagcag

SEQ ID NO: 59163 - DNA, 201 bp, Homo sapiens
ctcaaaaatgctcaacctgaacctccttagggggttggcagaagcattaactaaagctctcctatatttcaccaaaatgtgttggcaattcgtagcctgcyggaggaagggaggtgtgagctgttccctgtgttcagctggacagcctcccactctctataggcgcttcttttagagccagctccactgctggtcctggag

SEQ ID NO: 59164 - DNA, 201 bp, Homo sapiens
atcgcgggcatcttgatcgtgctgagctcggtggcttgctccttgggtgtcttcagctacattgggttgcccttgaccctcattgtgattgaagtcatccygttcctggtgctggctgttggagtggacaacatcttcattctggtgcaggcctaccaggtatacttccatattctcacagggctcagcatctgttcaagt

SEQ ID NO: 59165 - DNA, 201 bp, Homo sapiens; identical to SEQ ID NO: 11329

SEQ ID NO: 59166 - DNA, 201 bp, Homo sapiens
tagtttaactaaaaatataacattttgcttaccttttaggtttattaattttgtgaaaaactacaagaatcccaatctgaccatttccttcactgctgaaygaagtattgaagatgaactaaatcgtgaaagtgacagtgatgtcttcaccgttgtaattagctatgccatcatgtttctatatatttccctagccttggg

SEQ ID NO: 59167 - DNA, 201 bp, Homo sapiens
ggattcgaaggtctcactaggcatcgcgggcatcttgatcgtgctgagctcggtggcttgctccttgggtgtcttcagctacattgggttgcccttgaccytcattgtgattgaagtcatcccgttcctggtgctggctgttggagtggacaacatcttcattctggtgcaggcctaccaggtatacttccatattctcac

SEQ ID NO: 59168 - DNA, 201 bp, Homo sapiens
aggttttaaaattttcttttgagattgcctcggtgtttttccttaaagttagcacattctttgctttctacttcagcctcaaggacaggaagttcattctygctctttacattggggtgttgatgtttgtggttttgttgttttgttcttcatgttactcatgatgtattgatattaattaacctaaatacatatggaaat

SEQ ID NO: 59169 - DNA, 201 bp, Homo sapiens
atccgcccacctcggcctcccaaagtgctgggattacaggcatgagccactgcacctggcctagaaggggcttttttttaacctttcctgaactgttcctrtcgttgaaagaagcttccctatccagtcattttcttagtaattaaactctagagcatgttgtgaaatatccatatgatctaacctttaaaaatagaaact

SEQ ID NO: 59170 - DNA, 201 bp, Homo sapiens
catctgcaccagagacactgccgggtccgagtgagggcaggaggctgcacgagggagcctccctgggagtgagcgataggttcgctatgggaggtgggttygaaaggtgcctgagattttcatttgaaactctgttgaagaggaattggcaatagaggaggaaatacaaatagaggaaagattggtttcgtcttaagcact

SEQ ID NO: 59171 - DNA, 201 bp, Homo sapiens
taatagatcaggaatgggtttagcctgctggcctgacccctgattcagtcaccacactgtgaacattccatagggaaaaaactgcagacagtgtatactgrcacccactttcatagttttgttttagttttgtggctcctaaatgtctaagactaactagtaatatgaccttgggtgagtcacataaaaaaccagaagcta

SEQ ID NO: 59172 - DNA, 201 bp, Homo sapiens
agcaattatgtgccgtagagaaaatgtggctattctgtttccctagagttttttaaaatttatttttaaaatttatttattttagagacaggttcttgctstgttgcccaggcgtgggggcagtgtcgccatcatagctcactgcagcctggaactcctggcctcaagcagtccttccaccttggcctcccaaagcactgg

SEQ ID NO: 59173 - DNA, 201 bp, Homo sapiens
atgttctagaggttaacagcagtgcacagtgtaacgtcatatttttgcctctttattcttattccattatgtttaaaactgccataaattcccccatgttktaattgtatgtaacgtttctgttgcctacatctattttcttcattccaactttttggtttatcttaaagtttatttcacataatccagttttttcttatt

SEQ ID NO: 59174 - DNA, 201 bp, Homo sapiens
cttattccattatgtttaaaactgccataaattcccccatgttttaattgtatgtaacgtttctgttgcctacatctattttcttcattccaactttttgktttatcttaaagtttatttcacataatccagttttttcttatttgtccagtccatcacctaagaatgcaaactcataacatgtgttgcccgagcagacct

SEQ ID NO: 59175 - DNA, 201 bp, Homo sapiens
ttcattaaactgtgaaagtgacatgtggctgaagcttttagataaggggaaagattatccctcactagtaaggaaagtaatcgatagagaagaaagtaatrcccctcactgtcagtattttaaaatgttttacaaaaaatctggagacctattcttctaacagtcctccctgcatgtctccgccagtggttgaccctgcct

SEQ ID NO: 59176 - DNA, 201 bp, Homo sapiens
tctgtcctctctagtacccgaataggcttcgccccctcgtcctggatcgacgattatttcgactgggtgaagccacagtcgtcttgctgtcgagtggacartatcactgaccagttctgcaatgcttcaggtaccttctcctttaccaaatctttcctgttttgctgaaaaattttcaaattatcatttaaaaatcatttg

SEQ ID NO: 59177 - DNA, 201 bp, Homo sapiens
tgctccttgggtgtcttcagctacattgggttgcccttgaccctcattgtgattgaagtcatcccgttcctggtgctggctgttggagtggacaacatctycattctggtgcaggcctaccaggtatacttccatattctcacagggctcagcatctgttcaagtttcagggactgtgaatggctcctgggctccgcattc

SEQ ID NO: 59178 - DNA, 201 bp, Homo sapiens
ctgtcccctttcctctccctccagcttttcctggactttttcacctgagggtcctgcagtaatggcaggtggcctgcccagaaccatgcccttacctgctkcttctccccattttgtttaaaggcagtgacagctaccagttactcaggcttgaggctttatccctgaattctgcctcgccctcgccttcctcatggggtt

SEQ ID NO: 59179 - DNA, 201 bp, Homo sapiens
tcagttagtttaactaaaaatataacattttgcttaccttttaggtttattaattttgtgaaaaactacaagaatcccaatctgaccatttccttcactgytgaacgaagtattgaagatgaactaaatcgtgaaagtgacagtgatgtcttcaccgttgtaattagctatgccatcatgtttctatatatttccctagcc

SEQ ID NO: 59180 - DNA, 201 bp, Homo sapiens
agcgggtataacctttgtttccctctgtcccctcagaaaaatcggctagacatcttttgctgtgtcagaggtgctgaagatggaacaagcgtccaggcctsagagagctgtttgtttcgcttcttcaaaaactcctattctccacttctgctaaaggactggatgagaccaattgtggtatgcgcttatctgtggtttttc

SEQ ID NO: 59181 - DNA, 201 bp, Homo sapiens
tcatttgtggagaacaaacatacagttaaaaaaacaaaactgggccgagagttattcatgcctgtaatcccagcaatttgggaggcagaggcgagcacatyacttgagctaggagtttgagaccagcctgagcaacatggagaaaccccgtctctgcaaaaaatacaaaaattagctgggcatggtggtgcatgcttgtag

SEQ ID NO: 59182 - DNA, 201 bp, Homo sapiens; identical to SEQ ID NO: 11351

SEQ ID NO: 59183 - DNA, 201 bp, Homo sapiens; identical to SEQ ID NO: 11350

SEQ ID NO: 59184 - DNA, 201 bp, Homo sapiens
agtcctccctgcatgtctccgccagtggttgaccctgcctgcgttcgctgcaggcctctgactccggaaggcaaacagaggcctcaggggggagacttcakgagattcctgcccatgttcctttcggataaccctaaccccaagtgtggcaaagggtaagtgctgctgccattgcagataagcatccactgcaactttaat

SEQ ID NO: 59185 - DNA, 201 bp, Homo sapiens; identical to SEQ ID NO: 11352

SEQ ID NO: 59186 - DNA, 201 bp, Homo sapiens
ttcaccatgttggccaggttggtctcgatctcttgacctcgtgatcccgcccaccttggcctcccaaagtgctgggtttacaggcgtgagccaccgcgccyagcccagtagtgtgtttttaaaggacctaaaagttttaaataaaatgagggccacaaggtgaaattatcctttattaattgttctcttaacatcttctta

SEQ ID NO: 59187 - DNA, 201 bp, Homo sapiens
tacattctattaccccaaaaccctagttctatcttcattttctgttattgaactttaggcttcaggttaggaactaggcaagcttgcaatttgttaggtargtaggcattctttttttctctgcctatttgaaggactacctactttgaaggttgcagatcagcagcagaaaaaaattttttaaaaagctttttaaaaaaa

SEQ ID NO: 59188 - DNA, 201 bp, Homo sapiens
ttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctgcc

SEQ ID NO: 59189 - DNA, 201 bp, Homo sapiens
ccatgctgatcttgaactctctaacctctagaactgtaacagataaattcctattgtttaagtcacaccagtctttggtattttgtgcaatggcctcagaygtcactaaatgacattgattacattctattaccccaaaaccctagttctatcttcattttctgttattgaactttaggcttcaggttaggaactaggcaa

SEQ ID NO: 59190 - DNA, 201 bp, Homo sapiens
gttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctgc

SEQ ID NO: 59191 - DNA, 201 bp, Homo sapiens
ggttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctg

SEQ ID NO: 59192 - DNA, 201 bp, Homo sapiens
tggttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcct

SEQ ID NO: 59193 - DNA, 201 bp, Homo sapiens
atattagtatgcatggcagtcagcattttcttaataaataaagatctcatctcagcctggccaaaatgtgaaaccctgtctctactgaaaatacaaaaaawattagccacacgtggtggtgtgtgcctgtagtcccagctactcgggagactgaggcaggagaatcacttgaatcctggaggtggagtttgcagtgagcca

SEQ ID NO: 59194 - DNA, 201 bp, Homo sapiens
tggacctccgcttgacatacagatactgcaccaggtaacctgctgtttgaagaaataagtcactctagatgaccttgtggtttgctggcttttacatgttkactactgctagatggggatttggggctgaatgtcatggtatatcttgaaaatcttagcgtataatggcaaagctgcctttaagttaggtttcaagaaagt

SEQ ID NO: 59195 - DNA, 201 bp, Homo sapiens
gcctttcttccggacggagcagctcatcatccgggcccctctcactgacaaacacatttaccagccatacccttcgggagctgatgtaccctttggacctycgcttgacatacagatactgcaccaggtaacctgctgtttgaagaaataagtcactctagatgaccttgtggtttgctggcttttacatgttgactactg

SEQ ID NO: 59196 - DNA, 201 bp, Homo sapiens
cttgatcgtgctgagctcggtggcttgctccttgggtgtcttcagctacattgggttgcccttgaccctcattgtgattgaagtcatcccgttcctggtgstggctgttggagtggacaacatcttcattctggtgcaggcctaccaggtatacttccatattctcacagggctcagcatctgttcaagtttcagggactg

SEQ ID NO: 59197 - DNA, 201 bp, Homo sapiens
taatcccagctactcgggaagctgaggcatgagaatctttggagccggggatgtggaggttgcagtgagctgagatcatgtcactgcactccagcctgggmgacagagcaagactctgtctcaaaaaaaaaaaaaagaaaaaaggaaaaggaaagataaatttataatgtattgccaggaccacacaaacccttcatatgt

SEQ ID NO: 59198 - DNA, 201 bp, Homo sapiens
cagtgggcttttctttgagtttaagtataatacaaaattttggatgtttttaattgagatttgtactcaacacaattcctttctgtagattttccagtccrtgggatggagcccatgaacaatgccaccaaaggctgtgacgagtctgtggatgaggtcacagcaccatgtagctgccaagactgctctattgtctgtggc

SEQ ID NO: 59199 - DNA, 201 bp, Homo sapiens
tatgtgtgagatcatgcagaatataatttacttttcctttagatgtccatcctgtttttataacctactgaacctgttttgtgagctgacatgtagccctygacagagtcagtttttgaatgttacagctactgaagattatgttgatcctgttacaaaccagacgaaaacaaatgtgaaagagttacaatactacgtcgg

SEQ ID NO: 59200 - DNA, 201 bp, Homo sapiens
tttaattgagatttgtactcaacacaattcctttctgtagattttccagtccatgggatggagcccatgaacaatgccaccaaaggctgtgacgagtctgkggatgaggtcacagcaccatgtagctgccaagactgctctattgtctgtggccccaagccccagcccccacctcctcctgctccctggacgatccttggc

SEQ ID NO: 59201 - DNA, 201 bp, Homo sapiens
atccatcagtcagtacctgcatgcgggtccgcctgtgtactttgtcctggaggaagggcacgactacacttcttccaaggggcagaacatggtgtgcggcrgcatgggctgcaacaatgattccctggtgcagcagatatttaacgcggcgcagctggacaactagtcagtaccaccttgtcttgtacttcagaagcagcg

SEQ ID NO: 59202 - DNA, 201 bp, Homo sapiens
tcagagtgttcacactctctcctattcttttatctttctttcaggactcctacatggtggattatttcaaatccatcagtcagtacctgcatgcgggtccrcctgtgtactttgtcctggaggaagggcacgactacacttcttccaaggggcagaacatggtgtgcggcggcatgggctgcaacaatgattccctggtgc

SEQ ID NO: 59203 - DNA, 201 bp, Homo sapiens
agcaccctggggccctggggggaagactggtggtgttaggaatcatgagtccagctggaggcatctcagccaggaacctcctggcaccctcttattctccrtgatcctcgccttgcttagttactatcagagtgttcacactctctcctattcttttatctttctttcaggactcctacatggtggattatttcaaatcca

SEQ ID NO: 59204 - DNA, 201 bp, Homo sapiens
gactcaccacattacaaggagccagaataagctggaacaaagtcagcacttctgtgtttctttcacatagagaatcatcaaatagacccactagtggggckgtctgccccatgtctgaagtgtagtaagagcaaagtgactctgtccactataggggaggctggactggaatcactcagtccaaagaagaccatccacggg

SEQ ID NO: 59205 - DNA, 201 bp, Homo sapiens
agcaaagtgcttgctgcctttcttcatctcgagactgtccttgatccttttacttctatggccacttcaccttgcacaaaaatgacccacggttgaaagarcaatactgatttgcttcatttatagctttgtcactaaattgaagcactgaagtagaagattaagaaaatgaggggctttttatcatctccgggggataga

SEQ ID NO: 59206 - DNA, 201 bp, Homo sapiens
ctggtcaggtattttgtagcatgtccttccatttggctttatctggtattttctcatgatgagattgaaataaggtgttttgacaagtacatcacagaagycatgttatgtctttctcggtgcatcatgtcagggatccctgatgttgatgcgtctctttcctggtgatgttaaccttgatcacttgctcaaggtgatgtc

SEQ ID NO: 59207 - DNA, 201 bp, Homo sapiens
gagcgcgcggaagaggcacttgcccacatgggcagctccgtgagtaccctgagcagggccacgccggcagagtcgcaccacaaagtaatcctcctcagtgrctgaagagtctggatcctgtacttacaaagcagcttctaaggattgcaagctttcaggcaattcatgaattagctgccacatcgtggacagaacggacgt

SEQ ID NO: 59208 - DNA, 201 bp, Homo sapiens; identical to SEQ ID NO: 11403

SEQ ID NO: 59209 - DNA, 201 bp, Homo sapiens
tgagatagcaactaatgctttccctgttccgactttcaggaacggcttggctcttaacctccaccttcccttcctctcccgttcttccaggagaggcgtcytgctgtgaccctgtcagcgcagcatttgagggctgcttgaggcggctgttcacacgctgggggtctttctgcgtccgaaaccctggctgtgtcattttct

SEQ ID NO: 59210 - DNA, 201 bp, Homo sapiens
ctttgctgagcagataggtagctgagggcaggggtctcatatgtgtccccaggtgggcttgattcctgccatgagatagcaactaatgctttccctgttcygactttcaggaacggcttggctcttaacctccaccttcccttcctctcccgttcttccaggagaggcgtcctgctgtgaccctgtcagcgcagcatttga

SEQ ID NO: 59211 - DNA, 201 bp, Homo sapiens
cttgtgaataaatagtaaatgtgtagccttttaaaataattctataataactttgcaaatacaggatgtgtcttacccttttgtacttcaaaaggattacrtgaatgaatgtgtcttagttcactgaggaatgttgaccttactctaactgttgcctactcccgtgtctgtgctctttcacctgaaaggaactctgtccag

SEQ ID NO: 59212 - DNA, 201 bp, Homo sapiens; identical to SEQ ID NO: 11410

SEQ ID NO: 59213 - DNA, 201 bp, Homo sapiens
atgccaccacacctagctaagttttatatttttagtagaggtggggtttcaccatgttggccaggctggtctcaaactcctgacctcaagtcatctacccrcctcagcctggttattacaggctgggattacaggcatgagccactgcacctagcctaatttttatttttttctagagatgagggtctcactatgttggcc

SEQ ID NO: 59214 - DNA, 201 bp, Homo sapiens
ttacaggcatgcaccccccacacctggctaattttgtattttcagtagagacagggtttctccatgtcggtcaggctggtctcgaactcctgacctcaggygattcacctgcctcagcctcccaaagtgctgggattacaggtgtgagccaccgtgcccggcctgttgttgttgttgtttttaagagacagggtttcactg

SEQ ID NO: 59215 - DNA, 201 bp, Homo sapiens
tgtttagctcaaggtttgtgagtgctccaatcgacactctgtatctagctgctctggtgaggacgtggagaacctttatgtctagctcaaggtttgtaaayacaccaatcagcaccctgtgtttagctcaaggtttgtgagtgcaccaatcgacactctagctgctctggtgaggacgtggagaacctttatgtctagctc

SEQ ID NO: 59216 - DNA, 201 bp, Homo sapiens
aaacaattttgcatcataattacttagaaaatacccgggagggggtgggggaggaggaccctttgtcatactccatgtaactcaccatcgcataactctgstcggcatccaggtactttttatactcatggttgagtttatcaaaaacagtggctatcacgggcagcgatgctctgtctgactcacttaacactggaaagg

SEQ ID NO: 59217 - DNA, 201 bp, Homo sapiens
atcaaaccaacttcatgtcagcttcagaatttccacacgttgctatgataaaaactaatctcaaaaggttaccaatgcaaaagtacctttaaaggacactytaagaaatacaatactttaaagacctgacagctagatgtcattcgcaacccctttctggttacggttaaaaaaaaaaaaaaaaaaaaaagctatagcagg

SEQ ID NO: 59218 - DNA, 201 bp, Homo sapiens
ggctgtctggcattctgactgagcccctctgggcacagctgcagaacacgaataactagtcttatgaggttactttatgagatgctctcctgattgtgggkctagcaggaggagcaccctggggccctggggggaagactggtggtgttaggaatcatgagtccagctggaggcatctcagccaggaacctcctggcaccc

SEQ ID NO: 59219 - DNA, 201 bp, Homo sapiens
tcactgttgggaaagagatcttcacctccattttcttaacttcaaaatggaaatgacagatgcttttgagtggtctgaatacttgaaatttgagggaaaaygttaccagaaacacatacaactagagttaaagataaatacatatatcaaacgcatggctcaaaaatgacaacgcgtcttctttatctgccttcacgtaga

SEQ ID NO: 59220 - DNA, 201 bp, Homo sapiens
tggtgtgggctgtctggcattctgactgagcccctctgggcacagctgcagaacacgaataactagtcttatgaggttactttatgagatgctctcctgaytgtggggctagcaggaggagcaccctggggccctggggggaagactggtggtgttaggaatcatgagtccagctggaggcatctcagccaggaacctcct

SEQ ID NO: 59221 - DNA, 201 bp, Homo sapiens
agaacatggtgtgcggcggcatgggctgcaacaatgattccctggtgcagcagatatttaacgcggcgcagctggacaactagtcagtaccaccttgtctygtacttcagaagcagcggaggaggctctcagccaggcagtcagctcaggcctgaaatgtctcactgaaaatagactttcttggaaaagttgtttttatgc

SEQ ID NO: 59222 - DNA, 201 bp, Homo sapiens
gattacatgaatgaatgtgtcttagttcactgaggaatgttgaccttactctaactgttgcctactcccgtgtctgtgctctttcacctgaaaggaactcygtccaggattcttctttggcaatgtcagtctctgttgtgatgttcggcagcttcagacactaaaagacaacctgcagctgcctctacagtttctgtccag

SEQ ID NO: 59223 - DNA, 201 bp, Homo sapiens
ttgcttgagcccagcagttcaagaccaatctgggcaacatggtgaaaccccgtctctacaaaaaatacaaaaattagccaggagtggtggtgcacaggtgrgaggatcgcttgagcccaggaggtagaggctgcagcgagccatgatcatgccactgcacgccagacttggcaacagagtgagactctgtcccagaaaaaa

SEQ ID NO: 59224 - DNA, 201 bp, Homo sapiens
agaggaattgagttattttgaaatacttgttggctggtgatttatatttcattgatttagacactgctctgagtatggcttcagaagtgttacatacgcakaataaaatcctttacagctattaaaaggagtgaggtaggaaagcatactgctaaaagcaaagaagccagatgagaactgtgtactgtacatccccacttg

SEQ ID NO: 59225 - DNA, 201 bp, Homo sapiens
ctgctcctgctcctccgctcctcctgcgcggggtgctgaaacagcccggggaagtagagccgcctccggggagcccaaccagccgaacgccgccggcgtcmgcagccttgcgcggccacagcatgaccgctcgcggcctggcccttggcctcctcctgctgctactgtgtccagcgcaggtgagcggtcgccggccaccgg

SEQ ID NO: 59226 - DNA, 201 bp, Homo sapiens
acttggcagtggtgacaggatgaacacgcagtgttcgggagtgagagcgagctttaatgaggcctcccctctcccctccagtgtgttttatgtcttctacraacagtacctgaccatcattgacgacactatcttcaacctcggtgtgtccctgggcgcgatatttctggtgaccatggtcctcctgggctgtgagctctg

SEQ ID NO: 59227 - DNA, 201 bp, Homo sapiens
gcaccctgtgtttagctcaaggtttgtgagtgctccaatcgacactctgtatctagctgctctggtgaggacgtggagaacctttatgtctagctcaaggwttgtaaacacaccaatcagcaccctgtgtttagctcaaggtttgtgagtgcaccaatcgacactctagctgctctggtgaggacgtggagaacctttatg

SEQ ID NO: 59228 - DNA, 201 bp, Homo sapiens
ggattgtaaatacaccaatcggcagtctatctagctcaaggtttgtaaacacaccaatcagcaccctgtgtttagctcaaggtttgtgagtgctccaatcracactctgtatctagctgctctggtgaggacgtggagaacctttatgtctagctcaaggtttgtaaacacaccaatcagcaccctgtgtttagctcaagg

SEQ ID NO: 59229 - DNA, 201 bp, Homo sapiens
ctactgaacctgttttgtgagctgacatgtagccctcgacagagtcagtttttgaatgttacagctactgaagattatgttgatcctgttacaaaccagaygaaaacaaatgtgaaagagttacaatactacgtcggacagagttttgccaatggtaagtaaacttttaattattcctcttttacagctggcatcaggaca

SEQ ID NO: 59230 - DNA, 201 bp, Homo sapiens
agctcaaggattgtaaatacaccaatcggcagtctatctagctcaaggtttgtaaacacaccaatcagcaccctgtgtttagctcaaggtttgtgagtgcwccaatcgacactctgtatctagctgctctggtgaggacgtggagaacctttatgtctagctcaaggtttgtaaacacaccaatcagcaccctgtgtttag

SEQ ID NO: 59231 - DNA, 201 bp, Homo sapiens
tgtatctagctgctctggtgaggacgtggagaacctttatgtctagctcaaggattgtaaatacaccaatcggcagtctatctagctcaaggtttgtaaayacaccaatcagcaccctgtgtttagctcaaggtttgtgagtgctccaatcgacactctgtatctagctgctctggtgaggacgtggagaacctttatgtc

SEQ ID NO: 59232 - DNA, 201 bp, Homo sapiens
caacactctgtatctagctgctctggtgaggacgtggagaacctttatgtctagctcaaggattgtaaatacaccaatcggcagtctatctagctcaaggwttgtaaacacaccaatcagcaccctgtgtttagctcaaggtttgtgagtgctccaatcgacactctgtatctagctgctctggtgaggacgtggagaacc

SEQ ID NO: 59233 - DNA, 201 bp, Homo sapiens
aaaagtatttccaacagttctatttgcgcatgattgcaaagatttacatccaagaatgggccaggagtggtggctcacgcctgtaatcccagcactttagsaggctgaggcaggcagattgcttgagcccagcagttcaagaccaatctgggcaacatggtgaaaccccgtctctacaaaaaatacaaaaattagccagga

SEQ ID NO: 59234 - DNA, 201 bp, Homo sapiens
tccagcactttggaggctgaggcaggaggatcactttagccagggaggtcaaggctgcagtgagctgtgatcatgccactagactacaacctgggtgacasagtgagactctgtctcaaaagaaaaaagaaaaaagcacagaaaaataaataaaattacttataaatgtgtgaaaagatttttaatctcacttataattaa

SEQ ID NO: 59235 - DNA, 201 bp, Homo sapiens
cttaattaaaaggaaaagtctattaacaaaaagagttctcaaaaatgctcaacctgaacctccttagggggttggcagaagcattaactaaagctctcctrtatttcaccaaaatgtgttggcaattcgtagcctgctggaggaagggaggtgtgagctgttccctgtgttcagctggacagcctcccactctctataggc

SEQ ID NO: 59236 - DNA, 201 bp, Homo sapiens
tttaccttagggaaggggctactgtcagggaggggtaattggggagcttcaactgaatctatagagtgtgtgtgtgtgtgtaagtatttttttattttttkgaagagacgggcctcactgtgttggtgaggctggtcttgaactcctggccttaagtgatcctcctgcctcggcctgccaaagtgttgggactgtaggtgt

SEQ ID NO: 59237 - DNA, 201 bp, Homo sapiens
tgaggctggtcttgaactcctggccttaagtgatcctcctgcctcggcctgccaaagtgttgggactgtaggtgtgagccaccacacctggcctatagtgsattattatttttatttagtttttaaattatgccatagccagttgttctgaatagtgcagtactacaaaacagagtcaaggtctcatgctgtcacccaggc

SEQ ID NO: 59238 - DNA, 201 bp, Homo sapiens
tgtgtcagaggtgctgaagatggaacaagcgtccaggcctcagagagctgtttgtttcgcttcttcaaaaactcctattctccacttctgctaaaggactrgatgagaccaattgtggtatgcgcttatctgtggtttttctctttcctctcactgaaacagattatcacatgccttctaagaagccagacagcctgggaa

SEQ ID NO: 59239 - DNA, 201 bp, Homo sapiens
ccaaaggtttggagtcgctgaggacgtggtactgcaggaactgatgcagcatataaaagaggttgtgctggacaagggttttgataacaagttcatgtagrtaatgctgaggacaaaagtaaaaagtgaaagaacacttccaaatcattcagctacaacagactagaggctccccaaggactggctattctaaccaacaca

SEQ ID NO: 59240 - DNA, 201 bp, Homo sapiens
accacgaccatgccattattattacattattattagctaaaccagagatcttaatcagatttcaccagctttttctctaatgcccttccctgtttcaaggycccatattacatttttgtgttttatgagtcccctctaatctgtgacagaaagttcctcagtctttccttttctggccttaacactcttgatgatactggt

SEQ ID NO: 59241 - DNA, 201 bp, Homo sapiens
tagcattcattgttgggtcttgtctgcaacagttataactaaggtgtttgcctgatagtgatttttttctctttccctctcttcctctgcatttactaacyggacttctgtacagaaagctatcccttctccctcatttatttactcagttatttacatcatggacttttaattctgtgggttgtatccaacactgtcatt

SEQ ID NO: 59242 - DNA, 201 bp, Homo sapiens
cagggcagggttgaacctcacccttcagaggctcctgtgtcggcatctcctctgtggggtgggaatagcgctcattgagggcagccaacaaaggtggcttygctgagcagataggtagctgagggcaggggtctcatatgtgtccccaggtgggcttgattcctgccatgagatagcaactaatgctttccctgttccgac

SEQ ID NO: 59243 - DNA, 201 bp, Homo sapiens
ttgatgaacacataacatgtgctatcgtgccagctagagattagtgctatgaggagaaaaataaggctggacagagtggggggtgcattgcttaagcgtgragatgtgcacaaagggagaggaaaggacagctgggcacatcacagggatgagagttcccggcagaaccagcagcaagtgcagagccctggcaggaagctc

SEQ ID NO: 59244 - DNA, 201 bp, Homo sapiens; identical to SEQ ID NO: 11337

SEQ ID NO: 59245 - DNA, 201 bp, Homo sapiens
tgcaggcctctgactccggaaggcaaacagaggcctcaggggggagacttcatgagattcctgcccatgttcctttcggataaccctaaccccaagtgtgrcaaagggtaagtgctgctgccattgcagataagcatccactgcaactttaatttgcagtagaaaactaggagaggactgggctaagacagttgcatggga

SEQ ID NO: 59246 - DNA, 201 bp, Homo sapiens
gaggaagggcacgactacacttcttccaaggggcagaacatggtgtgcggcggcatgggctgcaacaatgattccctggtgcagcagatatttaacgcggygcagctggacaactagtcagtaccaccttgtcttgtacttcagaagcagcggaggaggctctcagccaggcagtcagctcaggcctgaaatgtctcactg

SEQ ID NO: 59247 - DNA, 201 bp, Homo sapiens
caaatccatcagtcagtacctgcatgcgggtccgcctgtgtactttgtcctggaggaagggcacgactacacttcttccaaggggcagaacatggtgtgcrgcggcatgggctgcaacaatgattccctggtgcagcagatatttaacgcggcgcagctggacaactagtcagtaccaccttgtcttgtacttcagaagca

SEQ ID NO: 59248 - DNA, 201 bp, Homo sapiens
tttctttcaggactcctacatggtggattatttcaaatccatcagtcagtacctgcatgcgggtccgcctgtgtactttgtcctggaggaagggcacgackacacttcttccaaggggcagaacatggtgtgcggcggcatgggctgcaacaatgattccctggtgcagcagatatttaacgcggcgcagctggacaacta

SEQ ID NO: 59249 - DNA, 201 bp, Homo sapiens
ttcacactctctcctattcttttatctttctttcaggactcctacatggtggattatttcaaatccatcagtcagtacctgcatgcgggtccgcctgtgtrctttgtcctggaggaagggcacgactacacttcttccaaggggcagaacatggtgtgcggcggcatgggctgcaacaatgattccctggtgcagcagata

SEQ ID NO: 59250 - DNA, 201 bp, Homo sapiens
agtttgagactagcctggccaacatggtgaaaccctgtctctactaaaaataccaaaattagccgggcctggtggcgcacgcctggagtcccagctactcrggaggctggggcaggagaagcactcaaacccgggaggtggagcttggagtgagctgagattgcgccattgcacttcagcctgggcgacagagcgagaatc

SEQ ID NO: 59251 - DNA, 201 bp, Homo sapiens
tttcaggttcttgacttacaaatagccatcgaaaacattactgcctcttatgacaatgagactgtgacacttcaagacatctgcttggcccctctttcacygtataacacgaactgcaccattttgagtgtgttaaattacttccagaacagccattccgtgctggaccacaagaaaggggacgacttctttgtgtatgcc

SEQ ID NO: 59252 - DNA, 201 bp, Homo sapiens
ctcactgcaacctccacctcccaggtttaagcaattcccctgcatcagcctcctgagtagctgggattacaggcatccgccaccatgcctgcatgcctgamtaatttttgtatttttagtagagacggggtttcaccgtgttggccaggctgatctccaactcctgacctcaggtgatctgcccgccttggcctcccagag

SEQ ID NO: 59253 - DNA, 201 bp, Homo sapiens
gttggaggatttgagagaagctttaaaattttatcttattactgtcccttgcttaggtcacaagaggagctcaaaataatttcataaacatgaattggctkccctagacacaacaaaggataagatcaaaagaattaacccatttaaaaaaatcagtctaggctggtcctaaggtagtgtgttatcaattgatcaaagtca

SEQ ID NO: 59254 - DNA, 201 bp, Homo sapiens
gatgaacgtcttcaaggggaaaccctggatcagcagctgggcagggtcctaggagaagtggctcccagtatgttcctgtcatccttttctgagactgtagmatttttcttaggtaattatgctttcaatcctaccagtcctgtagtctgctgagcctggagaaagaaggagctggctacctgaacatgtccctttgtgttg

SEQ ID NO: 59255 - DNA, 201 bp, Homo sapiens
aacttgatctctgcgccactgcacagctgcaagagacacacactggaaaatggcttaaggcagggggcgcttggagagcaggcggctcagagcagggcccrgcccacattcttggccaacaatgaaccagaatccctaactgctggttatttgggatgctgcctgtatgtagactttttatattgttaggggttttttttc

SEQ ID NO: 59256 - DNA, 201 bp, Homo sapiens
ctgacaggacatgggtgtacacatctgactggtccagcaccgcctgggtccgcaccggcctcttgaggagcgggctgcttcggctctgccctgcttccacygcctgaaagaaaaaaaccacaaactatgatcttcggcatcttagaggaagggtgctgtttacagttcatccacaaggactgaattcttcgatgtggaccc

SEQ ID NO: 59257 - DNA, 201 bp, Homo sapiens
agcaccgcctgggtccgcaccggcctcttgaggagcgggctgcttcggctctgccctgcttccaccgcctgaaagaaaaaaaccacaaactatgatcttcrgcatcttagaggaagggtgctgtttacagttcatccacaaggactgaattcttcgatgtggacccaggatatgagcggaaaacactttctctacttagat

SEQ ID NO: 59258 - DNA, 201 bp, Homo sapiens; identical to SEQ ID NO: 11356

SEQ ID NO: 59259 - DNA, 201 bp, Homo sapiens
tcacactctctcctattcttttatctttctttcaggactcctacatggtggattatttcaaatccatcagtcagtacctgcatgcgggtccgcctgtgtastttgtcctggaggaagggcacgactacacttcttccaaggggcagaacatggtgtgcggcggcatgggctgcaacaatgattccctggtgcagcagatat

SEQ ID NO: 59260 - DNA, 201 bp, Homo sapiens
gaatgctagggacctggcctagggacatttgttcagccagttgagcaaccacagtggctatttcttcagcatgggaacagagaaattattcctttttgccyttaaggacactgctcagccgactacttctcaagagctaaggactctcacttctggttctaaagaactttgaccttgagttctgtttgtttgttactggag

SEQ ID NO: 59261 - DNA, 201 bp, Homo sapiens
aggttttctgcaagggatgtttcccaaaggagtctgaccacttggcagtggtgacaggatgaacacgcagtgttcgggagtgagagcgagctttaatgagrcctcccctctcccctccagtgtgttttatgtcttctacgaacagtacctgaccatcattgacgacactatcttcaacctcggtgtgtccctgggcgcgat

SEQ ID NO: 59262 - DNA, 201 bp, Homo sapiens
ttattttgcatttgtctgtccattactcttcccagactggccccctccttcaggagcccccttggtgggcaccccatgctctaggacaggacatcttttcyttgaattattattattttttttttagagatgggatcttgctatgttgtccaggctggactcaaactcctgggttatagccatccttctgcctcagcttcc

SEQ ID NO: 59263 - DNA, 201 bp, Homo sapiens
aaccctccactcctaaaagggatgcagtattctaagcatggcagattacctacagcggaagcctggatcagtcatctctgatctcgggtgcccctttctgscctttgacctccagctctgtgaagggcatcagctctccagtcaaattgaactgcttgctagcaaaatcctgcccatcttccagggccccatttcacatgc

SEQ ID NO: 59264 - DNA, 201 bp, Homo sapiens
tttgacctccagctctgtgaagggcatcagctctccagtcaaattgaactgcttgctagcaaaatcctgcccatcttccagggccccatttcacatgctamattatctacgacattcttgtcctgttcccctaactagaatgccttccctctgaagttctgaatctttatttaaactgctgcaacagcatttgctgcctca

SEQ ID NO: 59265 - DNA, 201 bp, Homo sapiens
tgccaaatctcaaattttccagatattctacttcaggatgtatttggccatggtcttactgggagccactcacggattaatatttctccctgtcttactcrgttacataggtaagagttctcatcttaaaagggtggcacaatagaaggacattactgaaagggaattctatcctgaggcattcttttcaagtatttgaac

SEQ ID NO: 59266 - DNA, 201 bp, Homo sapiens
ggagatgactgtcaccctagttaacctgtctttccagaacaagggtaaaacaaaatgaatgtgtaagcatctccttgaagattagggaaagaagatcctgsgaagtttctagcaagcagagactggtaaatgagaatcgacagtacaggacccattccagctattttcttaggtgtaatacactgatactatccttatgta

SEQ ID NO: 59267 - DNA, 201 bp, Homo sapiens
tgtcgcataatttttttttttttttttaagagagatgaacgtcttcaaggggaaaccctggatcagcagctgggcagggtcctaggagaagtggctcccaktatgttcctgtcatccttttctgagactgtagcatttttcttaggtaattatgctttcaatcctaccagtcctgtagtctgctgagcctggagaaagaag

SEQ ID NO: 59268 - DNA, 201 bp, Homo sapiens
aagatacaaaattttaaaatgtaatgtgcagaatagtattttactgtttgtgtggttaagagggaaaggggaagaatctgtgtgtttgcttgtgtgtgtgyggagtggctctggaaagattcgcagatggtcacagtatggggaggagaactaagacaatgaaacagatgttggagaaggagagaattttcgataaacact

SEQ ID NO: 59269 - DNA, 201 bp, Homo sapiens
gattcattttgcccaaaggtgccactaaaaaggcaaaaggtcaacacgtgtcccgctgctgtagaaggtggtctcagtcgtcctgtagacccgacgtgggyggagactcagtgcacgtgagagtgatgttcactggtccagtcccctgccgcctgtgttccgagtgttttcctgataatgtggctggctcagctttccctt

SEQ ID NO: 59270 - DNA, 201 bp, Homo sapiens
cagatcagcagcagaaaaaaattttttaaaaagctttttaaaaaaattttagaagaaatcaaaggtttttttggtaataaaattttattggcttggcatgrtggttcatacctattatccagcactttggaggctgaggcaggaggatcactttagccagggaggtcaaggctgcagtgagctgtgatcatgccactagac

SEQ ID NO: 59271 - DNA, 201 bp, Homo sapiens
atagggtcttgcttttttgcccaggctggcctcaaactcctggcctcaggagatcttcccacagtgctgggattacaggtgtgagtcactgcacctggccragtccattatttttttaatgttgaggcaaatgttgtgaaatggtatgactgatagttaactgggtaatgaggaaatgagaattgtattattctccatgtg

SEQ ID NO: 59272 - DNA, 201 bp, Homo sapiens
tgaaaggaactctgtccaggattcttctttggcaatgtcagtctctgttgtgatgttcggcagcttcagacactaaaagacaacctgcagctgcctctacrgtttctgtccaggtaggttctgctggggaaacagaacaactgggctgtagatacttgtgaactggtaatgctcagctttccatttattctttgtttacat

SEQ ID NO: 59273 - DNA, 201 bp, Homo sapiens
caggcttctggtaagccggggggggggtggtgtatgttctagaggttaacagcagtgcacagtgtaacgtcatatttttgcctctttattcttattccatyatgtttaaaactgccataaattcccccatgttttaattgtatgtaacgtttctgttgcctacatctattttcttcattccaactttttggtttatcttaa

SEQ ID NO: 59274 - DNA, 201 bp, Homo sapiens
tgtgggaaggacgctgacgcctgtaatgccaccaactggattgaatacatgttcaataaggacaatggacaggcaccttttaccatcactcctgtgttttmaggtaggtataaagattccaagtttggtgtgtttatgatattgttttaaagccaaggaactggctgggcacagtggctcaccagtgcttggggagactga

SEQ ID NO: 59275 - DNA, 201 bp, Homo sapiens
tgcaccattttgagtgtgttaaattacttccagaacagccattccgtgctggaccacaagaaaggggacgacttctttgtgtatgccgattaccacacgcrctttctgtactgcgtacggtaagtggcaagagacaatcattggtagacaccattcttgggtctgacttagggtacatgggcaaaagcttgttttatgagc

SEQ ID NO: 59276 - DNA, 201 bp, Homo sapiens
tgggattacaagcatgagccaccgtgctggccctggaatcttttttttttttttcaagaccaggtcttactttggttgcccaggctggagcgcagtggcaygatcttggctcactacagcctcgacctcccgggctcaggtgattctcccacatcaagcctcccgagtagctgggactataggtgtgcaccatcatgccct

SEQ ID NO: 59277 - DNA, 201 bp, Homo sapiens
gttaaattacttccagaacagccattccgtgctggaccacaagaaaggggacgacttctttgtgtatgccgattaccacacgcactttctgtactgcgtayggtaagtggcaagagacaatcattggtagacaccattcttgggtctgacttagggtacatgggcaaaagcttgttttatgagcataacccagaggtgagc

SEQ ID NO: 59278 - DNA, 201 bp, Homo sapiens; identical to SEQ ID NO: 11374

SEQ ID NO: 59279 - DNA, 201 bp, Homo sapiens
ccctcttattctccatgatcctcgccttgcttagttactatcagagtgttcacactctctcctattcttttatctttctttcaggactcctacatggtggwttatttcaaatccatcagtcagtacctgcatgcgggtccgcctgtgtactttgtcctggaggaagggcacgactacacttcttccaaggggcagaacatg

SEQ ID NO: 59280 - DNA, 201 bp, Homo sapiens
cccccatccagccaggcagccagttacccacggaagccagatatatggcccaaaaatagtgatgatgaccggaagtctctggccttgatttggaagctttkggaggtggaagatgagtatccccatgtatgttaggtaaaccctgaacttaggtttttcataagaacatacatctgaccagagtcatatcagtgaatcatt

SEQ ID NO: 59281 - DNA, 201 bp, Homo sapiens
tggcttgctccttgggtgtcttcagctacattgggttgcccttgaccctcattgtgattgaagtcatcccgttcctggtgctggctgttggagtggacaayatcttcattctggtgcaggcctaccaggtatacttccatattctcacagggctcagcatctgttcaagtttcagggactgtgaatggctcctgggctccg

SEQ ID NO: 59282 - DNA, 201 bp, Homo sapiens
tagtacccgaataggcttcgccccctcgtcctggatcgacgattatttcgactgggtgaagccacagtcgtcttgctgtcgagtggacaatatcactgacyagttctgcaatgcttcaggtaccttctcctttaccaaatctttcctgttttgctgaaaaattttcaaattatcatttaaaaatcatttgcatcgtgcctc

SEQ ID NO: 59283 - DNA, 201 bp, Homo sapiens
catattatatgattggatttatgtgaactgtctgaaatagtcagataaatagagacagttcagtggttgcttagggcttagggaagtagggaggtagttgwgcatagctagaatacaggatttcttttgaggtgatgaaaatgttataaaattgactatggtgatagttgcatatatctatgaatatgctaaactccatta

SEQ ID NO: 59284 - DNA, 201 bp, Homo sapiens
ttgggtttgggtttcattccagatttaaaagaagtggattgggttagccatttttaggtcacacatgcctttgagaagctgtcgaaggctaagtacctttycccagaataatgcaattgcaaacctctgcattgttgttcagcttgaaggtcatgggcctccgaagttcatttatagaccctctagggagctcatggacct

SEQ ID NO: 59285 - DNA, 201 bp, Homo sapiens
atagcgccaccacacctggctaatttttttttatttttttattttttgtagagacggggttttgccatattgcccaggctggtctggacctcctgagctcwggcagtccacccaccagggcctcccaaattactgggattaaaggtgtgcataaccacccctggcccaaagacaaatatcttaaaagcaaatagagacaag

SEQ ID NO: 59286 - DNA, 201 bp, Homo sapiens
tggagcaggtcagtaaccctgtctgtcctctctagtacccgaataggcttcgccccctcgtcctggatcgacgattatttcgactgggtgaagccacagtygtcttgctgtcgagtggacaatatcactgaccagttctgcaatgcttcaggtaccttctcctttaccaaatctttcctgttttgctgaaaaattttcaaa

SEQ ID NO: 59287 - DNA, 201 bp, Homo sapiens
ttgttcaattacaggttggtaaaagtggtttctaacacagtatctcttcttttaggtgttcagtggaatcacacttacaaaatttggagggattgtggtgktggcttttgccaaatctcaaattttccagatattctacttcaggatgtatttggccatggtcttactgggagccactcacggattaatatttctccctgt

SEQ ID NO: 59288 - DNA, 201 bp, Homo sapiens
tgggaagtttctagcaagcagagactggtaaatgagaatcgacagtacaggacccattccagctattttcttaggtgtaatacactgatactatccttatrtaatgtgttgtgtgtatgtgtaagaaaataaaatccaaaaagataacagtattaggggttttttttgttttttttttttgtttttttgtgatggagtctt

SEQ ID NO: 59289 - DNA, 201 bp, Homo sapiens
gtcttcaaggggaaaccctggatcagcagctgggcagggtcctaggagaagtggctcccagtatgttcctgtcatccttttctgagactgtagcatttttyttaggtaattatgctttcaatcctaccagtcctgtagtctgctgagcctggagaaagaaggagctggctacctgaacatgtccctttgtgttgcttcctt

SEQ ID NO: 59290 - DNA, 201 bp, Homo sapiens
cctcggcctcccaaagtgctgggattacaggcgtgagcttccatgcccagctggaagcttacatcttaatggagggagacggttgatgaacacataacatrtgctatcgtgccagctagagattagtgctatgaggagaaaaataaggctggacagagtggggggtgcattgcttaagcgtggagatgtgcacaaagggag

SEQ ID NO: 59291 - DNA, 201 bp, Homo sapiens
cagggtcaggtgattttgcttagcctcaagtgctcagattctgctgatattttgcaagacctggactctcttgacacccaggattctttcctcaggggacrtgctgcctatagttctgcagttaacatcctccttggccatggcaccagggtcggagccacgtacttcatgacctaccacaccgtgctgcagacctctgct

SEQ ID NO: 59292 - DNA, 201 bp, Homo sapiens
agccgtgcacaccttctctctctttgcgggattggcagtcttcattgactttcttctgcagattacctgtttcgtgagtctcttggggttagacattaaabgtcaagaggtaagttggtgccaggattatagtctatttaatttgagtctagaatctagaggaagcagctagcgggtataacctttgtttccctctgtccc

SEQ ID NO: 59293 - DNA, 201 bp, Homo sapiens
ccagcctcatcaaatgttcactgtgtaaatgtttaggtccctgatgtcttgaggcccttctaactgggaggtgttttctaaactttttggcagggctcctkcctctctgaatgatacaagtttgctccatgacccttgtctgggtacgtttggtggaccagtgttcccgtggcttgtgttgggaggctatgatggtaagta

SEQ ID NO: 59294 - DNA, 201 bp, Homo sapiens
cactgtcagtattttaaaatgttttacaaaaaatctggagacctattcttctaacagtcctccctgcatgtctccgccagtggttgaccctgcctgcgttygctgcaggcctctgactccggaaggcaaacagaggcctcaggggggagacttcatgagattcctgcccatgttcctttcggataaccctaaccccaagtg

SEQ ID NO: 59295 - DNA, 201 bp, Homo sapiens
ttttaagagagatgaacgtcttcaaggggaaaccctggatcagcagctgggcagggtcctaggagaagtggctcccagtatgttcctgtcatccttttctragactgtagcatttttcttaggtaattatgctttcaatcctaccagtcctgtagtctgctgagcctggagaaagaaggagctggctacctgaacatgtcc

SEQ ID NO: 59296 - DNA, 201 bp, Homo sapiens
gttgattaaaaacaaagcttattttctgcattttccaataatattgtaaaaaatacttcatacccttcattgtttgggtttcatgtcttcattacattccytttacttcgtattatcttttaagattttgtagaagaatttcacttgggtaactgtaggcttaaatgatgcaatgctttctggaatccaggggtgactgac

SEQ ID NO: 59297 - DNA, 201 bp, Homo sapiens
cattttttaccaaaattcaaacttcatgaaaccctggcatttcatcctttgccttccatcctcatggccaccatcaaagtccacatctttattatcttacrtgtgaacagctgtaataacctttccagttattaattctttaaacaccacttttagcctgatgcatttcttttcaagaacctacggtatgtttatagtcca

SEQ ID NO: 59298 - DNA, 201 bp, Homo sapiens
atgtaaacatgtgttttaaaagctgtgtgttatggcgttccttcctttatgggttccaggtggagaatctgattctctcattgcctgagaaaagacccacwggggtcccagcgccactcccctgtagttctgcctttgtcttgggatgctaatgggatgtcatgaggggaggtggaggggggctggaagagaagaaaattc

SEQ ID NO: 59299 - DNA, 201 bp, Homo sapiens
aggcccgggtgtcccctgggctttggggtgtgccaatttgccctgtaaaccagtacccccggcccggagccgcggcgcgccggggcctcgcggactggctstcttcccgcggacaacctgtcgcgtcggggatgcccgcggccccgccatgcagctctggccgcttctatctgctgcgtgctgtcccggggacaaagacag

SEQ ID NO: 59300 - DNA, 201 bp, Homo sapiens
aaggtatagtaaccttttaacttataaaaatatgtgattttaaccatattaaagcatatctgattttcacatactacaaaaggtatagtatccttttaacttataaaaatatgtgattttaaaccatatttagattagttccatcatattttggaatggtgaatggtatgacaattttcctatacatttgccaattacaag

SEQ ID NO: 59301 - DNA, 201 bp, Homo sapiens
tgtcactcacccatacccccaacctcaccaatcctccaaagtggattagttgttgcttaggtgtgttttgtctttatattgcgtaaatattgtgaagaagkctctttcctctgtggtgctacaaagataattttttttcccgttacagtcaagctacaacttcaagcagaagagagaggagttgtgtctatcaaaggagtg

SEQ ID NO: 59302 - DNA, 201 bp, Homo sapiens
aaaggtatagtaaccttttaacttataaaaatatgtgattttaaccatattaaagcatatctgattttcacatactacaaaaggtatagtatccttttaacttataaaaatatgtgattttaaaccatatttagattagttccatcatattttggaatggtgaatggtatgacaattttcctatacatttgccaattacaa

SEQ ID NO: 59303 - DNA, 201 bp, Homo sapiens
aaaaggtatagtaaccttttaacttataaaaatatgtgattttaaccatattaaagcatatctgattttcacatactacaaaaggtatagtatccttttaacttataaaaatatgtgattttaaaccatatttagattagttccatcatattttggaatggtgaatggtatgacaattttcctatacatttgccaattaca

SEQ ID NO: 59304 - DNA, 201 bp, Homo sapiens
tccaggtgctgtctctctcaggttagcttgggctttttcagtggctggatctcaagaggaaagggttccaagagagcaagctccattgtgtaagccgctgkttgcatcctgtttgctaatatcaaaattgccaatgtcacatcagtcaacatgtctaggactagattcagtttgggaagagctacagaagatataaatatc

SEQ ID NO: 59305 - DNA, 201 bp, Homo sapiens
ctgcatagttcccctggtataatttagaatgtgtcatgcagctgcagtcaagtggtcacggggacaagaatatctgaaatggctttacttacatgtccaayaccttagcagggataactggaatcctaatgatatctttctccaggtgctgtctctctcaggttagcttgggctttttcagtggctggatctcaagaggaa

SEQ ID NO: 59306 - DNA, 201 bp, Homo sapiens
ccgctcccccatccttgcatccaaccaattgcttggatcaaagcacaattttagtattatttcaacctgctatgtcttgttggatggcaaatgaagagatracagagtggcatgcttcaaaggggcagtgtggttcagcattcagcaaaagaagaggattaggactgctgatcttgaccctagattgctgggtaactttaa

SEQ ID NO: 59307 - DNA, 201 bp, Homo sapiens
tatgtctttttagtgtaagaaataagaacacatagtataagaagactttctttggggagagaagacttcttggtattttcatccattcccctacttccccygctcccccatccttgcatccaaccaattgcttggatcaaagcacaattttagtattatttcaacctgctatgtcttgttggatggcaaatgaagagataa

SEQ ID NO: 59308 - DNA, 201 bp, Homo sapiens
agggagcaaaaaaaccaacatgaccagttttttgtggcacaggggaaggaaacacattcaatagttgtgattttaggcttcttttttgggatggaagtgtmagtactggagccagaaactatttcctttactacctgtgtacttgcttttatgacgcttagaaaatgtatacactatagctattaactatgtctttttagt

SEQ ID NO: 59309 - DNA, 201 bp, Homo sapiens
caggataagggaagtagaaagtagaagagggaaaggaagaaagagaaaaaaacaaaaacaaaataaagtgagaacaagcaagagaagatttaggttgaaayagacattcatattcaaaactcccaagtagctagttgtatgggactcttagcgctctcttcagagagcggttccaaatctcacaagaagaagggagcaaaa

SEQ ID NO: 59310 - DNA, 201 bp, Homo sapiens
acaacatcaagaaagtgaaaagaggccgggcgcggtggctcatgcctgtaatcccagcactttgggaggccgaggcgggcggatcacgaggtcaggagatygagaccatcctggctaacacgtgaaaccccgactctactaaaaatacaaaaaattagccgggcgtggtggcgggcgcctgtagtcccaactactcgggag

SEQ ID NO: 59311 - DNA, 201 bp, Homo sapiens
gcccacttgaggctggagacctcatattgctaataacaccagtttggatgaatgtatcatttccagaacattgtgtatgttgaacattgtgtatgttcaasaatgtatgttcaagaatgcagaagctggctgggcgcggtggctcacgcctgtaatcccagcaatttgggaggccaaggtgggtggattgcttgagctcag

SEQ ID NO: 59312 - DNA, 201 bp, Homo sapiens
tggctaacacttgctgagggcccacttgaggctggagacctcatattgctaataacaccagtttggatgaatgtatcatttccagaacattgtgtatgttsaacattgtgtatgttcaacaatgtatgttcaagaatgcagaagctggctgggcgcggtggctcacgcctgtaatcccagcaatttgggaggccaaggtgg

SEQ ID NO: 59313 - DNA, 201 bp, Homo sapiens
acctctaagtcactgcttttactctgcaaaactattaagctataatttaaaaaaaattttcttctattatgcagttgtttgaagatcattgggaataaatrtatacaattttgattattggtttttaagtttcttctttagaatgtgacgtacaaaacactagcaatgtagaacactagttgagaatgtaagctttctgcc

SEQ ID NO: 59314 - DNA, 201 bp, Homo sapiens
gtggcccaatcatggttcactgcaacctccacctacccaggctccagtgattcttgtgcctcagcctcccaagtagctgggattacaggcatatgccaccrcgcctggctatttttttgtattttttgtagagacaggttcttgccatgttgaccaggctggtctcgaattcctggcttcaagcaatccacccaccttggc

SEQ ID NO: 59315 - DNA, 201 bp, Homo sapiens
gatgctgttattgtctctcagctccgaatctgcccttctgtacttgcttagtgatgctggagctgggattctgctaaccagtttctgctttgccagctgaytcccttttatgctccaccattagactgcaaggctggaggaggaagggactagctccttaatgtgggccttctgtgtgctcgtggttcctgtgagtatcac

SEQ ID NO: 59316 - DNA, 201 bp, Homo sapiens
ttagttatctattatttaaaataatatattagcttattttaaagctaatcccagatattatgtttcattttgcatgtctgttgctgtcttggtaggaaaawttttaaaacataaattactatgacataatgatatctaacaaagttaattatttaagaaactttcaaaagttgctttttcatgccgtttccctagctacct

SEQ ID NO: 59317 - DNA, 201 bp, Homo sapiens
tgtttgtttgtttgtttgttttgttgttgttgttgagacagggtcttctctgtcatccaggctggagtgcattcgtgctatctcggctgactgcaacctcygcctcccaggcccaagcaattcttgtgcctcagccttctaggtagctgggattacaggcgcatgccaccatgcctggctaattttttttattttttgtag

SEQ ID NO: 59318 - DNA, 201 bp, Homo sapiens
gtagaaactttgcttaactccatatgtggaaactatacatctgttcactgatgtatacctagtgcttagtgcaccatgtatttttcttaataacacatctycaccttatataatattcattcgttttattatttgtatcttatgcatttgaatgtaagctccctatgcagaaactttactttgttcactgatgtgtaccta

SEQ ID NO: 59319 - DNA, 201 bp, Homo sapiens
caacaaaaaatcccccacaaaaaccccattcaagggtcagcagcctcaaagactgaaaatagacaaactcacaaagatgagaaagaatcaacgaaaaaatkatgaaaacccaaaaggccaaagtgcctcttctcctccaaatgatcgcaatgtctctccatcaagggtgcagaactgtatggaggatcagatggacgaatt

SEQ ID NO: 59320 - DNA, 201 bp, Homo sapiens
tttttcccctttgaggtcagtaagtatcttcagtgctaccctgtgaagttgctttttgaacaatttatctttttttttttttttttttgttttgttttgtwtttttgagacggagtctcgctgtgtctcccaggttggagtgcagtggcgcgatctcggctcactgcaagctccgcctcccaggttcatgccattctcctg

SEQ ID NO: 59321 - DNA, 201 bp, Homo sapiens
tagccttctactgctgcttctgataaaagtaaaaatgatccctgattggtaacctaccttgggactgggaagagtgtggatggatcataaatactgctggragctatagctttgggcttcccatagcatatttcttcttactgggtatgtccctccttgtgtttaacacctgacctgtctgttttggagctggagaattgt

SEQ ID NO: 59322 - DNA, 201 bp, Homo sapiens
aatctcgggtcactgtaccctctgccttctgggttcaagcaattctcctgcctcagcctcccgagtagctgggattacaggaatgcaccaccatgcctggytaatttttttgtattttttagtagagacagggtttcgccatgttggctgggctggtcctgaacttctgacctcaggtgatccgcctgccttggcctccca

SEQ ID NO: 59323 - DNA, 201 bp, Homo sapiens
ataatgtggtgtgacaagtcatctttctcaggatcttattttatgaaaatctttcatcacacttattttatgaaaatcatttgctgtgtaagcaaattaartataagcattttgtgtttccactagatagatatttgcacacaaaaaaatagacatcaaaatcccatatagaaagctaaatgcatctatagttcattgaag

SEQ ID NO: 59324 - DNA, 201 bp, Homo sapiens; identical to SEQ ID NO: 11418

SEQ ID NO: 59325 - DNA, 201 bp, Homo sapiens
tatcaacacccaaatcaaccaagtagaagaaaggatatcagaatttgaagaccaccttgctgaaataaggcatgcagacaagactagagaagaaagaatgkgaaggaatgaagaaagcctccaagaaatatgggacttcataaaaagaccgaacctactatcgattggagtaccagaagaagacagggagaacagaaacaa

SEQ ID NO: 59326 - DNA, 201 bp, Homo sapiens; identical to SEQ ID NO: 11419

SEQ ID NO: 59327 - DNA, 201 bp, Homo sapiens
tcattgatttttttgtagggtttttcgtgtctctatctccttcagttcttctatgatcttagttatttcttgttttctgctagcttttggattagtttgtkcttccctctttagctcttttaattatgatgttagggtgttgatttgagatctttcaagctttctgatgtgggcatttagtgctaaaaatttccctcttaa

SEQ ID NO: 59328 - DNA, 201 bp, Homo sapiens
tcaataccctttgtttctttctcttgcctgatttccctggccagaatttccaatactatgttgagtaggagtggtgagagaggcatccttgccttgtgccrgttttcaaagggaatgcttccagcttttgcccattcaatatattggctgtgggtttgtcacaaatagctcttattattttgagatatgttccatcaacac

SEQ ID NO: 59329 - DNA, 201 bp, Homo sapiens
cgacccgctctctccgcctcatttccatttcgtgggttctcgcccgctctctcccctccagcctgcaccctcctcccggatcttcactgcgaccctagcgstccgtgtggtttctggccgcgcggccctcggcggtttcgggttcaccactcaccccctcctttccgggctgcggcgtaggcccgggtgtcccctgggctt

SEQ ID NO: 59330 - DNA, 201 bp, Homo sapiens
cgtgcacataggtatacgtgtgccatgctggtttgctgcacccattgacccatcctctaagttccctcctttcactccccaccccacaacaggccctggtrtgtgttgttccccactctgtgtccatgtgttcttattgttcaactcccacttacgagagagaacatgcggtatttggttttcttttcctgtgttagtttg

SEQ ID NO: 59331 - DNA, 201 bp, Homo sapiens
ttgatatggttagtttaaatctgacattttgctatttttctttttttaaaatttcttctaaaaaaatgggatacatatgcagaacgtgcacataggtataygtgtgccatgctggtttgctgcacccattgacccatcctctaagttccctcctttcactccccaccccacaacaggccctggtgtgtgttgttccccact

SEQ ID NO: 59332 - DNA, 201 bp, Homo sapiens
gaggccgggcgcggtggctcatgcctgtaatcccagcactttgggaggccgaggcgggcggatcacgaggtcaggagatcgagaccatcctggctaacacrtgaaaccccgactctactaaaaatacaaaaaattagccgggcgtggtggcgggcgcctgtagtcccaactactcgggaggctgaggcaggagaatggcgt

SEQ ID NO: 59333 - DNA, 201 bp, Homo sapiens
atttaaagctgtaactttcccattaaacatgctgagttttcattatcataaaactagaaatattttctaaatttctttgtgatttattttctctgtttttktttgtttgtttgtttgttttgttgttgttgttgagacagggtcttctctgtcatccaggctggagtgcattcgtgctatctcggctgactgcaacctccg

SEQ ID NO: 59334 - DNA, 201 bp, Homo sapiens
atacaaatatttaaagctgtaactttcccattaaacatgctgagttttcattatcataaaactagaaatattttctaaatttctttgtgatttattttctytgtttttgtttgtttgtttgtttgttttgttgttgttgttgagacagggtcttctctgtcatccaggctggagtgcattcgtgctatctcggctgactgc

SEQ ID NO: 59335 - DNA, 201 bp, Homo sapiens
gttagtttttcttcttcaggatttctgaaaataggaataataatcttattccagaagaaaggacataattatgttaaacaaaaagggaacattcccaactwgatcacagtgatcgtgatgtggagatgttgtgggctgctgttgcctgtattctggagacttgtggtcacagcagtaaacaattgctgctgggcctgttgt

SEQ ID NO: 59336 - DNA, 201 bp, Homo sapiens
ccccacaatatggagggcaatctactctactcaaagtccactgattcaaatgtaaatttcattctaaaacacccttacagaatcatccagaataatgtttracctaatagctgggcactatggcccagccaagctgacacataaaattaaccatcacaaggcatttgttgacataaaccctagactggcctgactgtccaa

SEQ ID NO: 59337 - DNA, 201 bp, Homo sapiens
gggagtgctacaggtgtatcttggactgaccccatggactgggtttggtctatgagcagcagtattcactggaagtcaacctggctttggagtctcatcayagaggatgaccttgctatgtggaataggctgcctggggctgggactgatgacctgatgacctagcaactcgatttttaggaggcttgtttcagtctgggc

SEQ ID NO: 59338 - DNA, 201 bp, Homo sapiens
aatactcttgatggcatctagaattgtcagttatttccagaaggttttctttctttctttttctttttttctttctttctttctctttttctttctttctytttctttctttctttcttccttccttccttccttccttccttcctttctttcttcctttcttcctttctttctttctttttttttgactgggacctactc

SEQ ID NO: 59339 - DNA, 201 bp, Homo sapiens
gatatatacttgtgtagtaaataggaagactgagatctgaaaaggatgtatacctaactgctaacaagtgcttacagctttagagaaaggaatgggattaraagagacgagatcaaggggaatggtcacttctttacctatgtatttgtgaattttttaaaagaatgtatccatgtattatttatgcaaaattttctgaga

SEQ ID NO: 59340 - DNA, 201 bp, Homo sapiens
tcagcacaactgctttactttccttcaggaaatgatacttaattagtatttgaaagcagtacattatcttgaattcactgtctattctaaggcaaagcacmccaaaaatctaaaatcaaatatattctccatgatgtatttacttttctaaggtgagagaattataaccgtattctttgggaatgtcctcttatactcacg

SEQ ID NO: 59341 - DNA, 201 bp, Homo sapiens
tcctcactcattcatctgccccttggcttatttcttttcaagtcccacacagagaagcaaggccttgatcattatcagcacaactgctttactttccttcrggaaatgatacttaattagtatttgaaagcagtacattatcttgaattcactgtctattctaaggcaaagcacaccaaaaatctaaaatcaaatatattc

SEQ ID NO: 59342 - DNA, 201 bp, Homo sapiens
tcctttgtcagttatctatgcattaaacggttttcagtgcctggtcttcagcattggattggatgatggctgatggaagaaaaaaaaacagtggttatacmttggaatttagttttcagttactggtgaattttagatccaaggagactactaaacctggctcagttatttttggacaccaaaacataattttattggaaa

SEQ ID NO: 59343 - DNA, 201 bp, Homo sapiens
cagaagaagttcctgtttcgggaaacacttgtggactggggttttttgccgtcagtcacacgatggatgcacgggtgggctgtggagcactcctgggaagsgggcatggtcaggcctgtgcccgcgcattacaaggggcgcattcctcactcattcatctgccccttggcttatttcttttcaagtcccacacagagaagc

SEQ ID NO: 59344 - DNA, 201 bp, Homo sapiens
gaatggtcacttctttacctatgtatttgtgaattttttaaaagaatgtatccatgtattatttatgcaaaattttctgagaagaatgaatgggaagtgargaagtggatgcagatgttgaatacttttctctgaggtgcatgaatgtgaagggaaggagagagataggatagcagccagaagaagttcctgtttcgggaa

SEQ ID NO: 59345 - DNA, 201 bp, Homo sapiens
aaatctctctcagactattttcctgaacatagtaagtgatgtatggacatatcttcaaagaagatattgtgggtttggttccagaccaccgcaataaagtraatatcacaataaagcgagccacataaactttttggtttcctaatgcatatgaaagctatgtttacattgtactgtaatcggttaagtgtacagtagcat

SEQ ID NO: 59346 - DNA, 201 bp, Homo sapiens
cactcttcctgcacaaggtgacttttgacttgaccggtgtatctttgatacttactcatttacagaaatgtataatggatgtgtgtgtgtgtgtgtgtgtrtatgtgtgtatttgtatttttatagagctattgacttctgcaatttaacctctaagatgaattatccaatagaattctgaaatgaaaagttcacagattt

SEQ ID NO: 59347 - DNA, 201 bp, Homo sapiens
tcttctgtcactcttcctgcacaaggtgacttttgacttgaccggtgtatctttgatacttactcatttacagaaatgtataatggatgtgtgtgtgtgtrtgtgtgtgtatgtgtgtatttgtatttttatagagctattgacttctgcaatttaacctctaagatgaattatccaatagaattctgaaatgaaaagttc

SEQ ID NO: 59348 - DNA, 201 bp, Homo sapiens
ttttttgagacaagatcctgctctgttgcctaggctgaagagcagtggcccaatcatggttcactgcaacctccacctacccaggctccagtgattcttgkgcctcagcctcccaagtagctgggattacaggcatatgccaccacgcctggctatttttttgtattttttgtagagacaggttcttgccatgttgaccag

SEQ ID NO: 59349 - DNA, 201 bp, Homo sapiens; identical to SEQ ID NO: 11417

SEQ ID NO: 59350 - DNA, 201 bp, Homo sapiens
caaagcaggtagggtgcaaagccaacatatttgagtgctatatactaaaagtttatatatgggtgtgtacatatgtatatacacacacacacacacacacmaaaagatctataacaactgtttcccatcgtacaggtgagaaggtaagctcagttacttggagatgaaggctgattttgaatccaggtctgactccaaaat

SEQ ID NO: 59351 - DNA, 201 bp, Homo sapiens; identical to SEQ ID NO: 11420

SEQ ID NO: 59352 - DNA, 201 bp, Homo sapiens
tatgctaaatatttgtataagaattatgcacatttaaacttcctttttttccttcggaaatccttttccgaagcttttgtaaaccttccagccttccaagraggtttgcatctttctacaatttttcccaccaccctgaccaatctcctatgctatgctaaatatttgtataagaattatgcacatttaaacttcacaata

SEQ ID NO: 59353 - DNA, 201 bp, Homo sapiens; identical to SEQ ID NO: 11421

SEQ ID NO: 59354 - DNA, 201 bp, Homo sapiens
tagtgtaagaaataagaacacatagtataagaagactttctttggggagagaagacttcttggtattttcatccattcccctacttcccccgctcccccayccttgcatccaaccaattgcttggatcaaagcacaattttagtattatttcaacctgctatgtcttgttggatggcaaatgaagagataacagagtggca

SEQ ID NO: 59355 - DNA, 201 bp, Homo sapiens
tctctggcataggctgaagtggctgtccacaggcagaatttctgctgggaagcttcagctctgctcataaggcctttcaactgattgaaacaggcctgcarcattttcaagaataatgttctttactcgaagtcaattgttgaaacaggcctgcaacattttcaagaataatcttctttactggaagtcaattgattatgg

SEQ ID NO: 59356 - DNA, 201 bp, Homo sapiens
tgtaatctcagctacttgggagactcaggcacaaaaattgcttgaacctgggaggcggaggttgcagtgagccaagattgcaccactgcactccatcctgkgcaacaaagtgagactctgtctcaaaaaaaaaaagaaaaaaaaaagatacagtaaaagttgtgagttgagcaaaatgttatatatttgtttctggtcttg

SEQ ID NO: 59357 - DNA, 201 bp, Homo sapiens
cataagtttgttcattcattcaatagaaatttattgcttgttaggtgttgggcatacagaagttaatgtatatggcaagcataaagaagttaatgtatatdgggcataccgaacataatgtacatggcaaacccagtcattctttttatcttggcaccatgtgtttttcttaataacacttatctccaccttacataacat

SEQ ID NO: 59358 - DNA, 201 bp, Homo sapiens
gtaaccttttaacttataaaaatatgtgattttaaccatattaaagcatatctgattttcacatactacaaaaggtatagtatccttttaacttataaaaatatgtgattttaaaccatatttagattagttccatcatattttggaatggtgaatggtatgacaattttcctatacatttgccaattacaagtctgatgt

SEQ ID NO: 59359 - DNA, 201 bp, Homo sapiens
cactatattgcccaaattggtctcgaactcctgggctcaagaatcctcctgccttggcctcccaaagtgctgggatgacaagtgtgagccattgcacctgrcctgatgtttttttcatggccagatagggatttgagtgtttgagaggaagactatagaagtaaagtaccatttttgtggcatataatggtatatgttatc

SEQ ID NO: 59360 - DNA, 201 bp, Homo sapiens
ggtggctcacgcctgtaatcccagcaatttgggaggccaaggtgggtggattgcttgagctcaggagtttgagaccagcctgggcaacatggcaaaacctyatctctactaaaaatacaaaaattagctggatgcagtggcacatgcctgtaatctcagctacttgggagactcaggcacaaaaattgcttgaacctggga

SEQ ID NO: 59361 - DNA, 201 bp, Homo sapiens
gtatagtaaccttttaacttataaaaatatgtgattttaaccatattaaagcatatctgattttcacatactacaaaaggtatagtatccttttaacttataaaaatatgtgattttaaaccatatttagattagttccatcatattttggaatggtgaatggtatgacaattttcctatacatttgccaattacaagtct

SEQ ID NO: 59362 - DNA, 201 bp, Homo sapiens
tcctcctaccttggcctcccaagtaggtgggactacagatgcatgccaccatactctactaatttgtttttatttttagtagagatgaggtctcactataytgcccaaattggtctcgaactcctgggctcaagaatcctcctgccttggcctcccaaagtgctgggatgacaagtgtgagccattgcacctggcctgatg

SEQ ID NO: 59363 - DNA, 201 bp, Homo sapiens
ggggctgggactgatgacctgatgacctagcaactcgatttttaggaggcttgtttcagtctgggctttccagagaaactgaatgaataggagatcactcyatctatctatctatctatctatctatctatctatctgtctatctaatctatctatctacctacctacctagagggatttattttaaggaattggctcatg

SEQ ID NO: 59364 - DNA, 201 bp, Homo sapiens
catgatctcggctcactgcaagctccacctcccgggttcacgccattctcctgcctcagcctcccgagcagctgagactataggcacccgccaccatgccyggctaattttttgcatttttttagtagaggcagggtttcaccatgttagccagggtggtcttgatctcccaacctcgtgatcttccccccttggcctccc

SEQ ID NO: 59365 - DNA, 201 bp, Homo sapiens
ccagtctggccttgaactcctgggctcaagccatccttctgccttggcttcccaaaattttggaattacaggcataagttaccatgcccagcctccagaakgttttcaatttactttacccagatccattggaggaattactatctatggcagctatacccttacaaaatacatttcttaaatcttaagacttaaagtaga

SEQ ID NO: 59366 - DNA, 201 bp, Homo sapiens; identical to SEQ ID NO: 11422

SEQ ID NO: 59367 - DNA, 201 bp, Homo sapiens
ttttttttttttttttttgagatggagtctcgctctgttgcccaggctggagtgcagtggcatgatctcggctcactgcaagctccacctcccgggttcaygccattctcctgcctcagcctcccgagcagctgagactataggcacccgccaccatgcccggctaattttttgcatttttttagtagaggcagggtttca

SEQ ID NO: 59368 - DNA, 201 bp, Homo sapiens
acacccagctattttaaaaattttttgtagagacagggtctcactatgttacccagtctggccttgaactcctgggctcaagccatccttctgccttggcwtcccaaaattttggaattacaggcataagttaccatgcccagcctccagaaggttttcaatttactttacccagatccattggaggaattactatctatg

SEQ ID NO: 59369 - DNA, 201 bp, Homo sapiens
gaacatttatcttaaataatgtggtagctattaaattccattacttggagtattatttccaggtctttttgaaagccagctatccttttttttttttttttgataaatagttgaattgaaattaaaaggcaaagtccctccctcctgaaagagactgccagaaatcagtatgatacttacttattcctcattgtctaacag

SEQ ID NO: 59370 - DNA, 201 bp, Homo sapiens
acatggctggggaagcctcacaatcatggcggaaggcaaggaagagcaagtcacatcttaaatggatggcagtaggcagagagagcttgtgcaggggaagkcctctttataaaaccatcagatcttgtgagacttactatcacaagaacagcatgggaaagacttgtccccatgattcaattacctcccactgggtccttc

SEQ ID NO: 59371 - DNA, 201 bp, Homo sapiens
gccatgttgaccaggctggtctcgaattcctggcttcaagcaatccacccaccttggcctcccgaagtgctaggctacaggcgtgagccactgcacccagycttacttcttacatatctgtggcacctttgtcaaaactaagaaattgatactggttacaacgctggttctaaagtatagatttatttggattttgccgct

SEQ ID NO: 59372 - DNA, 201 bp, Homo sapiens
ccggaaaagtgtctaaaaattaaactcctctttcctttattgactctcctgtattttcaaatggtatcaccatcttccttgccaaccaggcccaggtgttrgagtgaatttctactatgtcgttttccccactcctcacttctcttctcaggccctgtccatttcatttctgcagcacattcacacttgtgccggtcactg

SEQ ID NO: 59373 - DNA, 201 bp, Homo sapiens
tttgagtgctatatactaaaagtttatatatgggtgtgtacatatgtatatacacacacacacacacacacaaaaagatctataacaactgtttcccatcktacaggtgagaaggtaagctcagttacttggagatgaaggctgattttgaatccaggtctgactccaaaattcatgcatttgacaccatgttatttactc

SEQ ID NO: 59374 - DNA, 201 bp, Homo sapiens; identical to SEQ ID NO: 11424

SEQ ID NO: 59375 - DNA, 201 bp, Homo sapiens
tcatatccagccacactaaccttcaaaagcgaaggagaaataaaatcctttccagacaagcagatgctgagggattttgtcaccaccaggcctgccttacmggagctcctgaaaggagcactcaatatggaaaggaaaaaccggtaccagtcactgcaaaaaacacaccaaaatataaagaccaatgacactatgaagaaa

SEQ ID NO: 59376 - DNA, 201 bp, Homo sapiens
tggcggcagggagtacagttaggaaatgatttcagttatccaattgagaaatgtaaatctctctcagactattttcctgaacatagtaagtgatgtatggrcatatcttcaaagaagatattgtgggtttggttccagaccaccgcaataaagtaaatatcacaataaagcgagccacataaactttttggtttcctaatg

SEQ ID NO: 59377 - DNA, 201 bp, Homo sapiens
ggagcactcaatatggaaaggaaaaaccggtaccagtcactgcaaaaaacacaccaaaatataaagaccaatgacactatgaagaaactgcatcagctagygtgcaaaataaccaaatagcagcatgacgacagaatcaaattaacacattttgctatttttctaattatcctatctgtcctttaccttctgtctttccct

SEQ ID NO: 59378 - DNA, 201 bp, Homo sapiens
ccaggcagacagggcggggaagggcaggaaggccaaggaggcagggccaggtctggcatgttttgggaaccaaaagaagtttggaatggcaagaagtaagrcctgctagctaggcagggactggattatgatgggccttgcaagccatactgaacaattcgtctttatcctagaagtggtggggagtcaatggagggtttt

SEQ ID NO: 59379 - DNA, 201 bp, Homo sapiens
gtattttattctagattgttttaaagttttaacaatgcaaacattgttacatgcttattataaaggtaacatgcacaactgagaaaaaaatttaaatatcrcaatgcatgtggaagtaaaatatcatttttatctcattatccccaaataattggtaaccctttgggattgtttcctactaatctgtacatattcaaatgt

SEQ ID NO: 59380 - DNA, 201 bp, Homo sapiens; identical to SEQ ID NO: 11428

SEQ ID NO: 59381 - DNA, 201 bp, Homo sapiens
tcaaacaggagtgacactgaacagaatgtttggaatcaagtagatgtttgccaggcagacagggcggggaagggcaggaaggccaaggaggcagggccagktctggcatgttttgggaaccaaaagaagtttggaatggcaagaagtaagacctgctagctaggcagggactggattatgatgggccttgcaagccatact

SEQ ID NO: 59382 - DNA, 201 bp, Homo sapiens
ccaaacgtgaattggcagaagaatgggcaatacactttcatatgagctgagtctttattgcttccaaaatagcaacctgcaagagaggcaagtatttaatktttttcaggcttgccataatttaaaaattttatcaatcacttaatcccgtaaaactgaaaagatgcttgtaacctattagatgggttagtgctagttctc

SEQ ID NO: 59383 - DNA, 201 bp, Homo sapiens
tttgttttggtatattgtcaatatctttgtaactcaccttaaatattacttgggatcaaacacattatacctcaataaaaataatatattgattaatttgytatttttaaccacaaagtaccactatattatacagagcattgggtgctggagatgaaaaagtcaaggcccttgtcccttaaaatgtgttttgtttggcac

SEQ ID NO: 59384 - DNA, 201 bp, Homo sapiens
ggtagagtatagtaagtgaaatgtatgctgcttatgtacacttagtattcaatttattccaggtgctcttatttacaaaaaaaaaaaaaaaaaaaaaaaaygagagtagttagaagtactgtatctacccttgggcttctcccaggaggtgactgcctgtgtgccacacttctttgcttgcaggctccagaggacgctgag

SEQ ID NO: 59385 - DNA, 201 bp, Homo sapiens
cttcagatgattatgctaaaccaaagttatgttttttgctagaccgtccacccaacttttaacagcaaagtaactaattcctgtgtagcaggaaaattcayttagttatttccatatatattttgcaactcaactaatttttcttggaagatactgcaggaagttacattattcaaagttagatattctctgttttagtga

SEQ ID NO: 59386 - DNA, 201 bp, Homo sapiens
tttacaaaaaaaaaaaaaaaaaaaaaaaatgagagtagttagaagtactgtatctacccttgggcttctcccaggaggtgactgcctgtgtgccacacttytttgcttgcaggctccagaggacgctgagacttggaaaggcagacctgcccaccccagtgtggagcaggggtggcttgtaggtgggcctgacccctgggc

SEQ ID NO: 59387 - DNA, 201 bp, Homo sapiens
ctattggcttttcaaaacatgatctctttgtccataacaactggtgattgtgcattctagacttcttagtgtttagaatacaagttcatggccagaattcygcatggacaaactagcagaaatttgaacagaaataatgatttaagcaaataatttaaactctttcagaggctttgccatgtccagcaaagttgaagtgtg

SEQ ID NO: 59388 - DNA, 201 bp, Homo sapiens
gctcactaaatgtcagctgatgaggaaaacattctctgtggaacttgctgtgaaataactactcatgaggcatatgctgtataaagcttggtcaaagtttmcagttttcttggtgtcttgacatctgtgtttagatacttggtcaatctttaaatgaagataattatatatagcaaagttatatttgggaaacatttcgga

SEQ ID NO: 59389 - DNA, 201 bp, Homo sapiens
tactatagtatgaggcatataaaatggtaaattgaatgcaacagcactgtagttcttttctgcaaacacctttaacattattcaagggaagcaataaaggyaaagcgtagtcatttgttggatcactttttattttggaaacttttcagctgttaagtaacatattaatatttctagccaacattaatgctcagttctaga

SEQ ID NO: 59390 - DNA, 201 bp, Homo sapiens
taattttatgtcccccagttttactggaaattcctagctggcaagaaatttttatttttaaaaaatccagaccacattacccagtagttctttactctttyctattctgagggtctgaggctgaatttactcatcccagggtccttttggcttcattgctgaatgagtgaccagtctgagtcccatgaaaaggttcactct

SEQ ID NO: 59391 - DNA, 201 bp, Homo sapiens
agggagaattaatggtttttactgttttcccatatacttggtacatagtctgaacacagaacttcatgctttctgtaatagttagtggtttatgtgtctgrcttctgcactgggactgtgaactctttgtaggcaagcactggatcccatttgctgcatctatcctcacacacagtggccactcaaagaatgtttgttaaa

SEQ ID NO: 59392 - DNA, 201 bp, Homo sapiens
gcaaacactttaatcttccacctgcagtgactagctttgagaccttgagccgacgcttaaccccagagccggtttcctcatcgctcacgtggggctaatayattactaccttgcagcaggcttgaggatgaaatgagaattgcagttttgctttctgtaagaaacaatgtttgtggttctagaaagaacactggcctaaat

SEQ ID NO: 59393 - DNA, 201 bp, Homo sapiens
ctcctcaggcggttatacttttgcccatccaactgtctttttttccactttcttctgttttttttttgcatttgtattcccccaaggttctgtttttagcyttctactcttctttctgtgtacttgtattccttcagaagatcatgtattgtctctgtctctgtcttgattccccatctcaatttcccactgcttggaggg

SEQ ID NO: 59394 - DNA, 201 bp, Homo sapiens; identical to SEQ ID NO: 11416

SEQ ID NO: 59395 - DNA, 201 bp, Homo sapiens
aattaatttttcccctttgaggtcagtaagtatcttcagtgctaccctgtgaagttgctttttgaacaatttatctttttttttttttttttttgttttgktttgtttttttgagacggagtctcgctgtgtctcccaggttggagtgcagtggcgcgatctcggctcactgcaagctccgcctcccaggttcatgccatt

SEQ ID NO: 59396 - DNA, 201 bp, Homo sapiens
tttctttttttctttctttctttctctttttctttctttctttttctttctttctttcttccttccttccttccttccttccttcctttctttcttccttycttcctttctttctttctttttttttgactgggacctactctgtcacccaggctggagtacggtggtatagtcatggctccctgcagccttgatctcctg

SEQ ID NO: 59397 - DNA, 201 bp, Homo sapiens
tctgggtcagtgaatgccttgagattagttgttaccctgtggtgttgttgagattagaagatgcagtaacctagtgcattagtccattttcatgctgccgmtaaagacataccagagactgggcaatttacaaaagaaagaggtttaattggacttacagttccacatggctggggaagcctcacaatcatggcggaaggc

SEQ ID NO: 59398 - DNA, 201 bp, Homo sapiens
gctttgcatttggtgaaggctcagtgcttctcagaaggatcactttcagccctttgacctgctcccagccttcagtggactgctgccttgcattctgcaarggcccagtgtacttgaagaggatctcttagcccttctgttctgttcctagcctttggtgtgtggtacttgtgcactgggtggaagctctatgggaaagaa

SEQ ID NO: 59399 - DNA, 201 bp, Homo sapiens
ccagagagaaaggccaggtcacctacaaagggaagcccatcggactaacagcagacctctcagcagaaactctataagccagaagagattgggggccaatmttcaacattgttacagaaaaaaattttcaacccagaatttcatatccagccacactaaccttcaaaagcgaaggagaaataaaatcctttccagacaagc

SEQ ID NO: 59400 - DNA, 201 bp, Homo sapiens
cgcgcggccctcggcggtttcgggttcaccactcaccccctcctttccgggctgcggcgtaggcccgggtgtcccctgggctttggggtgtgccaatttgycctgtaaaccagtacccccggcccggagccgcggcgcgccggggcctcgcggactggctgtcttcccgcggacaacctgtcgcgtcggggatgcccgcgg

SEQ ID NO: 59401 - DNA, 201 bp, Homo sapiens
aaaaacatcgtggacttgaaagacttcaatctcctggtacgcacattgcccccagagctcacagatgtttcaagtctgtaaaaatcagaaaacataggaargttaccagcagatgtgtggttgtcatagatataaaaaagtgggatacagggtgtttttggaaactctaggtaagtagtaagcttgatacagatctctgaa

SEQ ID NO: 59402 - DNA, 201 bp, Homo sapiens
aaaaaacacaccaaaatataaagaccaatgacactatgaagaaactgcatcagctagtgtgcaaaataaccaaatagcagcatgacgacagaatcaaattmacacattttgctatttttctaattatcctatctgtcctttaccttctgtctttccctttctgccttcttgggttaattgagtagttttaaaatatttcat

SEQ ID NO: 59403 - DNA, 201 bp, Homo sapiens
agtgaacccccagcaaactgcagaagccctcagaagagggacctgaccattgaaagacaaaaaaaaaaaaaaaaactagcagaaagcaacaacaacagcawcaacaacaacaaaaaatcccccacaaaaaccccattcaagggtcagcagcctcaaagactgaaaatagacaaactcacaaagatgagaaagaatcaacga

SEQ ID NO: 59404 - DNA, 201 bp, Homo sapiens
ggcttcagaccttctggtttacccatctctttttacagaagaggatactgaagctcagaaaagtcaccaattactcaagttcacttgtgggtttcctcttyttttatcctgaatgagcttcttaccacctggtcccttgccttctcttcctgccatccctcagcctcagtgcgctcttcattccaccatagagtgtgccct

SEQ ID NO: 59405 - DNA, 201 bp, Homo sapiens
cagcagctaataaaagtttcttaaaaattcagctggtttcttcgtggtcccatttttggcaagtttattcctccttctatcagagatgaagcagctatgcrtctcttttttgggaagaggtcatctgtatatcgaatttatttaggagatgaagcagctatgcatctctattttgggaagagatcatctgtatattgaatt

SEQ ID NO: 59406 - DNA, 201 bp, Homo sapiens
gcctaaagtgaacccccagcaaactgcagaagccctcagaagagggacctgaccattgaaagacaaaaaaaaaaaaaaaaactagcagaaagcaacaacarcagcatcaacaacaacaaaaaatcccccacaaaaaccccattcaagggtcagcagcctcaaagactgaaaatagacaaactcacaaagatgagaaagaat

SEQ ID NO: 59407 - DNA, 201 bp, Homo sapiens
ttctgatcctggcaataacagtaggtcagagaggagtgaggaaagtgctagcacttgtgattgattagatttaggactgaagatgaaagaaaagtcaaagrtggcttttaggttgctggtttgggtgagaaggtagacgagaaaggggaaggaagaaaagagcaaggtttgggaaaaggtagtaagttcgaatttagacct

SEQ ID NO: 59408 - DNA, 201 bp, Homo sapiens
cctgggctttttttggttggcaggctattaattactgcctcaatttcagagcttgttattggtctatttagggattcttcttcctggtttagccttgggayggtgtatgtgtccaggaatttatcagtttcttccagattttctagtttatttgagtagaagtgtttattgtattctctgatgatagtttctatttctgtg

SEQ ID NO: 59409 - DNA, 201 bp, Homo sapiens
tcctgggctttttttggttggcaggctattaattactgcctcaatttcagagcttgttattggtctatttagggattcttcttcctggtttagccttgggrcggtgtatgtgtccaggaatttatcagtttcttccagattttctagtttatttgagtagaagtgtttattgtattctctgatgatagtttctatttctgt

SEQ ID NO: 59410 - DNA, 201 bp, Homo sapiens
ttaaggagtttttgggcagagatgatggggttttctaaatatacaatcatgtcatctgcaaacagagacaatttgacttcctctcttcctatttcaatacsctttgtttctttctcttgcctgatttccctggccagaatttccaatactatgttgagtaggagtggtgagagaggcatccttgccttgtgccagttttca

SEQ ID NO: 59411 - DNA, 201 bp, Homo sapiens
gctgcaataaacacacatgtgcatgtgtctttatagtagaatgatgtatattcctttgggtatatacccagtaatgagattgctgggtcaaatggtatttytggttctagatccttgaattgccgcactgtcttcaacaatggttgaactaatttacattcccaccaacggtgttaaagtgtttctatttctccacagcct

SEQ ID NO: 59412 - DNA, 201 bp, Homo sapiens
gactggtgtgagatggtatctcattgtggttttgatttgcatttctctgatgatcagtgatgttgagcttttttccttatgtttgttggccatgtaaatgytgtcttttgagaagtgtctgttcatatcctttgcccactttttgatgaggttgtttttttcttgtaaatttgtttaagttccttataaattctggatatt

SEQ ID NO: 59413 - DNA, 201 bp, Homo sapiens
ttcttattgttcaactcccacttacgagagagaacatgcggtatttggttttcttttcctgtgttagtttgctgagggtgatggcttctagcttcatccaygtccctgcaaaagacatgatctcattcctttttatggctgcataatattccacggtgtgtgtgtaccacattttcttgatccagtctatcattgatgggc

SEQ ID NO: 59414 - DNA, 201 bp, Homo sapiens
gggaattctgatttccttaaaagtatttaagatttttatcatgtactattgttgtaggaaaatcctggttcttgtcacacgcccaggaaagattaggctcwcagacactttggagggtgaggggttatggaatttattggtcagaaagaaaaaaggaaaaacaacacagcaaagcaataggggttcatattaacaggcccc

SEQ ID NO: 59415 - DNA, 201 bp, Homo sapiens
ctctgtctgaattttccacaggcattgcaatttcactgtgtctgaagggaacatatatcattgtcttctcttgccaactttcccctcctgctgctccaacmacctccaagttatccaagacagaaaaacctgggacctatttctgaactatttgctttattctttcctcccttcttctctccttcctttttgccctctttt

SEQ ID NO: 59416 - DNA, 201 bp, Homo sapiens
taaaaagctcagtactttttactcagagagtgctcactaaatgtcagctgatgaggaaaacattctctgtggaacttgctgtgaaataactactcatgagscatatgctgtataaagcttggtcaaagtttacagttttcttggtgtcttgacatctgtgtttagatacttggtcaatctttaaatgaagataattatata

SEQ ID NO: 59417 - DNA, 201 bp, Homo sapiens
aggagttgtgtctatcaaaggagtgtgtgctaaccgttacctggctatgaaggaagatggaagattactggcttctgtaagcatactttctgttttcacaygttttttgttagcttttattgctgttaatttaccagcattgttgtttatcaaatctttataaaggattttacgtgtatcatcgtcatagtcaccctgtaa

SEQ ID NO: 59418 - DNA, 201 bp, Homo sapiens
tcttagaagccagaccagtctcattctaaacaccttcagaatatttttagtttgaagaaattggaagggcctggaggcaacagacagccaatattcagtgwttatgtctcatccagctgtcttctgtcactcttcctgcacaaggtgacttttgacttgaccggtgtatctttgatacttactcatttacagaaatgtata

SEQ ID NO: 59419 - DNA, 201 bp, Homo sapiens; identical to SEQ ID NO: 11413

SEQ ID NO: 59420 - DNA, 201 bp, Homo sapiens
atagaaccattgatttaataatacacgtactagattctctccccccacctctctttggtaatatctggcaagtggatagcaataattttacttaatgaacktgatatttactgtaataaatattgggtgcagtaaacaaatgaagtcagaatctaatagctcatttaatcttggaaatcatgtaatcagtacagcaatgaa

SEQ ID NO: 59421 - DNA, 201 bp, Homo sapiens
ccatctcttcactactgcctttggggtaaatagaaccattgatttaataatacacgtactagattctctccccccacctctctttggtaatatctggcaartggatagcaataattttacttaatgaacgtgatatttactgtaataaatattgggtgcagtaaacaaatgaagtcagaatctaatagctcatttaatctt

SEQ ID NO: 59422 - DNA, 201 bp, Homo sapiens
tttccatctcttcactactgcctttggggtaaatagaaccattgatttaataatacacgtactagattctctccccccacctctctttggtaatatctggyaagtggatagcaataattttacttaatgaacgtgatatttactgtaataaatattgggtgcagtaaacaaatgaagtcagaatctaatagctcatttaat

SEQ ID NO: 59423 - DNA, 201 bp, Homo sapiens
tttgaagagttcttactagtttacgggtgcctcaggttgatttcctggggttttggataaagccacctttccatctcttcactactgcctttggggtaaayagaaccattgatttaataatacacgtactagattctctccccccacctctctttggtaatatctggcaagtggatagcaataattttacttaatgaacgt

SEQ ID NO: 59424 - DNA, 201 bp, Homo sapiens
tctggtttacccatctctttttacagaagaggatactgaagctcagaaaagtcaccaattactcaagttcacttgtgggtttcctctttttttatcctgartgagcttcttaccacctggtcccttgccttctcttcctgccatccctcagcctcagtgcgctcttcattccaccatagagtgtgccctgctggaccccac

SEQ ID NO: 59425 - DNA, 201 bp, Homo sapiens
tacttaggagtgtcattcctacttaatccacaaataaactttcttatataatttgaacttctttagcttctaccagtaccaactgcctaaaagtgtagggkgaacatgactagattctgaaaagcatcactttcttggtcttaaaggaccaattattggcaggtttgaaaatcagcagagccaggaagctcaatgtgctag

SEQ ID NO: 59426 - DNA, 201 bp, Homo sapiens
aacatttcggaattttggagactggctattagtttttcttagaataatctagagaaagatgaatcatttttcaggaaaaattgtttagaacttttattggraattctgatttccttaaaagtatttaagatttttatcatgtactattgttgtaggaaaatcctggttcttgtcacacgcccaggaaagattaggctcaca

SEQ ID NO: 59427 - DNA, 201 bp, Homo sapiens
atttagtatggattaaattgtgagtgcaatttcttccccaaaagctggccagaaggactggagtttggggagggatgctttgaagactgtgatataaatgwtggggtcctggagaggtgcaggggaagaggaggcagagtgggaagctgtgaggtaggaaagagaggaaaattttctaaaagaagaggtaggagaagatga

SEQ ID NO: 59428 - DNA, 201 bp, Homo sapiens
ccatttctttgtgtcttcttgtctatgaattcttttttctttttttttgttggggaggggcaggtggaaagatctgatcttggaatagggataaatatagwaaaatggattaaaaacaattatgagatgacatggacaatattcttatggctgacatgattacttttcttcctgttagagttctatctatccatcacgtga

SEQ ID NO: 59429 - DNA, 201 bp, Homo sapiens
ttgaattgccgcactgtcttcaacaatggttgaactaatttacattcccaccaacggtgttaaagtgtttctatttctccacagccttgccagtatctgtygtttcctgactttttaataaccaccattctgactggtgtgagatggtatctcattgtggttttgatttgcatttctctgatgatcagtgatgttgagctt

SEQ ID NO: 59430 - DNA, 201 bp, Homo sapiens
tccatatacatgtatgaagatgtaaagtttttcattttcagcaaatgagttcctttttttttttccttttactttgttttctttttggagacagagtctcratctgtcacccaggctggagtgcagtggtctggtctcggctcactgcaacttccgcctcctgggttcaagtgattctcctgcctcagcctcctgagtagc

SEQ ID NO: 59431 - DNA, 201 bp, Homo sapiens
tgtgatggttgcacaatgctgtgattatagtaaagcacattgaactgtatgcatgttttaaatgagtgaattgcatggcatgtgaattatacctcaataargctataacaggtaaaacaaacaaaggaaccatgggtaccaacagttcagaataagtgccttcgatattacttagtattatggtgtctttggaaaaggaat

SEQ ID NO: 59432 - DNA, 201 bp, Homo sapiens
aaatttataaaaatgtaaaatacaaacacagaaaatcacgtttaaaaatttgtactttagggaattattcctatgtgaacattcttataactgttgctcargtcataaaacagaactttgccagccacctcagaagcgttctatgccctgtctctatcacagactgtcttccccaatgaaagtgtagacttatttcagtca

SEQ ID NO: 59433 - DNA, 201 bp, Homo sapiens
cagcctacctttggcataaatcagctgtacatctttaaattttttaaattacataagttaaatggtatggcttagaagtaaaattttggcaagagatttartatttcagacattgtatgttgcacttatttttaattaaattgttttaattattttgtcatcatctacaatcttaagtttcataataaaaaccatttttac

SEQ ID NO: 59434 - DNA, 201 bp, Homo sapiens
tttgtagttgttactggaatggtgcgagggtgtatatactaatgctgtgcttgatactcaatgagtgcttcataaatgcttgctggatgaagaatataagmaaaacttacctaattccttatcttttataaactaaaatggacaatattgataggagttaaatgaaagaatgaacgttcttatatattaaatggagagaga

SEQ ID NO: 59435 - DNA, 201 bp, Homo sapiens
gcttagctggttatactgcacaatgagagtacctgtttcttctgtagatagagcatagaagatatactaggaacatggggaaaagccattatatattttcytttttagatctgcaagccttttggatgtgagaagattttttaaaaggacattaaaaaatagcttctttttcacataaggatacaatattttaaagtagta

SEQ ID NO: 59436 - DNA, 201 bp, Homo sapiens
ttacatgagtaagttctttagtggtgatttgtgaaattttgttgcacccatcacccaagcagtatacactgaatccagtttgtagtcctgtccctccccarcttcccaccctttcttcccaagtccccaaagagactactctttttttaaaggatacctgtaccaggcaatagactgacaagaatacaaatctaaaaatga

SEQ ID NO: 59437 - DNA, 201 bp, Homo sapiens
caagctgacacataaaattaaccatcacaaggcatttgttgacataaaccctagactggcctgactgtccaaagagggtggtgaataagccctggcttggrtaagaccaacttattcactatgatgccccaaggacacgggtcagagacttcctaacagaggtactagactggcctcctgttgacactgagaggttcagtt

SEQ ID NO: 59438 - DNA, 201 bp, Homo sapiens
tagcacagtacctggcacatagctgttacccataaatgttaattgaattaatgagtaaatgtattcaccatttatggaaacactgacttgtctgtttccaraaaccatattctttcaccagggacagatctctctaaatatcagcttccttatttctaaatagggaaggtgtactggatgatcccttacactgctgataaa

SEQ ID NO: 59439 - DNA, 201 bp, Homo sapiens
ctcaggttgcccttttataggtgcactcactccctcagccccaccttgggaaactacccatctgttctccatttctataattttgtgggcaacttatttttagaaacatttctccaacagctggcccctgagaagaaaagaccatttaacacatatagggttgatgcgttttgtaggtggaagccaggtatttatagatgc

SEQ ID NO: 59440 - DNA, 201 bp, Homo sapiens
cccaaatcagcatctgacacgtaatagatcctgaaaattgttacttcttcctcacattacttctcatttacatatatgtcaggagagggactttttttttyctttttttttttgagatggagtctcactccactgcgcagactggagtgcagtggcgtaatctcgggtcactgtaccctctgccttctgggttcaagcaat

SEQ ID NO: 59441 - DNA, 201 bp, Homo sapiens
gacagaaagaaagtatagcgattgattattcagccttgcctcatgggcatttgtacatccttatgagttaaagtgagatgcaaatgcattcttcattaaawtggcttatctgaatcattttagagctgtatgcaataatttgcttatactcattaagataagtttggttatgttgattaaaaacaaagcttattttctgca

SEQ ID NO: 59442 - DNA, 201 bp, Homo sapiens
gttaataaagtgccatagctttgtttcagtagtgaaaagaagtgcaaacactttaatcttccacctgcagtgactagctttgagaccttgagccgacgctwaaccccagagccggtttcctcatcgctcacgtggggctaatatattactaccttgcagcaggcttgaggatgaaatgagaattgcagttttgctttctgt

SEQ ID NO: 59443 - DNA, 201 bp, Homo sapiens
tgtatgctgcttatgtacacttagtattcaatttattccaggtgctcttatttacaaaaaaaaaaaaaaaaaaaaaaaatgagagtagttagaagtactgkatctacccttgggcttctcccaggaggtgactgcctgtgtgccacacttctttgcttgcaggctccagaggacgctgagacttggaaaggcagacctgcc

SEQ ID NO: 59444 - DNA, 201 bp, Homo sapiens
ggtttaagtcactgttaggtcctttattacctaaaatattggggtagggatgaaggactggaatatgtgtgtagggaaagagaaaggacatgtgaatgtcratttagatatgtgtttgaatttgtgcatatgctcgtgttgagggttaaattttcctctgcaaaaaacacttgacattaatgcctggggagagtgaggtac

SEQ ID NO: 59445 - DNA, 201 bp, Homo sapiens
cagatccattggaggaattactatctatggcagctatacccttacaaaatacatttcttaaatcttaagacttaaagtagaaattacttcttgaaccatcrgctgcaaaatggatgttgtgttagcaggcatgaaaatgttaaccttgtacctctccatcaaagctcttgagtgactagctatgttgctagccaacagtat

SEQ ID NO: 59446 - DNA, 201 bp, Homo sapiens
gtgtacctagtgcttagaacagtgtatacagcagagtatgtataagaactcagtaatattcagtgaatgaattaatgggtccctacccttaactcttgaayacccagtttatgggtttaagtcactgttaggtcctttattacctaaaatattggggtagggatgaaggactggaatatgtgtgtagggaaagagaaagga

SEQ ID NO: 59447 - DNA, 201 bp, Homo sapiens
ttttttttgagcagtagtctcaaaagtgggtttaaaatattcagtaaaccacgatgtaaacagatgtgctgtcatccaggctttgttattccattgatagrgcacaggcagagtagatttagcataattcttaaggccctgggattttcagaatggtaaatgagcattggcttccacttaaagtcgccagctgcattagcc

SEQ ID NO: 59448 - DNA, 201 bp, Homo sapiens; identical to SEQ ID NO: 11412

SEQ ID NO: 59449 - DNA, 201 bp, Homo sapiens
atttttggttgctgtaacctggaagggtgctactggcatctggcaggtagaggccggggatgctgctgaacatcctacaatacacattataataccctcarcaaaaacatttttgaccccaaatgtcactagtactcaggttgagaactctgctaactttataactagctaaggacaagacattaaaagggaaatgtagaa

SEQ ID NO: 59450 - DNA, 201 bp, Homo sapiens
taaattaaattaatatttggggcttcccctaatactctttttttttcagactctattagttgctgaatcattttttctttgaagattttgatacccgattygccttagaataaaactatgtagaggttagccagtggacataattttgaattgcataccacattaccaccgttgtaaaaacaaccgttaactttttcttcc

SEQ ID NO: 59451 - DNA, 201 bp, Homo sapiens
agtgagatgcaaatgcattcttcattaaaatggcttatctgaatcattttagagctgtatgcaataatttgcttatactcattaagataagtttggttatrttgattaaaaacaaagcttattttctgcattttccaataatattgtaaaaaatacttcatacccttcattgtttgggtttcatgtcttcattacattcct

SEQ ID NO: 59452 - DNA, 201 bp, Homo sapiens
aagagaggcaagtatttaatttttttcaggcttgccataatttaaaaattttatcaatcacttaatcccgtaaaactgaaaagatgcttgtaacctattasatgggttagtgctagttctctattctggtaacttgaactcatctatttcaaaaaattatctttgtgattgaagtttgttctgcagttgtctgctacgcca

SEQ ID NO: 59453 - DNA, 201 bp, Homo sapiens
cgaaccgccgaactcagaggccggccccagaaaacccgagcgagtagggggcggcgcgcaggagggaggagaactgggggcgcgggaggctggtgggtgtsgggggtggagatgtagaagatgtgacgccgcggcccggcgggtgccagattagcggacgcggtgcccgcggttgcaacgggatcccgggcgctgcagctt

SEQ ID NO: 59454 - DNA, 201 bp, Homo sapiens
agtttatgccccacttgtacccctcgtcttttggtgatttagagattttcaaagcctgctctgacacagactcttccttggattgcaacttctctactttsgggtggaaacggcttctccgttttgaaacgctagcggggaaaaaatgggggagaaagttgagtttaaacttttaaaagttgagtcacggctggttgcgca

SEQ ID NO: 59455 - DNA, 201 bp, Homo sapiens
aagagaaatattctattttgaatgtgtttctaagtgttagttctccttacatatttatatatatctacattactctgaactcagtaatgggagtataattsaagtgagattgggaagataattttgttaactgttttaattgagtgtactaatgtataaagacatagacagaaggtgttggattgaaaaataacgaattac

SEQ ID NO: 59456 - DNA, 201 bp, Homo sapiens
ttttgtccacattgaaaatctgttgttagtgtagctaccttcatcagtgatcttagctagatcttctagataacttgcgctagcttctacatcagcactgkctgtgttaccttgcatgtttatgttatggagatggcttgttttgttaaacctcatgaaccaagctctgctagcctccaacttttcttctgtagcttcctt

SEQ ID NO: 59457 - DNA, 201 bp, Homo sapiens
cacctgctatatcctactgaaaattaccaaaatgcaattaacttcaattttacatttgggatttacagaaaataactctctctccaagaaatgcataacartttagctagggcaaatgccaggtccgagttaagacattaatgcgcttcgatcgcgataaggatttatccttatccccatcctcatctttctgcgtcgtct

SEQ ID NO: 59458 - DNA, 201 bp, Homo sapiens
tattttcctagtcatctgtggcacctgctatatcctactgaaaattaccaaaatgcaattaacttcaattttacatttgggatttacagaaaataactctytctccaagaaatgcataacaatttagctagggcaaatgccaggtccgagttaagacattaatgcgcttcgatcgcgataaggatttatccttatccccat

SEQ ID NO: 59459 - DNA, 201 bp, Homo sapiens
ctgtttcatgcctcagtcctggaatgacattctacccagaatatcattctcttttgtctctcccttgccaataccttgctcatgtggttatcttctatctrtactccaaaacttagctcaaaactcacccctcctagaaatattcccagccttttcatttaataatggatatgtcctattctgtagtctcctagcacctgt

SEQ ID NO: 59460 - DNA, 201 bp, Homo sapiens
atacaaacacagaaaatcacgtttaaaaatttgtactttagggaattattcctatgtgaacattcttataactgttgctcaggtcataaaacagaactttrccagccacctcagaagcgttctatgccctgtctctatcacagactgtcttccccaatgaaagtgtagacttatttcagtcacttctttatttttcttaat

SEQ ID NO: 59461 - DNA, 201 bp, Homo sapiens
attctttcaccagggacagatctctctaaatatcagcttccttatttctaaatagggaaggtgtactggatgatcccttacactgctgataaattggtatkgtatgattctaagattcatcatcctggggcatatacaaaagaaaatgatgtggattgtggaagatattccaaaataggagttccaaaatattttaagcaa

SEQ ID NO: 59462 - DNA, 201 bp, Homo sapiens
cctactggcatcaggttggtgctcctcgaggtcagaggacacagaagaagcaggcacccatctttgctgttctctagcctccttgagtaacatctccaggwgcaggagcaaatcagatagaatagggcctaaagtgaacccccagcaaactgcagaagccctcagaagagggacctgaccattgaaagacaaaaaaaaaaa

SEQ ID NO: 59463 - DNA, 201 bp, Homo sapiens
ataggggctagaattgatttcttagctagaatgtgttgaacagctattattaaaagtagagaaaatgcaaaagtgcaatcatgtggcttttcttcctggcyctaaccctagcctcagccctttctttctttcttctcatttctctggtgagctcattctcacagtttcatctttcacatatgtgcaggtaacaggtagact

SEQ ID NO: 59464 - DNA, 201 bp, Homo sapiens
ctggaggttcagtttttggggaaggctgataatatcattagaagtaggtatggccaatagaaaagagtataatcccagaaaagagggtacttcacaccagstctgtcactggagatggtcagagactgtttaacaaccctttgatcctaaagcaaataggcatgtgaagctaaattctgttagccgaaatatggcttaaat

SEQ ID NO: 59465 - DNA, 201 bp, Homo sapiens
ggaagagattaaaacggtcaaataatgcttccatttaaaaaattacttttggaaacatatcacttgataaacactttgcttttgaattagaaatgcaaatratctttctactgcctgctatatatcttttaatccaatacttgctgcatgtcttcatgtattcttactttttctattaattatgttacttttcttgcctag

SEQ ID NO: 59466 - DNA, 201 bp, Homo sapiens
ttttactattaacttgcctagtaaattaaggtgcttttcttgtaaacaacatagttaggttttgttttttcatcttgttgacaattgtttccttttagtgrtgtgttggacatttatattcagtgttattattgatatggttagtttaaatctgacattttgctatttttctttttttaaaatttcttctaaaaaaatggg

SEQ ID NO: 59467 - DNA, 201 bp, Homo sapiens
aacttcctttctgaccttcccttcacgtctcctgtcttccttgtcatcttagcctttaaccaggcagttttccttaagctgaaatgtcctgtctgtcctcrtaccttatcccatttccagtcatgctttgggccttatttctttcacatcatcctgtatccatctttccttttctgtgtgctatctaaaaattctctctaa

SEQ ID NO: 59468 - DNA, 201 bp, Homo sapiens; identical to SEQ ID NO: 11423

SEQ ID NO: 59469 - DNA, 201 bp, Homo sapiens
aatgaactctttcaactcaataataaaaagacaatctaaaaatgaatcaaagatctaagtagacagttcttcaaagaaggtaaccaaatagccaataagcrcatgaaaagatgctcaacattattacccatcgaagaaatgcaaatcaaaaccacagtgagatattacttcacactcaactaggatgcctataattgagaa

SEQ ID NO: 59470 - DNA, 201 bp, Homo sapiens
ttatgagagcaccagtagtcttctaatttaatcatgtggccttttccaatttttcatgctactctgacatgtggcagtattgtctgcctctgacttcttgrtaattccttggcttctattacatcacatcaacctggttctccttttgaaactgcctttgcaaaagttatatctgagaaaattatgacactgccagagata

SEQ ID NO: 59471 - DNA, 201 bp, Homo sapiens; identical to SEQ ID NO: 11425

SEQ ID NO: 59472 - DNA, 201 bp, Homo sapiens
acctgtttgaaaagttgaaaaatctatggtctcattcctcagactgttttgtccaactgacctgaacatctgtcactggaattttttttcctttggcatgwcactttgtgcctacatgttttctaaactgcaggtaacttttgaaaggccaagttcaaccattatcagattttaacatttagtatggattaaattgtgagt

SEQ ID NO: 59473 - DNA, 201 bp, Homo sapiens
tttatccattcatcatttgatggacatctggcttgtttccacattttggttattatgaataaagctgctatgaacatttatgtacatgttttcatgtgaayatatgtttccaattctcttggctacatacctaggagtggaattgctgggttgtctggtgactctgtttaattttagagttaactgtcagactgtttttat

SEQ ID NO: 59474 - DNA, 201 bp, Homo sapiens; identical to SEQ ID NO: 11426

SEQ ID NO: 59475 - DNA, 201 bp, Homo sapiens
tgaagtgaataaattaatttttcccctttgaggtcagtaagtatcttcagtgctaccctgtgaagttgctttttgaacaatttatcttttttttttttttkttttgttttgttttgtttttttgagacggagtctcgctgtgtctcccaggttggagtgcagtggcgcgatctcggctcactgcaagctccgcctcccagg

SEQ ID NO: 59476 - DNA, 201 bp, Homo sapiens
gtaaaagaagcttcattttgcatccccttcccaagagacaccagcaagctgatgcctcattctcagagatctgggtccagataaaccagcaccagctgaasagcaagaggtttgagttttaactgtgcatggtcccacatgaagggacccacaacccaccagaatggcataatgatgactctaaactgaagatatttaaga

SEQ ID NO: 59477 - DNA, 201 bp, Homo sapiens
tttgatataaaggtatcaagtagatgtaagggcaaaaggtatccaaaatctgaaatgttaccaaaagcactgagttttaaattcctcatttgttaatgagyataataatgttaaaatattgttgtgacttttaaagtatatgcataaaagcagtcaataatcatgcattaagggatttctcagctcttaggcctatataaa

SEQ ID NO: 59478 - DNA, 201 bp, Homo sapiens
aaagaaaggagagcaactggcttggatatctgaaaagaatgccaattagttgtttataataagtaaataagtatatataatctacatctaatttattaaayattaaatataaattacatatcattaatagctatcagttatattgaaatatcacctaacaccaaacatttacagaaattaaattattcctcttatttttat

SEQ ID NO: 59479 - DNA, 201 bp, Homo sapiens
cagttccacaaatgattaaacatagagttaccatatgacccagtaatttgactcctaggtatatactccccccaaaagaaaacatgtctacacaaaatctygtctacgaatgttcatagcaacgttatttacgtagccaaaaagtaaaaacagtccaaatatccatcagctgctgaatgaatgaatcaaagtctagctata

SEQ ID NO: 59480 - DNA, 201 bp, Homo sapiens
tagatatgtgtttgaatttgtgcatatgctcgtgttgagggttaaattttcctctgcaaaaaacacttgacattaatgcctggggagagtgaggtacatamagaaaggagagcaactggcttggatatctgaaaagaatgccaattagttgtttataataagtaaataagtatatataatctacatctaatttattaaaca

SEQ ID NO: 59481 - DNA, 201 bp, Homo sapiens
gtttggagattgttaatcatatgtaatataatgttccaatattatttttggcattatataccaatagctattttctgtacaataaactattcattattatsccttaaaaaacattagccacttaaaactttttgttaaaatttggggaattaactcttcttgtgagtaaagtattaacaaacctccttctgtatggaaaga

SEQ ID NO: 59482 - DNA, 201 bp, Homo sapiens
ctcttcctgcacaaggtgacttttgacttgaccggtgtatctttgatacttactcatttacagaaatgtataatggatgtgtgtgtgtgtgtgtgtgtgtrtgtgtgtatttgtatttttatagagctattgacttctgcaatttaacctctaagatgaattatccaatagaattctgaaatgaaaagttcacagattttc

SEQ ID NO: 59483 - DNA, 201 bp, Homo sapiens
gtttaagtcactgttaggtcctttattacctaaaatattggggtagggatgaaggactggaatatgtgtgtagggaaagagaaaggacatgtgaatgtcartttagatatgtgtttgaatttgtgcatatgctcgtgttgagggttaaattttcctctgcaaaaaacacttgacattaatgcctggggagagtgaggtaca

SEQ ID NO: 59484 - DNA, 201 bp, Homo sapiens
tgtcttctgtcactcttcctgcacaaggtgacttttgacttgaccggtgtatctttgatacttactcatttacagaaatgtataatggatgtgtgtgtgtrtgtgtgtgtgtatgtgtgtatttgtatttttatagagctattgacttctgcaatttaacctctaagatgaattatccaatagaattctgaaatgaaaagt

SEQ ID NO: 59485 - DNA, 201 bp, Homo sapiens; identical to SEQ ID NO: 11429

SEQ ID NO: 59486 - DNA, 201 bp, Homo sapiens
tagaagcttccccaaatctcctgcctccccacgctgagttatccgatgtctgaaatgtcacagcacttagtcttactcttctatggcctactttctactgstatttgtgttactcatgctacccatcttatctccctcagtgtgtgagacgctggcatcagatttggcatctcccacacactcaacattatgtgttgcaca

SEQ ID NO: 59487 - DNA, 201 bp, Homo sapiens
ccagacctcaggttatctgtccacctcagcctcccaaagtgctgtgattacaggcgtgagccaccgtgcccagcctggggcacaaatcttaacctcatcargatattctgtccaaacaaatgtattttgttctgttttatttttgagtttgtccttttctgtgctctgaaattaggatctggtctagtacttaatttgtat

SEQ ID NO: 59488 - DNA, 201 bp, Homo sapiens
ctctgtacttgccttttattctgccaatctattgtcagctcaagaggtgatgtaatagtttgggaatctaccaaagtagcattttaaatatctcccatgamagtgaaccaataagtaattttggatgactgacattttattagtgagaggaagatgagtttccaaccctcctgcccctttcactttaggatgtgacaaatc

SEQ ID NO: 59489 - DNA, 201 bp, Homo sapiens
atggccttttgaaacctaatgtttctacaaggaggcacgtccatacttgcaactccttctagaagcttccccaaatctcctgcctccccacgctgagttayccgatgtctgaaatgtcacagcacttagtcttactcttctatggcctactttctactgctatttgtgttactcatgctacccatcttatctccctcagtg

SEQ ID NO: 59490 - DNA, 201 bp, Homo sapiens
ttaattaataagctgtgggttctatcatgtatccacttagtccctggtactgtttcttttctctgaaatattaggaactggctgaaaaggcaaatgttatwggaatagttagtattctagtatgccaagcattgtagggagtgccagctagcaaggtggggcatccgggaagctgatagaacaccaacaaatgaacatatg

SEQ ID NO: 59491 - DNA, 201 bp, Homo sapiens
ggcctctgtaaacctttcatttttttcatgctttagcattgtgagggacttaatactgggatattttttcacaatatcttgttcaccatcttacctgtcaytcttttccctgaggtactttgatccaacagacattcactcgattctgttgtgtgtcgggcagtgtgccactgctagggatacagaaatggataaggtata

SEQ ID NO: 59492 - DNA, 201 bp, Homo sapiens
gtcactgaagatgacttggaaactcagaatggagacaattgaaaattgtacatatgttgctctgttagacatctacttttcttgaccactaaattttggcsctactactcatttttttaaaaaaatgcagtttgttttcaagagcaaaacagttgtttagtaaatttgcattgctgaacattcagcacagatgtaagtttc

SEQ ID NO: 59493 - DNA, 201 bp, Homo sapiens
ttcttgggctcaagcgatcctcctaccttggcctcccaagtaggtgggactacagatgcatgccaccatactctactaatttgtttttatttttagtagaratgaggtctcactatattgcccaaattggtctcgaactcctgggctcaagaatcctcctgccttggcctcccaaagtgctgggatgacaagtgtgagcca

SEQ ID NO: 59494 - DNA, 201 bp, Homo sapiens; identical to SEQ ID NO: 11414

SEQ ID NO: 59495 - DNA, 201 bp, Homo sapiens
atttgaaaattagattatttgtttgaattgtagggaatacaagttattttactgcgtgtagctgctccccaggtttctggatgccattgttaaaaaatatsatgacttagattttatccccgtgctcctggaatcctcaggtttctgtgacacagagttcaagtgagagttcaatcattctagggactactcagcaccaca

SEQ ID NO: 59496 - DNA, 201 bp, Homo sapiens
ggtccctcccgcaacacatgggaattcaagatgagatttgggtgggggcacagccaaaccatataacctagtaatcatggtgactctgtaagataattgcyggtggaatttttcatctcctcaggagcactggctgaatattgattcattgacaatgataaaaagacccattgttgttaaaagtgatgaaaacagaaattg

SEQ ID NO: 59497 - DNA, 201 bp, Homo sapiens
ctgagcccaggaggtcgaggttacagtgacccacgattctgccaatgcacaccagcttgggttgacagagcgagaccctgtctcaaaaaagaaaaaaaatmaaaaattaaaactgtgatgtaccttttaaaatagttttcccaaaatgctgtataatttagcctccctctgactgtcgataaggtctttggttcacctcat

SEQ ID NO: 59498 - DNA, 201 bp, Homo sapiens
tgggtaactgtaggcttaaatgatgcaatgctttctggaatccaggggtgactgacacacagaggtgactcagacatgaaatgttcaacaaaattctaagrttgtcttttttttaaattgtaaattcttaaacattcataaaagtagtgagattagaataatgaaatcctgtgcttctaatgactgttaacacaagtgaat

SEQ ID NO: 59499 - DNA, 201 bp, Homo sapiens
catatctgcatgcaaaagaatgaagttgtgccacataccacatacaaaaattaactcaaaatgtattaaaacctaaatagaaggggtaaaactaaaacttrgaggaatgcataggtgtaaaccttcatgaccctagattaggcagtgattttttagatatgacaccaaaagtacaagcaacaaaagaagaacattgataaa

SEQ ID NO: 59500 - DNA, 201 bp, Homo sapiens
atttttaggaggcttgtttcagtctgggctttccagagaaactgaatgaataggagatcactctatctatctatctatctatctatctatctatctatctrtctatctaatctatctatctacctacctacctagagggatttattttaaggaattggctcatgtgattacagaggctggcaagtccaagtccaggccagc

SEQ ID NO: 59501 - DNA, 201 bp, Homo sapiens
gcctggccttctctgtgttttatttggaaatgcattgcctaatttccaaatatttggggattttccagatatcatattgctaacatttctactttaatacrtcatatgatttcagtcatttcaaatgtattgaggcttgttttatggtcaagcatataatttattcttgggaacgttctatgtgcccttgaaaagaatgta

SEQ ID NO: 59502 - DNA, 201 bp, Homo sapiens
gttagttctcttacctgtaaaatagaaacaatgatactatctcattgggattttatcagaatttaattagatactacacatcaagtgcccaaatcagcatytgacacgtaatagatcctgaaaattgttacttcttcctcacattacttctcatttacatatatgtcaggagagggacttttttttttctttttttttttg

SEQ ID NO: 59503 - DNA, 201 bp, Homo sapiens
gtattttcagtcatgtttaatatgatgcacagttggtatttttattctagattgctttaaagttttaacaatgctaacattgttacatatggatgtaacawagttaactccctttttaattgagaaattctctctccctccttgaactcactcatgaatgtgcttattttcagttgtgtttaatatgacacacagttggta

SEQ ID NO: 59504 - DNA, 201 bp, Homo sapiens
taataataatgaaaaagtttgaaatattgcgacaattacccaaatgtgagacagacatgaaatgaacacatgctatttgaaaaaggtcactgatagacttrctcgatgcaggatttccacgaaactttaatttttaaaaatcatagtatctgtgaagagcaataatgcaaatcacagtaaaacaaggcatgcctgtatatg

SEQ ID NO: 59505 - DNA, 201 bp, Homo sapiens
tgactagtaatacacatttataagatggtggaccagagctgggctagcgttgattgataagggacagaaagaaagtatagcgattgattattcagccttgsctcatgggcatttgtacatccttatgagttaaagtgagatgcaaatgcattcttcattaaaatggcttatctgaatcattttagagctgtatgcaataat

SEQ ID NO: 59506 - DNA, 201 bp, Homo sapiens
tctttactggaagtcaattgattatggactttaatcacatttacaaagtaccttcacagcaacacatagattagtgtttcattgaattactggggactgcwgcctagccaagttgatacattaaaaaaaaatcacactgcatcttttgattttctttctgaatctctgcttttctttttcctaattttggcctctgtaaac

SEQ ID NO: 59507 - DNA, 201 bp, Homo sapiens
cctcagaagcgttctatgccctgtctctatcacagactgtcttccccaatgaaagtgtagacttatttcagtcacttctttatttttcttaatagtttttrtcatagaaataggtattctaaaatagtctactttagtttggcctttgaaaatatatgaatttttagctgttttcatgtcatgtcttccttccatcctttt

SEQ ID NO: 59508 - DNA, 201 bp, Homo sapiens
ttaatagacagctgatcctattttccaattactagtaaaacgtcatgcttcagatgattatgctaaaccaaagttatgttttttgctagaccgtccacccracttttaacagcaaagtaactaattcctgtgtagcaggaaaattcacttagttatttccatatatattttgcaactcaactaatttttcttggaagatac

SEQ ID NO: 59509 - DNA, 201 bp, Homo sapiens
acggttttcagtgcctggtcttcagcattggattggatgatggctgatggaagaaaaaaaaacagtggttataccttggaatttagttttcagttactggkgaattttagatccaaggagactactaaacctggctcagttatttttggacaccaaaacataattttattggaaagcgaacacactctatcaaccaatttt

SEQ ID NO: 59510 - DNA, 201 bp, Homo sapiens
tacctggcacatagctgttacccataaatgttaattgaattaatgagtaaatgtattcaccatttatggaaacactgacttgtctgtttccaaaaaccatrttctttcaccagggacagatctctctaaatatcagcttccttatttctaaatagggaaggtgtactggatgatcccttacactgctgataaattggtatt

SEQ ID NO: 59511 - DNA, 201 bp, Homo sapiens
ttgttatttccaggctgatctcttatttaaaaatgtatttattaatgatttaatatcacttttaataaactggaattatgcttttcctctaaaagaaaaamaataaaggtgatatagatgcattatcataatctaaaactattttaatagacagctgatcctattttccaattactagtaaaacgtcatgcttcagatgat

SEQ ID NO: 59512 - DNA, 201 bp, Homo sapiens
gttagatgtattctctgagtgctctcaaagtagcctgtgtatatttttctcatggcacttacagtattgagctttagttatccgtgtaccagtcctcatcrcctcaaccatgctgtatgttccttaaggctaaagaccaatgttatattttcctttgggcttcctattgcttagcacagtacctggcacatagctgttacc

SEQ ID NO: 59513 - DNA, 201 bp, Homo sapiens; identical to SEQ ID NO: 11427

SEQ ID NO: 59514 - DNA, 201 bp, Homo sapiens
gaaacctctctattcaggctgggttagatgtattctctgagtgctctcaaagtagcctgtgtatatttttctcatggcacttacagtattgagctttagtyatccgtgtaccagtcctcatcgcctcaaccatgctgtatgttccttaaggctaaagaccaatgttatattttcctttgggcttcctattgcttagcacag

SEQ ID NO: 59515 - DNA, 201 bp, Homo sapiens
aaaattttctaaaagaagaggtaggagaagatgacacaacacaaatgtttccaatttttcagtgttgctgaaggtcaactgtgcttcacacctgggcattytcctgaatttgcactcaaaagggcccattttctggcgtttttctcatagtcctggaataatcttcatttgacatgagagtcttgataaaaacaagatgtt

SEQ ID NO: 59516 - DNA, 201 bp, Homo sapiens
cacagcaacacatagattagtgtttcattgaattactggggactgcagcctagccaagttgatacattaaaaaaaaatcacactgcatcttttgattttcyttctgaatctctgcttttctttttcctaattttggcctctgtaaacctttcatttttttcatgctttagcattgtgagggacttaatactgggatatttt

SEQ ID NO: 59517 - DNA, 201 bp, Homo sapiens
atataagatgctttctttttgttcccgttctttcttttccttactattgctaattctttcagtctccaatcatttgtcactgcttccaggaaacctctctrttcaggctgggttagatgtattctctgagtgctctcaaagtagcctgtgtatatttttctcatggcacttacagtattgagctttagttatccgtgtacc

SEQ ID NO: 59518 - DNA, 201 bp, Homo sapiens
ctgtctaaaaaaaataaataaataataaaaataaaaacagtatgcctggttttaaagcttcaaagaatttactcattctcctgtatgtaacattctagaawtgcatctggagttaaagccttcttggagacttaagaacaaatgcacttatgcatggccttttgaaacctaatgtttctacaaggaggcacgtccatactt

SEQ ID NO: 59519 - DNA, 201 bp, Homo sapiens
ctggtttctcttgtctttcccctgaggtgtgtgggttagtttttcttcttcaggatttctgaaaataggaataataatcttattccagaagaaaggacatrattatgttaaacaaaaagggaacattcccaacttgatcacagtgatcgtgatgtggagatgttgtgggctgctgttgcctgtattctggagacttgtggt

SEQ ID NO: 59520 - DNA, 201 bp, Homo sapiens
ttaccattagatcacagatttgtccaatcatacttctccatgacttccacttctttatcaatcctagccttaaaaatacacaggcttccctcttaactttsggtcttaatttctgaagtctcctgttttgtgtaaaactcacataaataagttagtatgtttttctcttgttaatgtgtcttttgttacaggggcttcagc

SEQ ID NO: 59521 - DNA, 201 bp, Homo sapiens
agaggtgccttccctatacctggaggaaacagacatccttatctctgaagacacacggacagggaaaagaatctgagcaaataggccttgctaagtaagtycccccagtttattaccattagatcacagatttgtccaatcatacttctccatgacttccacttctttatcaatcctagccttaaaaatacacaggcttcc

SEQ ID NO: 59522 - DNA, 201 bp, Homo sapiens
ctactcagcaccacagtagcacctacagagatcatctggagggagtgattttgtctcaacagacggatcttcaatgaagatgaaacaaatccattttggaragagatgttagagaactgatggcgttcaggacatgctacccaaaaataatggtaccttggcacttaagaaaagagcagaagcaagagggttactttcact

SEQ ID NO: 59523 - DNA, 201 bp, Homo sapiens
gggcaaatgccaggtccgagttaagacattaatgcgcttcgatcgcgataaggatttatccttatccccatcctcatctttctgcgtcgtctaattcaagwtaggtcagtaaaggaaaccttttcgttttagcaacccaatctgctccccttctctggcctctttctctccttttgttggtagacgacttcagcctctgtc

SEQ ID NO: 59524 - DNA, 201 bp, Homo sapiens
tatgaaatggttaaaagaaagacttccacagacattgactacactgatacctgcccttccataatgtagatgatgaacttagctttcaaaaacagttttckgtgatgaaaataatgcattccttcatttgtcaaaaaagaaacaaacaagcaaaccaacttactgaggccccacttagtgccattaggtccttgggataca

SEQ ID NO: 59525 - DNA, 201 bp, Homo sapiens
aagcacattgaactgtatgcatgttttaaatgagtgaattgcatggcatgtgaattatacctcaataaggctataacaggtaaaacaaacaaaggaaccaygggtaccaacagttcagaataagtgccttcgatattacttagtattatggtgtctttggaaaaggaatttctcagatggagttaattgatttgaacaatt

SEQ ID NO: 59526 - DNA, 201 bp, Homo sapiens
tttctttctttctttctctttttctttctttctttttctttctttctttcttccttccttccttccttccttccttcctttctttcttcctttcttccttyctttctttctttttttttgactgggacctactctgtcacccaggctggagtacggtggtatagtcatggctccctgcagccttgatctcctggaatcaag

SEQ ID NO: 59527 - DNA, 201 bp, Homo sapiens
tactctgcaaaactattaagctataatttaaaaaaaattttcttctattatgcagttgtttgaagatcattgggaataaatgtatacaattttgattattrgtttttaagtttcttctttagaatgtgacgtacaaaacactagcaatgtagaacactagttgagaatgtaagctttctgcctggtacagatgccgactct

SEQ ID NO: 59528 - DNA, 201 bp, Homo sapiens
aagtctatgaccatgaaacggagcaaggcaaatctgtatctttggggcacatatctttttctttttttctttttgagacacagtcttaccctgtcacctargctggagtgcagtggcacaatctcagctcactacaacctctccttcctgggttcaagcaattcttctgcttcagctgtgattacaagcacctgccaccgc

SEQ ID NO: 59529 - DNA, 201 bp, Homo sapiens
tggtagagtatagtaagtgaaatgtatgctgcttatgtacacttagtattcaatttattccaggtgctcttatttacaaaaaaaaaaaaaaaaaaaaaaaatgagagtagttagaagtactgtatctacccttgggcttctcccaggaggtgactgcctgtgtgccacacttctttgcttgcaggctccagaggacgctga

SEQ ID NO: 59530 - DNA, 201 bp, Homo sapiens
gctgaagatgtcaggttatgtgagtacttgttctctatagactaatatagtgagccttgaaatatagtattagacaactgctttctgattatcttagtacsctaaattgagagtttcagtttgcttgggtttcaaattacttaaatgagaaataatattaacactggcccaactaatgaaaaattatgcaattgccactaa

SEQ ID NO: 59531 - DNA, 201 bp, Homo sapiens
gattttgatttaaagtgaaagacaatgagactcttcctttcacttgaacactgagaggccattgtaggtttactaattggcctaactttaatattgttgtrtcttagggaacagggaggccctaagagtggtggagacaggggaacattcgtcagtggagcagtcagaacacacacgtttattaagtttgctgtcttatat

SEQ ID NO: 59532 - DNA, 201 bp, Homo sapiens
ccagctattcggtaggctgaagtaggagaatcgcttgaacccaggaggtggaggttgcggtgagccgagatcgtgccattgatctccagcctgggcaacamgagcaaaactctgtctaaaaaaaataaataaataataaaaataaaaacagtatgcctggttttaaagcttcaaagaatttactcattctcctgtatgtaa

SEQ ID NO: 59533 - DNA, 201 bp, Homo sapiens
aagtgaaagacaatgagactcttcctttcacttgaacactgagaggccattgtaggtttactaattggcctaactttaatattgttgtgtcttagggaacrgggaggccctaagagtggtggagacaggggaacattcgtcagtggagcagtcagaacacacacgtttattaagtttgctgtcttatatgggtgtagtttg

SEQ ID NO: 59534 - DNA, 201 bp, Homo sapiens
catctttccttttctgtgtgctatctaaaaattctctctaatagcttgttgtattttaattttatgtcccccagttttactggaaattcctagctggcaakaaatttttatttttaaaaaatccagaccacattacccagtagttctttactcttttctattctgagggtctgaggctgaatttactcatcccagggtcct

SEQ ID NO: 59535 - DNA, 201 bp, Homo sapiens
tatctgaatcattttagagctgtatgcaataatttgcttatactcattaagataagtttggttatgttgattaaaaacaaagcttattttctgcattttcyaataatattgtaaaaaatacttcatacccttcattgtttgggtttcatgtcttcattacattccttttacttcgtattatcttttaagattttgtagaag

SEQ ID NO: 59536 - DNA, 201 bp, Homo sapiens
ggctatttttttgtattttttgtagagacaggttcttgccatgttgaccaggctggtctcgaattcctggcttcaagcaatccacccaccttggcctcccraagtgctaggctacaggcgtgagccactgcacccagccttacttcttacatatctgtggcacctttgtcaaaactaagaaattgatactggttacaacgc

SEQ ID NO: 59537 - DNA, 201 bp, Homo sapiens
ccaaatcagcatctgacacgtaatagatcctgaaaattgttacttcttcctcacattacttctcatttacatatatgtcaggagagggacttttttttttytttttttttttgagatggagtctcactccactgcgcagactggagtgcagtggcgtaatctcgggtcactgtaccctctgccttctgggttcaagcaatt

SEQ ID NO: 59538 - DNA, 201 bp, Homo sapiens
acactccatgctacctaattgctggaagttccttagatgtgctaggctttctctccctttctcctttggaagttatataagatgctttctttttgttcccrttctttcttttccttactattgctaattctttcagtctccaatcatttgtcactgcttccaggaaacctctctattcaggctgggttagatgtattctct

SEQ ID NO: 59539 - DNA, 201 bp, Homo sapiens
ggttgcccagggttgggatgagtggtattagggacgtgtaaaatgactgctaaagaatgtagggtgacgaaaatgttctataattgattgtgatggttgcmcaatgctgtgattatagtaaagcacattgaactgtatgcatgttttaaatgagtgaattgcatggcatgtgaattatacctcaataaggctataacaggt

SEQ ID NO: 59540 - DNA, 201 bp, Homo sapiens
tttcattaaaagctctcattctttcatgctattacacactaccaaactccttaacatagtattcagagcctctggtatctccagcctcatttagtcccccwtacccccttccacaacacacacatacatacccctacactccatgctacctaattgctggaagttccttagatgtgctaggctttctctccctttctcctt

SEQ ID NO: 59541 - DNA, 201 bp, Homo sapiens
ttttttgtattttttgtagagacaggttcttgccatgttgaccaggctggtctcgaattcctggcttcaagcaatccacccaccttggcctcccgaagtgmtaggctacaggcgtgagccactgcacccagccttacttcttacatatctgtggcacctttgtcaaaactaagaaattgatactggttacaacgctggttc

SEQ ID NO: 59542 - DNA, 201 bp, Homo sapiens
aacttttttttttttttttttttttttttgagacaagatcctgctctgttgcctaggctgaagagcagtggcccaatcatggttcactgcaacctccaccyacccaggctccagtgattcttgtgcctcagcctcccaagtagctgggattacaggcatatgccaccacgcctggctatttttttgtattttttgtagaga

SEQ ID NO: 59543 - DNA, 201 bp, Homo sapiens
ttaaaagaaactttttattttggaataattttagatctacagaagatttacaaagactttacaaagttcctctatacccttcacctagatttccctaaggktaacttttttttttttttttttttttttttgagacaagatcctgctctgttgcctaggctgaagagcagtggcccaatcatggttcactgcaacctccac

SEQ ID NO: 59544 - DNA, 201 bp, Homo sapiens
ttcagctatctgaggaacaatttttgtctttaaataatcctctcccctcttctaattactaaaagtgcaaccaacaggtagcaaaagtgatatttgagctycatccttcttttcttctgtccccgtaccctcaccttctagtgaaattactcagagactatgaagaatagggattggaagaaattgagagctcatggtggc

SEQ ID NO: 59545 - DNA, 201 bp, Homo sapiens
gccatgatcttcttttactgtgatcctgttttattcctttaaatactcagcacagctgaagaagaggtcctgttttcttactgaagactttcaggcaaagragccgtttccaacttcctactaagtccacccagcatatgtcatgcaggggatgcggggaagaattttccttgcaagggccttctcagaagttttggagat

SEQ ID NO: 59546 - DNA, 201 bp, Homo sapiens
cctgctgcacttgggttacgcatccatacccacgtggtctgtttttgtagttgttactggaatggtgcgagggtgtatatactaatgctgtgcttgatacwcaatgagtgcttcataaatgcttgctggatgaagaatataagcaaaacttacctaattccttatcttttataaactaaaatggacaatattgataggagt

SEQ ID NO: 59547 - DNA, 201 bp, Homo sapiens
catctttattatcttacatgtgaacagctgtaataacctttccagttattaattctttaaacaccacttttagcctgatgcatttcttttcaagaacctayggtatgtttatagtccagattgcattaaacctaacctttctgttatagggcccttttctgaggcccttatttatcttgctctgcaccatttatataacta

SEQ ID NO: 59548 - DNA, 201 bp, Homo sapiens
aaataagtctgccatcagataaacaattaattcctcgcttttatgagcatggaattggtgctagatcataaactgactatcctcattttaccaactttccsttaattgttttctgtgtcagtttttcatatttccaagttgaaaccccctaaacacaacatttttttccactgctcattttttaccaaaattcaaacttca

SEQ ID NO: 59549 - DNA, 201 bp, Homo sapiens
atgtgaattttgtttgcttaatggtgttccataggctttctttattcttttttattccttttttttttttttcgcctcactgggttatttcaaaagacctrtcttccagttcagaaattctttattttgctcaatctagtctactgttttttaatttttaattttatatatatattttttttttgagctggagttttgctc

SEQ ID NO: 59550 - DNA, 201 bp, Homo sapiens
tactgttttttaatttttaattttatatatatattttttttttgagctggagttttgctcttgtcacccaggctggagcatagtggtgcaatctcagctckctgcaacctctgcctcctgggttcaagcaattctcatgcctcagcctcgcaagtagctgggattacaggtgcctgccaccacgcccaactaatttttgta

SEQ ID NO: 59551 - DNA, 201 bp, Homo sapiens
ttatgaataaagcttctataaacatccacatggaggcttttatgtggacataaattttcagttcttttggttaaatacccaggaatgtgatttgctggatygtgtgataagactatgcttagttttataagaaactgcattccatagtggctgcaccattttgcattcccacaaacagtgaaagagagttcttgttgctcc

SEQ ID NO: 59552 - DNA, 201 bp, Homo sapiens
gcatagtggtgcaatctcagctcgctgcaacctctgcctcctgggttcaagcaattctcatgcctcagcctcgcaagtagctgggattacaggtgcctgcyaccacgcccaactaatttttgtaatttttttttttttttagtacagatatggtttcaccattttggccaggctggtctcgaactcctgacctcaggagat

SEQ ID NO: 59553 - DNA, 201 bp, Homo sapiens
cagttgattatttttttgtgggtctatttctaagctctgtattctggtcatttgacctatttgtctattctttcaccaaaaccacactgccttgattgctrtagctttgtagcaagtctcaatgttaggtggtgtcagttatctggctttgttcttttaatttcttttttttttttttcctgtgaatgaacaatactttct

SEQ ID NO: 59554 - DNA, 201 bp, Homo sapiens
ctaatttttgtaatttttttttttttttagtacagatatggtttcaccattttggccaggctggtctcgaactcctgacctcaggagatccacccacctcrgcctcccaaagtgctgggattacagttgtgagccactgcacctggcctagtctattgtttgtacaagctcttgattatatttttttacttcatttattga

SEQ ID NO: 59555 - DNA, 201 bp, Homo sapiens; identical to SEQ ID NO: 11432

SEQ ID NO: 59556 - DNA, 201 bp, Homo sapiens
ttggctttgattctgagtgggcacagcagtgtagtttctgtatgatttcttcacctgtcatcagtgtcagtggcatttgggttcctcagtggcttaggttrcagttgtcagcagacactatggcaaggctttgctggggatggggacaccaggcaggcctgttctcaggcaacagtggtggcagcagtggcctaggcttgc

SEQ ID NO: 59557 - DNA, 201 bp, Homo sapiens; identical to SEQ ID NO: 11434

SEQ ID NO: 59558 - DNA, 201 bp, Homo sapiens
ggcatttgggttcctcagtggcttaggttacagttgtcagcagacactatggcaaggctttgctggggatggggacaccaggcaggcctgttctcaggcamcagtggtggcagcagtggcctaggcttgccggttctcaggcccctgtgtgaaatatgtgggcactcgtggtgatgggtccttgagcctccaggagattta

SEQ ID NO: 59559 - DNA, 201 bp, Homo sapiens; identical to SEQ ID NO: 11437

SEQ ID NO: 59560 - DNA, 201 bp, Homo sapiens; identical to SEQ ID NO: 11436

SEQ ID NO: 59561 - DNA, 201 bp, Homo sapiens
ttggatacaagtccctatcatatatgggttttgcaaatatcttctctgagtctgtggtttgtctttttcactctcttgcagtgtcttttgcaaagcaaaarttttaattttaatgaagtccaacttaacagtgttttctttcttggattatgtttttgatgcgtatctcaaaagtcatcaccaaatccaaagtcacctaga

SEQ ID NO: 59562 - DNA, 201 bp, Homo sapiens
tcatgctggcctgtctgccttattcaatagttaactacaggaagatctgctcctctttgtgtaataccctcttcccttgcaatggcatagggacatctagratatagagaagacagagacaatggaggaagagtaaagaaactgactatatgccttcgtcatttcactgcaaggaaggccaagcagatttttgaatgaggt

SEQ ID NO: 59563 - DNA, 201 bp, Homo sapiens
gcagtgtcttttgcaaagcaaaaattttaattttaatgaagtccaacttaacagtgttttctttcttggattatgtttttgatgcgtatctcaaaagtcaycaccaaatccaaagtcacctagattttctcctatgttatcttctggaaattttatagttttgcattatacatttaggtctatggttaattttgagctgat

SEQ ID NO: 59564 - DNA, 201 bp, Homo sapiens
agatgcgcagtaaaaactcgtgggatgagcaaatgactctgaaacggtcccatgcgggaaatgtccatgaagtcctggattttatctaaaaagcccaggcrggggggggcgggggcggcggggctacagttccacgctgagctgcctcctggccgctcgtccccgccgcagtgcctgggcggcccgggcgcccgaccttgg

SEQ ID NO: 59565 - DNA, 201 bp, Homo sapiens
ctgaaagcttgcagagtaacaggagcacacaggttcagtgcagcagatgtggtgtggcttgagaattcttggaagagcttgatgagtgtttgctggagtcbgagggtgggcactgggaacacagagactggtaaatagtgtttggcaaatacaagtgcttgatgaatatttgttgaatgaatagatgagttcttcccccct

SEQ ID NO: 59566 - DNA, 201 bp, Homo sapiens
aaacgtagagcaagtccactggcaaatctgggggctagtgattattttgttttgatttttatttttttaaatcagacattttaaacactacaatgaggtamctctagaaatcaaattctgtccccctttcccagaggtgttttatttatttatttatttattttttgacagggtctcattctgtcacccaggctggagtgc

SEQ ID NO: 59567 - DNA, 201 bp, Homo sapiens
cgcagtgcctgggcggcccgggcgcccgaccttggccgtggacaccttcgcggtgggtgctgctcctccccatctgccactggaagatgctggggcgaccyggctccaggtttagcaggacactgagaaaagggaatggctgcctttcggaggctgggtgagcccttctctgtgcctcacctgcccgccccacagcggccc

SEQ ID NO: 59568 - DNA, 201 bp, Homo sapiens
gacttcctcggccccaaacaatcctcccactcagcctcccaagtagctgggactataggcacacgccaccatgcccagctaagttttgtattttttgtagrgatggagtttcactatgttgcgcaggctggctttgaactcctggactcaagcaatccacctgccttgccctccccaagttctgggactataggcttaagc

SEQ ID NO: 59569 - DNA, 201 bp, Homo sapiens
ctattccttctcattcccccgtccaatgccacaatttggtaagtttgcctcaacacgttttcagttcttaacactgtgataagaataaacaatagatcccrtagtaagatgacctgttaaaaggaatggggcatggcagagatgagtttggatgaggaaaggtgtcagtccgtttgggctgctctaactaagttctgagat

SEQ ID NO: 59570 - DNA, 201 bp, Homo sapiens
gatttcttacaatacctaatacaatgtaaatgttatgtaaatgttatgtagttgttaaactgtatggtcttttatttttattattttgtattattatattkttattatttatttattcatttattgaatattttcaatccatggttgtttgaatctatggatgtggaacccatggatatgaagggctgattgtattatccc

SEQ ID NO: 59571 - DNA, 201 bp, Homo sapiens
  misc_feature (1)...(201): n = A,T,C or G, or insertion/deletion polymorphism (see Tables 1-2)
actgaaagcttgcagagtaacaggagcacacaggttcagtgcagcagatgtggtgtggcttgagaattcttggaagagcttgatgagtgtttgctggagtncgagggtgggcactgggaacacagagactggtaaatagtgtttggcaaatacaagtgcttgatgaatatttgttgaatgaatagatgagttcttcccccc

SEQ ID NO: 59572 - DNA, 201 bp, Homo sapiens
atatctttctccatatatctttgcatatttcccagactttttgatgtgtctgctgcttgccccctctgttagcccttgctcaggtggctgcagctagtatrtttgcctttaattgtttacagcaaacaccagccagaaggctgttccagccctgagaaagttctaaggtgtacaaaacaaaggcaagcccctgagtgtgaa

SEQ ID NO: 59573 - DNA, 201 bp, Homo sapiens
ctcctctgaacatgcgtccagccttgggcacgtgagtggacttctggactccctggtatatacagagatttcctcagccttttttctcccacatatctttytccatatatctttgcatatttcccagactttttgatgtgtctgctgcttgccccctctgttagcccttgctcaggtggctgcagctagtatgtttgcctt

SEQ ID NO: 59574 - DNA, 201 bp, Homo sapiens
aggaaaatcacttgaacctgggagacagaggctgtagtgagctgagacagcgctactgtactccccgctgggcaacagagtgagactccatctcaaaaaarttaaaagaaaaaaaatctggtttcataatagctgtaacgaaataagccttaatgatattttattagcatcatcttctgtctgcattagcccttccttgct

SEQ ID NO: 59575 - DNA, 201 bp, Homo sapiens; identical to SEQ ID NO: 11454

SEQ ID NO: 59576 - DNA, 201 bp, Homo sapiens
ctgggaacacagagactggtaaatagtgtttggcaaatacaagtgcttgatgaatatttgttgaatgaatagatgagttcttcccccctggggaattcagraggtgaaaggttggcttgagcacccaaaatggcaggatgagagaagagaagcactgatagcaacctgccctcccattattgacatggtaaaaggatgtga

SEQ ID NO: 59577 - DNA, 201 bp, Homo sapiens
aacacagagactggtaaatagtgtttggcaaatacaagtgcttgatgaatatttgttgaatgaatagatgagttcttcccccctggggaattcaggaggtraaaggttggcttgagcacccaaaatggcaggatgagagaagagaagcactgatagcaacctgccctcccattattgacatggtaaaaggatgtgaatttc

SEQ ID NO: 59578 - DNA, 201 bp, Homo sapiens
ttcactatgttgcgcaggctggctttgaactcctggactcaagcaatccacctgccttgccctccccaagttctgggactataggcttaagccactgtgcygggcctccctttcccagggtgtattgttgcttcttgtggcttatagttgcttgtttaatgacttttctaaataatttttataaagattattctttgtcat

SEQ ID NO: 59579 - DNA, 201 bp, Homo sapiens
tgtgtaataccctcttcccttgcaatggcatagggacatctagaatatagagaagacagagacaatggaggaagagtaaagaaactgactatatgccttcktcatttcactgcaaggaaggccaagcagatttttgaatgaggtgtgagattgctgttaaattggactggcctggacattttaatcccttaaatagaggtg

SEQ ID NO: 59580 - DNA, 201 bp, Homo sapiens
gtaagtggaggtttgagagtaaccatccgatctttattaatcttagtgtatattatatttctagaatttggactcatatcaagatgctctgaagaagaacraccctttaggatagccactgcaacatcatgaccaaagacaaagaacctattgttaaaagcttccattttgtttgccttatgatcataatagttggaacca

SEQ ID NO: 59581 - DNA, 201 bp, Homo sapiens
cactgcaaggaaggccaagcagatttttgaatgaggtgtgagattgctgttaaattggactggcctggacattttaatcccttaaatagaggtgcaatgaytaaagtgagatttgtcactaaaatttatggtatctgcccaagattcaggagtgatgatgggaggagatccaacagaactttgttgtaaggcaatggttag

SEQ ID NO: 59582 - DNA, 201 bp, Homo sapiens; identical to SEQ ID NO: 11435

SEQ ID NO: 59583 - DNA, 201 bp, Homo sapiens
ggctacagttccacgctgagctgcctcctggccgctcgtccccgccgcagtgcctgggcggcccgggcgcccgaccttggccgtggacaccttcgcggtgsgtgctgctcctccccatctgccactggaagatgctggggcgacccggctccaggtttagcaggacactgagaaaagggaatggctgcctttcggaggctg

SEQ ID NO: 59584 - DNA, 201 bp, Homo sapiens
caatccatggttgtttgaatctatggatgtggaacccatggatatgaagggctgattgtattatccccttgggggttaggatttcaccataggaattttgrggggcacacaaacatccagaccatagcaaaagagataagaaacctaggttagtgaccagggagggctgctaggatgagccttgatgaaagatctttcatc

SEQ ID NO: 59585 - DNA, 201 bp, Homo sapiens
ataaactagcaaaagcaaaaacaaaaacacccctgatctttgcaggttggctgtgttggatcactttctcaatgcttagccagtctattcacagctctgcyttagccttcactttctgcatgcatggaagctaaagatgagccagaggtgaagtttaggattttctcaggtctcctctgaacatgcgtccagccttgggca

SEQ ID NO: 59586 - DNA, 201 bp, Homo sapiens
catggttgtttgaatctatggatgtggaacccatggatatgaagggctgattgtattatccccttgggggttaggatttcaccataggaattttgaggggsacacaaacatccagaccatagcaaaagagataagaaacctaggttagtgaccagggagggctgctaggatgagccttgatgaaagatctttcatcaggag

SEQ ID NO: 59587 - DNA, 201 bp, Homo sapiens
ttatcaactttttgccttaaatttttttttggctctttagcaataacacttagcttaaaacacacattctacagctatataaaaatattttccttctttayatctttattttgttttttctatttttaaaatattttatttttatttttcactttttaaacttttctgttaaaaactgagacacacacacagacacacaca

SEQ ID NO: 59588 - DNA, 201 bp, Homo sapiens
aaaactaggttgtttgttttcttattgtggagcttaagagttctttgcatagtttggatacaagtccctatcatatatgggttttgcaaatatcttctctsagtctgtggtttgtctttttcactctcttgcagtgtcttttgcaaagcaaaaattttaattttaatgaagtccaacttaacagtgttttctttcttggat

SEQ ID NO: 59589 - DNA, 201 bp, Homo sapiens; identical to SEQ ID NO: 11443

SEQ ID NO: 59590 - DNA, 201 bp, Homo sapiens
ctcactgggttatttcaaaagacctgtcttccagttcagaaattctttattttgctcaatctagtctactgttttttaatttttaattttatatatatatwttttttttgagctggagttttgctcttgtcacccaggctggagcatagtggtgcaatctcagctcgctgcaacctctgcctcctgggttcaagcaattct

SEQ ID NO: 59591 - DNA, 201 bp, Homo sapiens
cactgggttatttcaaaagacctgtcttccagttcagaaattctttattttgctcaatctagtctactgttttttaatttttaattttatatatatatttwttttttgagctggagttttgctcttgtcacccaggctggagcatagtggtgcaatctcagctcgctgcaacctctgcctcctgggttcaagcaattctca

SEQ ID NO: 59592 - DNA, 201 bp, Homo sapiens
gttttctttcttggattatgtttttgatgcgtatctcaaaagtcatcaccaaatccaaagtcacctagattttctcctatgttatcttctggaaattttayagttttgcattatacatttaggtctatggttaattttgagctgatttttgtgaaaactgtaaggtctgcgtctaaattctttctcttcttcttctttttt

SEQ ID NO: 59593 - DNA, 201 bp, Homo sapiens
atctggctttgttcttttaatttcttttttttttttttcctgtgaatgaacaatactttctgtttctttgcatggctaatttttttaaacaaataaattaragattcctttaatgccaagttacacaatcaaaaagataacaatctctttccatttgctttttgcaaggtttgtgttatttcagggcaaaacgtagagcaa

SEQ ID NO: 59594 - DNA, 201 bp, Homo sapiens
aattagagattcctttaatgccaagttacacaatcaaaaagataacaatctctttccatttgctttttgcaaggtttgtgttatttcagggcaaaacgtaragcaagtccactggcaaatctgggggctagtgattattttgttttgatttttatttttttaaatcagacattttaaacactacaatgaggtaactctaga

SEQ ID NO: 59595 - DNA, 201 bp, Homo sapiens; identical to SEQ ID NO: 11444

SEQ ID NO: 59596 - DNA, 201 bp, Homo sapiens; identical to SEQ ID NO: 11445

SEQ ID NO: 59597 - DNA, 201 bp, Homo sapiens; identical to SEQ ID NO: 11446

SEQ ID NO: 59598 - DNA, 201 bp, Homo sapiens
ttgcttaatggtgttccataggctttctttattcttttttattccttttttttttttttcgcctcactgggttatttcaaaagacctgtcttccagttcaraaattctttattttgctcaatctagtctactgttttttaatttttaattttatatatatattttttttttgagctggagttttgctcttgtcacccaggc

SEQ ID NO: 59599 - DNA, 201 bp, Homo sapiens; identical to SEQ ID NO: 11447

SEQ ID NO: 59600 - DNA, 201 bp, Homo sapiens; identical to SEQ ID NO: 11448

SEQ ID NO: 59601 - DNA, 201 bp, Homo sapiens; identical to SEQ ID NO: 11450

SEQ ID NO: 59602 - DNA, 201 bp, Homo sapiens; identical to SEQ ID NO: 11451

SEQ ID NO: 59603 - DNA, 201 bp, Homo sapiens; identical to SEQ ID NO: 11452

SEQ ID NO: 59604 - DNA, 201 bp, Homo sapiens
gactggcctggacattttaatcccttaaatagaggtgcaatgactaaagtgagatttgtcactaaaatttatggtatctgcccaagattcaggagtgatgwtgggaggagatccaacagaactttgttgtaaggcaatggttagagaaaaatgaagccctcgctttctggacttagttcattcaataaaccagtttcggcc

SEQ ID NO: 59605 - DNA, 201 bp, Homo sapiens; identical to SEQ ID NO: 11453

SEQ ID NO: 59606 - DNA, 201 bp, Homo sapiens; identical to SEQ ID NO: 11455

SEQ ID NO: 59607 - DNA, 201 bp, Homo sapiens; identical to SEQ ID NO: 11430

SEQ ID NO: 59608 - DNA, 201 bp, Homo sapiens; identical to SEQ ID NO: 11431

SEQ ID NO: 59609 - DNA, 201 bp, Homo sapiens; identical to SEQ ID NO: 11438

SEQ ID NO: 59610 - DNA, 201 bp, Homo sapiens; identical to SEQ ID NO: 11449

SEQ ID NO: 59611 - DNA, 201 bp, Homo sapiens; identical to SEQ ID NO: 11439

SEQ ID NO: 59612 - DNA, 201 bp, Homo sapiens
catctcttctgcttctggaactcccaaaatgtgaattttgtttgcttaatggtgttccataggctttctttattcttttttattccttttttttttttttygcctcactgggttatttcaaaagacctgtcttccagttcagaaattctttattttgctcaatctagtctactgttttttaatttttaattttatatatat

SEQ ID NO: 59613 - DNA, 201 bp, Homo sapiens; identical to SEQ ID NO: 11440

SEQ ID NO: 59614 - DNA, 201 bp, Homo sapiens; identical to SEQ ID NO: 11441

SEQ ID NO: 59615 - DNA, 201 bp, Homo sapiens; identical to SEQ ID NO: 11442

SEQ ID NO: 59616 - DNA, 201 bp, Homo sapiens
agagcaagtccactggcaaatctgggggctagtgattattttgttttgatttttatttttttaaatcagacattttaaacactacaatgaggtaactctaraaatcaaattctgtccccctttcccagaggtgttttatttatttatttatttattttttgacagggtctcattctgtcacccaggctggagtgcagtggt

SEQ ID NO: 59617 - DNA, 201 bp, Homo sapiens
agagataagaaacctaggttagtgaccagggagggctgctaggatgagccttgatgaaagatctttcatcaggaggatcctgggcatgtggctgggaaggrtcctgggcatgtggctgggaagacccttcaaaggggagggcacagtgggtgcaaagttggaagtgaaagaataccatgagcgaagaaagcatcaaattgg

SEQ ID NO: 59618 - DNA, 201 bp, Homo sapiens
cctgtggctaccaaaacaaattaccacaaactgggtggcttaaaacaacagaaatatatttctcccagttcaggaaggcagaagtcagaaatcaaggttgkcagggttgttccttccagaggctgtcagggagaaatcatccctttcctctctcctagcttctggtagttgctggcaaaccttggcgtcccttggtttgca

SEQ ID NO: 59619 - DNA, 201 bp, Homo sapiens
gatgggtatagtcttcttggttgacagtttcttctttcagcactttgagtatattatcccattctctcctggcctatagtttctgctgaaaaatctgttartctgatggggagtctcttctatatgacttgactttttttatttcttgctgtttttaggattctgtcttagtcttcaacttttgagagtttgactgtgatc

SEQ ID NO: 59620 - DNA, 201 bp, Homo sapiens
aacatttgagtgaaagtgggcagatacatattttttactaaaaggaaaccactcactattcaggtcacacaaaagcataatcacatacacacacacacacmccccccacacacaccccattgttaagctaggtcaacagtaaatgaatgaatgaatgaatgaatgaatgaatgaacaaatggacaagcaaacagcagaatt

SEQ ID NO: 59621 - DNA, 201 bp, Homo sapiens
aagatatacatacattttccttctagggttctagctttatatgattttgtgattatgaacaaatcatctttaaacaatccttataaatgaaaaactcgtcrtacacattgtttgaattcatatgatctgtaactttttaatcagatagattattttccaatagaaattgttcagatcaaaatagacatacctcagtatgaa

SEQ ID NO: 59622 - DNA, 201 bp, Homo sapiens
gataattgtatatattaccattatttgggtttagcaaacagctgaaggattttaaaatgtctaaggagtgacaggatatttttatgtttgtgaataaaagrtatattgattcttaagcaggaattttgtttcatggcttctttttttgaaagagctttgttgagtgaacggaatggtctccattaatttattgctgagaga

SEQ ID NO: 59623 - DNA, 201 bp, Homo sapiens
aatttgatactctagccatcaagtgcccagaactctttgccccagagcagggcagcctggattgttctgacactcgtggagaattcaatgttggctccacytgccatttctcttgtgacaacggctttaagctggaggggcccaataatgtggaatgcacaacttctggaagatggtcagctactccaccaacctgcaaag

SEQ ID NO: 59624 - DNA, 201 bp, Homo sapiens
gaaagttgagaatctgaatacagatttaattaacactctctttgcttgtgaaccccttgggaagtcagccttatcctggtttgaagaattccacttcagcrtttggaatggtgcattttgaaatgtgataggaagaacagcttgtgacacaacacaattcagagaaagcagtggggttaggttcgcaccaaagggttatcg

SEQ ID NO: 59625 - DNA, 201 bp, Homo sapiens
ttttgtatttttggtagagatgaggtttcaccatcttagctaggctggtctcaaactcctgacctcaggtgatctgcctgactcggcctcccacagtgctrgtattacaggtgtgagccactgctcccggccttgtacttgatatttaacaagccagtgtgctctgtcagtattgcaacatcttgtatgaacttgaacggg

SEQ ID NO: 59626 - DNA, 201 bp, Homo sapiens
ttttcctttttcccatttcgaagataaagcaactgaggctcagaaaggttattgtctagtgatagattgctagcaagtaacagagccaaaatttgggcgcmgattccaccacttggttgggaaagggggaagaaagtattttcctccatttctgtgtttccaatcatttgtcattgttttctggtaaggtcattggggtgt

SEQ ID NO: 59627 - DNA, 201 bp, Homo sapiens
tcactctgcattttgtgcaaataaacagctgtaaatcataacgttatgatactctcagtgtttaatcataggtcctgcagagatcagcagcttataagaayacaaaatatgcctacttaccaaagtcaagattcagaagctcccagatgaaaagttctaggcttatgagataactctactctctgggacacattaactggt

SEQ ID NO: 59628 - DNA, 201 bp, Homo sapiens
ttctgacactcgtggagaattcaatgttggctccacctgccatttctcttgtgacaacggctttaagctggaggggcccaataatgtggaatgcacaactkctggaagatggtcagctactccaccaacctgcaaaggtaataatatgtacttgctaagacagttctacttttggaaatttattctacaacaacaaacaat

SEQ ID NO: 59629 - DNA, 201 bp, Homo sapiens
tttacaagtacccagttgcaaacactccaagatctgtataaaattggagaaatagacttagaataaggtgaagagtgatagaaaaaagagaaaaactaatmtgtatactggaggttacgggattctcagaagaaagaaatgtgtggattcagtataaacattctatctgcattgtacttgatatacatacattttttgaga

SEQ ID NO: 59630 - DNA, 201 bp, Homo sapiens
tttacgaggagtacctcacactaaagtcatgttccagaagtgtaatattgacattttgtgttttcatttacggagacctctgagcaatctatgtgactccyctgggttcctaagtataccttgattttaaaatgaggcagtggtttgaaagcaggtcttgaagagatatttgtgcacccatgttcatagcactattaatca

SEQ ID NO: 59631 - DNA, 201 bp, Homo sapiens
catctttgtaccagtgcagttgcaaaatagaatttttaatatgttagcatggaggaagaagcctacataggcaaagttgcctgaagtctatgaaagtcatratgcagccctggctatatcagaatgaagtctttaaggcaaaacaatgccctggaaatgtcagcaagggaggtacaagcatgactaaccctcatgcaggca

SEQ ID NO: 59632 - DNA, 201 bp, Homo sapiens
cttggctactggaaactggaattctgttcctccagaatgccaaggtaagagtgtattctttctaacatcatggaaataaattgtaggcagtatttttaaargctggattttagaggtgacaactatgtaagatccaccttgaaatggactggaaaattcataaatactctcactcatcctcttgtcctataacccaaggat

SEQ ID NO: 59633 - DNA, 201 bp, Homo sapiens
aggccaagaggggcatgggaaggtgttccaggcagtctctcttttggaaaatggaggttttagggttctgaacacactgaaaatgtggacaggaaagatayagcatctaggaattttttctgaggaagaacccggcccttccattacctggctttagaagataccttttccacttagctatttcgtgtgagccgctggaga

SEQ ID NO: 59634 - DNA, 201 bp, Homo sapiens
ttttgtgtattaatgttctggtcggaaattcatctgagtatgcagaagcatacttgggatcacggcctcttttttggtgaggggtactaacctggcactcmctctcctttactctagaactaacaaaccagaaagaagtggcagcatggacttatcattacagcacaaaagcatactcatggaatatttcccgtaaatact

SEQ ID NO: 59635 - DNA, 201 bp, Homo sapiens
catggatccaccatcattaatttccaccctcaattaatggcatttgtgtttgttttcaatattccgctcttacaaataatgtcttcacaaaaatctctaamtagattttttggtatgcatcttgattacatacttagcataaattcttgggtccaaaagcatgataacttaaaaattattgacacatgttgccaagatgct

SEQ ID NO: 59636 - DNA, 201 bp, Homo sapiens
aaagttgtaattctgggagattatgaaaaagttatttttgtgaaaatgttcacagatgacttcatgtctaggagttacaccagtagacatgtttcaaaaakgtttagtaaattgatttgatgtgtcagatatgaagttgttaattactcaacaatttgagagtactgaactgaaattcactgtgttattttggctatttga

SEQ ID NO: 59637 - DNA, 201 bp, Homo sapiens
cgcaaagccttaatgatattattactatctattactaccactgctactaatatagcagctaatgttcattgagcactttctatgatctcagtctaactctrtgaggtagttacaattattactaccattttaaagatgagaagagacaacacatggaatatgtgtgctctcttcgtatatggttatttattttacatcttt

SEQ ID NO: 59638 - DNA, 201 bp, Homo sapiens
ctgtacattggttttccatgagggagcatataggtcttgaagaggtttgtaaaaatcaaactatctaagtaaatgagacttatctgaccaaggtattgttktcagaatagccttagatttaaagaaagaatagtcacttcatttgtctataacccaacatttattgataaataatagtcttatattagagaattaatgggg

SEQ ID NO: 59639 - DNA, 201 bp, Homo sapiens
gaacagcaaaaaaaaaaaaaaagaaaaaacaagaaggcaatagaatagatggctatacaccatgatgctgacacttagtctgagttatggaatgtattgtwtatgttatctgggagaaaaagacacaatgagctctttgacacacttaaaacggatcataagggattattcaagccattgttgtctccaggaaggtaaatg

SEQ ID NO: 59640 - DNA, 201 bp, Homo sapiens
tttcagtttgagatgatgaaaagagttttggagatgaataatggtgatggtggcacaataatatgaatgtgcttaataccactgaactgtacacttgataytggtgacatggtaaatggtaaattaaatttcatgctacgtatatctcactataataaaaaattgaacagcaaaaaaaaaaaaaaagaaaaaacaagaagg

SEQ ID NO: 59641 - DNA, 201 bp, Homo sapiens
ccctagacacacactctaggtaaaaacattttattcttgggagaaaacattgactcataaatttcaaaaaagaaaagggaaagggaaaggaagcaaaaccracagaactttcaggctaattttacttgtttgaagtaaaaacttgtgaaagaatgactatttcccaagatgcagccaatacaaagagaccaagtagagatg

SEQ ID NO: 59642 - DNA, 201 bp, Homo sapiens
ctcggcggaagagggaaatagggagttatggtttaatggatacggagtttcagtttgagatgatgaaaagagttttggagatgaataatggtgatggtggyacaataatatgaatgtgcttaataccactgaactgtacacttgatattggtgacatggtaaatggtaaattaaatttcatgctacgtatatctcactata

SEQ ID NO: 59643 - DNA, 201 bp, Homo sapiens
ggaatattattcaaccttaaagaggaagtaaattctgacctctgctacaaacatgaatgaaccttgaagacattatgctaagtgaaataagccactatgaraggacaaatactgtatgattccactcatatgaggaacttagagtagtcaaagtcatagagacagaaagtagaacggaggttgccaagggctcggcggaag

SEQ ID NO: 59644 - DNA, 201 bp, Homo sapiens
gttaccttataaatcacatgtctgtggtctgatttgacaaaatgatcctctttcaatatgttaggtttctaatcttttgctcttatactaaggcactcatsgggggcgggtgtggtggttcacaaggattattattttttttacgaggagtacctcacactaaagtcatgttccagaagtgtaatattgacattttgtgtt

SEQ ID NO: 59645 - DNA, 201 bp, Homo sapiens
cactttggccaggctggtctcaaactcccgacctcaagtgattcactcacatcagcctctcaaagtgctgggattataggtgtgagccattgtgctcagcyggatttttggttcttaaatgctctgagtctgtaaaaaccagaggtcaaagcccagagcaaagaggtagtctttacactttgaaaagtttcagaaatagcc

SEQ ID NO: 59646 - DNA, 201 bp, Homo sapiens
gaaatagctttttcttcttcctttaatgctcttcttcctgcttctcactggctggtttcttgcagtcattcttctctccacttaaacattatctcattaawgaggtcttccctgacgttcctgaccaacatagtgacacagtcattctatcacataagtttcatttcctacctagcacttatggctatattctgttaatat

SEQ ID NO: 59647 - DNA, 201 bp, Homo sapiens
tcttaatacctataccaatatttcgaatcatctctggcatacgaatgtatttatatccaaaggcaaagctctggaataaataagaaattagtaaaaggtayaatttttctcttataaagtgggagaaaggtgtattttaggcagattgtttttaagaaagtatatatgtgaaagttgagaatctgaatacagatttaatta

SEQ ID NO: 59648 - DNA, 201 bp, Homo sapiens
gaaaagatatacatacattttccttctagggttctagctttatatgattttgtgattatgaacaaatcatctttaaacaatccttataaatgaaaaactcrtcgtacacattgtttgaattcatatgatctgtaactttttaatcagatagattattttccaatagaaattgttcagatcaaaatagacatacctcagtat

SEQ ID NO: 59649 - DNA, 201 bp, Homo sapiens
aataaacaaaacaattagtgaggagattcaaatggaagaaatagtttgaggcagaaagcaatcattgcagttttaggtgtgttgaatttgagaagatggcrtgatatatgggagcaagtagtctcaggcaagaggaagggcggaaatgaaatcctggattgcacccattcaagtaagatagagggagctgcggcaggctac

SEQ ID NO: 59650 - DNA, 201 bp, Homo sapiens
tggacaactgatttttttcagccaagctcttcaagcccgctgctatgctgcagcttagctggcgacaggcccttatcaaggcagaactgtgccttgatagmggccaggaaggcgattcagagcagtaggccttgtccatgtgtttgttccctgcttcttcaccacttgaaaatagtgtttcagtgcccagtaacagggcac

SEQ ID NO: 59651 - DNA, 201 bp, Homo sapiens
caatggaggcagggatgaggtgctgtgggagcctggaggaaggaacacagagtccacctgggaaagccatggagaataggtggagtaaagtttatcagacrtaagaagagaggacagccaggattgtggggagagcatgtgcaaattcaaggaagtaggaattctgttttgctgagaaagtacatacagtgggcaatgagg

SEQ ID NO: 59652 - DNA, 201 bp, Homo sapiens
cacaaaattttcaaagacccacacacgtctgaatttcttttataattattttctttgaagtcaaagaaaatgttttaatatatagtgatatattcatcttygtaccagtgcagttgcaaaatagaatttttaatatgttagcatggaggaagaagcctacataggcaaagttgcctgaagtctatgaaagtcataatgcag

SEQ ID NO: 59653 - DNA, 201 bp, Homo sapiens
aaaatggggctactattatcagccttacctacctgcctcactagtagttgtgaattaatgtgtgtaaacgcaactttaaaactcttataggatttataggraaaatgatgatgatgacatgttaccttataaatcacatgtctgtggtctgatttgacaaaatgatcctctttcaatatgttaggtttctaatcttttgct

SEQ ID NO: 59654 - DNA, 201 bp, Homo sapiens
acacagtcccatgcaccctacatctcatcactggggtgtgacacacacacacacacacacacacacaactccacaccatcccatgcaccctacatcatccrtcactgtggcatgacacacacatacacacagaaccccacactgtcccatccaccctacattatccatcactgtggcatgacacacacacacacacacaca

SEQ ID NO: 59655 - DNA, 201 bp, Homo sapiens
catatagggtgcattggaatgaagaagatggggcttgggggaataaatcatgcatgaggaatagcatgggatggggaagggtaatggacaaggtgtttagytcagtcctgtcacttcctgtccttaagctagtggtttagactctctgaggctcagtatcttctgtaaaatggggctactattatcagccttacctacctg

SEQ ID NO: 59656 - DNA, 201 bp, Homo sapiens
cccatgcaccctacataatccatcactgggcgtgacacacacacacacacacacacacacacacacacaacctcacactgtcccatgcaccctacatcatycatcactgggtgtgacacacacatacacacaatcccacactgtcccatgcaccctacatcatccatcaccaggacatgatacatgaacacacacacaaca

SEQ ID NO: 59657 - DNA, 201 bp, Homo sapiens
tgtggacaggaaagatatagcatctaggaattttttctgaggaagaacccggcccttccattacctggctttagaagataccttttccacttagctatttygtgtgagccgctggagagtcctgtccacggaagcatggattgctctccatccttgagagcgtttcagtatgacaccaactgtagcttccgctgtgctgaa

SEQ ID NO: 59658 - DNA, 201 bp, Homo sapiens
atttatatccaaaggcaaagctctggaataaataagaaattagtaaaaggtataatttttctcttataaagtgggagaaaggtgtattttaggcagattgkttttaagaaagtatatatgtgaaagttgagaatctgaatacagatttaattaacactctctttgcttgtgaaccccttgggaagtcagccttatcctggt

SEQ ID NO: 59659 - DNA, 201 bp, Homo sapiens
atcaaggaagagcatgaggaaaccaatctttatcagaactgaggtcactcagggcttaattgtgctcaggaattcactttggctgcactcacttggcaacygaagtctgattaggatgacatcctgtgttctagagacaaagcccggtcaggatcattttacaggactaggtaacagtgtcaacaataagctatgctagtc

SEQ ID NO: 59660 - DNA, 201 bp, Homo sapiens
aaagtttcagaaatagcctggaaatgaaatgctttatcaaggaagagcatgaggaaaccaatctttatcagaactgaggtcactcagggcttaattgtgcwcaggaattcactttggctgcactcacttggcaactgaagtctgattaggatgacatcctgtgttctagagacaaagcccggtcaggatcattttacagga

SEQ ID NO: 59661 - DNA, 201 bp, Homo sapiens
gaatgtatttatatccaaaggcaaagctctggaataaataagaaattagtaaaaggtataatttttctcttataaagtgggagaaaggtgtattttaggcwgattgtttttaagaaagtatatatgtgaaagttgagaatctgaatacagatttaattaacactctctttgcttgtgaaccccttgggaagtcagccttat

SEQ ID NO: 59662 - DNA, 201 bp, Homo sapiens
tatgtaagatccaccttgaaatggactggaaaattcataaatactctcactcatcctcttgtcctataacccaaggatcccaaatgcaaatgcctccgggrgataggcagattacacaagtgtcaggatgtctggccatagacagtagggcatggcccttgctaactccttatcagggtctttacccagacctgaaggctc

SEQ ID NO: 59663 - DNA, 201 bp, Homo sapiens
gaattgcaaggtgcttgtgaggattaagtacataaaaagtatacaattaaatagcatgtataaagtacctagcatagagcttctgctctactgacatatcygaggtataggaccatgtcctatacttgagagggagttgggagcagcggctaaggtggctaaagagagtggttcaccatgtagtctttgagggtagccttt

SEQ ID NO: 59664 - DNA, 201 bp, Homo sapiens
cgaatgtatttatatccaaaggcaaagctctggaataaataagaaattagtaaaaggtataatttttctcttataaagtgggagaaaggtgtattttaggyagattgtttttaagaaagtatatatgtgaaagttgagaatctgaatacagatttaattaacactctctttgcttgtgaaccccttgggaagtcagcctta

SEQ ID NO: 59665 - DNA, 201 bp, Homo sapiens
ttcaacctccaggaaccatggttttctcatctgtgaaatggagctaagaattgcaaggtgcttgtgaggattaagtacataaaaagtatacaattaaatarcatgtataaagtacctagcatagagcttctgctctactgacatatccgaggtataggaccatgtcctatacttgagagggagttgggagcagcggctaag

SEQ ID NO: 59666 - DNA, 201 bp, Homo sapiens
gaccacggcttttatcagattttcaaaattcataagccctggaagaataagaataactgtgttaaccctatgcacattcatgtgagcaagcttgggcaaaycatttacgctcactgagtctcagtggtggggagtggtggctgccccatcttaggcattcgaagtctgaaagacttcctgcagaacagcagataaatgcta

SEQ ID NO: 59667 - DNA, 201 bp, Homo sapiens
ttgactctggacactggtctgcacccttgccaacctgtgagggtaggatttttcattagcaacctccattctgtccaagaaggaatcatggcatggtagasaggccaagggctctcagtgtcggggtgatctcttctaagttcttgcactagagcaagctcttcaacctccaggaaccatggttttctcatctgtgaaatg

SEQ ID NO: 59668 - DNA, 201 bp, Homo sapiens
tcgaatcatctctggcatacgaatgtatttatatccaaaggcaaagctctggaataaataagaaattagtaaaaggtataatttttctcttataaagtggragaaaggtgtattttaggcagattgtttttaagaaagtatatatgtgaaagttgagaatctgaatacagatttaattaacactctctttgcttgtgaacc

SEQ ID NO: 59669 - DNA, 201 bp, Homo sapiens
tgccagcccggctacagagtgaggggcttggacatgctccgctgcattgactctggacactggtctgcacccttgccaacctgtgagggtaggatttttcrttagcaacctccattctgtccaagaaggaatcatggcatggtagagaggccaagggctctcagtgtcggggtgatctcttctaagttcttgcactagagc

SEQ ID NO: 59670 - DNA, 201 bp, Homo sapiens
tatcctggtttgaagaattccacttcagcatttggaatggtgcattttgaaatgtgataggaagaacagcttgtgacacaacacaattcagagaaagcagyggggttaggttcgcaccaaagggttatcgatcactctgcattttgtgcaaataaacagctgtaaatcataacgttatgatactctcagtgtttaatcata

SEQ ID NO: 59671 - DNA, 201 bp, Homo sapiens
ataatttccccataagattagaaagggtggcctctacatctataagtggacactagaagacctactgagacaggtttatagaagtatagggaatagaggayattaagaatacagcttggaggaatctttgtttttaacagactcagatcaccctgggaactggtaatccaagtctggacaaacatcattagggtctcttga

SEQ ID NO: 59672 - DNA, 201 bp, Homo sapiens
aactgccaaatagccatcttgtaccagagattccagagagtggtctttggaatttcccaactcctttgcttcagtgccctgatctctggtaaactttatgytaacttttcacttaggcctaagtaattagggtagagcccagatctatgtgtgagaaatttaaggattgtagccagttggtttgaggcatgggaaaactgt

SEQ ID NO: 59673 - DNA, 201 bp, Homo sapiens
tttaaataaacaggaaagaaacccatttccaggcctgattgcttgctttgtacacctcttcatgtgggaaatggcctctcctgccccgggtggactcccayagactatgataagagtgctgtagtacctttatacttttgaaacgcacattctttagttcatttggtatcaaaaacacttgtgaaaaagggctgttctgag

SEQ ID NO: 59674 - DNA, 201 bp, Homo sapiens
aaaagttgaagaattcagaggagaagagttcaggctgtggtgatcagcagagtcttcagagactttacgagttaaatcctggaggattagtgggattttaygccataaaagtggaaaaattctcaggggaatgtgagccaagaaccagaagcaataacacacaaagtcacttcagggaattccaagaaactaatctatctt

SEQ ID NO: 59675 - DNA, 201 bp, Homo sapiens
aagttgaagaattcagaggagaagagttcaggctgtggtgatcagcagagtcttcagagactttacgagttaaatcctggaggattagtgggattttacgycataaaagtggaaaaattctcaggggaatgtgagccaagaaccagaagcaataacacacaaagtcacttcagggaattccaagaaactaatctatcttga

SEQ ID NO: 59676 - DNA, 201 bp, Homo sapiens
tgaagaattcagaggagaagagttcaggctgtggtgatcagcagagtcttcagagactttacgagttaaatcctggaggattagtgggattttacgccatraaagtggaaaaattctcaggggaatgtgagccaagaaccagaagcaataacacacaaagtcacttcagggaattccaagaaactaatctatcttgaccag

SEQ ID NO: 59677 - DNA, 201 bp, Homo sapiens
cattcaagtaagatagagggagctgcggcaggctacgaggtctctgaagcagagggtgtagagaaaatagggtgacattgtaagttcttgagtatggctgyctaaatctttgacttctttgtcttcgtgacttgtacctatactcttctctgtaagcttaccatcctcccactgccctttgcagcaaatgacctacatgat

SEQ ID NO: 59678 - DNA, 201 bp, Homo sapiens
ccatgtatatttggctttctgctgaatttcttatatttctgtaccatttcttgcttctttttaaaatagcaacaacaatgactcctctgatttcttctctkggccaggagaatcatctcctcaaggatgatttttaataattttcctcatctggttttctatctctgacactgatagtttttcttaacttccttaaatagc

SEQ ID NO: 59679 - DNA, 201 bp, Homo sapiens
tctgtccttcctcatgtcacaagctaaagctaatacacaagtactcagagacttaaaggaagaaacatttgcagatgtccaagatgtgttagaaaaatagrcatattaaatgtaaaacctgctatagaaattggtaaactagaagttgcatattatgtgacagtataaacattccatattttcataataatttgaacctaa

SEQ ID NO: 59680 - DNA, 201 bp, Homo sapiens
ctccaagtgtgagcttggacccaggcaggcctcaggtcagtggtaacggacgactgcttccgtggtgttggcaggtggaaatggagggatacagctttgtscggctcatgaatccctgggcattgtcccgcctgctagagcctctgatctctgccccttcttcacctgcagtaaaacagtcactagtttggttgctctccc

SEQ ID NO: 59681 - DNA, 201 bp, Homo sapiens
tattgttgtcagaatagccttagatttaaagaaagaatagtcacttcatttgtctataacccaacatttattgataaataatagtcttatattagagaatyaatggggagaaaagaataatgctaagaaaatatgtaactgcaataatttgtaaaaatacttttggggggaaattgtgaattaaaatttaaattcatttat

SEQ ID NO: 59682 - DNA, 201 bp, Homo sapiens
ataggtcttgaagaggtttgtaaaaatcaaactatctaagtaaatgagacttatctgaccaaggtattgttgtcagaatagccttagatttaaagaaagawtagtcacttcatttgtctataacccaacatttattgataaataatagtcttatattagagaattaatggggagaaaagaataatgctaagaaaatatgta

SEQ ID NO: 59683 - DNA, 201 bp, Homo sapiens
tatattccccaagctttttccccctcaatgtatccaattccttagttaacttttatagacaatgctgctttttaaacgcaagattttcatttataaaaathtgcagaaatataataaagaaatgaagaaatatcctcttaaatactcctatcctaaaatagacactgttaggcttctggtatgaattcttccaatattttc

SEQ ID NO: 59684 - DNA, 201 bp, Homo sapiens
gctgccttacactgctgtctgagcatctggtggatctgccccaatttcaggctgtatgggctgactttggtggagaaataccttcttatgtggaataatgygaggatgctggctgggtgggatgcaaaagttctgacttcagtaggggcaaagctgtgtggtctccatgcagatctgtcagctgaggttggtgttagtgaa

SEQ ID NO: 59685 - DNA, 201 bp, Homo sapiens
gccattcagctagattgggttcatctgagatgagaaaggaaaaaaattcctttctttccccaaacacaaatgcaggcagtttcagaatggcctcattcatmatttccccataagattagaaagggtggcctctacatctataagtggacactagaagacctactgagacaggtttatagaagtatagggaatagaggacat

SEQ ID NO: 59686 - DNA, 201 bp, Homo sapiens
atgaagcatcatgaaattcaaacaatcacttttagccaaataccatcgttgtatattaatcacacacacacacacacacacacacacacacacacacacasagagagagagagggagaaagagagagagagttacagagttcaggttgctgaattataaaatgatctcttcttttctcctctgccatgcccatgatagcca

SEQ ID NO: 59687 - DNA, 201 bp, Homo sapiens
aattgccaaaatttaattctcttcctacctgccattcagctagattgggttcatctgagatgagaaaggaaaaaaattcctttctttccccaaacacaaaygcaggcagtttcagaatggcctcattcataatttccccataagattagaaagggtggcctctacatctataagtggacactagaagacctactgagacag

SEQ ID NO: 59688 - DNA, 201 bp, Homo sapiens
tgatgaagcatcatgaaattcaaacaatcacttttagccaaataccatcgttgtatattaatcacacacacacacacacacacacacacacacacacacasacagagagagagagggagaaagagagagagagttacagagttcaggttgctgaattataaaatgatctcttcttttctcctctgccatgcccatgatagc

SEQ ID NO: 59689 - DNA, 201 bp, Homo sapiens
gaaattgaccagcttatggagaagctggcctgaattgccaaaatttaattctcttcctacctgccattcagctagattgggttcatctgagatgagaaagraaaaaaattcctttctttccccaaacacaaatgcaggcagtttcagaatggcctcattcataatttccccataagattagaaagggtggcctctacatct

SEQ ID NO: 59690 - DNA, 201 bp, Homo sapiens
gtgtgtaaaggtgagtttcaggtagttgggatgtataatgtccattgcacccagtccttacttagtgcatagatgaaattgaccagcttatggagaagctkgcctgaattgccaaaatttaattctcttcctacctgccattcagctagattgggttcatctgagatgagaaaggaaaaaaattcctttctttccccaaac

SEQ ID NO: 59691 - DNA, 201 bp, Homo sapiens
ccacagtgtttaggtatgtagaccttattcttttcatcctcactgacatagaattttgggggagaagaggacacaatgagctttctccattaaaaaatgtragaaataatgaccatctaggttagatggaaaactctggttatcactgttaactgtcaaccagagtaacattaatttcaattttcatggtatttttttatg

SEQ ID NO: 59692 - DNA, 201 bp, Homo sapiens
aataaataaataaaaatggacttccacattagggacattagtatatagaatcctggaattcttaagttagaagaatgctaagagttcatttaattcatatkcaacttccacgctttaaccttctacttttcccctttccctcagcaccaatgaccttaccaagtagttgtctaatttctacttgaatgcttccagtgatgg

SEQ ID NO: 59693 - DNA, 201 bp, Homo sapiens
atgggcccagcaagctggaatgcttggcttctggaatctggacaaataagcctccacagtgtttaggtatgtagaccttattcttttcatcctcactgacwtagaattttgggggagaagaggacacaatgagctttctccattaaaaaatgtgagaaataatgaccatctaggttagatggaaaactctggttatcactg

SEQ ID NO: 59694 - DNA, 201 bp, Homo sapiens
gtgagagagtgtggagaacttgagctccctcaacacgtgctcatgaactgcagccaccctctgggaaacttctcttttaactcgcagtgcagcttccactkcactgacgggtaccaagtaaatgggcccagcaagctggaatgcttggcttctggaatctggacaaataagcctccacagtgtttaggtatgtagacctta

SEQ ID NO: 59695 - DNA, 201 bp, Homo sapiens
aggatggtaccagcccccctctatcatctgtctcctccactcagtgtccctagacacacactctaggtaaaaacattttattcttgggagaaaacattgamtcataaatttcaaaaaagaaaagggaaagggaaaggaagcaaaaccaacagaactttcaggctaattttacttgtttgaagtaaaaacttgtgaaagaat

SEQ ID NO: 59696 - DNA, 201 bp, Homo sapiens
tgataaataacatttatttgaattaaatctaatttcttgacctttaatttcctatccataaattagaaagaataaccctgaagttccctgaaaatgtagtytaaggaggatgacagtctacttctttcaaacttccagtgtccagatatgctgaacacttattaagtatttcaataaacacatactgacatgccagttgat

SEQ ID NO: 59697 - DNA, 201 bp, Homo sapiens
tcacatctgtgaatgtccatgactctgacctttccatatctatgcagcctcctgccaggacatgtcctgcagcaaacaaggagagtgcctcgagaccatcrggaactacacctgctcctgttaccctggattctatgggccagaatgtgaatacggtgaggcttcctttttgttgatattattttggttttatgctagaga

SEQ ID NO: 59698 - DNA, 201 bp, Homo sapiens
atttcaataaacacatactgacatgccagttgatcacaaatgtagtaataacatttagactaacagtattttaagaaccaaaattttgtaaatagtatatktggaggcaagatttatcaatgcattagcaggtatttgtcggatgctactatgtgtccatctttgcatcttggttctttggatatcacccttcgagagaat

SEQ ID NO: 59699 - DNA, 201 bp, Homo sapiens
tgacattgggcttccataataaaacaatgcttggtttgaaaaccacagcccattttgtaccacatagggtttctctgtccacacatctgtcattggctccrtttgtccctctgtgtccacacacaacaataccctccttaggaaatactaaatgcagtatgaaatgggagccacgcaatactccagcaggcccctacaatg

SEQ ID NO: 59700 - DNA, 201 bp, Homo sapiens
gagtatttctagtgtgccagctctatgccttttgcacatatcaacttatttaaaattatacaacaattctgtgaaggagatttcagtattaatctcatttyatagttgtagaaactgaggcacaaatggatgaagtaaacttttcaaagtaaaacaataagaggtagatataggcttcaagtccagagatactgaattcac

SEQ ID NO: 59701 - DNA, 201 bp, Homo sapiens
gataactctactctctgggacacattaactggtttgagttgagttctccctggtatctggtcaggctgtagtcaaaagtgcatgaacacatgcacacacaygaccccacactgtcccatgcaccctactgggcgtgacacatacacaaccccacactgtcccatgcaccctacataatccatcactgggcgtgacacacac

SEQ ID NO: 59702 - DNA, 201 bp, Homo sapiens
catggaataacaaaaggtaattaacatgattatataatttgaatagtgttgtaatagttcataaaatggaaaagccaatttgagcccagaatctgggagayaggcagaactctggactgtaaagaatggcccagcaaagaggaagaaaatgggcattctaagttggtgcaataatatcagcacaggagaaaagacagaata

SEQ ID NO: 59703 - DNA, 201 bp, Homo sapiens
ttttgcatttttagtagagacgaggttttaccatgttgccaggctgttctcgaactcctgacctcaagtgatctgcccaccttggcctcccaaagtgctgrgattagaggcatgagccactgcaccagcccagttctttattaaagtaaaattaaagataatcatggtacttaatgaaggcttacacaggcacaggatgtt

SEQ ID NO: 59704 - DNA, 201 bp, Homo sapiens
catctgggctttgctaccaacaagttgtatagttctgcatcctcaacaactctcatattcacctcccctatttgcattcccactgatgccagaccaaaccwgtccctctttaactctcactgggaccattgcaatagcctcttcttttgcagtgcaatctccctgattgtaactcatttaaaaaaaaaaaagtatcgcact

SEQ ID NO: 59705 - DNA, 201 bp, Homo sapiens
aattttatttaaaatcatgaatgcagtggtttcacattttttaatcttggttctgccacttatcaactgtatctcttggacaagttactgactctttccaraacagttttttcatttgtttgtttccaatatgaatcccagggcttttaccccattagccatctctcacctctcaactagaaataaattccaccaaatcaa

SEQ ID NO: 59706 - DNA, 201 bp, Homo sapiens
agaagtaacttgcctaaggtcacatagcaagtaggcagcagagccaggattcatatcacacctgtgtgaccccacgccccacatctggtgcctaacctcartgcagtaatacgtgacattgggcttccataataaaacaatgcttggtttgaaaaccacagcccattttgtaccacatagggtttctctgtccacacatct

SEQ ID NO: 59707 - DNA, 201 bp, Homo sapiens
tacgtcttaaacatctcatttggctcctctgtttctccactgtaggattctggacatagatttgaagcaaatgaaaggtgaaagggtttgggctctaacaytgtgcaagctgagctcagagaagtaacttgcctaaggtcacatagcaagtaggcagcagagccaggattcatatcacacctgtgtgaccccacgccccac

SEQ ID NO: 59708 - DNA, 201 bp, Homo sapiens
gtcacctgagtggcactatcttggtgaagaggacatggcagttcagccatagtcagtactctcttcgcctgctgtattcagactcatgaaacatcacctcrtaagattgtttgtcctttaccatgagtacgtcttaaacatctcatttggctcctctgtttctccactgtaggattctggacatagatttgaagcaaatga

SEQ ID NO: 59709 - DNA, 201 bp, Homo sapiens
atatccacatatgacatatggatattcttttgtaatatacttccaagtgaaccagcatgtggacagggcttaagacagaggaagtaaccaccagaaaacarttcagccatagaacttacccccaactatgacctcattaataaaaacatctcagtgctttgaaagtatcaattctaatactaattctcatcaagtgcatat

SEQ ID NO: 59710 - DNA, 201 bp, Homo sapiens
tattcaggaaaccctgaaatgggatagaatacagaacattgtctctttttttcccctagagttctgagatcccaaggaagctataattggggaaacatttstatgctccaagaacatagggcaggcaggggttgctactgtaaggtattaagacattggtggggttaaggtcagggagcgaagtgaataggatgtggacca

SEQ ID NO: 59711 - DNA, 201 bp, Homo sapiens
acaaattgctaacctatctattcaggaaaccctgaaatgggatagaatacagaacattgtctctttttttcccctagagttctgagatcccaaggaagctrtaattggggaaacatttgtatgctccaagaacatagggcaggcaggggttgctactgtaaggtattaagacattggtggggttaaggtcagggagcgaag

SEQ ID NO: 59712 - DNA, 201 bp, Homo sapiens
ctaacccacaacagtggtagagacatcactaattaatacaactttacctgaacacagatgggttttatctccaccaacacagtactctaagcagccactaycattgattgtcgttttgccatctaagatgtaaaggatgtagagaagcatcaattatccatgggagatgagaaatagatatatttactgtaatatgaaatt

SEQ ID NO: 59713 - DNA, 201 bp, Homo sapiens
aataaagcaagccttctacattgtccctcttctccccaagcctcctagctgaggcaaaacatatccatgaatgcattatcatataatcagatctactttayaaataatgcatttatatataaataaattgattaattgagcatatattcatggatcaggatggacattaccaggatattagctcatcctactgctctccca

SEQ ID NO: 59714 - DNA, 201 bp, Homo sapiens
tcctttgtagcacacgaacactgtgcctaaggatggtatggactgccccgagcaggaagtttctaagtactctgaagcttctttgataaatcatctgccakacatattctgaattctttagattttaaacacctctccctcagaagccctcaacagtacaggtatggaacagaatacacagaataaagcaagccttctaca

SEQ ID NO: 59715 - DNA, 201 bp, Homo sapiens
gagaatataaccaaggattgtaaatgctttatagtttctcttcaacaacaacatatctttagatccattgaactttggtgggagggtagtggtggggagtrggcaggaaaggaaagaagtaattgaaggtgaaatacttcgagtgtattttaattctcaactttaccagtgccagagtaagcagacattcctgaaagcttg

SEQ ID NO: 59716 - DNA, 201 bp, Homo sapiens
gaatgcttccagtgatggagaatccactaccttctctatctagctattctaaaagtacttacgtgcctcctttaattctgcccccacatattaacacagtytctgtattccacatattacaatttgtgagcattactgtaactacagatttgtttttgctttctgagaaaacctgaagggtaaagactaactcttattaca

SEQ ID NO: 59717 - DNA, 201 bp, Homo sapiens
atcctattgaatgtgactcttcatttttttttctctctgttcatcatgtcctgggatatggtttaccttggctacttaaaggcatatgtaactgagaggargtttaattcagataaaatactatccttgagttgcaaactattttttctaattgaaatgttaaaaataagacttctcagaaattaactaaatcatacagtc

SEQ ID NO: 59718 - DNA, 201 bp, Homo sapiens
tggttgggtgccactgcactgcacagaaggttctccaagtgtgagcttggacccaggcaggcctcaggtcagtggtaacggacgactgcttccgtggtgtyggcaggtggaaatggagggatacagctttgtccggctcatgaatccctgggcattgtcccgcctgctagagcctctgatctctgccccttcttcacctgc

SEQ ID NO: 59719 - DNA, 201 bp, Homo sapiens
ctcttttcctcagattaaaaggggagccatctgcttaaggtggttgggtgccactgcactgcacagaaggttctccaagtgtgagcttggacccaggcagscctcaggtcagtggtaacggacgactgcttccgtggtgttggcaggtggaaatggagggatacagctttgtccggctcatgaatccctgggcattgtccc

SEQ ID NO: 59720 - DNA, 201 bp, Homo sapiens
tttttttttaattagccagtagtgatggcacacatctatagtcccagctactcaggaggctgaggtgggagaattgcttgagcccaggaggtcaaggctgsagcaagcagtaatcatgccactgcactccagcctgggccgcagagtgagaccctgtctcaaaaaaagaacctactagtctacataccacacttcctcatc

SEQ ID NO: 59721 - DNA, 201 bp, Homo sapiens
gtgatggacaaaatttgtccaaggactcacactattattctgtggttggttttagctgcccagtgcccacccctgaagattcctgaacgaggaaacatgayctgccttcattctgcaaaagcattccagcatcagtctagctgcagcttcagttgtgaagagggatttgcattagttggaccggaagtggtgcaatgcaca

SEQ ID NO: 59722 - DNA, 201 bp, Homo sapiens
aaagagaccaagtagagatggatagcttgggttaaaagtttagaaaattagagttaagagggttacacaaatagttacagctttcagcaaacatgacattsctgttaattctacatggaaaataaaaatcactattttgtctcctgcagtgagagagtgtggagaacttgagctccctcaacacgtgctcatgaactgcag

SEQ ID NO: 59723 - DNA, 201 bp, Homo sapiens
ttaattctacatggaaaataaaaatcactattttgtctcctgcagtgagagagtgtggagaacttgagctccctcaacacgtgctcatgaactgcagccaycctctgggaaacttctcttttaactcgcagtgcagcttccactgcactgacgggtaccaagtaaatgggcccagcaagctggaatgcttggcttctggaa

SEQ ID NO: 59724 - DNA, 201 bp, Homo sapiens
tacacttcttatgtcttgcatgtgtgtgtgtttgttttgtagcaggaccattgactatccaggaagccctgacttactttggtggagcggtggcttctacrataggtctgataatgggtgggacgctcctggctttgctaagaaagcgtttcagacaaaaaggtaaataggaaagagtcttctctttgcatcttggttaca

SEQ ID NO: 59725 - DNA, 201 bp, Homo sapiens
cctagaagcattctgctgagaaatcttgtgatagccttattgcaattcttgtctgtgatatgcttcttttctcttgctgattttaggatcctgtctttgtytttgatttttgatagtttgattattatgtcttggtgtagtcttttttggattgaacctgactggagatttttaagcttcctgtacctgaatattaatatt

SEQ ID NO: 59726 - DNA, 201 bp, Homo sapiens
actacagcagctctggagttgagaatatgggttacctttctacagtggctgaactagtgtctggagcaaagactttcacagagagaacttggcttggggtyccagggtgagatctagttcacaacagcagtgactccagtgtctgagacatgaggaggtgcactgcagccacagagccacagtccagagtgtgaatatctg

SEQ ID NO: 59727 - DNA, 201 bp, Homo sapiens
tacggtgaggcttcctttttgttgatattattttggttttatgctagagatgatgccaagaagtaaataaatcatgttgaagtctctccagtgagaatagratggtaccagcccccctctatcatctgtctcctccactcagtgtccctagacacacactctaggtaaaaacattttattcttgggagaaaacattgactc

SEQ ID NO: 59728 - DNA, 201 bp, Homo sapiens
ttccaagagtataaataggagttatggctttctgacttgaaactaaatacttgatacttgattttgctgtctgagatcaatctgaaaagtaataataatcrctaacatttgttgagcatcaattgtgggccaagtgtcatttcaatcactctgtacatattaactcatttcatcctacaacaacccggtgaggcaagttct

SEQ ID NO: 59729 - DNA, 201 bp, Homo sapiens
tgttttatctaagcttcactgttaggctacatgatgttgggatctggggcctgtcctctggctccgcagctgctgttcctcctactagaatttataggggmtctctgagaatagatcatggtaaacctgtcaccccattttccaagactgtacttctctctgggataaatgatggaataaatggaagactgggtaggtgcc

SEQ ID NO: 59730 - DNA, 201 bp, Homo sapiens
gtaagcagtctgggttgggcagaaggcagaaaaccagcagagtcacagaggagatggtgagtttatttttttctgcatgggaagtggttgaagtgagttgragtggtatggagtaaagtcaggcaggtaaaggttcagaaagtgaggaacagcgatagccatggagttttatgttgaattgcctattagattttgtgagta

SEQ ID NO: 59731 - DNA, 201 bp, Homo sapiens
caaataaagccatcgtggtttacagaggctgtgttttatctaagcttcactgttaggctacatgatgttgggatctggggcctgtcctctggctccgcagstgctgttcctcctactagaatttataggggctctctgagaatagatcatggtaaacctgtcaccccattttccaagactgtacttctctctgggataaat

SEQ ID NO: 59732 - DNA, 201 bp, Homo sapiens
gggttgggcagaaggcagaaaaccagcagagtcacagaggagatggtgagtttatttttttctgcatgggaagtggttgaagtgagttggagtggtatggrgtaaagtcaggcaggtaaaggttcagaaagtgaggaacagcgatagccatggagttttatgttgaattgcctattagattttgtgagtacttttaaactt

SEQ ID NO: 59733 - DNA, 201 bp, Homo sapiens
cctcctttttacaatgtcttttgcaatgtcttcttttctactctgaagtaaaatacacagataacaaatattctaattaaaatataaagtaggaataaaaygaaaagtaatttataataaaaacaagatgcaaaaacttaggcgctgtgccagtagatgcaatgaggtcatcagaagcgtgcaccttccacagaatcacta

SEQ ID NO: 59734 - DNA, 201 bp, Homo sapiens
aacatggtgaaacaccatatttactaaacttacaaaaactggctgggcatgttggcatgtgcctgtaatcccagctactcaggaggctgaggcaggacaawctcttgaacccaggaggtggaggtggcagtgagttgagatcacaccactgaactccagcctgggtgacagagcaagacttgtctcaaaaacaaaacaaaa

SEQ ID NO: 59735 - DNA, 201 bp, Homo sapiens
gtggggagtggtggctgccccatcttaggcattcgaagtctgaaagacttcctgcagaacagcagataaatgctaagttggcttggaagtgacctttatgktctcctatagctctgaaataacctgtaagaggtgaatcttggtatttggtgatgcatagaaacagaaaagtatgtcagattaaagcaggggatgcacact

SEQ ID NO: 59736 - DNA, 201 bp, Homo sapiens
agtggtggctgccccatcttaggcattcgaagtctgaaagacttcctgcagaacagcagataaatgctaagttggcttggaagtgacctttatgttctccyatagctctgaaataacctgtaagaggtgaatcttggtatttggtgatgcatagaaacagaaaagtatgtcagattaaagcaggggatgcacactgacttg

SEQ ID NO: 59737 - DNA, 201 bp, Homo sapiens
gcccctagagctatgatactcactaggtgaatatcaacatagccaactccatcttttggcaaagtgtattttagcacaaagcagacatctatctacttatytcatataatattagcaggacaatgccttttaaaggtaaaatgtatctattattcttgctccaagtctaaggtgaacactttcaaaaatttccttagaaaa

SEQ ID NO: 59738 - DNA, 201 bp, Homo sapiens
ttcaccatgttggccaggctggtcttgaactcctgacctcaggtgattcacccgccttggcctcccaaagtactgggattacaggcgtgagccactgcgcytagcctctgtgtgttaagtgctggaactatagtttacagtagcattttatcctcccaacataccctatcaggaaaaattattattgtcatccttatttca

SEQ ID NO: 59739 - DNA, 201 bp, Homo sapiens
ttagataaaacatataatagttataacaggctattttaagctgataaaatttaacttcaaggataaaaaaactccacacttttactctccctccacatttwataggtttttaatatttttcagactttatgtttttgatgttataatttacatcttttatattgtgtatctgttaacttattgtggttataattattttta

SEQ ID NO: 59740 - DNA, 201 bp, Homo sapiens
tattttaagctgataaaatttaacttcaaggataaaaaaactccacacttttactctccctccacattttataggtttttaatatttttcagactttatgyttttgatgttataatttacatcttttatattgtgtatctgttaacttattgtggttataattatttttaatagttttgtcttttaaccttcattctaaag

SEQ ID NO: 59741 - DNA, 201 bp, Homo sapiens
taggtcattgaaagttatatagtatttatctggaactgatgttaaaaaaaatagagagccaaaaattatagtagtcatcttgtctctgtaaaatgtaattmaataaatatgtcatgtacactgtatatacataagcaaacatgcaaataaaaaagcagcctactcaaaggttacaataatgttgcaacaattctggtagta

SEQ ID NO: 59742 - DNA, 201 bp, Homo sapiens
tctgaccttttacattctgcctcatttattggcaatgttaggttacaaaagaaactataatctctttcacctccaatccacatgttgtttctcttgcattmtttcttttctgcagctgtgaaatgctcagaactacatgttaataagccaatagcgatgaactgctccaacctctggggaaacttcagttatggatcaatc

SEQ ID NO: 59743 - DNA, 201 bp, Homo sapiens
taattcatattcaacttccacgctttaaccttctacttttcccctttccctcagcaccaatgaccttaccaagtagttgtctaatttctacttgaatgctkccagtgatggagaatccactaccttctctatctagctattctaaaagtacttacgtgcctcctttaattctgcccccacatattaacacagtttctgtat

SEQ ID NO: 59744 - DNA, 201 bp, Homo sapiens
ttattatacttctttgcaaaataaaaatataaaatttcaattttctacaactgtaagtctctatgtgttaaaatgtttttcttttctattgagttagcatkacaactactttcagtacacaattaaataaagtaaatatactgcaagttttgacaagtaacttaaacctttatatttaaattgctattaaagattcatctc

SEQ ID NO: 59745 - DNA, 201 bp, Homo sapiens
tagggttctagctttatatgattttgtgattatgaacaaatcatctttaaacaatccttataaatgaaaaactcgtcgtacacattgtttgaattcatatsatctgtaactttttaatcagatagattattttccaatagaaattgttcagatcaaaatagacatacctcagtatgaatacacagcatacatagtaaaaac

SEQ ID NO: 59746 - DNA, 201 bp, Homo sapiens
ttctacaactgtaagtctctatgtgttaaaatgtttttcttttctattgagttagcatgacaactactttcagtacacaattaaataaagtaaatatactrcaagttttgacaagtaacttaaacctttatatttaaattgctattaaagattcatctctaagacaggaggagctttccctcatttgttcatatatccatg

SEQ ID NO: 59747 - DNA, 201 bp, Homo sapiens
ggtcaatcatcatcttcctgccacatggcaagttaatgacaaagctggtgggatcattcaaatggaagaaatagtttgagacagaaagcaatcattgcagwaaatttcaactttcacattgacctttagtcagagaacagtaccatttcccaataaggcagggttgggcaggcagttggcccatgtatatttggctttctg

SEQ ID NO: 59748 - DNA, 201 bp, Homo sapiens
atctgcatggattcaacatactcagcacatggcaaattcaagttttgctttttggaactttatataatttattttttttctgaatgtttttgatccacaaygagttgaatccgtagatgcagaacccttggatacagagagtcggttatttttcagccttgtctctgcctttgcccttcaggacctgaagtccttttcatg

SEQ ID NO: 59749 - DNA, 201 bp, Homo sapiens
gtcttcttgctgattttagatgatgggaaatgccccttgaatcctcacaggtaaggtagaaatgttttatgattgagtaaattttgctaccttaactttawaattcactgtaatatgtcagaatgattacatgcaatgcctgcctcctttttacaatgtcttttgcaatgtcttcttttctactctgaagtaaaatacaca

SEQ ID NO: 59750 - DNA, 201 bp, Homo sapiens
tttattgaaggcctattaagtgctaaactctaggctcagtgctaaggatccaaagctaaaaagaaaacaccgtcggagatttacaacctggcagatgtagmctgtatcatagaaacagacattaccgtacatggcaatgagcacaatggaggcagggatgaggtgctgtgggagcctggaggaaggaacacagagtccacc

SEQ ID NO: 59751 - DNA, 201 bp, Homo sapiens
cgtataatacctaatgcaaagcctacacatcacttcatctgcatggattcaacatactcagcacatggcaaattcaagttttgctttttggaactttatakaatttattttttttctgaatgtttttgatccacaacgagttgaatccgtagatgcagaacccttggatacagagagtcggttatttttcagccttgtctc

SEQ ID NO: 59752 - DNA, 201 bp, Homo sapiens
ggccccacttcccattctgttgcagtggatttatgaattccagatcttctttcatgttagcttgtcagcattcccaggacctttggtgatcctacttgatygcacatcttagagttcttgaaaactttctgggagagaaagactagtcttttgcataatacacttcttatgtcttgcatgtgtgtgtgtttgttttgtagc

SEQ ID NO: 59753 - DNA, 201 bp, Homo sapiens
ctgttttgctgagaaagtacatacagtgggcaatgaggctggaccaactggtaggctccaggtcataaagcatgttattttccatgtgaagaggtagagcytgcccttaagacattttatatgtcatttaatctgagcttgggcaaattacttatgtctccttcttttataaaaggacaggagtaagttagatgacttcca

SEQ ID NO: 59754 - DNA, 201 bp, Homo sapiens
ccctgcagataccagaatccccagatgcccaagtcacttatataaaatggcataatatttgcatataacctacatacattctcctttagacttttaaaccrtctttagattacgtataatacctaatgcaaagcctacacatcacttcatctgcatggattcaacatactcagcacatggcaaattcaagttttgcttttt

SEQ ID NO: 59755 - DNA, 201 bp, Homo sapiens
tccctgcacacctttgctaagccctcagaatggaacaatgacctgtgttcaacctcttggaagttccagttataaatccacatgtcaattcatctgtgacragggatattctttgtctggaccagaaagattggattgtactcgatcgggacgctggacagactccccaccaatgtgtgaaggtaggctgtgggtctgtcc

SEQ ID NO: 59756 - DNA, 201 bp, Homo sapiens
tgaagaggtagagcttgcccttaagacattttatatgtcatttaatctgagcttgggcaaattacttatgtctccttcttttataaaaggacaggagtaarttagatgacttccagggtccctcctaactttgatatcttatgattccaaacctttaacatcaaggatcctcagaagatgacattttcctattctgacatc

SEQ ID NO: 59757 - DNA, 201 bp, Homo sapiens
caggcctagtctgattatagggctagtgttttgaccactgaactacactatcacccagtggcagagcttctgaatctcaggtaagtcacttgtgaatttaytcttttccactccacagattgcagctataactgctaaatgaactttagaaatggcagtgcctggtgatcagatgagagaatatgttggtagaaatctatt

SEQ ID NO: 59758 - DNA, 201 bp, Homo sapiens
atcactaattaatacaactttacctgaacacagatgggttttatctccaccaacacagtactctaagcagccactaccattgattgtcgttttgccatctragatgtaaaggatgtagagaagcatcaattatccatgggagatgagaaatagatatatttactgtaatatgaaattaagtttgattgttggaataattct

SEQ ID NO: 59759 - DNA, 201 bp, Homo sapiens
ttatagcattcctgtttaccacaattctaaaataataaggaaaggcagtatcatctcattttatagataaggaagagacacaagcttaaagaggttaaatwactcgtccagggtcacactgttagtaagtgaaaaggctcagctctatgtcactgaaagttttacttccttacagagtcttcttcagctacattcttcatt

SEQ ID NO: 59760 - DNA, 201 bp, Homo sapiens
tttacaggactaggtaacagtgtcaacaataagctatgctagtccagcttttttttttttccctataagtccagcattttcctgtatatactcttttcagrttcaatttcacagataatgtcaatatttaatgagcactttcaatgtacaaaacactctgctcagctccagaataaaactatgaatgactgagcccaactt

SEQ ID NO: 59761 - DNA, 201 bp, Homo sapiens
atctaattaaactaaagagcttctgcacagcaaaagaaactaccatcagagtgaacaggcaacctacagaatgggagaacatttttgcaatctactcatcygacaaagggctaatatccagaatctacaatgaactcaaacaaatttacaagaaaaaaacaaacaaccccatcaaaaagtgggcaaaggatatgaacagac

SEQ ID NO: 59762 - DNA, 201 bp, Homo sapiens
agataatgtcaatatttaatgagcactttcaatgtacaaaacactctgctcagctccagaataaaactatgaatgactgagcccaacttcgaggagaccayggtataatggggaagaatgacaatcatgtatgaacagcgcaagaacagaggctgtgggagcacattgcaggggcttctacccttagttaaggtgggaagg

SEQ ID NO: 59763 - DNA, 201 bp, Homo sapiens
tagcttcctcagctgtatgctcacatgtttgttgcgcatttaaattgtggacctcctgctcaagagaatattcagaaacggagatgctgattagaggacaytggaaacagatgaccataaggaggtcatctttacttcccaggaaagcagaagaatgagaagagaatagggccatggaggtgggaacctagagaaacactt

SEQ ID NO: 59764 - DNA, 201 bp, Homo sapiens
gcttttagttctttatttactctgaactttctcctcttgttgctgggtgcacatcaagtgaaatacccaaatgtgggctgggcaggaaggtaccatgcagwgtgcaatccactcgctgttgtaatacttctgagagagtgttatcagacaatttccctttttaatgtcctcccacccctccacatctacccctgctgtcag

SEQ ID NO: 59765 - DNA, 201 bp, Homo sapiens
tggggcagtgcaacaatagctgcttcttggtgagggggtgtgaggggtagtgcaactgtgtttccctttttagcatcctgctatgggaatggctgttggayaaaagatgccagtgtcctctgtggagcaggacactgggggcctcagtggctctgtgtcacatgactgacacagatagcctacaaatttctttattcgtag

SEQ ID NO: 59766 - DNA, 201 bp, Homo sapiens
ttgctctttggcttagagacaacctcttttctcactgtatttctttttccacccctaagctgggctaccaatatctgtgccacaccactaacaccaccacygtccagaaacataagggaactaatgtattagctgtaatagcttgtaacatctgggctttgctaccaacaagttgtatagttctgcatcctcaacaactct

SEQ ID NO: 59767 - DNA, 201 bp, Homo sapiens
cctgtgtaaattttgcttcaagttcagagagtggctttaattaacttttaggacctgagaaaatgaggataaggtttttctggtggggtattttcaatcasatagatctcagaggagtagctcttgattgggaacttatagttaaattgcactgatgtttgtcaaagttttagcgggctatggccgggctcagtggctcat

SEQ ID NO: 59768 - DNA, 201 bp, Homo sapiens
aagcaaaaacatcgacataaacaccaacctttagagacaaccacaggaggttcccagacctccatgtggatcccagggtaagaacccttctcgattgcctsctgggctttatgttcagaagcccctctcttggtaccctgaaattaggcttgagctctacagcgaagtgctaaggccccagccctggaatggtttttaata

SEQ ID NO: 59769 - DNA, 201 bp, Homo sapiens
cggcaagcgctgcccaggtcctggggtggtggcagccagcgggagcaggaaaggaagcatgttcccaggctgcccacgcctctgggtcctggtggtcttgrgcaccagctgggtaggctgggggagccaagggacagaagcggcacagctaaggcagttctacgtggctgctcagggcatcagttggagctaccgacctga

SEQ ID NO: 59770 - DNA, 201 bp, Homo sapiens
caaaaatcaatgagtacatgtgtattactgtttctttattccttacttcctcatcccttagctttgcagtgccaggatctcccagttccaaatgaggcccrggtgaactgctcccaccccttcggtgcctttaggtaccagtcagtctgcagcttcacctgcaatgaaggcttgctcctggtgggagcaagtgtgctacag

SEQ ID NO: 59771 - DNA, 201 bp, Homo sapiens
agggttggccactgtgatgggagactgggagcctcaccgactccttcgccctacacactcttgtgagctggccccaaagccagggaaatccctagaaatamtctgttcagggagaaaaccacttccacaggaagagtaccactaaatttaaaatcgttgcactccttctgcaatctgtctgaatagaggcaaagcccaggt

SEQ ID NO: 59772 - DNA, 201 bp, Homo sapiens
actgaattaattaattcatagctcctgtttagttgcaaaaggtgctattgttctaatgtattgttcagtgtagagttagtaataatgagaccagtgataatggtaataattattgcttaatgtaggactacctatttcataagcatcatcacattcaatccacacaaatgacccttaagttggttattactatgcccattt

SEQ ID NO: 59773 - DNA, 201 bp, Homo sapiens
ttacctcttacacctttctaagtggaaagctacaattttttatcccaaattttaaaagcaaaagaagattggattttccagtgtattacaaaaattagackgtaaaaataaaattgttacataatttcttaaagtttatccaatggaataaagtactagcatgatctgcaatcctcatcacttaaaagaccacaagcaggc

SEQ ID NO: 59774 - DNA, 201 bp, Homo sapiens
gtattgttcagtgtagagttagtaataatgagaccagtgataatggtaataattattgcttaatgtaggactacctatttcataagcatcatcacattcartccacacaaatgacccttaagttggttattactatgcccattttaaaggtgaagaaactgaggctttgagaggttaagtagctagcaaagttcatatagc

SEQ ID NO: 59775 - DNA, 201 bp, Homo sapiens
attcatctctaagacaggaggagctttccctcatttgttcatatatccatgaatgaatattacttatcaacaaaattagacaagtttggcatcaatattaytcccatatttcattttcaaggatttaaacattgagaaacttcattcatatgaataagtaaatggaattagaagttttattatagcaatgtctcaattcct

SEQ ID NO: 59776 - DNA, 201 bp, Homo sapiens
gcttaatgtaggactacctatttcataagcatcatcacattcaatccacacaaatgacccttaagttggttattactatgcccattttaaaggtgaagaarctgaggctttgagaggttaagtagctagcaaagttcatatagcttgaagtatggagacaggatgcaaacccaggcctagtctgattatagggctagtgtt

SEQ ID NO: 59777 - DNA, 201 bp, Homo sapiens
aagtaaatggaattagaagttttattatagcaatgtctcaattccttgaagtccttccaagttatatgccccaaattatatagtgatttactatcaaaatktagtcagacttgacaacttaatcgggtgctccctcaaagctgatgaaaggaaataaatggaaatcactagacttgaaaacggatttgctgcaatatcatt

SEQ ID NO: 59778 - DNA, 201 bp, Homo sapiens
aaatggttcctcttattttcccatatgcctgaacccattaatttttaaccctcagcactgccccctagaaccccaattttcacatggtgttttgcagagtwctaggatacatcagatggactcaggggcctccaagtaagcagaggcagtgtggcaggtggagttctcaagctgtctcttcagagtgcaatgtgagatttc

SEQ ID NO: 59779 - DNA, 201 bp, Homo sapiens
cctgaacgaggaaacatgacctgccttcattctgcaaaagcattccagcatcagtctagctgcagcttcagttgtgaagagggatttgcattagttggacyggaagtggtgcaatgcacagcctcgggggtatggacagccccagccccagtgtgtaaaggtgagtttcaggtagttgggatgtataatgtccattgcacc

SEQ ID NO: 59780 - DNA, 201 bp, Homo sapiens
agaattccacttcagcatttggaatggtgcattttgaaatgtgataggaagaacagcttgtgacacaacacaattcagagaaagcagtggggttaggttcrcaccaaagggttatcgatcactctgcattttgtgcaaataaacagctgtaaatcataacgttatgatactctcagtgtttaatcataggtcctgcagaga

SEQ ID NO: 59781 - DNA, 201 bp, Homo sapiens
cagcaaacatgacattgctgttaattctacatggaaaataaaaatcactattttgtctcctgcagtgagagagtgtggagaacttgagctccctcaacacrtgctcatgaactgcagccaccctctgggaaacttctcttttaactcgcagtgcagcttccactgcactgacgggtaccaagtaaatgggcccagcaagct

SEQ ID NO: 59782 - DNA, 201 bp, Homo sapiens
cttgcccttaagacattttatatgtcatttaatctgagcttgggcaaattacttatgtctccttcttttataaaaggacaggagtaagttagatgacttcyagggtccctcctaactttgatatcttatgattccaaacctttaacatcaaggatcctcagaagatgacattttcctattctgacatcattcacactttta

SEQ ID NO: 59783 - DNA, 201 bp, Homo sapiens
cttatatttctgtaccatttcttgcttctttttaaaatagcaacaacaatgactcctctgatttcttctcttggccaggagaatcatctcctcaaggatgmtttttaataattttcctcatctggttttctatctctgacactgatagtttttcttaacttccttaaatagctcttgcaggagcctcccttgttatgaagg

SEQ ID NO: 59784 - DNA, 201 bp, Homo sapiens
gagcaccttgaagaatataagatcagaattagagaaaactagctgcttaaaactagagggaaattttaatatcatccagctcacctgtctcatcttataamtgatgaaaaggacactcacgaggttttagtttctcaaggccgtggagcaggacagaagcaaagtgaggaccagaaaccagtctcccaaattttaggtgta

SEQ ID NO: 59785 - DNA, 201 bp, Homo sapiens
caatactcttttcctcagattaaaaggggagccatctgcttaaggtggttgggtgccactgcactgcacagaaggttctccaagtgtgagcttggacccargcaggcctcaggtcagtggtaacggacgactgcttccgtggtgttggcaggtggaaatggagggatacagctttgtccggctcatgaatccctgggcatt

SEQ ID NO: 59786 - DNA, 201 bp, Homo sapiens
ggtcttgaagaggtttgtaaaaatcaaactatctaagtaaatgagacttatctgaccaaggtattgttgtcagaatagccttagatttaaagaaagaatartcacttcatttgtctataacccaacatttattgataaataatagtcttatattagagaattaatggggagaaaagaataatgctaagaaaatatgtaact

SEQ ID NO: 59787 - DNA, 201 bp, Homo sapiens
aaatacttttggggggaaattgtgaattaaaatttaaattcatttattcattcacttggcaagtggttactgagcactgcctcttgagatcctgggatggsagttatggaagactcaaggatgaatcattcttgggttttagacactttcccatccagtagaagagtgagggtatgacatgggacatgacagcacatcagt

SEQ ID NO: 59788 - DNA, 201 bp, Homo sapiens
ggaaatgaaatcctggattgcacccattcaagtaagatagagggagctgcggcaggctacgaggtctctgaagcagagggtgtagagaaaatagggtgacwttgtaagttcttgagtatggctgcctaaatctttgacttctttgtcttcgtgacttgtacctatactcttctctgtaagcttaccatcctcccactgccc

SEQ ID NO: 59789 - DNA, 201 bp, Homo sapiens
ccaaaaaggctctcaccaacgaggctgagaactgggctgataatgaacctaacaacaaaaggaacaacgaggactgcgtggagatatacatcaagagtccrtcagcccctggcaagtggaatgatgagcactgcttgaagaaaaagcacgcattgtgttacacaggtagggccttctctactttgaaactttcctgttaaa

SEQ ID NO: 59790 - DNA, 201 bp, Homo sapiens
ttttaatcttggttctgccacttatcaactgtatctcttggacaagttactgactctttccaaaacagttttttcatttgtttgtttccaatatgaatccmagggcttttaccccattagccatctctcacctctcaactagaaataaattccaccaaatcaatactttttcacaatgttccccagtagattaaaactata

SEQ ID NO: 59791 - DNA, 201 bp, Homo sapiens
aatctaatccatatatctggctgcttaaactaagaacttgttctaacttgtcctgcccctagagctatgatactcactaggtgaatatcaacatagccaaytccatcttttggcaaagtgtattttagcacaaagcagacatctatctacttatttcatataatattagcaggacaatgccttttaaaggtaaaatgtatc

SEQ ID NO: 59792 - DNA, 201 bp, Homo sapiens
ctagtttggttgctctccctaatacctctggtcactgggagctgtgatctcaccaaacccctgccaggaaaagccccagaaaaagcggagggagtgagagycagaggctgctgctgccgtttgcaagaactgcaggggaggaggacgctgccacccacagcctctagagctcattgcagctgggacagcccggagtgtggt

SEQ ID NO: 59793 - DNA, 201 bp, Homo sapiens
aagaatacaaggggtcctggagacaggaaaatatgatcataataataaatttgtgattccttctttctctctttttctctttctttctttttctttctttyttttttttttttgatggagttttgctctcgttgcccaggctggagtaaaatggcatgatatcagctcactgcaaactccaccttccaggttcaagcaatt

SEQ ID NO: 59794 - DNA, 201 bp, Homo sapiens
taatagccaacacttaaacttacacttaacagcgtgataggtattgttccaaacacattaaattcatttaatggtccttacatgtctatgtatttggtgaytattatccttattattcacattgctgagtgtattattctgttctcatgatgctgatagagacatacccgagactggataacttattaaaaaaaaaaaggt

SEQ ID NO: 59795 - DNA, 201 bp, Homo sapiens
tgtctcaaaaaaagaacctactagtctacataccacacttcctcatccccatctgagactatatatattttttctaacatgaggcaatgccaaaaagaggrgctggtgagtgaaagtaagaacagaaagacatggaggcaagtcttatagaataatagccaacacttaaacttacacttaacagcgtgataggtattgttc

SEQ ID NO: 59796 - DNA, 201 bp, Homo sapiens
tatgaagggagtgaaaagcagttattccagattagccttaactctgttaacgcttcttttaattgggaggtctctgaatggaaacattttctcacaacagkcatagcatcacttcctactccaggggtgcaatgtccagccctcaccactcctgggcagggaaccatgtactgtaggcatcatccgggaacctttggtttt

SEQ ID NO: 59797 - DNA, 201 bp, Homo sapiens
ttctcacaacaggcatagcatcacttcctactccaggggtgcaatgtccagccctcaccactcctgggcagggaaccatgtactgtaggcatcatccgggracctttggttttaataccacttgttactttggctgcaacgctggattcacactcataggagacagcactctcagctgcagaccttcaggacaatggacag

SEQ ID NO: 59798 - DNA, 201 bp, Homo sapiens
caaccacaaccactactccaagtgtcatctcccttatgaaatccacaccaatcccattagaagtaatgtgtcacaggcatttcacttctgtccttcctcaygtcacaagctaaagctaatacacaagtactcagagacttaaaggaagaaacatttgcagatgtccaagatgtgttagaaaaatagacatattaaatgtaa

SEQ ID NO: 59799 - DNA, 201 bp, Homo sapiens
ttccttctttctctctttttctctttctttctttttctttctttcttttttttttttgatggagttttgctctcgttgcccaggctggagtaaaatggcaygatatcagctcactgcaaactccaccttccaggttcaagcaattctcttgcctcaatctctcgagtaggtgggattacaggtgtccaccacaacgcccgg

SEQ ID NO: 59800 - DNA, 201 bp, Homo sapiens
tagaagtaatgtgtcacaggcatttcacttctgtccttcctcatgtcacaagctaaagctaatacacaagtactcagagacttaaaggaagaaacatttgyagatgtccaagatgtgttagaaaaatagacatattaaatgtaaaacctgctatagaaattggtaaactagaagttgcatattatgtgacagtataaacat

SEQ ID NO: 59801 - DNA, 201 bp, Homo sapiens
gttgcatattatgtgacagtataaacattccatattttcataataatttgaacctaaataaaaagttaagccatacatgatatttcctgaagagctatcgycctacacataaagcattgagacctatgtttctttcatttttgtatcccccacaaaacatagcacagtgctttgcaaatgtcactactgataaataacatt

SEQ ID NO: 59802 - DNA, 201 bp, Homo sapiens
attgagacctatgtttctttcatttttgtatcccccacaaaacatagcacagtgctttgcaaatgtcactactgataaataacatttatttgaattaaatytaatttcttgacctttaatttcctatccataaattagaaagaataaccctgaagttccctgaaaatgtagtttaaggaggatgacagtctacttctttca

SEQ ID NO: 59803 - DNA, 201 bp, Homo sapiens
acagtgctttgcaaatgtcactactgataaataacatttatttgaattaaatctaatttcttgacctttaatttcctatccataaattagaaagaataacsctgaagttccctgaaaatgtagtttaaggaggatgacagtctacttctttcaaacttccagtgtccagatatgctgaacacttattaagtatttcaataa

SEQ ID NO: 59804 - DNA, 201 bp, Homo sapiens
gatggcaccagaggctgcagaaggccaagaatcaagctagaaggccacatgtcaccgtggaccttcctgccaccagtcactgtccctcaaatgacccaaasaccaatattcaaatgcgtaattaaaagaattttccccaaatgccgtgttcctctattttatggtttgttcagtaaggtctgtatacatcacattgtttac

SEQ ID NO: 59805 - DNA, 201 bp, Homo sapiens
cgtatatctcactataataaaaaattgaacagcaaaaaaaaaaaaaaagaaaaaacaagaaggcaatagaatagatggctatacaccatgatgctgacacytagtctgagttatggaatgtattgtatatgttatctgggagaaaaagacacaatgagctctttgacacacttaaaacggatcataagggattattcaagc

SEQ ID NO: 59806 - DNA, 201 bp, Homo sapiens
gagtgaaagtgggcagatacatattttttactaaaaggaaaccactcactattcaggtcacacaaaagcataatcacatacacacacacacaccccccccmcacacaccccattgttaagctaggtcaacagtaaatgaatgaatgaatgaatgaatgaatgaatgaacaaatggacaagcaaacagcagaattgaatgtc

SEQ ID NO: 59807 - DNA, 201 bp, Homo sapiens
ttgagtgaaagtgggcagatacatattttttactaaaaggaaaccactcactattcaggtcacacaaaagcataatcacatacacacacacacaccccccmcacacacaccccattgttaagctaggtcaacagtaaatgaatgaatgaatgaatgaatgaatgaatgaacaaatggacaagcaaacagcagaattgaatg

SEQ ID NO: 59808 - DNA, 201 bp, Homo sapiens
ggaataacaaaaggtaattaacatgattatataatttgaatagtgttgtaatagttcataaaatggaaaagccaatttgagcccagaatctgggagatagrcagaactctggactgtaaagaatggcccagcaaagaggaagaaaatgggcattctaagttggtgcaataatatcagcacaggagaaaagacagaatattg

SEQ ID NO: 59809 - DNA, 201 bp, Homo sapiens
catctgcactgagcattggcatgcctttctttatcagatattcactgagaacctactatgggccatgtcctttgtgcttgggaccagggatgagatgaaayggtgcgtgaagccagtcttaggcacatgtccactatagtatagtcaaggtgaggtttgcactgattgacacatatagggtgcattggaatgaagaagatg

SEQ ID NO: 59810 - DNA, 201 bp, Homo sapiens
tccaccacaacgcccggctaattttttatatttttagtagagaagggtttcaccatgttggccaggctggtcttgaactcctgacctcaggtgattcaccygccttggcctcccaaagtactgggattacaggcgtgagccactgcgcctagcctctgtgtgttaagtgctggaactatagtttacagtagcattttatcc

SEQ ID NO: 59811 - DNA, 201 bp, Homo sapiens
tgattcacatggtgagtacacagggaaccatgactggtcattctgtcccctcatcctgtgggtaagtttccaaagttctggagattcgttcctctggtagsaattgttgagtcaaaaccatagaaacacaacccagacaaactgtcatattgtttaaccctaaatcatatcatttctctctagcattttcttatgaaaaat

SEQ ID NO: 59812 - DNA, 201 bp, Homo sapiens
aggcttggtcatgtcgcatgctttatcatccaaaacagcaatgcagcatgggatttagaagcctggaggttaatgaaggttaaaaaaaaaaaaaaaaaaaagtacagtggaaagagctctttcttgtttcaaagtcaagctctgctactgtcattctgaacgtgttatttagatgccccaagcttcagtattttcatgtgc

SEQ ID NO: 59813 - DNA, 201 bp, Homo sapiens
tcttactttcagttattcctctgccattattcattcatatatttatccataaaatgtttattgagtattgagtatgtgccctaccatggctggggattcaracctgagtaagtaatagtccttgcccttgagaagcctctgtcagtagcttcctcagctgtatgctcacatgtttgttgcgcatttaaattgtggacctcc

SEQ ID NO: 59814 - DNA, 201 bp, Homo sapiens
gaggccaaagaaaaagtattgcttgagcccaggggctccaggccagcctgggcaatatagtgagaacttatctctacaaaaaattagccgggtgtggtgaygcatgcctgtagtcccagttactcaggaggctgagatgggaagatcacttgaggccaggaggtggaggtttcagtgaacccagatcatgccactgcactt

SEQ ID NO: 59815 - DNA, 201 bp, Homo sapiens
catttttggaggccaaagaaaaagtattgcttgagcccaggggctccaggccagcctgggcaatatagtgagaacttatctctacaaaaaattagccgggygtggtgatgcatgcctgtagtcccagttactcaggaggctgagatgggaagatcacttgaggccaggaggtggaggtttcagtgaacccagatcatgcca

SEQ ID NO: 59816 - DNA, 201 bp, Homo sapiens
atagtttctcatccccatccctcccatttctttctgtgagcctatgaatcttctgggactgatctggaatatccacatagtttccttttctgccctaagaytcaatcttgttaatgactcagtttcttcttctataaaatggatatagtaataatactctatagtttcatcatgaggattaaataagattttgctgaaaag

SEQ ID NO: 59817 - DNA, 201 bp, Homo sapiens
catcctacaacaacccggtgaggcaagttctgttattctgttttacagttgaggaaacagaggcatagagagcttaagtagtttgcccagtagatagccaraagaggagccaggatgggtctcgggcagtttaacagcacagctgaagtcttaaccactatgccaacagctttttggtcctacacatcccatgggaagagg

SEQ ID NO: 59818 - DNA, 201 bp, Homo sapiens
tggacaaaagatgccagtgtcctctgtggagcaggacactgggggcctcagtggctctgtgtcacatgactgacacagatagcctacaaatttctttattsgtagctatctcctggtgtctcatatatgccagtctcaccggtgattcttctacatggatattctttcttttctccattgtgttgttccaaattctttaac

SEQ ID NO: 59819 - DNA, 201 bp, Homo sapiens
ctgggatgggagttatggaagactcaaggatgaatcattcttgggttttagacactttcccatccagtagaagagtgagggtatgacatgggacatgacarcacatcagttcagacaaaaagttgaagaattcagaggagaagagttcaggctgtggtgatcagcagagtcttcagagactttacgagttaaatcctggag

SEQ ID NO: 59820 - DNA, 201 bp, Homo sapiens
gaggggtagtgcaactgtgtttccctttttagcatcctgctatgggaatggctgttggacaaaagatgccagtgtcctctgtggagcaggacactgggggyctcagtggctctgtgtcacatgactgacacagatagcctacaaatttctttattcgtagctatctcctggtgtctcatatatgccagtctcaccggtgat

SEQ ID NO: 59821 - DNA, 201 bp, Homo sapiens
atgttggctccacctgccatttctcttgtgacaacggctttaagctggaggggcccaataatgtggaatgcacaacttctggaagatggtcagctactccrccaacctgcaaaggtaataatatgtacttgctaagacagttctacttttggaaatttattctacaacaacaaacaattatctagttcttatatgtgaact

SEQ ID NO: 59822 - DNA, 201 bp, Homo sapiens
acaatgactcctctgatttcttctcttggccaggagaatcatctcctcaaggatgatttttaataattttcctcatctggttttctatctctgacactgayagtttttcttaacttccttaaatagctcttgcaggagcctcccttgttatgaagggagtgaaaagcagttattccagattagccttaactctgttaacgc

SEQ ID NO: 59823 - DNA, 201 bp, Homo sapiens
tacttctttcaaacttccagtgtccagatatgctgaacacttattaagtatttcaataaacacatactgacatgccagttgatcacaaatgtagtaataayatttagactaacagtattttaagaaccaaaattttgtaaatagtatatttggaggcaagatttatcaatgcattagcaggtatttgtcggatgctactat

SEQ ID NO: 59824 - DNA, 201 bp, Homo sapiens
gacatgccagttgatcacaaatgtagtaataacatttagactaacagtattttaagaaccaaaattttgtaaatagtatatttggaggcaagatttatcawtgcattagcaggtatttgtcggatgctactatgtgtccatctttgcatcttggttctttggatatcacccttcgagagaatattttcatatatgtgctgt

SEQ ID NO: 59825 - DNA, 201 bp, Homo sapiens
aaacttcagttatggatcaatctgctctttccattgtctagagggccagttacttaatggctctgcacaaacagcatgccaagagaatggccactggtcamctaccgtgccaacctgccaaggtacaattttcatgtgggttaagaagtcactttgatgtggaaaataacaaaatcagtgtttcttccctgtgtctttctc

SEQ ID NO: 59826 - DNA, 201 bp, Homo sapiens
atattccccttataatgagccctcctgaaaatcagtctactggttttccccagtaatttctatccttaatgaccctctctttcatcttgttttttttttttaatcattcattcttgtcttcttgctgattttagatgatgggaaatgccccttgaatcctcacaggtaaggtagaaatgttttatgattgagtaaattttg

SEQ ID NO: 59827 - DNA, 201 bp, Homo sapiens
ataaataggtcattgaaagttatatagtatttatctggaactgatgttaaaaaaaatagagagccaaaaattatagtagtcatcttgtctctgtaaaatgyaattaaataaatatgtcatgtacactgtatatacataagcaaacatgcaaataaaaaagcagcctactcaaaggttacaataatgttgcaacaattctgg

SEQ ID NO: 59828 - DNA, 201 bp, Homo sapiens; identical to SEQ ID NO: 11472

SEQ ID NO: 59829 - DNA, 201 bp, Homo sapiens
tcttgcaggagcctcccttgttatgaagggagtgaaaagcagttattccagattagccttaactctgttaacgcttcttttaattgggaggtctctgaatkgaaacattttctcacaacaggcatagcatcacttcctactccaggggtgcaatgtccagccctcaccactcctgggcagggaaccatgtactgtaggcat

SEQ ID NO: 59830 - DNA, 201 bp, Homo sapiens
tttgtaactacctcttgtcacctagaagaggttgcagcaacttagagggtataacaggtattcagtacataaagcatgaacaataacttagtgtgggtgcraaatgcaatgcaaattacccagagctggtaagtgggatatcgaatatttctttggcatttatttttctttcctttctaaagcagaattccaagggtggat

SEQ ID NO: 59831 - DNA, 201 bp, Homo sapiens
aaactatcgttagattatcaagtgttaatgccaagaattttgtaactacctcttgtcacctagaagaggttgcagcaacttagagggtataacaggtattyagtacataaagcatgaacaataacttagtgtgggtgcaaaatgcaatgcaaattacccagagctggtaagtgggatatcgaatatttctttggcatttat

SEQ ID NO: 59832 - DNA, 201 bp, Homo sapiens
attgtcgtagacatccagcacccttgccccatacccactcaatatcggaagaactcttggttataaaaatcaaaaaacacccctaggggtcatattgcacyctttgaaaactatcgttagattatcaagtgttaatgccaagaattttgtaactacctcttgtcacctagaagaggttgcagcaacttagagggtataaca

SEQ ID NO: 59833 - DNA, 201 bp, Homo sapiens
actgccttggtagtcagtgaaaatagaacactaagcgtgcaataaatgcaaaccttatctgttttctatttttgtaattattcaggagtttttttttttttgccaaagttttagagtaggctcaagaatatgaccacttctcaaagttatgcacaaaagtcattcctgggtataactcttttcctgcatctgcactaatct

SEQ ID NO: 59834 - DNA, 201 bp, Homo sapiens
atatgaactctattgtcgtagacatccagcacccttgccccatacccactcaatatcggaagaactcttggttataaaaatcaaaaaacacccctaggggkcatattgcaccctttgaaaactatcgttagattatcaagtgttaatgccaagaattttgtaactacctcttgtcacctagaagaggttgcagcaacttag

SEQ ID NO: 59835 - DNA, 201 bp, Homo sapiens
gttccaggctcagagatttttaacctgtatgaatatcgagcagatattccaaagttatgtgggatgttggacaattcttttgtgtcctgtaccccttgctrtttataatctagcaatagttttcaaaaagggacagtatgcccccaagggtatttttttatttttgtaatgaacaagagttctactgacattgagtgggca

SEQ ID NO: 59836 - DNA, 201 bp, Homo sapiens
agcattagaactgtggccaacaccagcctaatttttcaacatggtgaacaactccggtaaagagtctgaaaacctgtgataattgtcctttgattcatatrgcaattgcattttaaagatgcaaaaaaatgcttaatatttacatgtaaagtgcttgagttccaggctcagagatttttaacctgtatgaatatcgagcag

SEQ ID NO: 59837 - DNA, 201 bp, Homo sapiens
cacgcaggtggactgatgggggaatgttgtattagtgactcaaagagcattagaactgtggccaacaccagcctaatttttcaacatggtgaacaactccrgtaaagagtctgaaaacctgtgataattgtcctttgattcatatggcaattgcattttaaagatgcaaaaaaatgcttaatatttacatgtaaagtgctt

SEQ ID NO: 59838 - DNA, 201 bp, Homo sapiens
atcaaaatagacatacctcagtatgaatacacagcatacatagtaaaaacatgttaggaaacatctctctgttgaaattactccacgtaagagactgataytttttagtaaagattttacaccatcatctacatttctgtattaaagatctggggcaggggaggacaataacttttcaattgtactaaaaataaataaata

SEQ ID NO: 59839 - DNA, 201 bp, Homo sapiens
ccagattagccttaactctgttaacgcttcttttaattgggaggtctctgaatggaaacattttctcacaacaggcatagcatcacttcctactccagggktgcaatgtccagccctcaccactcctgggcagggaaccatgtactgtaggcatcatccgggaacctttggttttaataccacttgttactttggctgcaa

SEQ ID NO: 59840 - DNA, 201 bp, Homo sapiens
agtgcccagaactctttgccccagagcagggcagcctggattgttctgacactcgtggagaattcaatgttggctccacctgccatttctcttgtgacaayggctttaagctggaggggcccaataatgtggaatgcacaacttctggaagatggtcagctactccaccaacctgcaaaggtaataatatgtacttgctaa

SEQ ID NO: 59841 - DNA, 201 bp, Homo sapiens
catcaagtgcccagaactctttgccccagagcagggcagcctggattgttctgacactcgtggagaattcaatgttggctccacctgccatttctcttgtracaacggctttaagctggaggggcccaataatgtggaatgcacaacttctggaagatggtcagctactccaccaacctgcaaaggtaataatatgtactt

SEQ ID NO: 59842 - DNA, 201 bp, Homo sapiens
gcccagggttctaagctagttgatggtggagccagtttcacactcatgttgattccaaagttggtgttttttagccatgtaaactaccacattctttgctstacatttttatgagacaatttgagaatataaccaaggattgtaaatgctttatagtttctcttcaacaacaacatatctttagatccattgaactttggt

SEQ ID NO: 59843 - DNA, 201 bp, Homo sapiens
ccagattgctggaagacaaatgtacccaacgccatcatattggtagaaagggcataggaaagaacttaaaatgatatatccaggacgaatgtatccattasgcacagtagacacagacgcacaaaattttcaaagacccacacacgtctgaatttcttttataattattttctttgaagtcaaagaaaatgttttaatata

SEQ ID NO: 59844 - DNA, 201 bp, Homo sapiens
ttgatactctagccatcaagtgcccagaactctttgccccagagcagggcagcctggattgttctgacactcgtggagaattcaatgttggctccacctgycatttctcttgtgacaacggctttaagctggaggggcccaataatgtggaatgcacaacttctggaagatggtcagctactccaccaacctgcaaaggta

SEQ ID NO: 59845 - DNA, 201 bp, Homo sapiens
gtgtaacatttccattattaactgctaggtggtgatgatgtggccttgcctgcaaagcagaagtcaggactgctgaaaaatgtttacgaactgttatggartcaattccctatgctacctgctggaaaaacaaaaataatctgatgctatccctctcccaaaaagtgggtagttgagtgtcctacaaaaagcctgaatggc

SEQ ID NO: 59846 - DNA, 201 bp, Homo sapiens
agaaaaccacttccacaggaagagtaccactaaatttaaaatcgttgcactccttctgcaatctgtctgaatagaggcaaagcccaggttcaaaggcaagyactcaggtccccttcatgaaggctgcagagttgtgctcttcagcagcaatatttttgctcctatacctccaaaaatatcctggaacactatgttacctct

SEQ ID NO: 59847 - DNA, 201 bp, Homo sapiens
caaacaaacaaacaaacaggttaaaatgggaaacatctctttttggaaattttgtttaaaccaaatcttatttaaaagtttaaacaaacaagtcaaagcasgaaacagtgggtagggttggccactgtgatgggagactgggagcctcaccgactccttcgccctacacactcttgtgagctggccccaaagccagggaaa

SEQ ID NO: 59848 - DNA, 201 bp, Homo sapiens
ggaaagcaacgcccacgcaggtggactgatgggggaatgttgtattagtgactcaaagagcattagaactgtggccaacaccagcctaatttttcaacatrgtgaacaactccggtaaagagtctgaaaacctgtgataattgtcctttgattcatatggcaattgcattttaaagatgcaaaaaaatgcttaatatttac

SEQ ID NO: 59849 - DNA, 201 bp, Homo sapiens
tgaatcttggtatttggtgatgcatagaaacagaaaagtatgtcagattaaagcaggggatgcacactgacttgcattttcctttcttagatgttgtgccktcatcaaaagcactgtaccagtcctctaaaaccttcaaatgtttaaaacaagttgtctcgctctctctcactttgttttatcttgtgtggtagagaattt

SEQ ID NO: 59850 - DNA, 201 bp, Homo sapiens
taaatattgtcgaatgtttaatttagcctaaaacactttctacctttcagggagaaactgttcccaatattccccttataatgagccctcctgaaaatcaktctactggttttccccagtaatttctatccttaatgaccctctctttcatcttgttttttttttttaatcattcattcttgtcttcttgctgattttaga

SEQ ID NO: 59851 - DNA, 201 bp, Homo sapiens
aatagattttttggtatgcatcttgattacatacttagcataaattcttgggtccaaaagcatgataacttaaaaattattgacacatgttgccaagatgytcaacaaaggtttagcatttcctaataaaatccttcatgtgccgttataattaaatgacactttttcttatcttctatgttaaacaagcccaattcagga

SEQ ID NO: 59852 - DNA, 201 bp, Homo sapiens
cctgacctcaagtgatctgcccaccttggcctcccaaagtgctgggattagaggcatgagccactgcaccagcccagttctttattaaagtaaaattaaasataatcatggtacttaatgaaggcttacacaggcacaggatgttattctaatgacccagtctctgactcctttccagcaacttccagttgaaccagcctt

SEQ ID NO: 59853 - DNA, 201 bp, Homo sapiens
gaaggacaaatggccactcatgccccaatatttttaataataaatacattcatttgttggggatgggagcttttttcctcagcttctcccaatttgatttyaggctttgaagttttctatggccaaataagaggaaaatgctgcagccatagctgaaaattcaactatgagagtctgttatttggataaaaatatgctacc

SEQ ID NO: 59854 - DNA, 201 bp, Homo sapiens
tttttatttaacatcatacattgagacctctctcctatctttacaagttaaaatatattatttttagtgacctttaacattcttttcatggatccaccatmattaatttccaccctcaattaatggcatttgtgtttgttttcaatattccgctcttacaaataatgtcttcacaaaaatctctaaatagattttttggta

SEQ ID NO: 59855 - DNA, 201 bp, Homo sapiens
acacctactagcctctggtacctccttgtgtgaaaagttaggtcaaggcatttgcttcttccactttctctctgcttttctcttcaccctgcaatcattawtagtttttttgcttgtttgtttgttttgttttttgagaaagagtctcactctgttgccaaggctggagtgtctcggctcactgccacctctgccttctgg

SEQ ID NO: 59856 - DNA, 201 bp, Homo sapiens
aggcaagagctcctagaccttaatctctatgatcatgtaggaatcactctaatcttgatgtttcccccaagtcctttctttgactttgagacatttccagrggaccctctaacagtggagaaggacaaatggccactcatgccccaatatttttaataataaatacattcatttgttggggatgggagcttttttcctcag

SEQ ID NO: 59857 - DNA, 201 bp, Homo sapiens
aacttatctctacaaaaaattagccgggtgtggtgatgcatgcctgtagtcccagttactcaggaggctgagatgggaagatcacttgaggccaggaggtrgaggtttcagtgaacccagatcatgccactgcacttcagcctgggcaacagagcaagaccctgtcccccagccccacaaaaaaaatcataccaccattaa

SEQ ID NO: 59858 - DNA, 201 bp, Homo sapiens
atggagtttttacaaacgctgcatttgacccgagtccttaaggtaagatccctataaagatatttttgaaggaaatagaacactagggaaaaatggaagaytataaagcttaacttttctttacataatcatatattaaattttaagtatgtattaaattttcaggcatgaaggaaattgtgttggcagtaggacacaggt

SEQ ID NO: 59859 - DNA, 201 bp, Homo sapiens
atgcctaaaccagactggcaggtcagaaagcctttttcaagcttagctttgaagaatgagaggcatttagccaaggggaaaatggaaatagagttccatcrgagaaaatggcatgtagaaagacatgaaagtgtaaaatcaatgagaagatggtatgtttcgcagttcagtgcatctgaatcaaaaggggattatggagga

SEQ ID NO: 59860 - DNA, 201 bp, Homo sapiens
cagcatttttggaggccaaagaaaaagtattgcttgagcccaggggctccaggccagcctgggcaatatagtgagaacttatctctacaaaaaattagccrggtgtggtgatgcatgcctgtagtcccagttactcaggaggctgagatgggaagatcacttgaggccaggaggtggaggtttcagtgaacccagatcatg

SEQ ID NO: 59861 - DNA, 201 bp, Homo sapiens
ggcttctggtatgaattcttccaatattttctccgcttttcctcctatgcaattaatatttttatgatgtatatacaattttaacaataaagttgaatggrtaaaagactagacagttctacattatttgccatacctttcactttgtatagactttcaacatttgagtgaaagtgggcagatacatattttttactaaaa

SEQ ID NO: 59862 - DNA, 201 bp, Homo sapiens
tgatgtttgtcaaagttttagcgggctatggccgggctcagtggctcatgcctgtaatcccagcactttgggaggccgaggcgcatagatcacttgaagtygagagttcaagagcagcctggccaacatggtgaaacaccatatttactaaacttacaaaaactggctgggcatgttggcatgtgcctgtaatcccagcta

SEQ ID NO: 59863 - DNA, 201 bp, Homo sapiens
aggtgaaatcagtgccggtagtgaagtgtagtaagtgtgttaggacacaaatacaacctaggtattattagaacatagactagggatgcctaaaccagacyggcaggtcagaaagcctttttcaagcttagctttgaagaatgagaggcatttagccaaggggaaaatggaaatagagttccatcagagaaaatggcatgt

SEQ ID NO: 59864 - DNA, 201 bp, Homo sapiens
ttgtctcaaaaacaaaacaaaaaaaaagttttagtgggctaaggagcaggtctggattttcgtccatttataccttttaaccaccttatgtggcttccagkccttactcttcttttcattacctgtttttcaaaatgcaactaaaatagttcagactctcctgggctagccaccagctcttagaatgtgcatcttcagaga

SEQ ID NO: 59865 - DNA, 201 bp, Homo sapiens
tacagcacaattataatattggaaaattctgaatttgactgtatttttatttttacctgtgacttttatactttcgtagattttcatgtaattaattaacrtccctttctttcagcttgaagaattccctttaacatttcttgtaaggcaggtctcgtgttgatgaactacctcagcttttatttgtttgggaaagtcttt

SEQ ID NO: 59866 - DNA, 201 bp, Homo sapiens
ggaaggaaaaatccagtaggggagacaggtgaaatcagtgccggtagtgaagtgtagtaagtgtgttaggacacaaatacaacctaggtattattagaacwtagactagggatgcctaaaccagactggcaggtcagaaagcctttttcaagcttagctttgaagaatgagaggcatttagccaaggggaaaatggaaata

SEQ ID NO: 59867 - DNA, 201 bp, Homo sapiens
tcatttattcatcaactctgttagagtgtgagactcataatgatggtttctgatattaaggaaggaaaaatccagtaggggagacaggtgaaatcagtgcyggtagtgaagtgtagtaagtgtgttaggacacaaatacaacctaggtattattagaacatagactagggatgcctaaaccagactggcaggtcagaaagc

SEQ ID NO: 59868 - DNA, 201 bp, Homo sapiens
gttcttgaaaactttctgggagagaaagactagtcttttgcataatacacttcttatgtcttgcatgtgtgtgtgtttgttttgtagcaggaccattgacyatccaggaagccctgacttactttggtggagcggtggcttctacgataggtctgataatgggtgggacgctcctggctttgctaagaaagcgtttcagac

SEQ ID NO: 59869 - DNA, 201 bp, Homo sapiens
ctccttgccttataaagtagtggaaattaaacccagtgactgtgtaggtaatcacccctcctcttcagtgttcagtttgtgaaatgaaaccttttgcttcrttataatctctgtttaacagaccttgaagtttcaaaatgttttaaactgggagttatttcatgcagatttctaatttattatctcagaagacctttgctt

SEQ ID NO: 59870 - DNA, 201 bp, Homo sapiens
aagtgggtagttgagtgtcctacaaaaagcctgaatggcagaatattcgaaatctagaaagaaaagattatgctgcgcctcagggtgtagatatgatgagyaatttttttctttcttttatttttttaaggaaatgataattatttaaatttctttggtctcatttccagagacctgtccttttcctggtctcctcattca

SEQ ID NO: 59871 - DNA, 201 bp, Homo sapiens
actgaattaaataaactgggcaaatgctaattttgcatccaacaatgtagtttatcattctgagggtttagaaagcaccctatttgattggttagatgctrccttcttttcaagtttattttcaatacagttttgttagtatgtttgtgttggcttatatattggttaattcaaaggcaccaggcacttgctccctcatta

SEQ ID NO: 59872 - DNA, 201 bp, Homo sapiens
ctggtgtctgatgaacagtgcccatggagtggccaagagccaaggcctgaagcatgggcatgcatggagggaccacagcaccagattcaattgtagcaatrgtaccagtgcccaaggcacaggcatacttactatcacattgataatggtgtgtaaaatgcaggtacttataaagcagctaaggagccagggactttactg

SEQ ID NO: 59873 - DNA, 201 bp, Homo sapiens
gtgcccagcttccgttggcttatcattgcacttagaataaaatctcatccccttgttttggatcccaaagcccgatgtgatctgtcactacccccggctcrtatttttctctccattgctcattccattctggccacactaatgtcttcatgttctttgaacacactgcagtttgcttccaccttaaggcctttgaaatag

SEQ ID NO: 59874 - DNA, 201 bp, Homo sapiens
gggttggccactgtgatgggagactgggagcctcaccgactccttcgccctacacactcttgtgagctggccccaaagccagggaaatccctagaaatackctgttcagggagaaaaccacttccacaggaagagtaccactaaatttaaaatcgttgcactccttctgcaatctgtctgaatagaggcaaagcccaggtt

SEQ ID NO: 59875 - DNA, 201 bp, Homo sapiens
ctgacatgtcataattactggaaaatgggcactggaaaatcacattgtaattaattcaaagcatgttttccaaatgtactactttaaattggagcttatakcataatccaaggaaacctttgtgtgtgtactgttcccacattgctcagcctgggatatccaggagtaattcaccttgcgcctgcctccagaccatcttcc

SEQ ID NO: 59876 - DNA, 201 bp, Homo sapiens
gttaaaatgtttttcttttctattgagttagcatgacaactactttcagtacacaattaaataaagtaaatatactgcaagttttgacaagtaacttaaamctttatatttaaattgctattaaagattcatctctaagacaggaggagctttccctcatttgttcatatatccatgaatgaatattacttatcaacaaaa

SEQ ID NO: 59877 - DNA, 201 bp, Homo sapiens
aataaacttggagattgtgacactcttaatttgatactctagccatcaagtgcccagaactctttgccccagagcagggcagcctggattgttctgacacycgtggagaattcaatgttggctccacctgccatttctcttgtgacaacggctttaagctggaggggcccaataatgtggaatgcacaacttctggaagat

SEQ ID NO: 59878 - DNA, 201 bp, Homo sapiens
gaaaacggatttgctgcaatatcatttacaatattcaaattcttaatacctataccaatatttcgaatcatctctggcatacgaatgtatttatatccaarggcaaagctctggaataaataagaaattagtaaaaggtataatttttctcttataaagtgggagaaaggtgtattttaggcagattgtttttaagaaagt

SEQ ID NO: 59879 - DNA, 201 bp, Homo sapiens
ctctcagtgtttaatcataggtcctgcagagatcagcagcttataagaacacaaaatatgcctacttaccaaagtcaagattcagaagctcccagatgaaragttctaggcttatgagataactctactctctgggacacattaactggtttgagttgagttctccctggtatctggtcaggctgtagtcaaaagtgcatg

SEQ ID NO: 59880 - DNA, 201 bp, Homo sapiens
agagcccagatctatgtgtgagaaatttaaggattgtagccagttggtttgaggcatgggaaaactgtccaagtccagattgctggaagacaaatgtaccyaacgccatcatattggtagaaagggcataggaaagaacttaaaatgatatatccaggacgaatgtatccattaggcacagtagacacagacgcacaaaat

SEQ ID NO: 59881 - DNA, 201 bp, Homo sapiens
atgttggccaggctggtcttgaactcctgacctcaggtgattcacccgccttggcctcccaaagtactgggattacaggcgtgagccactgcgcctagcckctgtgtgttaagtgctggaactatagtttacagtagcattttatcctcccaacataccctatcaggaaaaattattattgtcatccttatttcacagatg

SEQ ID NO: 59882 - DNA, 201 bp, Homo sapiens
gccatcatattggtagaaagggcataggaaagaacttaaaatgatatatccaggacgaatgtatccattaggcacagtagacacagacgcacaaaattttyaaagacccacacacgtctgaatttcttttataattattttctttgaagtcaaagaaaatgttttaatatatagtgatatattcatctttgtaccagtgca

SEQ ID NO: 59883 - DNA, 201 bp, Homo sapiens
gcctttaggtaccagtcagtctgcagcttcacctgcaatgaaggcttgctcctggtgggagcaagtgtgctacagtgcttggctactggaaactggaattytgttcctccagaatgccaaggtaagagtgtattctttctaacatcatggaaataaattgtaggcagtatttttaaaggctggattttagaggtgacaact

SEQ ID NO: 59884 - DNA, 201 bp, Homo sapiens
agaaagggcataggaaagaacttaaaatgatatatccaggacgaatgtatccattaggcacagtagacacagacgcacaaaattttcaaagacccacacaygtctgaatttcttttataattattttctttgaagtcaaagaaaatgttttaatatatagtgatatattcatctttgtaccagtgcagttgcaaaatagaa

SEQ ID NO: 59885 - DNA, 201 bp, Homo sapiens
tgaaggaaccatggactgtgttcatccgctcactgcttttgcctatggctccagctgtaaatttgagtgccagcccggctacagagtgaggggcttggacrtgctccgctgcattgactctggacactggtctgcacccttgccaacctgtgagggtaggatttttcattagcaacctccattctgtccaagaaggaatca

SEQ ID NO: 59886 - DNA, 201 bp, Homo sapiens
ttctgagccctatcttaataagggagtattcagacatggaagaagtagagtagttaatgaaagacaaacagccaagaagaatggaaagactataagattgyagatcaggatatctgatttcccacccgggttctgccacaaacctactgtgtttcactcattcaacaagtatttattgaaggcctattaagtgctaaactc

SEQ ID NO: 59887 - DNA, 201 bp, Homo sapiens
accattgctctctgtgtggcttttctcctttctcagtatctttctctttatccttggttattctctccagctgtgcagtgtcagcacctggaagcccccartgaaggaaccatggactgtgttcatccgctcactgcttttgcctatggctccagctgtaaatttgagtgccagcccggctacagagtgaggggcttggac

SEQ ID NO: 59888 - DNA, 201 bp, Homo sapiens
tgaaataatataaatcaatatgtttaagaattcagatgcaatcatgtatactttcttgatggactatagaagaacaccaatgaatacccatatgtgatagmactgccttggtagtcagtgaaaatagaacactaagcgtgcaataaatgcaaaccttatctgttttctatttttgtaattattcaggagtttttttttttt

SEQ ID NO: 59889 - DNA, 201 bp, Homo sapiens
tggcactcactctcctttactctagaactaacaaaccagaaagaagtggcagcatggacttatcattacagcacaaaagcatactcatggaatatttcccrtaaatactgccagaatcgctacacagacttagtggccatccagaataaaaatgaaattgattacctcaataaggtcctaccctactacagctcctactac

SEQ ID NO: 59890 - DNA, 201 bp, Homo sapiens
ttgagatcacaccactgaactccagcctgggtgacagagcaagacttgtctcaaaaacaaaacaaaaaaaaagttttagtgggctaaggagcaggtctggrttttcgtccatttataccttttaaccaccttatgtggcttccagtccttactcttcttttcattacctgtttttcaaaatgcaactaaaatagttcagac

SEQ ID NO: 59891 - DNA, 201 bp, Homo sapiens
ttgccaggctgttctcgaactcctgacctcaagtgatctgcccaccttggcctcccaaagtgctgggattagaggcatgagccactgcaccagcccagttytttattaaagtaaaattaaagataatcatggtacttaatgaaggcttacacaggcacaggatgttattctaatgacccagtctctgactcctttccagca

SEQ ID NO: 59892 - DNA, 201 bp, Homo sapiens
gaattacttttgtcctgtctttttgcatgtcatacttctgaattggttaacttaaatgagcagttattcctctcttccttctactctccttggcatcctcstctatttcaaaggtatgaacttattggatcagagagttctttgagattttgatgaaagttacaacttgtctttcccagatgaaagcaaaaacatcgacat

SEQ ID NO: 59893 - DNA, 201 bp, Homo sapiens
tgcacatggttaagctacttccaattttcctcagactttccaagagtatcccacatagtcccagggtccgaaatcctgcagtctgtggctatggaggaacmaggcaggtctctgtttttgagcacctttctgtgggactccagaaaaaagtaccgcatacacctgattcatcctactgctttgctttactatagcacactt

SEQ ID NO: 59894 - DNA, 201 bp, Homo sapiens
taagttggcttggaagtgacctttatgttctcctatagctctgaaataacctgtaagaggtgaatcttggtatttggtgatgcatagaaacagaaaagtaygtcagattaaagcaggggatgcacactgacttgcattttcctttcttagatgttgtgccttcatcaaaagcactgtaccagtcctctaaaaccttcaaat

SEQ ID NO: 59895 - DNA, 201 bp, Homo sapiens
tatgcacctagataaaatgcacatggttaagctacttccaattttcctcagactttccaagagtatcccacatagtcccagggtccgaaatcctgcagtcygtggctatggaggaaccaggcaggtctctgtttttgagcacctttctgtgggactccagaaaaaagtaccgcatacacctgattcatcctactgctttgc

SEQ ID NO: 59896 - DNA, 201 bp, Homo sapiens
aataagtgtttcacaatgaatcaggcagaatctccttgccttataaagtagtggaaattaaacccagtgactgtgtaggtaatcacccctcctcttcagtrttcagtttgtgaaatgaaaccttttgcttcgttataatctctgtttaacagaccttgaagtttcaaaatgttttaaactgggagttatttcatgcagatt

SEQ ID NO: 59897 - DNA, 201 bp, Homo sapiens
gagcctgacacatagtaagtgattagtaaatgttagccattattgttacaataaaaagaaaattcttaggaatagtggggtttaggattcagggaagatcyaaggatagctaggcattttgaactcagcaatgttatatgctcatggataagatgcacgtggttaggctacttctaattcagggaagatccaaggatagct

SEQ ID NO: 59898 - DNA, 201 bp, Homo sapiens
tggcttctttttttgaaagagctttgttgagtgaacggaatggtctccattaatttattgctgagagaaacagacaatactggggtagagtcactggtccrgtttttcaaatctaggaattgaggtgcagagaggtcaatcatcatcttcctgccacatggcaagttaatgacaaagctggtgggatcattcaaatggaag

SEQ ID NO: 59899 - DNA, 201 bp, Homo sapiens
ctctctgagaatagatcatggtaaacctgtcaccccattttccaagactgtacttctctctgggataaatgatggaataaatggaagactgggtaggtgcyctgggacaagcttacaattgaatagtttctcatccccatccctcccatttctttctgtgagcctatgaatcttctgggactgatctggaatatccacata

SEQ ID NO: 59900 - DNA, 201 bp, Homo sapiens
gggatacagtgttcaaagaactgacaaggtccctgctttcctgcagctgacattatacatattcttcagtttaaagttgtaattctgggagattatgaaamagttatttttgtgaaaatgttcacagatgacttcatgtctaggagttacaccagtagacatgtttcaaaaaggtttagtaaattgatttgatgtgtcaga

SEQ ID NO: 59901 - DNA, 201 bp, Homo sapiens
tatatcataatccaaggaaacctttgtgtgtgtactgttcccacattgctcagcctgggatatccaggagtaattcaccttgcgcctgcctccagaccatsttccatggaagggggtgaccccttgcctcttggcaaccactatttctaagctgccaacattactcttgcattatcaacattctaacttcatgggaagggc

SEQ ID NO: 59902 - DNA, 201 bp, Homo sapiens
actcttttcctgcatctgcactaatctccattccagcagcatccttgataactccacaaatgtcattcatcccatgtttgctgagtgcccaccatatgccrgatctgggttaggcttccatgtaactcatctaggctgcccctcaaacaggtaaacccacttctttacatgatccagagccaaattcttagtatgtaaggg

SEQ ID NO: 59903 - DNA, 201 bp, Homo sapiens
cagaaggctgccggaatagtaaacattcactgacatgtcataattactggaaaatgggcactggaaaatcacattgtaattaattcaaagcatgttttccraatgtactactttaaattggagcttatatcataatccaaggaaacctttgtgtgtgtactgttcccacattgctcagcctgggatatccaggagtaattc

SEQ ID NO: 59904 - DNA, 201 bp, Homo sapiens
atatgaccacttctcaaagttatgcacaaaagtcattcctgggtataactcttttcctgcatctgcactaatctccattccagcagcatccttgataactscacaaatgtcattcatcccatgtttgctgagtgcccaccatatgccggatctgggttaggcttccatgtaactcatctaggctgcccctcaaacaggtaa

SEQ ID NO: 59905 - DNA, 201 bp, Homo sapiens
ccctgtctcaaaaaaagaacctactagtctacataccacacttcctcatccccatctgagactatatatattttttctaacatgaggcaatgccaaaaagwggggctggtgagtgaaagtaagaacagaaagacatggaggcaagtcttatagaataatagccaacacttaaacttacacttaacagcgtgataggtattg

SEQ ID NO: 59906 - DNA, 201 bp, Homo sapiens
ttcttgatggactatagaagaacaccaatgaatacccatatgtgatagcactgccttggtagtcagtgaaaatagaacactaagcgtgcaataaatgcaamccttatctgttttctatttttgtaattattcaggagtttttttttttttgccaaagttttagagtaggctcaagaatatgaccacttctcaaagttatgc

SEQ ID NO: 59907 - DNA, 201 bp, Homo sapiens
ggctggagcaagcagtaatcatgccactgcactccagcctgggccgcagagtgagaccctgtctcaaaaaaagaacctactagtctacataccacacttcytcatccccatctgagactatatatattttttctaacatgaggcaatgccaaaaagaggggctggtgagtgaaagtaagaacagaaagacatggaggcaag

SEQ ID NO: 59908 - DNA, 201 bp, Homo sapiens
agataatttactaaatctatttgaaataatataaatcaatatgtttaagaattcagatgcaatcatgtatactttcttgatggactatagaagaacaccartgaatacccatatgtgatagcactgccttggtagtcagtgaaaatagaacactaagcgtgcaataaatgcaaaccttatctgttttctatttttgtaatt

SEQ ID NO: 59909 - DNA, 201 bp, Homo sapiens
acgtcctaaaatatggtgaactggtgccccctaaaactctggcccagctgacatctccatttttttcttcattcccccaacatttctctgaatctgtgggrcttcctagttttattcctaaagtttgagtttacaatattcaactcagatacatttattattcatactatatcttctttccagaaaattattgagaaaact

SEQ ID NO: 59910 - DNA, 201 bp, Homo sapiens
gtctctgcctttgcccttcaggacctgaagtccttttcatgagcctaagcagtgcttgaggttcttgtgccaactttgatgatgccacctgcatgatggaktgcttgtacacagtttccgtatccctcctgtccctgcctgttggaccactttcatgatacagactgctgaattcctaatcccttaacactgtctgtcatt

SEQ ID NO: 59911 - DNA, 201 bp, Homo sapiens
tggttcttaaatgctctgagtctgtaaaaaccagaggtcaaagcccagagcaaagaggtagtctttacactttgaaaagtttcagaaatagcctggaaatraaatgctttatcaaggaagagcatgaggaaaccaatctttatcagaactgaggtcactcagggcttaattgtgctcaggaattcactttggctgcactca

SEQ ID NO: 59912 - DNA, 201 bp, Homo sapiens
tgcaatgtgagatttcattttgggggatggctctaccgatagttccactttagttagaatgccggttccctgggccctctgggatgtggcctctgcctagytgttcctcagtatctgcagggggaattggttccaggactccctgcagataccagaatccccagatgcccaagtcacttatataaaatggcataatatttg

SEQ ID NO: 59913 - DNA, 201 bp, Homo sapiens
caccatgtagtctttgagggtagcctttgacaaagaagcaaaggaaggaacactgcatcgaaaaagtgtgtgatgcaatcccaggcaattacataattccrccaaaatgaattctctgcaattgcctcacaccctcagtttataaggcggacagtggtaatgggagaataggaaatttacgatagattagtgaattcccag

SEQ ID NO: 59914 - DNA, 201 bp, Homo sapiens
aaacctgtatccatttagctgctattgcctcctacatcttctctttatttgaacccttcccagtgtctcagtgcagcttcaccaaattcactggctgccayaggaacttcttcctatagaaccttgcatggtttatagaattttagtatctcagaattgagaggaaacatagagatcatgtagcacagcatatccacatat

SEQ ID NO: 59915 - DNA, 201 bp, Homo sapiens
tgaagcatcatgaaattcaaacaatcacttttagccaaataccatcgttgtatattaatcacacacacacacacacacacacacacacacacacacacacmgagagagagagggagaaagagagagagagttacagagttcaggttgctgaattataaaatgatctcttcttttctcctctgccatgcccatgatagccat

SEQ ID NO: 59916 - DNA, 201 bp, Homo sapiens
aactggtgatgaagcatcatgaaattcaaacaatcacttttagccaaataccatcgttgtatattaatcacacacacacacacacacacacacacacacasacacacacagagagagagagggagaaagagagagagagttacagagttcaggttgctgaattataaaatgatctcttcttttctcctctgccatgcccat

SEQ ID NO: 59917 - DNA, 201 bp, Homo sapiens
ctaactggtgatgaagcatcatgaaattcaaacaatcacttttagccaaataccatcgttgtatattaatcacacacacacacacacacacacacacacasacacacacacagagagagagagggagaaagagagagagagttacagagttcaggttgctgaattataaaatgatctcttcttttctcctctgccatgccc

SEQ ID NO: 59918 - DNA, 201 bp, Homo sapiens
atagccttagatttaaagaaagaatagtcacttcatttgtctataacccaacatttattgataaataatagtcttatattagagaattaatggggagaaargaataatgctaagaaaatatgtaactgcaataatttgtaaaaatacttttggggggaaattgtgaattaaaatttaaattcatttattcattcacttggc

SEQ ID NO: 59919 - DNA, 201 bp, Homo sapiens
taaaaatcacctctaaagctgtttgtgattgagcacttcaggatgtcaatcaactgtaagctgctgctattttacacctctacaatctctaactggtgatraagcatcatgaaattcaaacaatcacttttagccaaataccatcgttgtatattaatcacacacacacacacacacacacacacacacacacacacacag

SEQ ID NO: 59920 - DNA, 201 bp, Homo sapiens
gacatgggacatgacagcacatcagttcagacaaaaagttgaagaattcagaggagaagagttcaggctgtggtgatcagcagagtcttcagagactttaygagttaaatcctggaggattagtgggattttacgccataaaagtggaaaaattctcaggggaatgtgagccaagaaccagaagcaataacacacaaagtc

SEQ ID NO: 59921 - DNA, 201 bp, Homo sapiens
atgggacatgacagcacatcagttcagacaaaaagttgaagaattcagaggagaagagttcaggctgtggtgatcagcagagtcttcagagactttacgarttaaatcctggaggattagtgggattttacgccataaaagtggaaaaattctcaggggaatgtgagccaagaaccagaagcaataacacacaaagtcact

SEQ ID NO: 59922 - DNA, 201 bp, Homo sapiens
gggatcattcaaatggaagaaatagtttgagacagaaagcaatcattgcagtaaatttcaactttcacattgacctttagtcagagaacagtaccatttcycaataaggcagggttgggcaggcagttggcccatgtatatttggctttctgctgaatttcttatatttctgtaccatttcttgcttctttttaaaatagc

SEQ ID NO: 59923 - DNA, 201 bp, Homo sapiens
ctcacaacaggcatagcatcacttcctactccaggggtgcaatgtccagccctcaccactcctgggcagggaaccatgtactgtaggcatcatccgggaamctttggttttaataccacttgttactttggctgcaacgctggattcacactcataggagacagcactctcagctgcagaccttcaggacaatggacagca

SEQ ID NO: 59924 - DNA, 201 bp, Homo sapiens
gtgcaatgtccagccctcaccactcctgggcagggaaccatgtactgtaggcatcatccgggaacctttggttttaataccacttgttactttggctgcarcgctggattcacactcataggagacagcactctcagctgcagaccttcaggacaatggacagcagtaactccagcatgcagaggtaaggtgaaaaggagc

SEQ ID NO: 59925 - DNA, 201 bp, Homo sapiens
ataaccctgaagttccctgaaaatgtagtttaaggaggatgacagtctacttctttcaaacttccagtgtccagatatgctgaacacttattaagtatttyaataaacacatactgacatgccagttgatcacaaatgtagtaataacatttagactaacagtattttaagaaccaaaattttgtaaatagtatatttgga

SEQ ID NO: 59926 - DNA, 201 bp, Homo sapiens
gcaagtactcaagctagccattgtgcctgtatgttgaagtctcacccaaccacaaccactactccaagtgtcatctcccttatgaaatccacaccaatccyattagaagtaatgtgtcacaggcatttcacttctgtccttcctcatgtcacaagctaaagctaatacacaagtactcagagacttaaaggaagaaacatt

SEQ ID NO: 59927 - DNA, 201 bp, Homo sapiens
acttccagtgtccagatatgctgaacacttattaagtatttcaataaacacatactgacatgccagttgatcacaaatgtagtaataacatttagactaayagtattttaagaaccaaaattttgtaaatagtatatttggaggcaagatttatcaatgcattagcaggtatttgtcggatgctactatgtgtccatcttt

SEQ ID NO: 59928 - DNA, 201 bp, Homo sapiens
acagagaggtacagtaacttgcccaagacaacacagctagtaagtgaaactgaaatctggacaactgatttttttcagccaagctcttcaagcccgctgcyatgctgcagcttagctggcgacaggcccttatcaaggcagaactgtgccttgatagaggccaggaaggcgattcagagcagtaggccttgtccatgtgtt

SEQ ID NO: 59929 - DNA, 201 bp, Homo sapiens
ttcatttttgtatcccccacaaaacatagcacagtgctttgcaaatgtcactactgataaataacatttatttgaattaaatctaatttcttgacctttamtttcctatccataaattagaaagaataaccctgaagttccctgaaaatgtagtttaaggaggatgacagtctacttctttcaaacttccagtgtccagat

SEQ ID NO: 59930 - DNA, 201 bp, Homo sapiens
agagctactgtgaatattggaagtggctcatatcctttctgaccttttacattctgcctcatttattggcaatgttaggttacaaaagaaactataatctstttcacctccaatccacatgttgtttctcttgcattatttcttttctgcagctgtgaaatgctcagaactacatgttaataagccaatagcgatgaactg

SEQ ID NO: 59931 - DNA, 201 bp, Homo sapiens
ttttgtatcccccacaaaacatagcacagtgctttgcaaatgtcactactgataaataacatttatttgaattaaatctaatttcttgacctttaatttcytatccataaattagaaagaataaccctgaagttccctgaaaatgtagtttaaggaggatgacagtctacttctttcaaacttccagtgtccagatatgct

SEQ ID NO: 59932 - DNA, 201 bp, Homo sapiens
aggaattcaagaccagcctgggaaatatagagagaccctatctctagagatttttttttttaattagccagtagtgatggcacacatctatagtcccagcyactcaggaggctgaggtgggagaattgcttgagcccaggaggtcaaggctggagcaagcagtaatcatgccactgcactccagcctgggccgcagagtga

SEQ ID NO: 59933 - DNA, 201 bp, Homo sapiens
tctgttcatcatgtcctgggatatggtttaccttggctacttaaaggcatatgtaactgagaggaggtttaattcagataaaatactatccttgagttgcmaactattttttctaattgaaatgttaaaaataagacttctcagaaattaactaaatcatacagtctattcaatatttccagttagttattttttaaatgg

SEQ ID NO: 59934 - DNA, 201 bp, Homo sapiens
tttaaaaaaacctttaaaaatctcattcacattttaaatcatgtaggcaaccaacatggctgctaaatctgtaatctctaaagcccttgcttcccttcacyactttccagcccccctttctctgcaggaggaggcatttgcctcccactttgcaggccccatccccactcactgtcaagacccaaccctgaccatgaacag

SEQ ID NO: 59935 - DNA, 201 bp, Homo sapiens
taagtagctagcaaagttcatatagcttgaagtatggagacaggatgcaaacccaggcctagtctgattatagggctagtgttttgaccactgaactacaytatcacccagtggcagagcttctgaatctcaggtaagtcacttgtgaatttactcttttccactccacagattgcagctataactgctaaatgaacttta

SEQ ID NO: 59936 - DNA, 201 bp, Homo sapiens
acaaatggatgaagtaaacttttcaaagtaaaacaataagaggtagatataggcttcaagtccagagatactgaattcacagcctgcaccctagccaccgygctgtatagaagtcatggcatatgtgggtgctgttatgtcttgattatggctgggccactgtccccacattaggaagcaaaacaaagccactctgatcaa

SEQ ID NO: 59937 - DNA, 201 bp, Homo sapiens
actgggattacaggcgtgagccactgcgcctagcctctgtgtgttaagtgctggaactatagtttacagtagcattttatcctcccaacataccctatcasgaaaaattattattgtcatccttatttcacagatgtcaaaactgaacagagaggtacagtaacttgcccaagacaacacagctagtaagtgaaactgaaa

SEQ ID NO: 59938 - DNA, 201 bp, Homo sapiens
agagttagtaataatgagaccagtgataatggtaataattattgcttaatgtaggactacctatttcataagcatcatcacattcaatccacacaaatgayccttaagttggttattactatgcccattttaaaggtgaagaaactgaggctttgagaggttaagtagctagcaaagttcatatagcttgaagtatggaga

SEQ ID NO: 59939 - DNA, 201 bp, Homo sapiens
caccacaacgcccggctaattttttatatttttagtagagaagggtttcaccatgttggccaggctggtcttgaactcctgacctcaggtgattcacccgycttggcctcccaaagtactgggattacaggcgtgagccactgcgcctagcctctgtgtgttaagtgctggaactatagtttacagtagcattttatcctc

SEQ ID NO: 59940 - DNA, 201 bp, Homo sapiens
acatgcaatgcctgcctcctttttacaatgtcttttgcaatgtcttcttttctactctgaagtaaaatacacagataacaaatattctaattaaaatatamagtaggaataaaatgaaaagtaatttataataaaaacaagatgcaaaaacttaggcgctgtgccagtagatgcaatgaggtcatcagaagcgtgcacctt

SEQ ID NO: 59941 - DNA, 201 bp, Homo sapiens
tgctattgttctaatgtattgttcagtgtagagttagtaataatgagaccagtgataatggtaataattattgcttaatgtaggactacctatttcataakcatcatcacattcaatccacacaaatgacccttaagttggttattactatgcccattttaaaggtgaagaaactgaggctttgagaggttaagtagctag

SEQ ID NO: 59942 - DNA, 201 bp, Homo sapiens
ttttgtaaaagttcccctgggaattctgatggtctgccaactttgggagacactgataatattgtagataaagaagtgtaagcaactgttcagttagggakacaatagatacctgcatggaataacaaaaggtaattaacatgattatataatttgaatagtgttgtaatagttcataaaatggaaaagccaatttgagcc

SEQ ID NO: 59943 - DNA, 201 bp, Homo sapiens
gcctcagcctcccgaatagctaggattacaggcaactttttgtatttttaatagagactagggtttcaccactttggccaggctggtctcaaactcccgamctcaagtgattcactcacatcagcctctcaaagtgctgggattataggtgtgagccattgtgctcagccggatttttggttcttaaatgctctgagtctg

SEQ ID NO: 59944 - DNA, 201 bp, Homo sapiens
cattcattcttgtcttcttgctgattttagatgatgggaaatgccccttgaatcctcacaggtaaggtagaaatgttttatgattgagtaaattttgctaycttaactttataattcactgtaatatgtcagaatgattacatgcaatgcctgcctcctttttacaatgtcttttgcaatgtcttcttttctactctgaag

SEQ ID NO: 59945 - DNA, 201 bp, Homo sapiens
actgagcattactaaatcccagccacagaccttatttagggatgggtgagatttaaccctagcataactatgtgtgcacttccctcctctctccacttctwtattgaatataagcttcttgaaggcaggagctgtgccttcttcatctttataccccctgcagcagctagacagaataaaaatgggtgtgtgtgacaaata

SEQ ID NO: 59946 - DNA, 201 bp, Homo sapiens
ccaccaatgtgtgaaggtaggctgtgggtctgtcctttcttatggctttaaagatgacatcagagaatggagaatcatcagggatttatataaaagtgttyttgagctgaagcaaacaacactctccacaacaatggtaatctagataaaaaagttctccctctctttaaataatattttaatagctttagttaaatattc

SEQ ID NO: 59947 - DNA, 201 bp, Homo sapiens
taccgtgccaacctgccaaggtacaattttcatgtgggttaagaagtcactttgatgtggaaaataacaaaatcagtgtttcttccctgtgtctttctcayagtggtcttgctttccatccccgggtttccccctgcttaataagtgtttcacaatgaatcaggcagaatctccttgccttataaagtagtggaaattaaa

SEQ ID NO: 59948 - DNA, 201 bp, Homo sapiens
acagttcattgctccatactgtcctgcctctgggtgtttcacagcaaggaggttgccactcaccacggcttcctgtgaccttccagttcccttctgctttyagttctttatttactctgaactttctcctcttgttgctgggtgcacatcaagtgaaatacccaaatgtgggctgggcaggaaggtaccatgcagagtgca

SEQ ID NO: 59949 - DNA, 201 bp, Homo sapiens
attgaaggatagacgtatattttttatattccccaagctttttccccctcaatgtatccaattccttagttaacttttatagacaatgctgctttttaaaygcaagattttcatttataaaaatctgcagaaatataataaagaaatgaagaaatatcctcttaaatactcctatcctaaaatagacactgttaggcttct

SEQ ID NO: 59950 - DNA, 201 bp, Homo sapiens
acttgatatttaacaagccagtgtgctctgtcagtattgcaacatcttgtatgaacttgaacgggttctagtcatccatgtttgtgaattgaaggatagaygtatattttttatattccccaagctttttccccctcaatgtatccaattccttagttaacttttatagacaatgctgctttttaaacgcaagattttcat

SEQ ID NO: 59951 - DNA, 201 bp, Homo sapiens
ggcctcccacagtgctggtattacaggtgtgagccactgctcccggccttgtacttgatatttaacaagccagtgtgctctgtcagtattgcaacatcttktatgaacttgaacgggttctagtcatccatgtttgtgaattgaaggatagacgtatattttttatattccccaagctttttccccctcaatgtatccaat

SEQ ID NO: 59952 - DNA, 201 bp, Homo sapiens
cccttcttcacctgcagtaaaacagtcactagtttggttgctctccctaatacctctggtcactgggagctgtgatctcaccaaacccctgccaggaaaarccccagaaaaagcggagggagtgagagccagaggctgctgctgccgtttgcaagaactgcaggggaggaggacgctgccacccacagcctctagagctca

SEQ ID NO: 59953 - DNA, 201 bp, Homo sapiens
ttacaggcgtgagccactgcgcctagcctctgtgtgttaagtgctggaactatagtttacagtagcattttatcctcccaacataccctatcaggaaaaaytattattgtcatccttatttcacagatgtcaaaactgaacagagaggtacagtaacttgcccaagacaacacagctagtaagtgaaactgaaatctggac

SEQ ID NO: 59954 - DNA, 201 bp, Homo sapiens
ctggaattacaggcgcccgccaccatgcccagataatttttgtatttttagtagagacttggttttatcatgttggccaggctggtctcaaactcctgacytcaggtgatctacctgccttggtctcccaaagtgttgggattacaggtgtgagccaccatgcctagcctgcatttctttctaagagcccaagatgtagct

SEQ ID NO: 59955 - DNA, 201 bp, Homo sapiens
gaacctgggaggcagaagttgcagtgagctgagattgtgccattgcactctagcctagataacagagcaagactgtgtctcaaaaaacaaacaacaacaamaaaaaaaactcttttctcaatgatattgcattagtgtacataataaataattcgagtaattacaaaagcaagtacagcaaacaggtggtaggctttcatg

SEQ ID NO: 59956 - DNA, 201 bp, Homo sapiens
tctctggggaaccctgttgagatgaacagacttaagccaggaatattggtgcatcattttcattaaaaaaataaactttcattcacctgacaaggggaccyttgtcaggtgaatgaaatctggctatttggaggaacacagaaactttggttgaaggagagtttgcgaaaaacatacaagtccttggacaagtcatttcat

SEQ ID NO: 59957 - DNA, 201 bp, Homo sapiens
ggtggcacatgcctgtgatcccagctacttgggaggctgaggcaggagaatcgcttgaacccaggaggcagaggttcacccaggagggtgagccgagatcrcaacactgcactccagcctggccaacagggcgagactccatctcaaaaaaaaaaaaaacaaaaaaactatctacattaactgtatgtttatttgtgttta

SEQ ID NO: 59958 - DNA, 201 bp, Homo sapiens
ttctttaactgcaatgagaatttaaagacatttgcaaagccatcccagtgtagaatccttcttgatctttatgattttttttcctcctaagattttctgtygtctgttccaaatttaatcttgcttttagaggggtttttttgtttttcgtttttttggttttttggttttttttgcacctcacctttccagagtatttat

SEQ ID NO: 59959 - DNA, 201 bp, Homo sapiens
actttccccctggggtcctcatctatgaaatgatgatgatgattatagtagtcaattcctgggactgctataatgactgcattgggtaatctatgtggaargatttatttagccaaatggggattccatatttattggctgggtgtgcttactaagcacctcctatttgccaggctttggggtcctcatggggagaaatac

SEQ ID NO: 59960 - DNA, 201 bp, Homo sapiens
tttatgattttttttcctcctaagattttctgttgtctgttccaaatttaatcttgcttttagaggggtttttttgtttttcgtttttttggttttttggktttttttgcacctcacctttccagagtatttatcttaggttttcatagaaagaacccttatagctggggccgggcatggtggctcatgcctgtaatccca

SEQ ID NO: 59961 - DNA, 201 bp, Homo sapiens
caagagtgagaaggccgggatgagactcccactgaaggctggggtgctgctcctttcaaagcctaaataacagaggccacgccccatatcttgtgggaccrcagcttgtccaatcttttattggtgttatctaagaatcccaaggaatgctggcatagtccataaaatgtaccctaatgaacagcagctaacaattacagg

SEQ ID NO: 59962 - DNA, 201 bp, Homo sapiens
tgaatgaggccgggcaaggtggctcatgcctgtaatcctcgcactttgggaagccaaggtgggcggatcacctgaggtcacgagttcaagaccagcctggycaacatggcaaaacctcatctctactaaaaatacaaaaattagctgggcatggtggcacatgcctgtagttccagctacatgggaggctgaggcaggaga

SEQ ID NO: 59963 - DNA, 201 bp, Homo sapiens
cgcaggcactgggaagccagacacaccgaatcaggctggatgtgctgggacacagcagggcgccgggaaggggtggagagggctccctttgtggactggcmtgaccagggaccagggcctggctttcccaggcacccggccatccccaagttcagtggcagactgtgcttctctccccaggtggctgttgaacctcttcca

SEQ ID NO: 59964 - DNA, 201 bp, Homo sapiens
tggccctggaccaggccatgggggctggtttagacgtacttgggcccaaagcccagggaggacaaatcatttgcccaggtcatggagctgttgtggggcaygctggggacaaagctccaagtccgttcggttgggcagaaaatggtcaactgcttgaccaagggttaaacagcaggggctaaacagagactccagcccctc

SEQ ID NO: 59965 - DNA, 201 bp, Homo sapiens
tgtggactggcctgaccagggaccagggcctggctttcccaggcacccggccatccccaagttcagtggcagactgtgcttctctccccaggtggctgttkaacctcttccacaaccagattgagtccaagttccagaaagtactggagagcagggtaagaaggtccaagcctctggcctcccccgagcttggcgagggct

SEQ ID NO: 59966 - DNA, 201 bp, Homo sapiens
ctatctgactccaaaacattttcatcatcccaagagaaaattccttacccattaaacaatcattccccatttcccttcccccagctccagacaaccaccaytggggttggagactcctggaatagaccacattttgccccattgttctcaaaggctgcataacattgggtgcccacagcttattcaacctgtcgctgctag

SEQ ID NO: 59967 - DNA, 201 bp, Homo sapiens
attacatgtgtggctctcattctattgctttagaaagacggctggtttatatgttacctacatatgcacatttgttctagttccatgaaaggaactggccwcactctcttaccctggcttttgtcactgaagtatcttaaatatctctttctatgggcatatgactatctacctcattttttttcacttttttgaatgtgc

SEQ ID NO: 59968 - DNA, 201 bp, Homo sapiens
atgatgcttcagtgagctgccccacaccacgcgtatatcttggcaggaagagctacgggataaaggcttagaagttaaattactgggccaaagagtatgtrtgttagaacgaggagagatctcactgatttgtgtttcagaaagcttgtgccaatgtgcactctcccagccacagtgtctgggacttctgtttactcgtac

SEQ ID NO: 59969 - DNA, 201 bp, Homo sapiens
agactccattgctacaaaaaagaaaaaacaaatagccaggcctggtggcatgcacctgtagtcctatctactcagggggttgatgtgggaggatcgcttgrgcccaggagattgaggctgcagtgagccatgattgcaccactgcactccagctgggcgacagacagagactccatctctaaaacaataataataatttat

SEQ ID NO: 59970 - DNA, 201 bp, Homo sapiens
gaaagaaatgttctgtggaatatcatattaaaagagtaatacgagaaaattaaatattttttttaaaaaagaaatggtgggatccagctgtgtcatatttygaaaacactggcatctgacctcagcatgcccaattagcagaatgtgatgaggggatggagaaaccttgggagaggtagggagggagaaaaaatgggccca

SEQ ID NO: 59971 - DNA, 201 bp, Homo sapiens
ctccagcctcagccgcctgagtagctggaattacaggcgcccgccaccatgcccagataatttttgtatttttagtagagacttggttttatcatgttggscaggctggtctcaaactcctgacctcaggtgatctacctgccttggtctcccaaagtgttgggattacaggtgtgagccaccatgcctagcctgcatttc

SEQ ID NO: 59972 - DNA, 201 bp, Homo sapiens; identical to SEQ ID NO: 11577

SEQ ID NO: 59973 - DNA, 201 bp, Homo sapiens
gtttgagaccagcctggccaacatggtgaaaccccatctctattaaaaatacaaaaattagctggacatggtggcaggtgcctgtaatcccagctactcasgaggctgaggcaggagaattgcttgaatccaggaggtgaaggttgcagtgagccgagatcacgccactgcactccagcctgggcaacagagcaacactcc

SEQ ID NO: 59974 - DNA, 201 bp, Homo sapiens
gaaagtctggccaggggcaggacgggtgctcctgggccttgccatatgccacaaagccatccacatgtccttcagaagtggcacctctgctggtgcaggtrgcatttgacacagccctatgccaccaccacatcccatccctaccatgaggggcctgagggaagctcaagaccagctcgttttgaaaatactgcgggccgg

SEQ ID NO: 59975 - DNA, 201 bp, Homo sapiens
tgttgaacctcttccacaaccagattgagtccaagttccagaaagtactggagagcagggtaagaaggtccaagcctctggcctcccccgagcttggcgarggctgaatggaagacctcactgaccaatggccctggaccaggccatgggggctggtttagacgtacttgggcccaaagcccagggaggacaaatcatttg

SEQ ID NO: 59976 - DNA, 201 bp, Homo sapiens
tgacatgggatcgttgaagttggcctcatctccctccagggctctaatgagggttgggggctgggacagctctttggagcacgggaaacctccttataagygggacagagggacacatggaagtgccccacatcctgaagaggcaggtcaaagactgaggaccaagttaatatagaaggcacaaggcagccgcctctgaac

SEQ ID NO: 59977 - DNA, 201 bp, Homo sapiens
aactgggttggcggactcattagcaggagggggatgctgcgctgtgcctggtacattgttaacaacagaaaataatagccattaaagggaatgaagggcargggggatgattagggacctagaaacactggccaactgttctatctaaaaaacaaatgtcgaaagcccttttgggctctgagatactcagcacttaactgc

SEQ ID NO: 59978 - DNA, 201 bp, Homo sapiens
ctgtatgaccgtgggcaagtcacttctctctgagcttagtgacctgcctgtgacatgggatcgttgaagttggcctcatctccctccagggctctaatgarggttgggggctgggacagctctttggagcacgggaaacctccttataagcgggacagagggacacatggaagtgccccacatcctgaagaggcaggtcaa

SEQ ID NO: 59979 - DNA, 201 bp, Homo sapiens
gatgttcgtttaggcctcacagtgactcgaaggtggggactattgttatccccattttatggataaggaagttgaggttcagggagatggaagggctggcytgagatcacaaagtcaggacacaaaccgaagtctgtgtgaccgcaaacctcaccctcgcagaccctctgagtgggagccacacatcagctgccccccggg

SEQ ID NO: 59980 - DNA, 201 bp, Homo sapiens
ggtgcccacagcttattcaacctgtcgctgctagcggacatgtaggctgcttcctttttttttttttttttttttttttgctactgcctatgatgcttcartgagctgccccacaccacgcgtatatcttggcaggaagagctacgggataaaggcttagaagttaaattactgggccaaagagtatgtatgttagaacga

SEQ ID NO: 59981 - DNA, 201 bp, Homo sapiens
tagaccacattttgccccattgttctcaaaggctgcataacattgggtgcccacagcttattcaacctgtcgctgctagcggacatgtaggctgcttcctytttttttttttttttttttttttgctactgcctatgatgcttcagtgagctgccccacaccacgcgtatatcttggcaggaagagctacgggataaaggc

SEQ ID NO: 59982 - DNA, 201 bp, Homo sapiens
ttgtataaccaattccccgtattaaattccctctgcgttaaacattgagagtcagttttccttttttgatggactctgtctaatagggaagggatgttggrtcctttgggggccttgctccctggatggagaactctgctctcttgtttcttgacttttgaaatcaacaagtcaaatctctaccagggtaattcttcctag

SEQ ID NO: 59983 - DNA, 201 bp, Homo sapiens
tccaatcttttattggtgttatctaagaatcccaaggaatgctggcatagtccataaaatgtaccctaatgaacagcagctaacaattacagggggcttcytaggtgccaggcatgttcttggttctttaaaaaattattttttggccaggcatggtggctcatgcctgtaatcccagcattgtgggtggccaaggtgggt

SEQ ID NO: 59984 - DNA, 201 bp, Homo sapiens
tatattttcagagaaaaggaaataaagaccaagtgaaaataaagcacaattataaagacactgagcccttaaattaatttctttaacatctcaaacctgtyggggagcttccttgtagctaaagtgaaaaagatacatgatttcatgattcatggtgaaaaggagagacagtcttcctcacacccccaaaacaactgtttc

SEQ ID NO: 59985 - DNA, 201 bp, Homo sapiens
tttgccatgtcccgctagtggccatgagcagccctgtccctgggtctatctcttcaggcttatgatcctatttaatcctcatgacaaccgctaaaggtagmcaaggttgcccttgtttttcagatgaggagtctctagaaaagtcgtgtggcctgctaagctaactgttcagagcctgggctctggagtcacctggcggtg

SEQ ID NO: 59986 - DNA, 201 bp, Homo sapiens
gtgttcctagcttatcagaaaggccacgtgatggacagatggagtccaagcccggaggtggcctggggattgagtcctggctcttggatgagtgtctttcygtctctgagtctctacttcctcatctcccaaaggggacgggcctgcttccttgatggagtcatgggagggctaagtgcggtaatatcatgtctccttggt

SEQ ID NO: 59987 - DNA, 201 bp, Homo sapiens
tattaaataaatatgagggaggagtaccctctgcaaggagagaaggtggggaggggcacaggaagactaagcactgtcttcatcattttgccatgtcccgmtagtggccatgagcagccctgtccctgggtctatctcttcaggcttatgatcctatttaatcctcatgacaaccgctaaaggtagccaaggttgcccttg

SEQ ID NO: 59988 - DNA, 201 bp, Homo sapiens
gtttgcagagaacattttcggtaaaaatctgtctctaattattatttattcaccaatctctttcaatgttgtgcttcaacctctagataagttggccgaargcttcccccttcctctgctgaagcgtgttcagctctacgaccttgggctgcagatccataaggtcggtgggttcaggggggctctgaggatgtgtgaggg

SEQ ID NO: 59989 - DNA, 201 bp, Homo sapiens
gcttcctagaatgtggagcagcttgtaccaaagcccttctagggctaggtgtcttgggaaagatggagatctcacctgacccctgatccttagagatcttygaattatcttccagaaaaactaagagcctgacgcaggcctttctaattccccactcagggtgggatgtggtacctggaccagcaaggctaaggagaagaa

SEQ ID NO: 59990 - DNA, 201 bp, Homo sapiens
tgccaccacgcccagctaattttttgcatttttagtaaaggcagggtttcaccatgttagccaggttggtcttgatctcctgacctcatgatctgcctgcytcagcctcccaaagtgctgggattacaggcgtgagccaccgcgcctggcctgactcccagtcttttctccagttaatctttcctgggtttttgatgagat

SEQ ID NO: 59991 - DNA, 201 bp, Homo sapiens
cccaaatctgctgaatgtgatcatgcgattgggtgccgcaggcactgggaagccagacacaccgaatcaggctggatgtgctgggacacagcagggcgccrggaaggggtggagagggctccctttgtggactggcctgaccagggaccagggcctggctttcccaggcacccggccatccccaagttcagtggcagactg

SEQ ID NO: 59992 - DNA, 201 bp, Homo sapiens
attgcatcccttcctcaaggttctatttccccctttgtggaaagggagcaagaacactgctgaccccttcagtgtggcccatatggcatgaagaaagtaaygtgcttagcatggtcataagatcgatgcctggggcacagcaggtgcttacctggagcagatcctgctggtctagtccccactgtggagaggggaggcgca

SEQ ID NO: 59993 - DNA, 201 bp, Homo sapiens
cctggggttgctgatgcaaggatgagaggagacgtgcagcttaaccagcacagcgcctgcacatagtaggtgctcaataaatatcagtttctttccaattyctgctgggtgctgcaaggatctcaggaaatggaagactcagccgtgcctgcaaggagccatcagactggtggtgtggggactgaggggagggacggatga

SEQ ID NO: 59994 - DNA, 201 bp, Homo sapiens
gctgcagcagtgacatcgctgacgtggaggtggacatgtcgggagacttggggtaggtctccatcggggcactgccagctggactcctggttgcagctccyggccaatccagcgctcagcctggcctccgataattgcaatgatccaggtggcttgcacaggcacttgaagatcattctctggggaaccctgttgagatga

SEQ ID NO: 59995 - DNA, 201 bp, Homo sapiens
gagcctgggctctggagtcacctggcggtggtttcaaacataaatccggccccctcaagagctgtgtgactttgcaaatgttccttaacctctctggcccyctatttcctcctttgaaaaggagagttaaaatcttgccctctcggcatgaggttattgggaagaatcagaggtatgattgatagggtcatggcacagtgg

SEQ ID NO: 59996 - DNA, 201 bp, Homo sapiens
ttcctttggcaattatctactatttgctgctcagtattctagacactatggattccaaattctgggtttttcaaaatcttttcagtaacacttttgtagtsagaatattatcggtggcgagtccgcaacactcccagcccttgtcttctcagaggaaagaattcaattgagagacgcaggcaagttttaaagcagaggcaa

SEQ ID NO: 59997 - DNA, 201 bp, Homo sapiens
ctaggatgttcgtttaggcctcacagtgactcgaaggtggggactattgttatccccattttatggataaggaagttgaggttcagggagatggaagggcyggcctgagatcacaaagtcaggacacaaaccgaagtctgtgtgaccgcaaacctcaccctcgcagaccctctgagtgggagccacacatcagctgccccc

SEQ ID NO: 59998 - DNA, 201 bp, Homo sapiens
ctatgttggcacacacagaaccaccatgtggccctgtggcgatgtaaatatatctctcctgttctcttccaggcagagctgttggaagcgctcctcaactrttacatccttaacaccttctaccccaagttcaatggtaagaatcactgtggatttttccaagtcaaaagtgaacactgctgtctggaggaaagagagttg

SEQ ID NO: 59999 - DNA, 201 bp, Homo sapiens
gtagcatgatgtaatactagtttgcttttcccaagcgttttgctatgttggcacacacagaaccaccatgtggccctgtggcgatgtaaatatatctctcytgttctcttccaggcagagctgttggaagcgctcctcaactattacatccttaacaccttctaccccaagttcaatggtaagaatcactgtggatttttc

SEQ ID NO: 60000 - DNA, 201 bp, Homo sapiens
agttcaggaaaaacattctcactgtaaataaaaccgatactaaagataaggctaaggacatgtcaaatgttgatgttcttcctttagaggaaagactgtcrggtgtgtaactttccaaaatttttctattcacttgcataccaaatgttcatctcaaaagagttttatcttataaaatagtagcatgatgtaatactagtt

SEQ ID NO: 60001 - DNA, 201 bp, Homo sapiens
acaggcacacattcagatctgcaggtgatgtggcttggggagaggctgccataaatattaaactcccaactccaaagtaccctgcagagattcagaactgmaggaattcataacatcattctctttcaagagtcagtgttctcaggagtgtgggcaccgtcatagaaaactatcgaaaaggagagtgaagcattagagaac

SEQ ID NO: 60002 - DNA, 201 bp, Homo sapiens
cccgatatatggaatagggacattaatatgaactttgaggggttgttgtgaagattgaatcagacatgcacgtaaagctctgagctctctgcttggcatayagtgggggttagaagttgtgtttcatgattttggtagagaagcttattttgtttttattaaattttttaaattatgtaggtagttcaggaaaaacattct

SEQ ID NO: 60003 - DNA, 201 bp, Homo sapiens
cagtttcccgatatatggaatagggacattaatatgaactttgaggggttgttgtgaagattgaatcagacatgcacgtaaagctctgagctctctgcttrgcatatagtgggggttagaagttgtgtttcatgattttggtagagaagcttattttgtttttattaaattttttaaattatgtaggtagttcaggaaaaa

SEQ ID NO: 60004 - DNA, 201 bp, Homo sapiens
ttcttattcagagaaggaaattccagacagagtcccttctggtgcttcaggaaagaggatcagagagctaaggaggtgagggaagatcagagggagaccttgagtctgcttttttagttcagcatatcaatgtgccatatattggcgtattgttttctgagccccaacagtgttatatctcgatggggtagtacaggacaa

SEQ ID NO: 60005 - DNA, 201 bp, Homo sapiens
tagattcgaatcctgatgctgctgcccagtttgtagtaagtccctttcattctgtaggcctcagtttcccgatatatggaatagggacattaatatgaacyttgaggggttgttgtgaagattgaatcagacatgcacgtaaagctctgagctctctgcttggcatatagtgggggttagaagttgtgtttcatgattttg

SEQ ID NO: 60006 - DNA, 201 bp, Homo sapiens
ttccatgatgctggcctccactgaccacctccacctgtgccctgcctcccagactttcccgaagcacttatgaagtggaaacaaacacagaggcggtgggragagatgcagggaccctgaagctaactcctttcagagaataaagggtggagtgaataatggtgcactcatattgtatctgtgcgtgtttactgcaaagta

SEQ ID NO: 60007 - DNA, 201 bp, Homo sapiens
gctgggtagactttaatgtgtagtcgttggcttctcttttaccattccatgatgctggcctccactgaccacctccacctgtgccctgcctcccagacttwcccgaagcacttatgaagtggaaacaaacacagaggcggtggggagagatgcagggaccctgaagctaactcctttcagagaataaagggtggagtgaat

SEQ ID NO: 60008 - DNA, 201 bp, Homo sapiens
ggggaaaatagactccgttatcaaaacaagagggattgagtgctgagcaggtaaatccaagaagtgatttccacaaggtagaaaaagtggtgaagtagacrgccccaaataaaaggaggaaagagaacgtgaaaatcagtgtgggccaaagttatggagaagagctttctggaaagagggaaggaggagctgggtagactt

SEQ ID NO: 60009 - DNA, 201 bp, Homo sapiens
acagaattctcttaactgcaagagacagaaagccaattgaaatcatcttaagcaaagaggagaaatatataggattatataattgaaaagcaaaaataaaygaaaaaactaagaccagaggtttcaggcatagctggatccaggtgttctaattagtgcatcaagaatctctctccatctctctgttctgttttcatttgt

SEQ ID NO: 60010 - DNA, 201 bp, Homo sapiens
tgagtacaagtatgacggtgttgcaaaagtaattgtggtttttgctgttactttctttttttttttttttgaggtagagtctagctctgtcgctcaggctrgagtgcagtggtgcaatctcagctcactgcaagctccgcctcccgggttcacgccattctcctgactcagcctcctgagtagctgggactacaggtgcct

SEQ ID NO: 60011 - DNA, 201 bp, Homo sapiens
aagtttgagaccagcctggccaacatggtgaaaccccatctctactaaaaatacaaaaattagctgggcatggtggtgcgcacctgtaatcccagctactyaggaggctgaggcaggagaatggcttgaacacgggaggcagaggttgcagtgagctgagatcatgccactgcactccagcctgggcgacagagcaagact

SEQ ID NO: 60012 - DNA, 201 bp, Homo sapiens
gtagctgggactacaggtgcctgccaccacgcccagctaattttttgcatttttagtaaaggcagggtttcaccatgttagccaggttggtcttgatctcytgacctcatgatctgcctgcctcagcctcccaaagtgctgggattacaggcgtgagccaccgcgcctggcctgactcccagtcttttctccagttaatct

SEQ ID NO: 60013 - DNA, 201 bp, Homo sapiens
ccctatgccaccaccacatcccatccctaccatgaggggcctgagggaagctcaagaccagctcgttttgaaaatactgcgggccgggtgcagtggctcaygcctgtaatcccagcactttgggaggctggggcgggcagatcacgaggtcaggagtttgagaccagcctggccaacatggtgaaaccccatctctattaa

SEQ ID NO: 60014 - DNA, 201 bp, Homo sapiens
cctccctgggtttaaatcccctttctgacacttcctgtgtgacctagaacaagttacttggccactctgtgcctcagtttccttatctgtaaaatggaaakaataatcacacctacctcatagtcttggaaatcactaaatgggaatatactgaatatagagtttgcagagaacattttcggtaaaaatctgtctctaatt

SEQ ID NO: 60015 - DNA, 201 bp, Homo sapiens
actcccactgaaggctggggtgctgctcctttcaaagcctaaataacagaggccacgccccatatcttgtgggaccacagcttgtccaatcttttattggygttatctaagaatcccaaggaatgctggcatagtccataaaatgtaccctaatgaacagcagctaacaattacagggggcttcctaggtgccaggcatgt

SEQ ID NO: 60016 - DNA, 201 bp, Homo sapiens
ttttaaaaactttttattgaagtatatttataaagaaaagtgctcaaatcataagtgtgctgttaaagagtttttacatgcatgtaaccagctcccaaccragaaacagaacacggctggtttttcagagcccctggtgtccccctcggtcactgcccagccctccagggtcaccaccatcccaacttctaccagcaaaga

SEQ ID NO: 60017 - DNA, 201 bp, Homo sapiens
atgtacaaatataaatacatgtaagcatataaatagacattcatgtatgtattattttgttcatgaatctatgtgtatatgtattattttaaatatatatrttcatatacatatagtataggcattgttccagatttcttttttttgagatggggtctcactctgtgtcccaggctggagtgcagtggtgtgatctcggct

SEQ ID NO: 60018 - DNA, 201 bp, Homo sapiens
ttgttgcatgcacctgtagtgtagctggtttattctccttgctgcatagtatatcaccatgtagatgtttccccatttatttgttcattctactgttgaargccatctggggggtgttcagttttaggccattatccgtagtgctgctataaatgtcctagtacctatggtcgcatgtctttgggtatatatctgggagtg

SEQ ID NO: 60019 - DNA, 201 bp, Homo sapiens
aaactacagggctcctttgatgtcagtgtcaagggcatcagcatttcggtcaacctcctgttgggcagcgagtcctccgggaggcccacagttactgcctscagctgcagcagtgacatcgctgacgtggaggtggacatgtcgggagacttggggtaggtctccatcggggcactgccagctggactcctggttgcagct

SEQ ID NO: 60020 - DNA, 201 bp, Homo sapiens
taaaatcaatcgaaagcaacttccagctttatctgactccctcaggcctctcctggcagacttgtatattttcttctcttgatgtaatctcctaattctgytcccagttagccaggctctaccccaacatgaacctggaactccagggatcagtgccctctgctccgctcctgaacttcagccctgggaatctgtctgtgg

SEQ ID NO: 60021 - DNA, 201 bp, Homo sapiens
ataaaacaatatataattaagtcatctactgaacagaattctcttaactgcaagagacagaaagccaattgaaatcatcttaagcaaagaggagaaatatrtaggattatataattgaaaagcaaaaataaacgaaaaaactaagaccagaggtttcaggcatagctggatccaggtgttctaattagtgcatcaagaatc

SEQ ID NO: 60022 - DNA, 201 bp, Homo sapiens
cacggtggctcatgcctgtaatcccagcactttgggaggctgaggcaggtggatcatttgaggtcaggagttcaagaccagcttggtcaacatggtgaaaycccatctctactaaaaatacaaaaattagctgggcgtagtggcgcatgcctgtaatctcagctacttaggaggatgagacaggagaaccgctgtagcctg

SEQ ID NO: 60023 - DNA, 201 bp, Homo sapiens
gtaacccaggctgtggagaagcgacagtcttgcacatccccctgtctccccaatcttctttagaccttcagctccagcgggagcaccctaaaacttcttcrtgtctctttgctgcagataccgcctgactctaatatccgactgaccaccaagtccttccgacccttcgtcccacgggtaaggagtcccttagttccccat

SEQ ID NO: 60024 - DNA, 201 bp, Homo sapiens
tccaagttcaaatattgtttgagcacctacagtgagccttctgggagtctatgatctagtgggcaaatttcctgctttagctcattgagctgtttgttgaraggagacagttggtccctcgtcatcatccttcctatacatacaaccttcatcacttacacctgcttccttcttctggcatttccaggccactaatgtgtc

SEQ ID NO: 60025 - DNA, 201 bp, Homo sapiens
gtactctataccttctcttagtagtctgttcaaagtttaactgctaacataaacaacaatttcaagtaaaaatgttcaagtccaagttcaaatattgtttsagcacctacagtgagccttctgggagtctatgatctagtgggcaaatttcctgctttagctcattgagctgtttgttgagaggagacagttggtccctcg

SEQ ID NO: 60026 - DNA, 201 bp, Homo sapiens
tccccactcaccacctgggtaattcctccaggtctcaacttaaatattacttcccgagagagggctttcttgctggcccttacccccaatctaccttacgmcccttgccactttttcttgtaacaccccattatctttcttctcagcgtttactacaaagatactttgtagctgtctgcaggtgtatttgtttaatgcatg

SEQ ID NO: 60027 - DNA, 201 bp, Homo sapiens
cccattgggggaaacatttattttttaaataaacgagccaatatattttaaaaaagagagtttggttggtgccagatgtagcttcactctcaaccctgccstctgctgggggtgagatctcaagggagctatgtggcttttttgaacctcagtttcctcatctgctaaaccaggccttcctagccgagctcttaagagact

SEQ ID NO: 60028 - DNA, 201 bp, Homo sapiens
acaaaacaaaaaaagaaagcattgctgtccttcaacccagcaactccacctctaggaatgttttcctgaaaagaatagccaagggtgctcacaggaggtgktcattataatggcaaaaccctggagacaacttgatgcccaatagagtttaatccatcgcaggacccatacataacgaaatacaacacagccgtgaaatag

SEQ ID NO: 60029 - DNA, 201 bp, Homo sapiens
tccgctcctgaacttcagccctgggaatctgtctgtggacccctatatggagatagatgcctttgtgctcctgcccagctccagcaaggagcctgtcttcyggctcagtgtggtaaggttcagagcctttgcaaatgctgtttccttttccccacatgcttttcccttttccccacatgcttttctccccactcaccacct

SEQ ID NO: 60030 - DNA, 201 bp, Homo sapiens
attgccttccagaaaatttcaccaccagcaaggtttgagaaacactgttttcccattgggggaaacatttattttttaaataaacgagccaatatattttwaaaaagagagtttggttggtgccagatgtagcttcactctcaaccctgccgtctgctgggggtgagatctcaagggagctatgtggcttttttgaacctc

SEQ ID NO: 60031 - DNA, 201 bp, Homo sapiens
gggcatggtggcacatgcctgtagttccagctacatgggaggctgaggcaggagaattgcttgagcccaggaggcagaggttgcagtgagctgtgatctcrctacttcactgcagcctgggcaacagagtgagactgcatctcaaaaaaaaaaaaaaaaatatatatatatatatatatatatatttatatgtgaatgagg

SEQ ID NO: 60032 - DNA, 201 bp, Homo sapiens
ctgatgatttctggaggtttattaaaaaatattttagtgaatgaggccgggcaaggtggctcatgcctgtaatcctcgcactttgggaagccaaggtgggyggatcacctgaggtcacgagttcaagaccagcctggtcaacatggcaaaacctcatctctactaaaaatacaaaaattagctgggcatggtggcacatgc

SEQ ID NO: 60033 - DNA, 201 bp, Homo sapiens
ctcaggcctctcctggcagacttgtatattttcttctcttgatgtaatctcctaattctgctcccagttagccaggctctaccccaacatgaacctggaaytccagggatcagtgccctctgctccgctcctgaacttcagccctgggaatctgtctgtggacccctatatggagatagatgcctttgtgctcctgcccag

SEQ ID NO: 60034 - DNA, 201 bp, Homo sapiens
tgactccctcaggcctctcctggcagacttgtatattttcttctcttgatgtaatctcctaattctgctcccagttagccaggctctaccccaacatgaamctggaactccagggatcagtgccctctgctccgctcctgaacttcagccctgggaatctgtctgtggacccctatatggagatagatgcctttgtgctcc

SEQ ID NO: 60035 - DNA, 201 bp, Homo sapiens
ctgtagtcccagctacttgggaggccaaggtgggaggatcgcttgagcccaggaggtcaaggcagcggtgggctgaaattgtgccactgcactccagcctrggccacagagtgagatcctatctcaaaaagaaatgaaataaaataaaacatgaggtccatgcatattgttgcatgcacctgtagtgtagctggtttattc

SEQ ID NO: 60036 - DNA, 201 bp, Homo sapiens
ggagaatcgcttgaaccccagaggcagaggttgcagtgagctgagatggcaccattgcactccagcctgggtgacaagagcaaaactccatctcaaaaaayaaaacaaaaaaagaaagcattgctgtccttcaacccagcaactccacctctaggaatgttttcctgaaaagaatagccaagggtgctcacaggaggtggt

SEQ ID NO: 60037 - DNA, 201 bp, Homo sapiens
caggatggtcttgatctcctgacctcgtgatccgcccgctcggcctcccaaagtgctgggattgcaggcgtgagagctcacgcctgtaatcccaacatttwgggaggccgaggcgggtggattacctgaggtcaggagttcgagaccagcccagtcaacatggtgaaaccccgtctctactaaaaatacaaaaattagcca

SEQ ID NO: 60038 - DNA, 201 bp, Homo sapiens
tcagctccagcgggagcaccctaaaacttcttcatgtctctttgctgcagataccgcctgactctaatatccgactgaccaccaagtccttccgacccttygtcccacgggtaaggagtcccttagttccccatgagtgcagaccgagcctactagactccagaggtttctctttaaaacctctgcatctctcagcttgac

SEQ ID NO: 60039 - DNA, 201 bp, Homo sapiens
agaaggctttctttgttcaactttaaaatatgaggtcagggctgggcgcggtggctcacgcctttattttttgttttctttttttttttttttttttttgkgagacggagtctcgctctgttgcccaggctggagtgcagtggcgcaatctcggctcactgcaagcttcgcctcgcgatttcacgccattctcctgtctca

SEQ ID NO: 60040 - DNA, 201 bp, Homo sapiens
cctactgcggcacgggcctctctttcaatgggatgataatagctacgttttatggagcactcaccatgtgctgggccttgtgctaggatgttcgtttaggmctcacagtgactcgaaggtggggactattgttatccccattttatggataaggaagttgaggttcagggagatggaagggctggcctgagatcacaaagt

SEQ ID NO: 60041 - DNA, 201 bp, Homo sapiens
tactgcatttcctgttcatatctttttttttcttttgagttgttctttctttccttgttaatttatattggcttgttctttgtatattagggaaataagcycatatattaaggaaattggctctttagatgtctcatactgcaattttttttttactttacatatggcattttttttgtccactgaagttttaattttcta

SEQ ID NO: 60042 - DNA, 201 bp, Homo sapiens
gaccctatctcaaaataattaattcattagttaattaaataaaataaattagccaccacacctggctaatttttaaaattatttattataaataaataaawctcattaatattttttatattgattacatgttgaaatcatactatgtattactaaaattaatttcagctctttctttttatctttttaatgtatcttctg

SEQ ID NO: 60043 - DNA, 201 bp, Homo sapiens
ttatcctcacagcccccttcttgctttgcagtttcaatggcatgccaatgaggaaagtttagtttagtttagtttagtttagtttagtttagtttagtttwgttttgttttgttttgttttgtttgagacagagtctgactctgtcgcccaggctagagtgcggtagtgcgatctcggctcactgcaatctctgcctcccg

SEQ ID NO: 60044 - DNA, 201 bp, Homo sapiens
gctaaacagagactccagcccctccctctgctccaccttgctcagtgccccacactgccctgcattccaccaaggtccgaaaggaaaccattcctcaggcrcctgcaagagaccaggcaggaaagctcagcgagggcgtgggccaggtgggaactgggcgagctcatgagcaccagccctggatggggaggcagcaacact

SEQ ID NO: 60045 - DNA, 201 bp, Homo sapiens
cccgggaccatacccccaagaaaataaaaattttagaggctgggcatggtggcccaagtctataatcccagtattttggaaggccaagcgggaggcttacwtgagctcaggagttcgacaccagcctgggcaacatagcaagacctcgtccctactaaaatacaaaaaattagctggacatggtggctcacacctgtagtc

SEQ ID NO: 60046 - DNA, 201 bp, Homo sapiens
ctccaagcacaatccgtggtcagcagcatcaccctcaccagggagcttgttaaaatgcagaggctcagccccaagaggaacatgatggatcaagatttgcmtctaaacaagatccctgggggacttgactgcacgtctttgtttctgaaaagctgtcctagtccccagccctcatctgcatttgggggaaacatgaggaac

SEQ ID NO: 60047 - DNA, 201 bp, Homo sapiens
actattttaatatcaagtgaaatagtgaaaaactattttcattattcaaactattattctgaccaagcattttgtggtctatctgtgcttccaattttcargttatcttttgaggtgagatgaactgggttggcggactcattagcaggagggggatgctgcgctgtgcctggtacattgttaacaacagaaaataatagc

SEQ ID NO: 60048 - DNA, 201 bp, Homo sapiens
tatggagaagagctttctggaaagagggaaggaggagctgggtagactttaatgtgtagtcgttggcttctcttttaccattccatgatgctggcctccaytgaccacctccacctgtgccctgcctcccagactttcccgaagcacttatgaagtggaaacaaacacagaggcggtggggagagatgcagggaccctgaa

SEQ ID NO: 60049 - DNA, 201 bp, Homo sapiens
ggtgaatgcaggacaggcatctcctccctgccagggtaacccaggctgtggagaagcgacagtcttgcacatccccctgtctccccaatcttctttagacyttcagctccagcgggagcaccctaaaacttcttcatgtctctttgctgcagataccgcctgactctaatatccgactgaccaccaagtccttccgaccct

SEQ ID NO: 60050 - DNA, 201 bp, Homo sapiens
cacttgaagatcattctctggggaaccctgttgagatgaacagacttaagccaggaatattggtgcatcattttcattaaaaaaataaactttcattcacytgacaaggggacccttgtcaggtgaatgaaatctggctatttggaggaacacagaaactttggttgaaggagagtttgcgaaaaacatacaagtccttgg

SEQ ID NO: 60051 - DNA, 201 bp, Homo sapiens
ctgcttggcatatagtgggggttagaagttgtgtttcatgattttggtagagaagcttattttgtttttattaaattttttaaattatgtaggtagttcargaaaaacattctcactgtaaataaaaccgatactaaagataaggctaaggacatgtcaaatgttgatgttcttcctttagaggaaagactgtcgggtgtg

SEQ ID NO: 60052 - DNA, 201 bp, Homo sapiens
attatttagcaatacctttaaaatttgtgcccgttaggtactttatgtatattattcctcaattttaaagaatgggcaggccaggcacagtggctcacgcytgtaatcccagcactttgggaggccgaggtgggtggatagcttcaggccaggagttcgaggcaagcctggccaacatggtgaagcctcgcctctcctaaa

SEQ ID NO: 60053 - DNA, 201 bp, Homo sapiens
gcctcagcctcccaaagtgctgagattacaggcaggagccaccatgcccagctgcatttcttctttctttttatttattttttttgagatggagtttctcycttgttgcccaagctggagtgcaatggcatgatctcggctcactgcaacctcggcctcccaggttgaagtgattctccagcctcagccgcctgagtagct

SEQ ID NO: 60054 - DNA, 201 bp, Homo sapiens
ttgtctccataactaagcacagttcatcatctctaacagaatcctttcatctcctgacaatcctactttccacatccccagcctggggcctaggcgtaggyaagagaattaaattactggaggaaaaggcaggcaggctatagccagttgaggtctccttccatcaccaaaaccatagttctgtctgaatggcctgagcag

SEQ ID NO: 60055 - DNA, 201 bp, Homo sapiens
gctgttgaacctcttccacaaccagattgagtccaagttccagaaagtactggagagcagggtaagaaggtccaagcctctggcctcccccgagcttggcragggctgaatggaagacctcactgaccaatggccctggaccaggccatgggggctggtttagacgtacttgggcccaaagcccagggaggacaaatcatt

SEQ ID NO: 60056 - DNA, 201 bp, Homo sapiens
ctgatctcaataaccggaagaactggactgtcaaagaaccttcaagagaccacagactcattgctgtgtagatctcattctcacacaaaaccaagatgccwccttggagcgcctcctcttgactacaacctgttcctcccttctgcccttctctgatttcccctctcctctcctcaacctgatcaagacctctagcctcac

SEQ ID NO: 60057 - DNA, 201 bp, Homo sapiens
ctaattctgccctgtcctcattcacagttacaacagagattgacagtttcgccgacattgattatagcttagtggaagcccctcgggcaacagcccagatrctggaggtgatgtttaaggtgagggtcctggggccgggctgcgtgggtgaggctttccctcagggtcagccattctttgggccacctgtccccccaactt

SEQ ID NO: 60058 - DNA, 201 bp, Homo sapiens
ggcactgggaagccagacacaccgaatcaggctggatgtgctgggacacagcagggcgccgggaaggggtggagagggctccctttgtggactggcctgascagggaccagggcctggctttcccaggcacccggccatccccaagttcagtggcagactgtgcttctctccccaggtggctgttgaacctcttccacaac

SEQ ID NO: 60059 - DNA, 201 bp, Homo sapiens
ctggcatcgtgtttggtttacccatcctactgcggcacgggcctctctttcaatgggatgataatagctacgttttatggagcactcaccatgtgctgggscttgtgctaggatgttcgtttaggcctcacagtgactcgaaggtggggactattgttatccccattttatggataaggaagttgaggttcagggagatgg

SEQ ID NO: 60060 - DNA, 201 bp, Homo sapiens
gatcagagagctaaggaggtgagggaagatcagagggagaccttgagtctgcttttttagttcagcatatcaatgtgccatatattggcgtattgttttcygagccccaacagtgttatatctcgatggggtagtacaggacaacacagctggccctagagtcccatagcaggttctgacgccctgaaatctgactgtaaa

SEQ ID NO: 60061 - DNA, 201 bp, Homo sapiens
agggcctgagtctcagcatctccgactcctccatccgggtccagggcaggtggaaggtgcgcaagtcattcttgtaagttggctctgctcccaggccctgragctcttggccttggccttcgccccatccttcttaggtccaaggtgttcctagcttatcagaaaggccacgtgatggacagatggagtccaagcccggag

SEQ ID NO: 60062 - DNA, 201 bp, Homo sapiens
catccaagggaatccatgtagtgtctttcttgaagaagcaattctttgcctcagggccgggctagtagggggattctgaagaaagtcacagggaatgtgartcagccagagcccttgcccctcctccagcagctgaaagtgtcatctggcccctaattctgccctgtcctcattcacagttacaacagagattgacagttt

SEQ ID NO: 60063 - DNA, 201 bp, Homo sapiens
caggcatctcctccctgccagggtaacccaggctgtggagaagcgacagtcttgcacatccccctgtctccccaatcttctttagaccttcagctccagcrggagcaccctaaaacttcttcatgtctctttgctgcagataccgcctgactctaatatccgactgaccaccaagtccttccgacccttcgtcccacgggt

SEQ ID NO: 60064 - DNA, 201 bp, Homo sapiens
cttcataaaagttgaggcctcatgaataatgtcaggatggtgggagaaacagtgtggttcggctcagacggtccagcttaccctggtataagtcaggggcygtctggtagatcgagggtcattttgtccttctgatggcctcctacacctgcacaggccttcgcttctggcatcgtgtttggtttacccatcctactgcgg

SEQ ID NO: 60065 - DNA, 201 bp, Homo sapiens
gatacatgaggttgggtctcacttctcctgtcctgtttcccacagcatagcagtggtatcttggagcagtgatttactggcacactgactcaattatgtayttaagggcaagtccctgaaattgaattcctgggtcacagggcatgcaactgtttaaacatttgccaattgccttccagaaaatttcaccaccagcaaggt

SEQ ID NO: 60066 - DNA, 201 bp, Homo sapiens
cccttcagcctgaacatccacagctgtgagctgcttcactctgcgctgaggcctgtccctggccagggcctgagtctcagcatctccgactcctccatccrggtccagggcaggtggaaggtgcgcaagtcattcttgtaagttggctctgctcccaggccctggagctcttggccttggccttcgccccatccttcttag

SEQ ID NO: 60067 - DNA, 201 bp, Homo sapiens
gtatgtgtgtgtgtgtgtgtgcttgtctggaaactgcttaggccctaggctgagcatacacccccaccattgttaactcatccaagggaatccatgtagtstctttcttgaagaagcaattctttgcctcagggccgggctagtagggggattctgaagaaagtcacagggaatgtgagtcagccagagcccttgcccctc

SEQ ID NO: 60068 - DNA, 201 bp, Homo sapiens
gaattgcttgagcccaggaggcagaggttgcagtgagctgtgatctcactacttcactgcagcctgggcaacagagtgagactgcatctcaaaaaaaaaawaaaaaatatatatatatatatatatatatatttatatgtgaatgaggcaagataatacatgcactgataaatgcatatattttcagagaaaaggaaataa

SEQ ID NO: 60069 - DNA, 201 bp, Homo sapiens
agaagcctattttgaaccccccaaaatagaaccttactctatggtgccattggaaacggatgcctcatgacatccctttccttgccaagaaatacctttawttctgcagcctcactttaagggacatgtcataattcatttaaccaatgcccttctggtggatacatgaggttgggtctcacttctcctgtcctgtttccc

SEQ ID NO: 60070 - DNA, 201 bp, Homo sapiens
ggcatgaagaaagtaacgtgcttagcatggtcataagatcgatgcctggggcacagcaggtgcttacctggagcagatcctgctggtctagtccccactgkggagaggggaggcgcaaggtccctggtgaggctgggtccaggcccagggctgacacctccttccatgtctctcccttcagcctgaacatccacagctgtg

SEQ ID NO: 60071 - DNA, 201 bp, Homo sapiens
acccctgttgacatcagtcaaatagtgagttatagctaagagaaaaatcaacaccaagaaaaatatgttagcacaatctccctttttactttggcaaccargaaactcaaagccaaagttctttctcccatggctgggtgtggtggctcacgcctgtaatctcagcactttgggagcctgaggcgggcggatcacttgagg

SEQ ID NO: 60072 - DNA, 201 bp, Homo sapiens
catgaggtcaaaagtttgagaccagcctggccaacatggtgaaaccccatctctactaaaaatacaaaaattagctgggcatggtggtgcgcacctgtaaycccagctacttaggaggctgaggcaggagaatggcttgaacacgggaggcagaggttgcagtgagctgagatcatgccactgcactccagcctgggcgac

SEQ ID NO: 60073 - DNA, 201 bp, Homo sapiens
agacaatgcctcatgactccttgctaaatattttccagattgttgaacatagaagcctattttgaaccccccaaaatagaaccttactctatggtgccatyggaaacggatgcctcatgacatccctttccttgccaagaaatacctttatttctgcagcctcactttaagggacatgtcataattcatttaaccaatgcc

SEQ ID NO: 60074 - DNA, 201 bp, Homo sapiens
gttatcctcacagcccccttcttgctttgcagtttcaatggcatgccaatgaggaaagtttagtttagtttagtttagtttagtttagtttagtttagttttgttttgttttgttttgttttgtttgagacagagtctgactctgtcgcccaggctagagtgcggtagtgcgatctcggctcactgcaatctctgcctccc

SEQ ID NO: 60075 - DNA, 201 bp, Homo sapiens
ttttttaggccaggagcggtggttcatgcctgtaaccccagcactttgggaggccaaggcgggcagatcatgaggtcaaaagtttgagaccagcctggccracatggtgaaaccccatctctactaaaaatacaaaaattagctgggcatggtggtgcgcacctgtaatcccagctacttaggaggctgaggcaggagaat

SEQ ID NO: 60076 - DNA, 201 bp, Homo sapiens
tgttatcctcacagcccccttcttgctttgcagtttcaatggcatgccaatgaggaaagtttagtttagtttagtttagtttagtttagtttagtttagttttgttttgttttgttttgttttgtttgagacagagtctgactctgtcgcccaggctagagtgcggtagtgcgatctcggctcactgcaatctctgcctcc

SEQ ID NO: 60077 - DNA, 201 bp, Homo sapiens
gtgaggctttccctcagggtcagccattctttgggccacctgtccccccaacttcagatctgtcctcatcctcccagtggttcccgctttgtcaagggccrggtgatatggagtggtggggagtgtttccagagctaggattctcccacggctgtcttacacctctcaggtcttaacgcttccctcctccttcttccccta

SEQ ID NO: 60078 - DNA, 201 bp, Homo sapiens
ttgttatcctcacagcccccttcttgctttgcagtttcaatggcatgccaatgaggaaagtttagtttagtttagtttagtttagtttagtttagtttagttttgttttgttttgttttgttttgtttgagacagagtctgactctgtcgcccaggctagagtgcggtagtgcgatctcggctcactgcaatctctgcctc

SEQ ID NO: 60079 - DNA, 201 bp, Homo sapiens
ccagatgctggaggtgatgtttaaggtgagggtcctggggccgggctgcgtgggtgaggctttccctcagggtcagccattctttgggccacctgtccccscaacttcagatctgtcctcatcctcccagtggttcccgctttgtcaagggccgggtgatatggagtggtggggagtgtttccagagctaggattctccca

SEQ ID NO: 60080 - DNA, 201 bp, Homo sapiens
cttgttatcctcacagcccccttcttgctttgcagtttcaatggcatgccaatgaggaaagtttagtttagtttagtttagtttagtttagtttagtttagttttgttttgttttgttttgttttgtttgagacagagtctgactctgtcgcccaggctagagtgcggtagtgcgatctcggctcactgcaatctctgcct

SEQ ID NO: 60081 - DNA, 201 bp, Homo sapiens
agttacaacagagattgacagtttcgccgacattgattatagcttagtggaagcccctcgggcaacagcccagatgctggaggtgatgtttaaggtgaggrtcctggggccgggctgcgtgggtgaggctttccctcagggtcagccattctttgggccacctgtccccccaacttcagatctgtcctcatcctcccagtg

SEQ ID NO: 60082 - DNA, 201 bp, Homo sapiens
tgcttgttatcctcacagcccccttcttgctttgcagtttcaatggcatgccaatgaggaaagtttagtttagtttagtttagtttagtttagtttagttdagttttgttttgttttgttttgttttgtttgagacagagtctgactctgtcgcccaggctagagtgcggtagtgcgatctcggctcactgcaatctctgc

SEQ ID NO: 60083 - DNA, 201 bp, Homo sapiens
gaatccatgtagtgtctttcttgaagaagcaattctttgcctcagggccgggctagtagggggattctgaagaaagtcacagggaatgtgagtcagccagmgcccttgcccctcctccagcagctgaaagtgtcatctggcccctaattctgccctgtcctcattcacagttacaacagagattgacagtttcgccgacat

SEQ ID NO: 60084 - DNA, 201 bp, Homo sapiens
tttgaacccagaaggcggaggttgcagtgtgctgagatcacaccactgcactccatccagcctgggtgatggagtgagactctgtctcaaaaaaaaaaaaacaaaaaaaatactatatctggctacagtagtattcccaatgcctgccacatagttggtgatcagtaagtatttattttaaaaatgatctgggatttcaac

SEQ ID NO: 60085 - DNA, 201 bp, Homo sapiens
ggctcagcattaagctccaggtgtggctggagaggtgaagcctggactcatggtgtgtgtgtatgtgtgtgtgtgtgtgtgcttgtctggaaactgcttargccctaggctgagcatacacccccaccattgttaactcatccaagggaatccatgtagtgtctttcttgaagaagcaattctttgcctcagggccgggct

SEQ ID NO: 60086 - DNA, 201 bp, Homo sapiens
gctgtcccttgctattgccaacagggctgcaaggagccatctacaagtggagtctctggatccagggtgcacacattaagctcggagggggagaccctggyaaattatctgagatgttctctgatgccttagctcctaagcccctatgcggttatttgctgacatcacctttaccagaggtccaggtcggcaacccggtac

SEQ ID NO: 60087 - DNA, 201 bp, Homo sapiens
cacaaagtcaggacacaaaccgaagtctgtgtgaccgcaaacctcaccctcgcagaccctctgagtgggagccacacatcagctgccccccggggagagcrggcaggatgctgaagtcccatgtgctctccttgggtgaatgcaggacaggcatctcctccctgccagggtaacccaggctgtggagaagcgacagtcttg

SEQ ID NO: 60088 - DNA, 201 bp, Homo sapiens
tgcctgaccttcctggttattggctcagcattaagctccaggtgtggctggagaggtgaagcctggactcatggtgtgtgtgtatgtgtgtgtgtgtgtgygcttgtctggaaactgcttaggccctaggctgagcatacacccccaccattgttaactcatccaagggaatccatgtagtgtctttcttgaagaagcaat

SEQ ID NO: 60089 - DNA, 201 bp, Homo sapiens
cacgtaaagctctgagctctctgcttggcatatagtgggggttagaagttgtgtttcatgattttggtagagaagcttattttgtttttattaaatttttwaaattatgtaggtagttcaggaaaaacattctcactgtaaataaaaccgatactaaagataaggctaaggacatgtcaaatgttgatgttcttcctttag

SEQ ID NO: 60090 - DNA, 201 bp, Homo sapiens
ccaggagattgaggctgcagtgagccatgattgcaccactgcactccagctgggcgacagacagagactccatctctaaaacaataataataatttattawtgttgttactagggctgaatcttgacctgagataactagaaatgatcctttttagagctttccaagggtaggtactctataccttctcttagtagtctgt

SEQ ID NO: 60091 - DNA, 201 bp, Homo sapiens
gataatctctgggtggcctcaccaactctttactagcttctcaacaattccatcacttgtataaccaattccccgtattaaattccctctgcgttaaacaytgagagtcagttttccttttttgatggactctgtctaatagggaagggatgttgggtcctttgggggccttgctccctggatggagaactctgctctctt

SEQ ID NO: 60092 - DNA, 201 bp, Homo sapiens
ccaatgggaggtactgtcaggagaatgatggcggggaggaaggatgaagccagagtactatttcctctttctttaccacggcagaggctctggctgtgacwatgtctcctcatggtgacttccataattccacctccactctttgttcctctagtcctggggtggatacagcctcctgtctctggataatctctgggtggc

SEQ ID NO: 60093 - DNA, 201 bp, Homo sapiens
gaaattgcaagctcgtcatatcatgtgatatgcccagattcagcattataagatcctgccaaacagttttccaaagtggttgtaacagaccttatttgttracagccgtgtagtgttccatcacatggatgtgtcttcatttatttaataagtcccccactgatggacatttaggtgctttgctgtcccttgctattgcca

SEQ ID NO: 60094 - DNA, 201 bp, Homo sapiens
tgcactttgatttccacccaggtcaaccaatgggaggtactgtcaggagaatgatggcggggaggaaggatgaagccagagtactatttcctctttctttrccacggcagaggctctggctgtgactatgtctcctcatggtgacttccataattccacctccactctttgttcctctagtcctggggtggatacagcctc

SEQ ID NO: 60095 - DNA, 201 bp, Homo sapiens
gtatttggaggtcagaactgagccttctattttccccacaaatggtggcagacccctggtctaggaactaaccatggcttctcttacctcctccagcaaamtacagggctcctttgatgtcagtgtcaagggcatcagcatttcggtcaacctcctgttgggcagcgagtcctccgggaggcccacagttactgcctccag

SEQ ID NO: 60096 - DNA, 201 bp, Homo sapiens
ataaatgtcctagtacctatggtcgcatgtctttgggtatatatctgggagtgaaattgcaagctcgtcatatcatgtgatatgcccagattcagcattayaagatcctgccaaacagttttccaaagtggttgtaacagaccttatttgttaacagccgtgtagtgttccatcacatggatgtgtcttcatttatttaat

SEQ ID NO: 60097 - DNA, 201 bp, Homo sapiens
cagctttatctgactccctcaggcctctcctggcagacttgtatattttcttctcttgatgtaatctcctaattctgctcccagttagccaggctctaccycaacatgaacctggaactccagggatcagtgccctctgctccgctcctgaacttcagccctgggaatctgtctgtggacccctatatggagatagatgcc

SEQ ID NO: 60098 - DNA, 201 bp, Homo sapiens
taggacaccccatccatcccgggacacttttatttctgttaatttctataagagcatatatatatcttataaaatagtaaatggggcaaaaatatagaaartaaaaattaagggccaggcgcagcggctcacacctgtaatctcagcagtctgggaggccgaggcgggtggatcacctgaggtcaggagttcgagaccagc

SEQ ID NO: 60099 - DNA, 201 bp, Homo sapiens
actaaccatggcttctcttacctcctccagcaaactacagggctcctttgatgtcagtgtcaagggcatcagcatttcggtcaacctcctgttgggcagcragtcctccgggaggcccacagttactgcctccagctgcagcagtgacatcgctgacgtggaggtggacatgtcgggagacttggggtaggtctccatcgg

SEQ ID NO: 60100 - DNA, 201 bp, Homo sapiens
attgtgccactgcactccagcctgggccacagagtgagatcctatctcaaaaagaaatgaaataaaataaaacatgaggtccatgcatattgttgcatgcrcctgtagtgtagctggtttattctccttgctgcatagtatatcaccatgtagatgtttccccatttatttgttcattctactgttgaaggccatctgggg

SEQ ID NO: 60101 - DNA, 201 bp, Homo sapiens
agccttggctacttaagggacctgggcccaatccacagctgggacagtcctggcccactgcactgggaatctaggatgggggccttggccagagccctgcygtccatactgctggcattgctgcttacgtccaccccagaggctctgggtgccaaccccggcttggtcgccaggatcaccgacaagggactgcagtatggt

SEQ ID NO: 60102 - DNA, 201 bp, Homo sapiens
cctcctccagcaaactacagggctcctttgatgtcagtgtcaagggcatcagcatttcggtcaacctcctgttgggcagcgagtcctccgggaggcccacrgttactgcctccagctgcagcagtgacatcgctgacgtggaggtggacatgtcgggagacttggggtaggtctccatcggggcactgccagctggactcc

SEQ ID NO: 60103 - DNA, 201 bp, Homo sapiens
aaaaaggaagagtcttgccccaaattaaactctgtacctatctctagtacacagaaaattaagagcacttttgaaatggtggaatctagggctggtcgtgktggctcacacctataatcctagcactctgggaggccaaagtgggggggtagcttgaggccaggagttcaagaccaacctggacaacatagcaaaaccctg

SEQ ID NO: 60104 - DNA, 201 bp, Homo sapiens
gaaattgtgccactgcactccagcctgggccacagagtgagatcctatctcaaaaagaaatgaaataaaataaaacatgaggtccatgcatattgttgcaygcacctgtagtgtagctggtttattctccttgctgcatagtatatcaccatgtagatgtttccccatttatttgttcattctactgttgaaggccatctg

SEQ ID NO: 60105 - DNA, 201 bp, Homo sapiens
ccaggcatggtggctcatgcctgtaatcccagcattgtgggtggccaaggtgggtggattgcttgagtccaggagttcaagaccagcctgggcaacatgaygaaaccccatctctacaaaaaatacaaaaattagccaagcgtagcggcacatagctgtagtcccagccactggggaggctgaggtgggaagatcacctga

SEQ ID NO: 60106 - DNA, 201 bp, Homo sapiens
aattagccaggcatagtggtgtgtgcctgtagtcccagctacttgggaggccaaggtgggaggatcgcttgagcccaggaggtcaaggcagcggtgggctraaattgtgccactgcactccagcctgggccacagagtgagatcctatctcaaaaagaaatgaaataaaataaaacatgaggtccatgcatattgttgcat

SEQ ID NO: 60107 - DNA, 201 bp, Homo sapiens
aagtcccatgtgctctccttgggtgaatgcaggacaggcatctcctccctgccagggtaacccaggctgtggagaagcgacagtcttgcacatccccctgyctccccaatcttctttagaccttcagctccagcgggagcaccctaaaacttcttcatgtctctttgctgcagataccgcctgactctaatatccgactga

SEQ ID NO: 60108 - DNA, 201 bp, Homo sapiens
ggtcaggcttggtggtgcacacctataatcccagcactttgggaggccaaggagggagtatcacttcagttcaggagttcaaggccagcccgggcaacatrgcgaaaccccatctctacaataaatacaaaaattagccaggcatagtggtgtgtgcctgtagtcccagctacttgggaggccaaggtgggaggatcgctt

SEQ ID NO: 60109 - DNA, 201 bp, Homo sapiens
gggaggctgaggcaggagaatcacttgaacctgggaggcggagtttgcggtgagttgagattgtgctactgcactccagcctgggcaacagaacaagactytgtctcaacaaagaaaaaaaataataaataataaataaacaaaataaaatatgaggtcaggtcaggcttggtggtgcacacctataatcccagcactttg

SEQ ID NO: 60110 - DNA, 201 bp, Homo sapiens
aggtgccgtggtggatgcctgtaatcccagctactcgggaggctgaggcaggagaatcacttgaacctgggaggcggagtttgcggtgagttgagattgtkctactgcactccagcctgggcaacagaacaagactctgtctcaacaaagaaaaaaaataataaataataaataaacaaaataaaatatgaggtcaggtca

SEQ ID NO: 60111 - DNA, 201 bp, Homo sapiens
aatacaaaaattagccaggtgccgtggtggatgcctgtaatcccagctactcgggaggctgaggcaggagaatcacttgaacctgggaggcggagtttgcrgtgagttgagattgtgctactgcactccagcctgggcaacagaacaagactctgtctcaacaaagaaaaaaaataataaataataaataaacaaaataaa

SEQ ID NO: 60112 - DNA, 201 bp, Homo sapiens
gtgctgggattgcaggcgtgagagctcacgcctgtaatcccaacatttagggaggccgaggcgggtggattacctgaggtcaggagttcgagaccagcccrgtcaacatggtgaaaccccgtctctactaaaaatacaaaaattagccaggtgccgtggtggatgcctgtaatcccagctactcgggaggctgaggcagga

SEQ ID NO: 60113 - DNA, 201 bp, Homo sapiens
tagaggcctgccgggcagcagcagctcggggaatgacagatcgatctctaccttggagaaggtagctgggaagagctgtgctttacggagagcttggggastgaggcacactcgcaatttatgcactgacctggattctggcagagcttgtgtttcgtgagacgtgggctccctttcaatcgcagatgcatctttttggag

SEQ ID NO: 60114 - DNA, 201 bp, Homo sapiens
cttgatggagtcatgggagggctaagtgcggtaatatcatgtctccttggtttgcttcccacagaagcagactttagggcaagaattccagtgcaatactytatcttggaagcgatctgaggaaacccacaggggagtggggaagtgaggaagggaagggaagggaaggaagtcagcctggtgggcaagtgaagctctgtc

SEQ ID NO: 60115 - DNA, 201 bp, Homo sapiens
tttgagatggagtttctctcttgttgcccaagctggagtgcaatggcatgatctcggctcactgcaacctcggcctcccaggttgaagtgattctccagcytcagccgcctgagtagctggaattacaggcgcccgccaccatgcccagataatttttgtatttttagtagagacttggttttatcatgttggccaggctg

SEQ ID NO: 60116 - DNA, 201 bp, Homo sapiens
tccagcttaccctggtataagtcaggggccgtctggtagatcgagggtcattttgtccttctgatggcctcctacacctgcacaggccttcgcttctggcrtcgtgtttggtttacccatcctactgcggcacgggcctctctttcaatgggatgataatagctacgttttatggagcactcaccatgtgctgggccttgt

SEQ ID NO: 60117 - DNA, 201 bp, Homo sapiens
gtgatcagcacggggccagaccagagctggggaactcactcagtcattctcttcccatgtttttcagatttgcgaaatgatccagaaatcagtgtcctccratctacagccttatctccaaactctgccaggtaggacaccccatccatcccgggacacttttatttctgttaatttctataagagcatatatatatctta

SEQ ID NO: 60118 - DNA, 201 bp, Homo sapiens
tgtgactgcagtgatcagcacggggccagaccagagctggggaactcactcagtcattctcttcccatgtttttcagatttgcgaaatgatccagaaatcrgtgtcctccgatctacagccttatctccaaactctgccaggtaggacaccccatccatcccgggacacttttatttctgttaatttctataagagcatat

SEQ ID NO: 60119 - DNA, 201 bp, Homo sapiens
gttcatatctttttttttcttttgagttgttctttctttccttgttaatttatattggcttgttctttgtatattagggaaataagctcatatattaaggraattggctctttagatgtctcatactgcaattttttttttactttacatatggcattttttttgtccactgaagttttaattttctatgccgacaagttt

SEQ ID NO: 60120 - DNA, 201 bp, Homo sapiens
acagagggagactgtctcaaaaaaataaataaaaataaaacaaagaatgagcaaaagtaggagtatttttttttaaatactgaaacaaagcctcccgactmtccaggtggcatgggaactgggatatttatacaccacagtgattgattgagggcttctgggccgggggtttgtcaactccccagcacttctgtcctgttg

SEQ ID NO: 60121 - DNA, 201 bp, Homo sapiens
agacaaggtttcacaatgctggccaggctggtctcaaactcctggcctcaagtgatatgctcacctcagcctcccaaagtgctgggattacaggcatgagmcaccatatacagccaacactatatatgtttacaaaaattattcataaacctattgctccactacaagcacagtttgaattttggtgtacttctagtgctt

SEQ ID NO: 60122 - DNA, 201 bp, Homo sapiens
agatgaataagtgcagaagaaatgctcagtgttgctaattgtgtccaacagggttcaggcaagaaaagagaatccaactgcattggttcttgggatttgawtaaagtggctatttctagagttgggggacaagcttgaggaaaccaaccagggactgtttttcctaaggctcaagcagcaaagaaaagcatctgggtatcc

SEQ ID NO: 60123 - DNA, 201 bp, Homo sapiens
aaatagaaccttactctatggtgccattggaaacggatgcctcatgacatccctttccttgccaagaaatacctttatttctgcagcctcactttaagggrcatgtcataattcatttaaccaatgcccttctggtggatacatgaggttgggtctcacttctcctgtcctgtttcccacagcatagcagtggtatcttgg

SEQ ID NO: 60124 - DNA, 201 bp, Homo sapiens
gcttgttatcctcacagcccccttcttgctttgcagtttcaatggcatgccaatgaggaaagtttagtttagtttagtttagtttagtttagtttagtttwgttttgttttgttttgttttgttttgtttgagacagagtctgactctgtcgcccaggctagagtgcggtagtgcgatctcggctcactgcaatctctgcc

SEQ ID NO: 60125 - DNA, 201 bp, Homo sapiens
tataaatatttgtaaatcagtgatcactgagcacatgtgtggaataatgtgactgcagtgatcagcacggggccagaccagagctggggaactcactcagkcattctcttcccatgtttttcagatttgcgaaatgatccagaaatcagtgtcctccgatctacagccttatctccaaactctgccaggtaggacacccca

SEQ ID NO: 60126 - DNA, 201 bp, Homo sapiens
ccacatgggggcccacatagttttattgtttgtatttccttggtacctggctcatgacaagcacttataaatatttgtaaatcagtgatcactgagcacaygtgtggaataatgtgactgcagtgatcagcacggggccagaccagagctggggaactcactcagtcattctcttcccatgtttttcagatttgcgaaatg

SEQ ID NO: 60127 - DNA, 201 bp, Homo sapiens
gttagccaggatggtcttgatctcctgacctcgtgatccgcccgctcggcctcccaaagtgctgggattgcaggcgtgagagctcacgcctgtaatcccarcatttagggaggccgaggcgggtggattacctgaggtcaggagttcgagaccagcccagtcaacatggtgaaaccccgtctctactaaaaatacaaaaat

SEQ ID NO: 60128 - DNA, 201 bp, Homo sapiens
gtgccccctcctcaggctatgtcagtgactccctagctcaggtgtccagccctgggacagactgaaaagtccaactggaccctagtggagtccacatgggkgcccacatagttttattgtttgtatttccttggtacctggctcatgacaagcacttataaatatttgtaaatcagtgatcactgagcacatgtgtggaat

SEQ ID NO: 60129 - DNA, 201 bp, Homo sapiens
attaaactctaaattctgagaggccaggacctcccaaaggaaaactttgtaatggtggagtttcaggcactgtctccagccagtgccccctcctcaggctrtgtcagtgactccctagctcaggtgtccagccctgggacagactgaaaagtccaactggaccctagtggagtccacatgggggcccacatagttttattg

SEQ ID NO: 60130 - DNA, 201 bp, Homo sapiens
atttaatcttgcttttagaggggtttttttgtttttcgtttttttggttttttggttttttttgcacctcacctttccagagtatttatcttaggttttcrtagaaagaacccttatagctggggccgggcatggtggctcatgcctgtaatcccagcactttgggaggccgatgggggtggaccatttgaggtcagaagt

SEQ ID NO: 60131 - DNA, 201 bp, Homo sapiens
aggcgtaagccaccacacccagccagtcccattggatcttaacctcgaccttggaaggaggtgccattttccacatggacagaggaggctgaggggtggaktagctttcccagtgtcaccttgctggtgagaggctgaatcaggattggagcttcctagaatgtggagcagcttgtaccaaagcccttctagggctaggtg

SEQ ID NO: 60132 - DNA, 201 bp, Homo sapiens
gcaggaatggggaatactgatcagtccagccaatctgttcaggatgaccattaagaactatctacaggccgaatgtggtggctcacgtctgtaatcccagmactttgggaggccaaggcaggtggatcgcctgaggtcaggagttcaagaccagcctggccaacatggtgaaaccccgtctccactaaatatataacaatt

SEQ ID NO: 60133 - DNA, 201 bp, Homo sapiens
agctcccggccaatccagcgctcagcctggcctccgataattgcaatgatccaggtggcttgcacaggcacttgaagatcattctctggggaaccctgttragatgaacagacttaagccaggaatattggtgcatcattttcattaaaaaaataaactttcattcacctgacaaggggacccttgtcaggtgaatgaaat

SEQ ID NO: 60134 - DNA, 201 bp, Homo sapiens
tcccttcagcctgaacatccacagctgtgagctgcttcactctgcgctgaggcctgtccctggccagggcctgagtctcagcatctccgactcctccatcygggtccagggcaggtggaaggtgcgcaagtcattcttgtaagttggctctgctcccaggccctggagctcttggccttggccttcgccccatccttctta

SEQ ID NO: 60135 - DNA, 201 bp, Homo sapiens
ccaggagtaccagcaggaatggggaatactgatcagtccagccaatctgttcaggatgaccattaagaactatctacaggccgaatgtggtggctcacgtmtgtaatcccagcactttgggaggccaaggcaggtggatcgcctgaggtcaggagttcaagaccagcctggccaacatggtgaaaccccgtctccactaaa

SEQ ID NO: 60136 - DNA, 201 bp, Homo sapiens
taaactcctctcccagaaaatggagcagctgcaaagagaggttaagatacagccctttgccctcccagcccccagcgtcacccttccatcagcaacccagygtctgatggatggtgcctgcttacccttcagcacagaagccatctgtgacccctgcactaggccagggctctgcatgtccctctccttcactgtacatgt

SEQ ID NO: 60137 - DNA, 201 bp, Homo sapiens
actctcaaccctgccgtctgctgggggtgagatctcaagggagctatgtggcttttttgaacctcagtttcctcatctgctaaaccaggccttcctagcckagctcttaagagactggctgagatgaggcaagatgaacagtgatgaatatggggtctttctgtggggagggtggacagggatgatcataggagtcaggct

SEQ ID NO: 60138 - DNA, 201 bp, Homo sapiens
tctcaaaggctgcataacattgggtgcccacagcttattcaacctgtcgctgctagcggacatgtaggctgcttcctttttttttttttttttttttttttgctactgcctatgatgcttcagtgagctgccccacaccacgcgtatatcttggcaggaagagctacgggataaaggcttagaagttaaattactgggcca

SEQ ID NO: 60139 - DNA, 201 bp, Homo sapiens
cttccaggagtaccagcaggaatggggaatactgatcagtccagccaatctgttcaggatgaccattaagaactatctacaggccgaatgtggtggctcaygtctgtaatcccagcactttgggaggccaaggcaggtggatcgcctgaggtcaggagttcaagaccagcctggccaacatggtgaaaccccgtctccact

SEQ ID NO: 60140 - DNA, 201 bp, Homo sapiens
accacacacacgcgcacacacacacacacacacacacacacacaccctcgtctgtaggtccaacctctggtttggctttgagtgccccctcgtggttgaarcaggaacagcaggcaaaccccgcattttgggtgtggccagctgtgctctttcttttctggttctgggtccctgggattaagtgaccctgagaaatatgcc

SEQ ID NO: 60141 - DNA, 201 bp, Homo sapiens
tctatcccaaggctgcatcataaataattcgggtgattacagtggcaagtacagccaacaagtttggaaatgcacatttccttctcttgagaagcaggccrcacaactggtggcaattgtgtgtgagtagcctacagaccccagcattcagtcttccaggagtaccagcaggaatggggaatactgatcagtccagccaat

SEQ ID NO: 60142 - DNA, 201 bp, Homo sapiens
caaacaggtggtaggctttcatgtggactccagtagggcccagttggacttttcaaagtctatcccaaggctgcatcataaataattcgggtgattacagyggcaagtacagccaacaagtttggaaatgcacatttccttctcttgagaagcaggccgcacaactggtggcaattgtgtgtgagtagcctacagacccca

SEQ ID NO: 60143 - DNA, 201 bp, Homo sapiens
aataaataattcgagtaattacaaaagcaagtacagcaaacaggtggtaggctttcatgtggactccagtagggcccagttggacttttcaaagtctatcscaaggctgcatcataaataattcgggtgattacagtggcaagtacagccaacaagtttggaaatgcacatttccttctcttgagaagcaggccgcacaac

SEQ ID NO: 60144 - DNA, 201 bp, Homo sapiens
tgggactacaggtgcctgccaccacgcccagctaattttttgcatttttagtaaaggcagggtttcaccatgttagccaggttggtcttgatctcctgacytcatgatctgcctgcctcagcctcccaaagtgctgggattacaggcgtgagccaccgcgcctggcctgactcccagtcttttctccagttaatctttcct

SEQ ID NO: 60145 - DNA, 201 bp, Homo sapiens
tcttttctcaatgatattgcattagtgtacataataaataattcgagtaattacaaaagcaagtacagcaaacaggtggtaggctttcatgtggactccaktagggcccagttggacttttcaaagtctatcccaaggctgcatcataaataattcgggtgattacagtggcaagtacagccaacaagtttggaaatgcac

SEQ ID NO: 60146 - DNA, 201 bp, Homo sapiens
attcatgggttctgatgcagactgcaaaaccgtgagcaattgcatcccttcctcaaggttctatttccccctttgtggaaagggagcaagaacactgctgrccccttcagtgtggcccatatggcatgaagaaagtaacgtgcttagcatggtcataagatcgatgcctggggcacagcaggtgcttacctggagcagatc

SEQ ID NO: 60147 - DNA, 201 bp, Homo sapiens
aaaaaaaaaactcttttctcaatgatattgcattagtgtacataataaataattcgagtaattacaaaagcaagtacagcaaacaggtggtaggctttcakgtggactccagtagggcccagttggacttttcaaagtctatcccaaggctgcatcataaataattcgggtgattacagtggcaagtacagccaacaagtt

SEQ ID NO: 60148 - DNA, 201 bp, Homo sapiens
gttcgacaccagcctgggcaacatagcaagacctcgtccctactaaaatacaaaaaattagctggacatggtggctcacacctgtagtcccagctacttakggggctgtggtgggaggatcacttgagcccaggaagttgaggttgcagcgagcgatgttcatgccactggactcctgcttgagcaacagagtagactttg

SEQ ID NO: 60149 - DNA, 201 bp, Homo sapiens
aattggcccaattcttctgccccactggtcctgcccccacaaatctcaaattgttaaagaattcactaagactgttacttcttaatgtatgaattttagamgccagctatatgaacttcctgaaatgataaagagtgagctttttgacactatctcatctgccctgtgacagtcttcccgatgtcattgtatcactgcttt

SEQ ID NO: 60150 - DNA, 201 bp, Homo sapiens
ataaatatttgtaaatcagtgatcactgagcacatgtgtggaataatgtgactgcagtgatcagcacggggccagaccagagctggggaactcactcagtyattctcttcccatgtttttcagatttgcgaaatgatccagaaatcagtgtcctccgatctacagccttatctccaaactctgccaggtaggacaccccat

SEQ ID NO: 60151 - DNA, 201 bp, Homo sapiens
tgactcccagctatttcctttccacagcggcccaggaggggctattggctctgcagagtgagctgctcaggatcacgctgcctgacttcaccggggacttraggatcccccacgtcggccgtgggcgctatgagttccacaggtggggctctcccttctgctgcggctctgaagtggctggagctggctgtcagggggaat

SEQ ID NO: 60152 - DNA, 201 bp, Homo sapiens
tttaaaaaagagagtttggttggtgccagatgtagcttcactctcaaccctgccgtctgctgggggtgagatctcaagggagctatgtggcttttttgaamctcagtttcctcatctgctaaaccaggccttcctagccgagctcttaagagactggctgagatgaggcaagatgaacagtgatgaatatggggtctttct

SEQ ID NO: 60153 - DNA, 201 bp, Homo sapiens
ttttcctaggacttcctgttcttgggtgccaatgtccaatacatgagagtttgaggacaagaaagatgaagcttggaggtcacagctggatctgcttgttscatttccagctgtgcagcacgtctcagagattcttgaagaatgaagacatttctgctctcagctccgggggtgaggtgtgcctggcctctgcctccaccc

SEQ ID NO: 60154 - DNA, 201 bp, Homo sapiens
caggtgggagccaccgtagggtttagagcaggggaggaggcaggcagatcaagctgactcccagctatttcctttccacagcggcccaggaggggctattrgctctgcagagtgagctgctcaggatcacgctgcctgacttcaccggggacttgaggatcccccacgtcggccgtgggcgctatgagttccacaggtggg

SEQ ID NO: 60155 - DNA, 201 bp, Homo sapiens
ccgctgtagcctgggaggcggaggttgcggtgagccaagatcacgccactgcactccagtctgggcaagagagtgagaccctatctcaaaataattaattmattagttaattaaataaaataaattagccaccacacctggctaatttttaaaattatttattataaataaataaatctcattaatattttttatattgat

SEQ ID NO: 60156 - DNA, 201 bp, Homo sapiens
agactccagaggtttctctttaaaacctctgcatctctcagcttgaccaagagtgagaaggccgggatgagactcccactgaaggctggggtgctgctccyttcaaagcctaaataacagaggccacgccccatatcttgtgggaccacagcttgtccaatcttttattggtgttatctaagaatcccaaggaatgctggc

SEQ ID NO: 60157 - DNA, 201 bp, Homo sapiens
ccaatggccctggaccaggccatgggggctggtttagacgtacttgggcccaaagcccagggaggacaaatcatttgcccaggtcatggagctgttgtggsgcacgctggggacaaagctccaagtccgttcggttgggcagaaaatggtcaactgcttgaccaagggttaaacagcaggggctaaacagagactccagcc

SEQ ID NO: 60158 - DNA, 201 bp, Homo sapiens
tgctgcggctctgaagtggctggagctggctgtcagggggaattggagagtgaggaagagagagcctcaggattgggctgtggggggacctctccggggcrgacagtgggatagttccctgaagagctcagaaggaaattctgggaaggaattgagctcctccactcagtcacgcagcaaatattaaggaagacctactgg

SEQ ID NO: 60159 - DNA, 201 bp, Homo sapiens
aacatggtgaaaccccatctctactaaaaatacaaaaattagctgggcgtagtggcgcatgcctgtaatctcagctacttaggaggatgagacaggagaaycgctgtagcctgggaggcggaggttgcggtgagccaagatcacgccactgcactccagtctgggcaagagagtgagaccctatctcaaaataattaattc

SEQ ID NO: 60160 - DNA, 201 bp, Homo sapiens
gaagtcagcctggtgggcaagtgaagctctgtctagctggggaactcagggacagcggagaacacgcctctgagttactccagccccacgctgtcaccccrtcctcctgcttgccattggccaagggctgcttccaggggctctggctctcaggcactttgaacagttctctgacctcagaggcacttggatggaaggggt

SEQ ID NO: 60161 - DNA, 201 bp, Homo sapiens
tcacagttctggaggctgagggccaaggtcaaggttttggcaggcctggtttcttctgaggccactctctttggcttgcagatggctgccctttggcaatktcctcacgtggtctttcctctgtgctcaagaaatcccatttctgaggccatgcacgttggctcacccctgtaatcccagcactttgggaggctgaggcgg

SEQ ID NO: 60162 - DNA, 201 bp, Homo sapiens
aacccacaggggagtggggaagtgaggaagggaagggaagggaaggaagtcagcctggtgggcaagtgaagctctgtctagctggggaactcagggacagyggagaacacgcctctgagttactccagccccacgctgtcaccccgtcctcctgcttgccattggccaagggctgcttccaggggctctggctctcaggca

SEQ ID NO: 60163 - DNA, 201 bp, Homo sapiens
gtgtctcaaaaaacaaacaacaacaaaaaaaaaaactcttttctcaatgatattgcattagtgtacataataaataattcgagtaattacaaaagcaagtrcagcaaacaggtggtaggctttcatgtggactccagtagggcccagttggacttttcaaagtctatcccaaggctgcatcataaataattcgggtgatta

SEQ ID NO: 60164 - DNA, 201 bp, Homo sapiens
tttaaatgtagtagcccaacggttagagctgaagtttgtacttgggggagtcagggaaggcttccaggagaaggtggcatttgagccaagtcttcaaaagwttactagacttgagcagctgatgctttaaaagagcgtgaactgctttttgagggatgggcagtgaagaaacgacaatcagactcgtagcacattgtaccc

SEQ ID NO: 60165 - DNA, 201 bp, Homo sapiens
agatgaactgggttggcggactcattagcaggagggggatgctgcgctgtgcctggtacattgttaacaacagaaaataatagccattaaagggaatgaarggcaggggggatgattagggacctagaaacactggccaactgttctatctaaaaaacaaatgtcgaaagcccttttgggctctgagatactcagcactta

SEQ ID NO: 60166 - DNA, 201 bp, Homo sapiens
ataacagagcaagactgtgtctcaaaaaacaaacaacaacaaaaaaaaaaactcttttctcaatgatattgcattagtgtacataataaataattcgagtrattacaaaagcaagtacagcaaacaggtggtaggctttcatgtggactccagtagggcccagttggacttttcaaagtctatcccaaggctgcatcataa

SEQ ID NO: 60167 - DNA, 201 bp, Homo sapiens
taatcccagcactttgggaggccgatgggggtggaccatttgaggtcagaagttctagaccagcttagccaacatggtgagaccccagtctctactaaaawtacaaaaattagcagggtgtggtggcacatgcctgtaatcccagctacttaggaagctgaggtaggagagtcacttgaacctgggaggcagaagttgcag

SEQ ID NO: 60168 - DNA, 201 bp, Homo sapiens
ctggttcaagtgattctcctgcctcagcctcccgagtagctgggattacaggcacatgctaccacgcccagctaatttttgtatttttagtagagacaggrtttcactatgttggccaggatggtctcgatgatccacccgcctcggcctcccaaagtgctgggattacaggcgtgagccactgcgcccgacccctttcca

SEQ ID NO: 60169 - DNA, 201 bp, Homo sapiens
ttgctttctggcagctcatcgctgctaaactcctctcccagaaaatggagcagctgcaaagagaggttaagatacagccctttgccctcccagcccccagygtcacccttccatcagcaacccagcgtctgatggatggtgcctgcttacccttcagcacagaagccatctgtgacccctgcactaggccagggctctgca

SEQ ID NO: 60170 - DNA, 201 bp, Homo sapiens
atttatcttaggttttcatagaaagaacccttatagctggggccgggcatggtggctcatgcctgtaatcccagcactttgggaggccgatgggggtggaycatttgaggtcagaagttctagaccagcttagccaacatggtgagaccccagtctctactaaaattacaaaaattagcagggtgtggtggcacatgcctg

SEQ ID NO: 60171 - DNA, 201 bp, Homo sapiens
tgcgaatatatgcccgggaccatacccccaagaaaataaaaattttagaggctgggcatggtggcccaagtctataatcccagtattttggaaggccaagmgggaggcttacttgagctcaggagttcgacaccagcctgggcaacatagcaagacctcgtccctactaaaatacaaaaaattagctggacatggtggctc

SEQ ID NO: 60172 - DNA, 201 bp, Homo sapiens
ttggttttttggttttttttgcacctcacctttccagagtatttatcttaggttttcatagaaagaacccttatagctggggccgggcatggtggctcatkcctgtaatcccagcactttgggaggccgatgggggtggaccatttgaggtcagaagttctagaccagcttagccaacatggtgagaccccagtctctact

SEQ ID NO: 60173 - DNA, 201 bp, Homo sapiens
cattgcacaagaggtggtagctggctaacaaaaagagctgtttaaagtgaggactttctcatcgcacatcaacaaagaaaatattgacgtatgaacccaawtgttttaatggtggagtttcaggcagcgtctccagtgccccctcttcgagctgtgtcagtgaaggcccacagctattctttgaaaatggtctcttgattg

SEQ ID NO: 60174 - DNA, 201 bp, Homo sapiens
ctctgcatgtccctctccttcactgtacatgtggattcattgcacaagaggtggtagctggctaacaaaaagagctgtttaaagtgaggactttctcatcrcacatcaacaaagaaaatattgacgtatgaacccaaatgttttaatggtggagtttcaggcagcgtctccagtgccccctcttcgagctgtgtcagtgaa

SEQ ID NO: 60175 - DNA, 201 bp, Homo sapiens
atctctatccccaacttcccaaaatattaccagaaaggggtcctgatccagaacctcaagagagtgttcttggatctcacgcaagaaagaatttggggtgmgttcataaagtgaaagcaagtttattagagaagtaatgacggaaaagaatggctactccacaggctaagcagcaacatgggctgctcagtcgcgtatact

SEQ ID NO: 60176 - DNA, 201 bp, Homo sapiens
ggtccaacctctggtttggctttgagtgccccctcgtggttgaaacaggaacagcaggcaaaccccgcattttgggtgtggccagctgtgctctttctttkctggttctgggtccctgggattaagtgaccctgagaaatatgccaatctactcaggcaccctgttgccatattgctgtgcataacaatagtaatgtagca

SEQ ID NO: 60177 - DNA, 201 bp, Homo sapiens
cacaccacacacaccctccacacacacacaaacacaccacccactcacaccccccacaccacacacacgcgcacacacacacacacacacacacacacacmccctcgtctgtaggtccaacctctggtttggctttgagtgccccctcgtggttgaaacaggaacagcaggcaaaccccgcattttgggtgtggccagctg

SEQ ID NO: 60178 - DNA, 201 bp, Homo sapiens
ctcctgctcccgccctacctttggccctgtgccttctcaagcccatcctttctcgcttctggggacccccgcattgcttaaacttgcataaagcccacacyttttaatcttctctgattcattacagggtaaaagtggaactgaaagaatccaaagttggactattcaatgtaagttgtttttattgatgacatgattaga

SEQ ID NO: 60179 - DNA, 201 bp, Homo sapiens
gttccaaatttaatcttgcttttagaggggtttttttgtttttcgtttttttggttttttggttttttttgcacctcacctttccagagtatttatcttargttttcatagaaagaacccttatagctggggccgggcatggtggctcatgcctgtaatcccagcactttgggaggccgatgggggtggaccatttgaggt

SEQ ID NO: 60180 - DNA, 201 bp, Homo sapiens
atttccttggtacctggctcatgacaagcacttataaatatttgtaaatcagtgatcactgagcacatgtgtggaataatgtgactgcagtgatcagcacsgggccagaccagagctggggaactcactcagtcattctcttcccatgtttttcagatttgcgaaatgatccagaaatcagtgtcctccgatctacagcct

SEQ ID NO: 60181 - DNA, 201 bp, Homo sapiens
tagagtttgcagagaacattttcggtaaaaatctgtctctaattattatttattcaccaatctctttcaatgttgtgcttcaacctctagataagttggcygaaggcttcccccttcctctgctgaagcgtgttcagctctacgaccttgggctgcagatccataaggtcggtgggttcaggggggctctgaggatgtgtg

SEQ ID NO: 60182 - DNA, 201 bp, Homo sapiens
ctgtgcctccccttcccgctcccaggaacccatccagcctcaggaactgcccccagccatcgagccttggctacttaagggacctgggcccaatccacagytgggacagtcctggcccactgcactgggaatctaggatgggggccttggccagagccctgccgtccatactgctggcattgctgcttacgtccaccccag

SEQ ID NO: 60183 - DNA, 201 bp, Homo sapiens
gtctctttgctgcagataccgcctgactctaatatccgactgaccaccaagtccttccgacccttcgtcccacgggtaaggagtcccttagttccccatgwgtgcagaccgagcctactagactccagaggtttctctttaaaacctctgcatctctcagcttgaccaagagtgagaaggccgggatgagactcccactga

SEQ ID NO: 60184 - DNA, 201 bp, Homo sapiens; identical to SEQ ID NO: 11603

SEQ ID NO: 60185 - DNA, 201 bp, Homo sapiens
atcaccctcaccagggagcttgttaaaatgcagaggctcagccccaagaggaacatgatggatcaagatttgcatctaaacaagatccctgggggacttgmctgcacgtctttgtttctgaaaagctgtcctagtccccagccctcatctgcatttgggggaaacatgaggaacagagaggggtggagtttgttccaggtc

SEQ ID NO: 60186 - DNA, 201 bp, Homo sapiens
agcgggagcaccctaaaacttcttcatgtctctttgctgcagataccgcctgactctaatatccgactgaccaccaagtccttccgacccttcgtcccacrggtaaggagtcccttagttccccatgagtgcagaccgagcctactagactccagaggtttctctttaaaacctctgcatctctcagcttgaccaagagtg

SEQ ID NO: 60187 - DNA, 201 bp, Homo sapiens
tatagagtttgcagagaacattttcggtaaaaatctgtctctaattattatttattcaccaatctctttcaatgttgtgcttcaacctctagataagttgrccgaaggcttcccccttcctctgctgaagcgtgttcagctctacgaccttgggctgcagatccataaggtcggtgggttcaggggggctctgaggatgtg

SEQ ID NO: 60188 - DNA, 201 bp, Homo sapiens
tcagaactgcaggaattcataacatcattctctttcaagagtcagtgttctcaggagtgtgggcaccgtcatagaaaactatcgaaaaggagagtgaagcrttagagaactgctgagcttggagggaactcggagctcatttagtcccttgttcccgaagctccaagcacaatccgtggtcagcagcatcaccctcaccag

SEQ ID NO: 60189 - DNA, 201 bp, Homo sapiens
ccacaaaggatcgtcactgacgttactacttttattttgtaagcccgcatgtctcagggctcatgtgtgtgtgtctgtgcgtgtgcgtacacaggcacacrttcagatctgcaggtgatgtggcttggggagaggctgccataaatattaaactcccaactccaaagtaccctgcagagattcagaactgcaggaattcat

SEQ ID NO: 60190 - DNA, 201 bp, Homo sapiens
gttcggttgggcagaaaatggtcaactgcttgaccaagggttaaacagcaggggctaaacagagactccagcccctccctctgctccaccttgctcagtgycccacactgccctgcattccaccaaggtccgaaaggaaaccattcctcaggcgcctgcaagagaccaggcaggaaagctcagcgagggcgtgggccaggt

SEQ ID NO: 60191 - DNA, 201 bp, Homo sapiens
gcggaggttgcagtgtgctgagatcacaccactgcactccatccagcctgggtgatggagtgagactctgtctcaaaaaaaaaaaaacaaaaaaaatactrtatctggctacagtagtattcccaatgcctgccacatagttggtgatcagtaagtatttattttaaaaatgatctgggatttcaacccacatctgcataa

SEQ ID NO: 60192 - DNA, 201 bp, Homo sapiens
gtacttgggcccaaagcccagggaggacaaatcatttgcccaggtcatggagctgttgtggggcacgctggggacaaagctccaagtccgttcggttgggyagaaaatggtcaactgcttgaccaagggttaaacagcaggggctaaacagagactccagcccctccctctgctccaccttgctcagtgccccacactgcc

SEQ ID NO: 60193 - DNA, 201 bp, Homo sapiens
tcctgtcccccacccccccgcaaaagaaaagaaaaatgtggattctcaagccgcttccccaaatctgctgaatgtgatcatgcgattgggtgccgcaggcrctgggaagccagacacaccgaatcaggctggatgtgctgggacacagcagggcgccgggaaggggtggagagggctccctttgtggactggcctgaccag

SEQ ID NO: 60194 - DNA, 201 bp, Homo sapiens
tttagacgtacttgggcccaaagcccagggaggacaaatcatttgcccaggtcatggagctgttgtggggcacgctggggacaaagctccaagtccgttcrgttgggcagaaaatggtcaactgcttgaccaagggttaaacagcaggggctaaacagagactccagcccctccctctgctccaccttgctcagtgcccca

SEQ ID NO: 60195 - DNA, 201 bp, Homo sapiens
ttcttcttactatactgtaaagactatatctgaccaggtgcagtggctcacgacctgtaatcccagcactttggaagtctgaggcaggtggatcacttgarcccaggagttcgagaccagcctgggcaacatggcgaaacccagtctccactaaaaacacaaaaattagccgggcgtggtggcacacacctgtagtcccag

SEQ ID NO: 60196 - DNA, 201 bp, Homo sapiens
ctgggaagccagacacaccgaatcaggctggatgtgctgggacacagcagggcgccgggaaggggtggagagggctccctttgtggactggcctgaccagkgaccagggcctggctttcccaggcacccggccatccccaagttcagtggcagactgtgcttctctccccaggtggctgttgaacctcttccacaaccaga

SEQ ID NO: 60197 - DNA, 201 bp, Homo sapiens
cctcaagagctgtgtgactttgcaaatgttccttaacctctctggccctctatttcctcctttgaaaaggagagttaaaatcttgccctctcggcatgagkttattgggaagaatcagaggtatgattgatagggtcatggcacagtggttaagagtatgaaccatgatcccagatatcttgggtttaaatcccacgtctg

SEQ ID NO: 60198 - DNA, 201 bp, Homo sapiens
agaagcagactttagggcaagaattccagtgcaatactttatcttggaagcgatctgaggaaacccacaggggagtggggaagtgaggaagggaagggaarggaaggaagtcagcctggtgggcaagtgaagctctgtctagctggggaactcagggacagcggagaacacgcctctgagttactccagccccacgctgtc

SEQ ID NO: 60199 - DNA, 201 bp, Homo sapiens
agccctgtccctgggtctatctcttcaggcttatgatcctatttaatcctcatgacaaccgctaaaggtagccaaggttgcccttgtttttcagatgaggmgtctctagaaaagtcgtgtggcctgctaagctaactgttcagagcctgggctctggagtcacctggcggtggtttcaaacataaatccggccccctcaag

SEQ ID NO: 60200 - DNA, 201 bp, Homo sapiens
aggtccctggtgaggctgggtccaggcccagggctgacacctccttccatgtctctcccttcagcctgaacatccacagctgtgagctgcttcactctgcrctgaggcctgtccctggccagggcctgagtctcagcatctccgactcctccatccgggtccagggcaggtggaaggtgcgcaagtcattcttgtaagttg

SEQ ID NO: 60201 - DNA, 201 bp, Homo sapiens
agcaggaactgcaaacccaaagggatatgtctacggaccttctcaggatgccaccgggggtcattagattcatgggttctgatgcagactgcaaaaccgtragcaattgcatcccttcctcaaggttctatttccccctttgtggaaagggagcaagaacactgctgaccccttcagtgtggcccatatggcatgaagaaa

SEQ ID NO: 60202 - DNA, 201 bp, Homo sapiens
ttggagagtgaggaagagagagcctcaggattgggctgtggggggacctctccggggcggacagtgggatagttccctgaagagctcagaaggaaattctrggaaggaattgagctcctccactcagtcacgcagcaaatattaaggaagacctactggctgtgtgatctgagccttgatttccttatctgtaaaatggag

SEQ ID NO: 60203 - DNA, 201 bp, Homo sapiens
gtgaaggttgtttggggactttgtcaaagtcacccagctagaaagatgccctctttctctagcccccagatccttccagtttcttctacacaggccagatrtcatggagaacaagaaggaggactatccgtccaagcgcacagcacttttgcccttggggatttgttggcaaaggcattccatttcctcatcagtaaaatg

SEQ ID NO: 60204 - DNA, 201 bp, Homo sapiens
agccatccacatgtccttcagaagtggcacctctgctggtgcaggtggcatttgacacagccctatgccaccaccacatcccatccctaccatgaggggcytgagggaagctcaagaccagctcgttttgaaaatactgcgggccgggtgcagtggctcacgcctgtaatcccagcactttgggaggctggggcgggcaga

SEQ ID NO: 60205 - DNA, 201 bp, Homo sapiens
ccaaaatatattttcctattagtacacagagatcttctgcatttgatttttaaaatttaacacagctacataatattccacatttgtgtatgtacaaaacracttcttcattcttatttaaagatgcataggatctcctggtgaaagatacaatttatttaaccagttcctacttatgggtcatcaggttgttttaaaact

SEQ ID NO: 60206 - DNA, 201 bp, Homo sapiens
aactttccaaaatttttctattcacttgcataccaaatgttcatctcaaaagagttttatcttataaaatagtagcatgatgtaatactagtttgcttttyccaagcgttttgctatgttggcacacacagaaccaccatgtggccctgtggcgatgtaaatatatctctcctgttctcttccaggcagagctgttggaag

SEQ ID NO: 60207 - DNA, 201 bp, Homo sapiens
aatatactgaatatagagtttgcagagaacattttcggtaaaaatctgtctctaattattatttattcaccaatctctttcaatgttgtgcttcaacctcyagataagttggccgaaggcttcccccttcctctgctgaagcgtgttcagctctacgaccttgggctgcagatccataaggtcggtgggttcaggggggct

SEQ ID NO: 60208 - DNA, 201 bp, Homo sapiens
accctccttgctgcagtcatgagccttcctgaggaacacaacaaaatggtctactttgccatctcggattatgtcttcaacacggccagcctggtttatcrtgaggaaggatatctgaacttctccatcacagatgacatggtgaggatggtggcaaacaggtctctcaaatgaacacataacctaccgctccttccttct

SEQ ID NO: 60209 - DNA, 201 bp, Homo sapiens
tgacctcaggtgatctacctgccttggtctcccaaagtgttgggattacaggtgtgagccaccatgcctagcctgcatttctttctaagagcccaagatgwagcttagaagaaaagacactagcatgccaggatagtccatattgtgctgtaagtgaaggcagcatggagaagtcttggcaatataggtaacaaggtcagg

SEQ ID NO: 60210 - DNA, 201 bp, Homo sapiens
tgtgcttcctccagacagcaccatgcctgatagcttaggctcccaagtcagcctccctgggtttaaatcccctttctgacacttcctgtgtgacctagaayaagttacttggccactctgtgcctcagtttccttatctgtaaaatggaaagaataatcacacctacctcatagtcttggaaatcactaaatgggaatata

SEQ ID NO: 60211 - DNA, 201 bp, Homo sapiens
cctcaccggtgtcttccaggccgctattctgatttaatttgtctccataactaagcacagttcatcatctctaacagaatcctttcatctcctgacaatcytactttccacatccccagcctggggcctaggcgtaggtaagagaattaaattactggaggaaaaggcaggcaggctatagccagttgaggtctccttcca

SEQ ID NO: 60212 - DNA, 201 bp, Homo sapiens
gaaatctttcatcgtaaccaccgttctccagttaccctccttgctgcagtcatgagccttcctgaggaacacaacaaaatggtctactttgccatctcggrttatgtcttcaacacggccagcctggtttatcatgaggaaggatatctgaacttctccatcacagatgacatggtgaggatggtggcaaacaggtctctc

SEQ ID NO: 60213 - DNA, 201 bp, Homo sapiens
ctctaccccaacatgaacctggaactccagggatcagtgccctctgctccgctcctgaacttcagccctgggaatctgtctgtggacccctatatggagayagatgcctttgtgctcctgcccagctccagcaaggagcctgtcttccggctcagtgtggtaaggttcagagcctttgcaaatgctgtttccttttcccca

SEQ ID NO: 60214 - DNA, 201 bp, Homo sapiens
agggctctcctgggggctgtatgaccgtgggcaagtcacttctctctgagcttagtgacctgcctgtgacatgggatcgttgaagttggcctcatctcccyccagggctctaatgagggttgggggctgggacagctctttggagcacgggaaacctccttataagcgggacagagggacacatggaagtgccccacatcc

SEQ ID NO: 60215 - DNA, 201 bp, Homo sapiens
taatggtggagtttcaggcagtgttccagccagcgtcccttcatcggactgtgtaggggaatacctagcccctgccccacgataggctttgaaaagtccarttggaccctatttccctctccagggtgaaatctttcatcgtaaccaccgttctccagttaccctccttgctgcagtcatgagccttcctgaggaacacaa

SEQ ID NO: 60216 - DNA, 201 bp, Homo sapiens
gaaccaccatgtggccctgtggcgatgtaaatatatctctcctgttctcttccaggcagagctgttggaagcgctcctcaactattacatccttaacaccytctaccccaagttcaatggtaagaatcactgtggatttttccaagtcaaaagtgaacactgctgtctggaggaaagagagttggacttggaaaacagggc

SEQ ID NO: 60217 - DNA, 201 bp, Homo sapiens
catttgatttttaaaatttaacacagctacataatattccacatttgtgtatgtacaaaacaacttcttcattcttatttaaagatgcataggatctcctrgtgaaagatacaatttatttaaccagttcctacttatgggtcatcaggttgttttaaaacttttgcttttataaataatgtttcagtgaatacctgtatt

SEQ ID NO: 60218 - DNA, 201 bp, Homo sapiens
ctgacctcaggtgatctgccctcctcggcctcccaaagtgctgggattacaggcgtgagccaccacgcccagcaaatgtattgttgtcattgctatttgayagatgaacaaagtgaaggttgtttggggactttgtcaaagtcacccagctagaaagatgccctctttctctagcccccagatccttccagtttcttctac

SEQ ID NO: 60219 - DNA, 201 bp, Homo sapiens
gctacttgcattgaaactgtaaatcagggaagtttctcttttgttcctttgcactgtgcacacacaccatgtttatgtaaccagtcctctgaggttggacrttttggtcctttccatattttttttttttttgaaacggagtctcactctgttgccaggctggagtgcaatggcacaatctcagctcactgcaacctccga

SEQ ID NO: 60220 - DNA, 201 bp, Homo sapiens
aaagactcaaggatatggacaggcactgaccacatgtcttctcacatccctagagcctcaattgccttacctattaaatgagataacaacattcccttagrtagggttgttgggagcccagactggctcgagacaggcagagggaaatcagggaaggattccaggatatagtaaaatggaaaagacagtgggaattaccca

SEQ ID NO: 60221 - DNA, 201 bp, Homo sapiens
atactgaaacaaagcctcccgactatccaggtggcatgggaactgggatatttatacaccacagtgattgattgagggcttctgggccgggggtttgtcarctccccagcacttctgtcctgttgcatgtacctgctttctgcagttccaggacaaaaagcctcgggacatacaggctcagggaggcagacattggcagct

SEQ ID NO: 60222 - DNA, 201 bp, Homo sapiens
ccaccacctctgatgatgggaaccactcagctgggaaaattctgcgtaaagtttggaaacacatgcctctgaactggaagtcagaattgtggtcacctctrgaggcaggcagagaccctgaagggcatgagggaggtctgccggggtgctggaagttgccatatcttgatccaggtggtgatcacattcctgtataaacat

SEQ ID NO: 60223 - DNA, 201 bp, Homo sapiens
ccagccaccacctctgatgatgggaaccactcagctgggaaaattctgcgtaaagtttggaaacacatgcctctgaactggaagtcagaattgtggtcacytctagaggcaggcagagaccctgaagggcatgagggaggtctgccggggtgctggaagttgccatatcttgatccaggtggtgatcacattcctgtataa

SEQ ID NO: 60224 - DNA, 201 bp, Homo sapiens
tcagtttcctcatctgctaaaccaggccttcctagccgagctcttaagagactggctgagatgaggcaagatgaacagtgatgaatatggggtctttctgkggggagggtggacagggatgatcataggagtcaggcttcctcatccactgatctaggcagtgaaaactggcttctaagtatgaccttatgacttcagtga

SEQ ID NO: 60225 - DNA, 201 bp, Homo sapiens
aaacatttattttttaaataaacgagccaatatattttaaaaaagagagtttggttggtgccagatgtagcttcactctcaaccctgccgtctgctggggrtgagatctcaagggagctatgtggcttttttgaacctcagtttcctcatctgctaaaccaggccttcctagccgagctcttaagagactggctgagatga

SEQ ID NO: 60226 - DNA, 201 bp, Homo sapiens
aaaaaatgaaaaaagaaaaaaaaattgtacgtatcaacaagcaaaaacttttttaacacttataattctacccccacaaccagagacaatgcctcatgacyccttgctaaatattttccagattgttgaacatagaagcctattttgaaccccccaaaatagaaccttactctatggtgccattggaaacggatgcctcat

SEQ ID NO: 60227 - DNA, 201 bp, Homo sapiens
gcgcaaagggttctgggacctcagaggggaccctttctagaatccagagaagcatgggagtggtcagggaaggcttcctgggggtgagggcaaagcagaaytcacaaatgtaagcagggctggggcaaaactctaaaaattaaacacagtctgtactataaattttgttttccagaatgaaattttactatctttacttac

SEQ ID NO: 60228 - DNA, 201 bp, Homo sapiens
gcctccccatttaaacaagtactacaaccatatatacttttttttttttttttttgagacagagcctggctctgtcacccaggctggagtgcagtggtgcratcttggcttactgcaacctctgcctcccaggttcaagagattcttgagcctgagcctctggagtggctggaactacaggctcccgccaccactcccagc

SEQ ID NO: 60229 - DNA, 201 bp, Homo sapiens
cagtgagctgtgatctcactacttcactgcagcctgggcaacagagtgagactgcatctcaaaaaaaaaaaaaaaaatatatatatatatatatatatatwtttatatgtgaatgaggcaagataatacatgcactgataaatgcatatattttcagagaaaaggaaataaagaccaagtgaaaataaagcacaattataa

SEQ ID NO: 60230 - DNA, 201 bp, Homo sapiens
gagtcccatagcaggttctgacgccctgaaatctgactgtaaacatatgagtatcctggacagctccaacctgtagagaaggactggccttgggacaggakgttctgatctcaataaccggaagaactggactgtcaaagaaccttcaagagaccacagactcattgctgtgtagatctcattctcacacaaaaccaagat

SEQ ID NO: 60231 - DNA, 201 bp, Homo sapiens; identical to SEQ ID NO: 11601

SEQ ID NO: 60232 - DNA, 201 bp, Homo sapiens
agttagccaggctctaccccaacatgaacctggaactccagggatcagtgccctctgctccgctcctgaacttcagccctgggaatctgtctgtggacccstatatggagatagatgcctttgtgctcctgcccagctccagcaaggagcctgtcttccggctcagtgtggtaaggttcagagcctttgcaaatgctgttt

SEQ ID NO: 60233 - DNA, 201 bp, Homo sapiens
tttcattaaaagacataacactgcctttaatggtggagtttcaggcagtgttccagccagcgtcccttcatcggactgtgtaggggaatacctagcccctsccccacgataggctttgaaaagtccaattggaccctatttccctctccagggtgaaatctttcatcgtaaccaccgttctccagttaccctccttgctgc

SEQ ID NO: 60234 - DNA, 201 bp, Homo sapiens
gacctggacttaaattcctgctgggtgactgcagcctacatcacttcaccctgccaaacctcagtttcttcatctcaagacaagactaaaatatccacctkgggttgctgatgcaaggatgagaggagacgtgcagcttaaccagcacagcgcctgcacatagtaggtgctcaataaatatcagtttctttccaatttctg

SEQ ID NO: 60235 - DNA, 201 bp, Homo sapiens
agcaaagcttctggtgagcttttcattaaaagacataacactgcctttaatggtggagtttcaggcagtgttccagccagcgtcccttcatcggactgtgkaggggaatacctagcccctgccccacgataggctttgaaaagtccaattggaccctatttccctctccagggtgaaatctttcatcgtaaccaccgttct

SEQ ID NO: 60236 - DNA, 201 bp, Homo sapiens
ccaaagcctcccaaaggctggctccttaccctgaggcctctgctcagcttgttgcctcccaagagaaccctgccctgaccagagttttggaatggcatcckgcagacctggacttaaattcctgctgggtgactgcagcctacatcacttcaccctgccaaacctcagtttcttcatctcaagacaagactaaaatatcca

SEQ ID NO: 60237 - DNA, 201 bp, Homo sapiens
gtagcaaagcttctggtgagcttttcattaaaagacataacactgcctttaatggtggagtttcaggcagtgttccagccagcgtcccttcatcggactgygtaggggaatacctagcccctgccccacgataggctttgaaaagtccaattggaccctatttccctctccagggtgaaatctttcatcgtaaccaccgtt

SEQ ID NO: 60238 - DNA, 201 bp, Homo sapiens
acaatcagactcgtagcacattgtacccctccctgctcactgctgttgggcgtttccttcattcctgccttcttttattcagtccatcagcaaaaatctaytgggcacctactatgtgcccggcaaataaaatagaacttgaccgttcttttcccactgtgacaaccttgctgacttttttggggtcttatcttaaggctg

SEQ ID NO: 60239 - DNA, 201 bp, Homo sapiens
agccagggacatccttaaactgctgccagaggaagagtgacatctatgtccccataagatccttatgctccagaatgtcctcccccactctcctcccctcytgggcaggctgaggtccaggaagcaaaggcccctaggcacactggggatgcacctgtgagccctttcctgctccaaagcctcccaaaggctggctcctta

SEQ ID NO: 60240 - DNA, 201 bp, Homo sapiens
caacatagcaaaaccctgtctctattttagaaagaaaagttaaaaaagaaagaaagaaagaaagaaatgttctgtggaatatcatattaaaagagtaatamgagaaaattaaatattttttttaaaaaagaaatggtgggatccagctgtgtcatatttcgaaaacactggcatctgacctcagcatgcccaattagcaga

SEQ ID NO: 60241 - DNA, 201 bp, Homo sapiens
ttcaaactattattctgaccaagcattttgtggtctatctgtgcttccaattttcaggttatcttttgaggtgagatgaactgggttggcggactcattakcaggagggggatgctgcgctgtgcctggtacattgttaacaacagaaaataatagccattaaagggaatgaagggcaggggggatgattagggacctaga

SEQ ID NO: 60242 - DNA, 201 bp, Homo sapiens
tgcactccagcctgggcaacagagcaacactccgtcaaaaaaaaaaaaaagaaagaaaaaaaaaagaaagaaaatactgtaagtcctagacgtagcattargtcaggttctgaaagtcatttgtaagttttaagcttttcttctaaattttaaggttgaagagctttattataaatacctgtttggcatgcctccccattt

SEQ ID NO: 60243 - DNA, 201 bp, Homo sapiens
cagtggctcacgcctgtaatcccagcactttgggaggctggggcgggcagatcacgaggtcaggagtttgagaccagcctggccaacatggtgaaaccccrtctctattaaaaatacaaaaattagctggacatggtggcaggtgcctgtaatcccagctactcaggaggctgaggcaggagaattgcttgaatccaggag

SEQ ID NO: 60244 - DNA, 201 bp, Homo sapiens
cacatcaacaaagaaaatattgacgtatgaacccaaatgttttaatggtggagtttcaggcagcgtctccagtgccccctcttcgagctgtgtcagtgaargcccacagctattctttgaaaatggtctcttgattgacattgcccttggtctttcctgcataaaacattaaactgctacaaattccatcccaggtttctt

SEQ ID NO: 60245 - DNA, 201 bp, Homo sapiens
ctgagatgaggcaagatgaacagtgatgaatatggggtctttctgtggggagggtggacagggatgatcataggagtcaggcttcctcatccactgatctrggcagtgaaaactggcttctaagtatgaccttatgacttcagtgatgtcgcaagcaggttccagtccctgtgcctccccttcccgctcccaggaacccat

SEQ ID NO: 60246 - DNA, 201 bp, Homo sapiens
aatttggggtgagttcataaagtgaaagcaagtttattagagaagtaatgacggaaaagaatggctactccacaggctaagcagcaacatgggctgctcaktcgcgtatacttgtggttatttcttgagtctgtgctaaaggggtggattattcatgagttttcctggaaaggggcgaggacttcccagaactgagggttc

SEQ ID NO: 60247 - DNA, 201 bp, Homo sapiens
cctgggtgacaaggtgagatcctgtcccccacccccccgcaaaagaaaagaaaaatgtggattctcaagccgcttccccaaatctgctgaatgtgatcatrcgattgggtgccgcaggcactgggaagccagacacaccgaatcaggctggatgtgctgggacacagcagggcgccgggaaggggtggagagggctccctt

SEQ ID NO: 60248 - DNA, 201 bp, Homo sapiens
tcaaaaaatgaaaaaagaaaaaaaaattgtacgtatcaacaagcaaaaacttttttaacacttataattctacccccacaaccagagacaatgcctcatgwctccttgctaaatattttccagattgttgaacatagaagcctattttgaaccccccaaaatagaaccttactctatggtgccattggaaacggatgcctc

SEQ ID NO: 60249 - DNA, 201 bp, Homo sapiens
agttgaggttgcagcgagcgatgttcatgccactggactcctgcttgagcaacagagtagactttgtctcaaaaaatgaaaaaagaaaaaaaaattgtacktatcaacaagcaaaaacttttttaacacttataattctacccccacaaccagagacaatgcctcatgactccttgctaaatattttccagattgttgaac

SEQ ID NO: 60250 - DNA, 201 bp, Homo sapiens
tgcctgccaccacgcccagctaattttttgcatttttagtaaaggcagggtttcaccatgttagccaggttggtcttgatctcctgacctcatgatctgcytgcctcagcctcccaaagtgctgggattacaggcgtgagccaccgcgcctggcctgactcccagtcttttctccagttaatctttcctgggtttttgatg

SEQ ID NO: 60251 - DNA, 201 bp, Homo sapiens
cataggagtcaggcttcctcatccactgatctaggcagtgaaaactggcttctaagtatgaccttatgacttcagtgatgtcgcaagcaggttccagtccytgtgcctccccttcccgctcccaggaacccatccagcctcaggaactgcccccagccatcgagccttggctacttaagggacctgggcccaatccacagc

SEQ ID NO: 60252 - DNA, 201 bp, Homo sapiens
acattcagttggttgaggccatcatgaaaacctgcccaatttcaagggaagggggcagaaacattaccttttgatggaaggaatatcaaagaattcgtggrcatatttttaaaggaccacaattatcaaaaagcagagtggttaatgctgtggtggggaaagcgcaaagggttctgggacctcagaggggaccctttctag

SEQ ID NO: 60253 - DNA, 201 bp, Homo sapiens
aaagagagttggacttggaaaacagggctctcctgggggctgtatgaccgtgggcaagtcacttctctctgagcttagtgacctgcctgtgacatgggatygttgaagttggcctcatctccctccagggctctaatgagggttgggggctgggacagctctttggagcacgggaaacctccttataagcgggacagaggg

SEQ ID NO: 60254 - DNA, 201 bp, Homo sapiens
gcctctctttcaatgggatgataatagctacgttttatggagcactcaccatgtgctgggccttgtgctaggatgttcgtttaggcctcacagtgactcgraggtggggactattgttatccccattttatggataaggaagttgaggttcagggagatggaagggctggcctgagatcacaaagtcaggacacaaaccga

SEQ ID NO: 60255 - DNA, 201 bp, Homo sapiens
aaaattattctgccttgggatcctgttgatctgtgaccttacccccaaccctgtgctctctgaaacatgtgctgtgtccacccagggttaaatggattaakggcggtgcaagatgtgctttgttaaacagatgcttgaaggcagcatgctcgttaaaagtcatcaccactccctaatctcaagtaccccgggacacaaaca

SEQ ID NO: 60256 - DNA, 201 bp, Homo sapiens
ggacaacacagctggccctagagtcccatagcaggttctgacgccctgaaatctgactgtaaacatatgagtatcctggacagctccaacctgtagagaargactggccttgggacaggaggttctgatctcaataaccggaagaactggactgtcaaagaaccttcaagagaccacagactcattgctgtgtagatctca

SEQ ID NO: 60257 - DNA, 201 bp, Homo sapiens
attgcactccagcctgggtgacaagagcaaaactccatctcaaaaaacaaaacaaaaaaagaaagcattgctgtccttcaacccagcaactccacctctargaatgttttcctgaaaagaatagccaagggtgctcacaggaggtggtcattataatggcaaaaccctggagacaacttgatgcccaatagagtttaatcc

SEQ ID NO: 60258 - DNA, 201 bp, Homo sapiens
ctactttgccttgcccatcatgcagaaaaggccaatcagagcgggtcttagggagtgtagatgggcctagggcatatagaggggctggccaggacttcctrtgggttaatgtagcaaagcttctggtgagcttttcattaaaagacataacactgcctttaatggtggagtttcaggcagtgttccagccagcgtcccttc

SEQ ID NO: 60259 - DNA, 201 bp, Homo sapiens
tgatgtttaaggtgagggtcctggggccgggctgcgtgggtgaggctttccctcagggtcagccattctttgggccacctgtccccccaacttcagatctrtcctcatcctcccagtggttcccgctttgtcaagggccgggtgatatggagtggtggggagtgtttccagagctaggattctcccacggctgtcttacac

SEQ ID NO: 60260 - DNA, 201 bp, Homo sapiens
acaagtcatttcatctcttctagtctcagtttccttgattagaaaagtgtgaccgggtgtggtggctcacgcctgtaatcctaacaatttgagacgccaargcagaaaatcgcttgagctcaggagttcaagaccagcctgggcaacgtggtaaaacctgtctccacaaaaaaatacaaaaattagccaggcatgatggca

SEQ ID NO: 60261 - DNA, 201 bp, Homo sapiens
cccttgccactttttcttgtaacaccccattatctttcttctcagcgtttactacaaagatactttgtagctgtctgcaggtgtatttgtttaatgcatgwatctctcactatgtgagtctgggctattgtggggagaaaggtatactggtgtttgtctatttgtctattttgaccttggaagactacatttcccaagctt

SEQ ID NO: 60262 - DNA, 201 bp, Homo sapiens
tcctcctgcttgccattggccaagggctgcttccaggggctctggctctcaggcactttgaacagttctctgacctcagaggcacttggatggaaggggtrttcatgtgctagggctgccataacaagcatagactgggtggcttaagcagaaatgtgttttctcacagttctggaggctgagggccaaggtcaaggtttt

SEQ ID NO: 60263 - DNA, 201 bp, Homo sapiens
cgaagtctgtgtgaccgcaaacctcaccctcgcagaccctctgagtgggagccacacatcagctgccccccggggagagcgggcaggatgctgaagtcccmtgtgctctccttgggtgaatgcaggacaggcatctcctccctgccagggtaacccaggctgtggagaagcgacagtcttgcacatccccctgtctcccca

SEQ ID NO: 60264 - DNA, 201 bp, Homo sapiens
catgatttcatgattcatggtgaaaaggagagacagtcttcctcacacccccaaaacaactgtttccaatgtggctttgtataagggagactgaattttayagtggatctcacctttaatggttctccagtttatctaatatttctgggtttcaaaaagttgtttcttgaagcacttcataaaagttgaggcctcatgaat

SEQ ID NO: 60265 - DNA, 201 bp, Homo sapiens
gagtttctctcttgttgcccaagctggagtgcaatggcatgatctcggctcactgcaacctcggcctcccaggttgaagtgattctccagcctcagccgcytgagtagctggaattacaggcgcccgccaccatgcccagataatttttgtatttttagtagagacttggttttatcatgttggccaggctggtctcaaac

SEQ ID NO: 60266 - DNA, 201 bp, Homo sapiens
gtatcttctggaaaatttaaaattacatgtgtggctctcattctattgctttagaaagacggctggtttatatgttacctacatatgcacatttgttctasttccatgaaaggaactggccacactctcttaccctggcttttgtcactgaagtatcttaaatatctctttctatgggcatatgactatctacctcatttt

SEQ ID NO: 60267 - DNA, 201 bp, Homo sapiens
ataatcctagcactctgggaggccaaagtgggggggtagcttgaggccaggagttcaagaccaacctggacaacatagcaaaaccctgtctctattttagraagaaaagttaaaaaagaaagaaagaaagaaagaaatgttctgtggaatatcatattaaaagagtaatacgagaaaattaaatattttttttaaaaaaga

SEQ ID NO: 60268 - DNA, 201 bp, Homo sapiens
tcccactgaaggctggggtgctgctcctttcaaagcctaaataacagaggccacgccccatatcttgtgggaccacagcttgtccaatcttttattggtgytatctaagaatcccaaggaatgctggcatagtccataaaatgtaccctaatgaacagcagctaacaattacagggggcttcctaggtgccaggcatgttc

SEQ ID NO: 60269 - DNA, 201 bp, Homo sapiens
ctcagacggtccagcttaccctggtataagtcaggggccgtctggtagatcgagggtcattttgtccttctgatggcctcctacacctgcacaggccttcrcttctggcatcgtgtttggtttacccatcctactgcggcacgggcctctctttcaatgggatgataatagctacgttttatggagcactcaccatgtgct

SEQ ID NO: 60270 - DNA, 201 bp, Homo sapiens
gcataactcaaaacatttatgccagtgattctcaatgtatgatccagggctgtctgcctgaatgggcctgaccccaagaatcagagcccctggctggccasaactctggatttatcctctccagttcagcaataggctcacagtgtaacctgggccagttctccctctctaggtctcagtttccccatctgtaaaagtaag

SEQ ID NO: 60271 - DNA, 201 bp, Homo sapiens
ttttactttggcaaccaagaaactcaaagccaaagttctttctcccatggctgggtgtggtggctcacgcctgtaatctcagcactttgggagcctgaggygggcggatcacttgaggtcaggagcttgagaccagcctggccaacatggcaaaaacctgtctccactaaaaatacaaaaattagccaggtgtggtggtgt

SEQ ID NO: 60272 - DNA, 201 bp, Homo sapiens
aggagccatctacaagtggagtctctggatccagggtgcacacattaagctcggagggggagaccctggcaaattatctgagatgttctctgatgccttakctcctaagcccctatgcggttatttgctgacatcacctttaccagaggtccaggtcggcaacccggtactgggacttggaacattcatccattcagggtt

SEQ ID NO: 60273 - DNA, 201 bp, Homo sapiens
tgtcaagggcatcagcatttcggtcaacctcctgttgggcagcgagtcctccgggaggcccacagttactgcctccagctgcagcagtgacatcgctgacrtggaggtggacatgtcgggagacttggggtaggtctccatcggggcactgccagctggactcctggttgcagctcccggccaatccagcgctcagcctgg

SEQ ID NO: 60274 - DNA, 201 bp, Homo sapiens
cactcccagcccttgtcttctcagaggaaagaattcaattgagagacgcaggcaagttttaaagcagaggcaaaggtttattgaaagaagcaaagtacaaytgagagatcaagtgccccgctcaacctttggctcggggcttttatacactggcttggttctggggtttcttctcctccttgattcctcccttcggtgggc

SEQ ID NO: 60275 - DNA, 201 bp, Homo sapiens
agaaaatggtcaactgcttgaccaagggttaaacagcaggggctaaacagagactccagcccctccctctgctccaccttgctcagtgccccacactgccytgcattccaccaaggtccgaaaggaaaccattcctcaggcgcctgcaagagaccaggcaggaaagctcagcgagggcgtgggccaggtgggaactgggcg

SEQ ID NO: 60276 - DNA, 201 bp, Homo sapiens
atggctgggtgtggtggctcacgcctgtaatctcagcactttgggagcctgaggcgggcggatcacttgaggtcaggagcttgagaccagcctggccaacrtggcaaaaacctgtctccactaaaaatacaaaaattagccaggtgtggtggtgtgcgcctgtaatcccagctacttgggaggctgaggtgggagaatcgc

SEQ ID NO: 60277 - DNA, 201 bp, Homo sapiens
gttttaatggtggagtttcaggcagcgtctccagtgccccctcttcgagctgtgtcagtgaaggcccacagctattctttgaaaatggtctcttgattgasattgcccttggtctttcctgcataaaacattaaactgctacaaattccatcccaggtttctttaactgcaatgagaatttaaagacatttgcaaagccat

SEQ ID NO: 60278 - DNA, 201 bp, Homo sapiens
gcccttctagggctaggtgtcttgggaaagatggagatctcacctgacccctgatccttagagatcttcgaattatcttccagaaaaactaagagcctgaygcaggcctttctaattccccactcagggtgggatgtggtacctggaccagcaaggctaaggagaagaataagcactcacgaatgcttgctctctgggcga

SEQ ID NO: 60279 - DNA, 201 bp, Homo sapiens
ggcccacagttactgcctccagctgcagcagtgacatcgctgacgtggaggtggacatgtcgggagacttggggtaggtctccatcggggcactgccagcyggactcctggttgcagctcccggccaatccagcgctcagcctggcctccgataattgcaatgatccaggtggcttgcacaggcacttgaagatcattctc

SEQ ID NO: 60280 - DNA, 201 bp, Homo sapiens
ctgggtccaggcccagggctgacacctccttccatgtctctcccttcagcctgaacatccacagctgtgagctgcttcactctgcgctgaggcctgtcccyggccagggcctgagtctcagcatctccgactcctccatccgggtccagggcaggtggaaggtgcgcaagtcattcttgtaagttggctctgctcccaggc

SEQ ID NO: 60281 - DNA, 201 bp, Homo sapiens
tcacctgacaaggggacccttgtcaggtgaatgaaatctggctatttggaggaacacagaaactttggttgaaggagagtttgcgaaaaacatacaagtcyttggacaagtcatttcatctcttctagtctcagtttccttgattagaaaagtgtgaccgggtgtggtggctcacgcctgtaatcctaacaatttgagacg

SEQ ID NO: 60282 - DNA, 201 bp, Homo sapiens
ttggcaggaagagctacgggataaaggcttagaagttaaattactgggccaaagagtatgtatgttagaacgaggagagatctcactgatttgtgtttcaraaagcttgtgccaatgtgcactctcccagccacagtgtctgggacttctgtttactcgtacattcaatagcattgagtactaaaacttcaaaagtttttt

SEQ ID NO: 60283 - DNA, 201 bp, Homo sapiens
caagcctcagtgtcctctcctgtcaaatgaggctgggaagagctcttggcgggattattttggaaattgatgggttcaggttaagcttccgtgggtgcccwgagaataaccaggtggtggtcaatggatgacacaattagatcacctgtcatacttggtgtccccagaagcagaccctgaagaaaagaggtgagtacaagt

SEQ ID NO: 60284 - DNA, 201 bp, Homo sapiens
tcagcaaatattagtggacatagtcaaacatttttccccaccacatatgttcttaaagtttaaattaatgtttgtaatgatagctgaaagcagtgtcacayatttcttggaaatgctatctaaaactattcttatggctccaagtaactttgaagttttcattaaggcaggatctctgattcaaattaagctttttgtcct

SEQ ID NO: 60285 - DNA, 201 bp, Homo sapiens
taaaataagctaagaattatttatgtcactgatttacaggaaatcgaaaaatagaaaccaaattttcctacctattccttaaactattggatcaaattcartgtgtatcatgacaaatcaatgtatttgtttgataccaatattatttctccatgaccttttccttaatatgcatgtcccctattctatttagccaacaat

SEQ ID NO: 60286 - DNA, 201 bp, Homo sapiens
aatatgcaaattagcctgacaacagtatgcccaatgagagggagctgatatgaacaaaatggacttgggagccagactgaccagagttccaatccctttgmcacttctactttgtaaagttggcttcaacccagagtggatattataactctctccaatatagcagatagatgatatgcccgaaatactgtatgtacaagt

SEQ ID NO: 60287 - DNA, 201 bp, Homo sapiens
atctttgggacactcatgagaagagttattgtacagtgctattcaaaatatgacccacaacgatttgttactgcttcatgacaagtacaaaacaggagaawaagtatatagaagcttttattgaaatttacagagtaatttcacatctgtttaataaaaatttttccttatttttctagaaaatcatttttactgtatttt

SEQ ID NO: 60288 - DNA, 201 bp, Homo sapiens
agccactttggtagtatggaaagaaaagggtaaaccatgaaggttttttaaatagcacactgggtttcagaagtgattttgtcaaataaaatttcattatrgactttaacagaggctgaaagacagccagataacatgattgtgccactccaagcagtccttcagggttggttaatctaccaaataagaatctagccatgt

SEQ ID NO: 60289 - DNA, 201 bp, Homo sapiens
ttgcacttaatggtagatgttttaggatctttataaatagtaattaatcctcctaacaaccctttgaggtagatagcattattattcctattttaaagatracagtagtgaggcacagagagaaaaatttacttgccctggctctacacctttcttactgcactatgctaccttgaagaactcctgctggttctgttgtta

SEQ ID NO: 60290 - DNA, 201 bp, Homo sapiens
attaaatgattacggtggttccaccctatctgcacaggatgtgttccaagacccccagtgggcacctgtaaccgcagatagtaccaaaccctatgtatatwtaccatgttttttcctatcacacatatttatgataaagtttaacttataagttaggcacagtaagagattaacagtaactaacaataaattagaacagtt

SEQ ID NO: 60291 - DNA, 201 bp, Homo sapiens
ctagcacattgagcttcctggctctgctgattttcaaacctgccaataattggtcctttaagaccaagaaagtgatgcttttcagaatctagtcatgttcmccctacacttttaggcagttggtactggtagaagctaaagaagttcaaattatataagaaagtttatttgtggattaagtaggaatgacactcctaagta

SEQ ID NO: 60292 - DNA, 201 bp, Homo sapiens
tttgcctgaagaagtccccaaagacttctcaaaggaggtgaaatttaaactaggtcttgaagaatgagtaggagctttccaggtgcagaagaaaaaaaataaaaaacaaactgataaaattcgaattgcttgtacaaaggcacagagctcagaaagggactgacatagtttagaaataatggtaaaaagttcagtgtggcc

SEQ ID NO: 60293 - DNA, 201 bp, Homo sapiens
aaaggtcttgaaatgaatattgagatatttgagatttggatcatcagggggcacagcctgtgttgtatgcatagtgattcaaggaataaaaatgagaagtsaattcatttattcaataaatattgtaagcacatctgttgtctgaatgtttgttccccctaaaattcatatgttgaaacctgatccccaatgtgatggtat

SEQ ID NO: 60294 - DNA, 201 bp, Homo sapiens
aaggaggtgaaatttaaactaggtcttgaagaatgagtaggagctttccaggtgcagaagaaaaaaaataaaaaacaaactgataaaattcgaattgcttrtacaaaggcacagagctcagaaagggactgacatagtttagaaataatggtaaaaagttcagtgtggcccagaatatggacagtggtaagatatttgact

SEQ ID NO: 60295 - DNA, 201 bp, Homo sapiens
agtgctgtgagtggggatagttgcaaggtgcaccaaatcgcccataccttagagatctacagattactgttaccagaagggggtcctgatccagaccccamgataggattcttggatctcacacaagaaagaatttgggtgaatccgtaaaatgaaagcaagttttattaagaaagtaaaggggccgggcgcagtggctca

SEQ ID NO: 60296 - DNA, 201 bp, Homo sapiens
gagatctacagattactgttaccagaagggggtcctgatccagaccccaagataggattcttggatctcacacaagaaagaatttgggtgaatccgtaaartgaaagcaagttttattaagaaagtaaaggggccgggcgcagtggctcatgcctgtaatccctgcactttgggaggccgaggcgggcagatcacgaggtc

SEQ ID NO: 60297 - DNA, 201 bp, Homo sapiens
agcctgggtgactgagcgaaactctgtctcagaaaaaaaaaaaaaaaaagaaagtaaagaaataggccaggtgcggtggctggtgcctgtaatctcagcaytttgggaggctgaggcaggtggatcacttgaggccaggagtttgagaccagcctggctaacatggtgaaaccccatctctactttaaaaaaacacaaaaa

SEQ ID NO: 60298 - DNA, 201 bp, Homo sapiens
tagaagattctaaacgcgccaatcagcactctgtaaaatggaccaatcactgctctgtaaaatggaccaatcagcaggacatgggcagggacaaataaggraataaaagctggccacttcagccagcagtggcaacccgctggggtccccttccatgctgtggaaactttgttctttggctcttcatagtaaatcttgctg

SEQ ID NO: 60299 - DNA, 201 bp, Homo sapiens
caggcagatcacgaggtcaagagttcaagaccagcctggccaacatgataaaaccccttctctacaaaaatacaaaaattagctgggcatggtggtatgcrcctgtaatccaagctacttggaaggctgaggcaggagaatcgcttgaacctgggagacaggttgcagtgagccaagatcatgccattgcactccagccta

SEQ ID NO: 60300 - DNA, 201 bp, Homo sapiens
ggtttatatactgtatagtatatcatcttaataaaaggggatacaggggtataggacttctagtgaaaacatgcaggcatagtagcttctgacaaagtttygttatgcaatttctcatctaggtgctaatggtcagtctccttcctggctgaaagcttccccaaccccctcaatcccccactcctactcaggggattaatg

SEQ ID NO: 60301 - DNA, 201 bp, Homo sapiens
tcacgtgatggatagatagaactctaacaggaagaaaagtaatcatgtcagccataagaatattgtccatgtcatctcataattgtttttaatccattttwctatatttatccctattccaagatcagatctttccacctgcccctccccaacaaaaaaaaagaaaaaagaattcatagacaagaagacacaaagaaatgg

SEQ ID NO: 60302 - DNA, 201 bp, Homo sapiens
cttgtaattggcaaatgtataggaaaattgtcataccattcaccattccaaaatatgatggaactaatctaaatatggtttaaaatcacatatttttataagttaaaaggatactataccttttgtagtatgtgaaaatcagatatgctttaatatggttaaaatcacatatttttataagttaaaaggttactatacctt

SEQ ID NO: 60303 - DNA, 201 bp, Homo sapiens
ttgtaattggcaaatgtataggaaaattgtcataccattcaccattccaaaatatgatggaactaatctaaatatggtttaaaatcacatatttttataagttaaaaggatactataccttttgtagtatgtgaaaatcagatatgctttaatatggttaaaatcacatatttttataagttaaaaggttactataccttt

SEQ ID NO: 60304 - DNA, 201 bp, Homo sapiens
tgtaattggcaaatgtataggaaaattgtcataccattcaccattccaaaatatgatggaactaatctaaatatggtttaaaatcacatatttttataagttaaaaggatactataccttttgtagtatgtgaaaatcagatatgctttaatatggttaaaatcacatatttttataagttaaaaggttactatacctttt

SEQ ID NO: 60305 - DNA, 201 bp, Homo sapiens
cgtttttgcatctcctcccggcttccccatccctaaaccaacgtctgttgaattaaactaccaaacaaaataagtgagtggcggtgggggaggaggttttycccgcttaactggagcggggcaaattgctgagaagggctggtggaccacttcgcggtctccttggcatagctctgcagagtggtaaccccagctcaactc

SEQ ID NO: 60306 - DNA, 201 bp, Homo sapiens
tgactttaggcaagccagtcatttcattagtacaaattgagccccagtgcataatgtagggttaccctggaggattgcaaatgcatggaatattaaatagrattggaaaaaatagctaatggaagagatatcattaggtcatatgtaataagttctaataaattgtacagacatagtagtctttaaattcataatggtgag

SEQ ID NO: 60307 - DNA, 201 bp, Homo sapiens
agaaatcaaactcccagagcaatctgtacttgaaatatgtaattgaaaaggaaagaattgagttgggctatatttttaaaacagggtaatagtgaaaactrtgtttaataaatttgcctgaattccaggtaaaccactaaaacttttatggttctctgttaatcatggttgcacttaatgcgtctctagttttattcatct

SEQ ID NO: 60308 - DNA, 201 bp, Homo sapiens
aagcttttattgaaatttacagagtaatttcacatctgtttaataaaaatttttccttatttttctagaaaatcatttttactgtattttagaaaagtgcygatctgtgacctattataaattttaaagtcttcaccacagagagcttgagaagcatttggctaaaaggcaaccacatcaaggcgcaaaaacaaaagattt

SEQ ID NO: 60309 - DNA, 201 bp, Homo sapiens
aaataagtgaaagtgttttctgaaatgtttcttagtgtttttcaacatagtcagaaaacaaagggagatccagacctaatgacaaaacaaataaataggcrtcatcccattgtaggggaaaactcaatccacagtggcactgtttgcatcattctttggaataactgagttcatcctgtaatgtttacttacaaagattca

SEQ ID NO: 60310 - DNA, 201 bp, Homo sapiens
acatctatctggctctagaggattaagttatgtttctacttctgccccacattatggtcaccagatctttttcttttgtattaccaagaatacgtaaagakagtaacagaagtcgtcttccttatacgaacacacaccactagtgatttcaacttttggctgaaaaagggggtccagaattcaggccagttaacaacacct

SEQ ID NO: 60311 - DNA, 201 bp, Homo sapiens
ttactgactagcctgcagtcttagcctccaaatatttgttaaaggatttgaagaaactgtggaagccaggaaaccatttgtcatagatgtgttaggcactkagtgacttatcagagaataactgaatgagagatgacctctcgaagtcctagttctgtctgtgactcatgggtgggaatatgggcatagcactcctaaaat

SEQ ID NO: 60312 - DNA, 201 bp, Homo sapiens
tccggggcagaagtcagcgagggtccgcccctgcgccgtaatcccctgagtggagcgcagcagtgcacagcgtggtgggagggactgagcgttttcaaaamcagcagtctttgaaacagctgtaacggcatctgtgaaagaagataggttccaggaacggaactgccacttagattgtaaattcctgaaaaacaggacgtt

SEQ ID NO: 60313 - DNA, 201 bp, Homo sapiens
gtacctcactctccccaggcattaatgtcaagtgttttttgcagaggaaaatttaaccctcaacacgagcatatgcacaaattcaaacacatatctaaatygacattcacatgtcctttctctttccctacacacatattccagtccttcatccctaccccaatattttaggtaataaaggacctaacagtgacttaaacc

SEQ ID NO: 60314 - DNA, 201 bp, Homo sapiens
tcctttctctttccctacacacatattccagtccttcatccctaccccaatattttaggtaataaaggacctaacagtgacttaaacccataaactgggtrttcaagagttaagggtagggacccattaattcattcactgaatattactgagttcttatacatactctgctgtatacactgttctaagcactaggtacac

SEQ ID NO: 60315 - DNA, 201 bp, Homo sapiens
aatgttttgagcctttacataatgctactttaactgaaaatctttgatgatacagtttctaaaagtgtaattattattgatttgtacatctctttttttamgtaggagacacagcggttcgagaagtttttgaagagactggtataaaatcagaattcaggtccgtcctgagtattcggcaacagcacacaaatcctggag

SEQ ID NO: 60316 - DNA, 201 bp, Homo sapiens
gtgatactcacaggaaccacgagcacacagaaggcccacattaaggagctagtcccttcctcctccagccttgcagtctaatggtggagcataaaagggartcagctggcaaagcagaaactggttagcagaatcccagctccagcatcactaagcaagtacagaagggcagattcggagctgagagacaataacagcatc

SEQ ID NO: 60317 - DNA, 201 bp, Homo sapiens
ttagcttgctttttgtgaataacgccagctctaattactggatagatgcgttgatcaaagatgaaactaatttgtaaacttaagtaccaaatacttgttayattttttcaataaaacaaattttgttgcacttaatggtagatgttttaggatctttataaatagtaattaatcctcctaacaaccctttgaggtagatag

SEQ ID NO: 60318 - DNA, 201 bp, Homo sapiens
taggtacacatcagtgaacaaagtaaagtttctgcatagggagcttacattcaaatgcataagatacaaataataaaacgaatgaatattatataaggtgragatgtgttattaagaaaaatacatggtgcactaagcactaggtatacatcagtgaacagatgtatagtttccacatatggagttaagcaaagtttctac

SEQ ID NO: 60319 - DNA, 201 bp, Homo sapiens
caggagaatggcatgaacctgggaggcggagcttgcagtgagccgagatcgcgccactgcactccaacctgggagacacagcgagactccgtctcaaaaawacaaaacaaaacaaaaaaaaaaaaaaaaaaagataaattgttcaaaaagcaacttcacagggtagcactgaagatacttactgacctcaaaggggaaaaa

SEQ ID NO: 60320 - DNA, 201 bp, Homo sapiens
gaaaaaaactcttaagttttaaattgcatgctgttctgagtaatgtgatgaaatctctcaccatcctgctctgtcccaccaggccgtgaatcttccccatrtccagtgtatccatgatccataggctacctatccattagttacttagtagccttccctgttatcagatcagctgtcccagtatcacagtacttggattca

SEQ ID NO: 60321 - DNA, 201 bp, Homo sapiens
atttgtaaagtaaatgatcatttttatgttgaatttcaggtaaagcaaaccaatttttcaatgatttgaacaattacttcttaataatatttacattattstgccaaacagttgtttaaaatcgtgtaatttaagtgtagagtagaattttgaagtggctgattagcttcagagacataggaaagttgagagaagacttcc

SEQ ID NO: 60322 - DNA, 201 bp, Homo sapiens
acaattctccagctccaaaacagacaggtcaggtgttaaacacaaggagggacatacccagtaagaagaaatatgctatgggaagcccaaagctatagctyccagcagtatttatgatccatccacactcttcccagtcccaaggtaggttaccaatcagggatcatttttacttttatcagaagcagcagtagaaggcta

SEQ ID NO: 60323 - DNA, 201 bp, Homo sapiens
cttgaccaatcttgaacactaactaggatttgaagccactgttgggggtgtggacgaggtaatgtaagaaattgttctggaaaggtgcagagttgtttttkttgttttttgtttttttttttttttgaggcagggtctcactttgtcacccaggctggaatgcagtgtcatgatctgggctcattccgacctccacctctt

SEQ ID NO: 60324 - DNA, 201 bp, Homo sapiens
tgatttgtacatctctttttttacgtaggagacacagcggttcgagaagtttttgaagagactggtataaaatcagaattcaggtccgtcctgagtattcrgcaacagcacacaaatcctggagcttttgggaagtcagatatgtatatcatctgccgcctaaagccatattcattcaccataaatttttgccaggaagaa

SEQ ID NO: 60325 - DNA, 201 bp, Homo sapiens
tgaccaatcttgaacactaactaggatttgaagccactgttgggggtgtggacgaggtaatgtaagaaattgttctggaaaggtgcagagttgtttttttkgttttttgtttttttttttttttgaggcagggtctcactttgtcacccaggctggaatgcagtgtcatgatctgggctcattccgacctccacctcttta

SEQ ID NO: 60326 - DNA, 201 bp, Homo sapiens
gaactttgaaataaatataataaagtcagttataaagcagtgattatataattcttcactttatgaaaattgtatctactatttatttttaatagtcaggwagtcaaaacatagtaaaatgtcatataagaaagtctcaactgagaaataatcccctaacacaacttactgagctcagtatttaagacaaggaaatataaa

SEQ ID NO: 60327 - DNA, 201 bp, Homo sapiens
tgaagccactgttgggggtgtggacgaggtaatgtaagaaattgttctggaaaggtgcagagttgttttttttgttttttgtttttttttttttttgaggmagggtctcactttgtcacccaggctggaatgcagtgtcatgatctgggctcattccgacctccacctctttagctcaagtgatcctcctgccttagcctc

SEQ ID NO: 60328 - DNA, 201 bp, Homo sapiens
atcactcacaggattattgtgacttatacctgagctaatgtacgttgaagcacagtgcctaatcataataataatttttatgttgtgaccagcagaggtckctcaaattgtgctttagtggtgctggttttgtctctgatactgtgctcatgtttacagtgaattcattagggacaagttcaatttgagtaaccacaaatt

SEQ ID NO: 60329 - DNA, 201 bp, Homo sapiens
cggtggtgggtggtttcagtcttcaataagaaaactttttactggctttcaaccttgagcccaatgataagaaagcttggatggaggagccttcactttgraagaagtcgatttagtggtgcagcagtttttcaaacggcctctgagggttttataatctaattgaaggcatagcatgcaaattcaactatggaaaaatct

SEQ ID NO: 60330 - DNA, 201 bp, Homo sapiens
ttagcctccaaatatttgttaaaggatttgaagaaactgtggaagccaggaaaccatttgtcatagatgtgttaggcacttagtgacttatcagagaatamctgaatgagagatgacctctcgaagtcctagttctgtctgtgactcatgggtgggaatatgggcatagcactcctaaaatttcctatgtggaaaagacca

SEQ ID NO: 60331 - DNA, 201 bp, Homo sapiens
catttgtcatagatgtgttaggcacttagtgacttatcagagaataactgaatgagagatgacctctcgaagtcctagttctgtctgtgactcatgggtgrgaatatgggcatagcactcctaaaatttcctatgtggaaaagaccacttttatgttggcagaggtaaagtataacagcacatagaggggtaagcaaataa

SEQ ID NO: 60332 - DNA, 201 bp, Homo sapiens
ataaaagggagaatatacattttacaacttttgttatttttctttactgggacaatggttacatattttactactggataaaaaattgtttgaccaattayccaaactgagctatacacatttattttcttttactctcattaacaaatttctaaaatatacttcttctttcatgtgaaatgagattagatgtggccatta

SEQ ID NO: 60333 - DNA, 201 bp, Homo sapiens
tttacatgtcaatgggaaggatctagttcaaaaacaagttgaaccttcaggacagaacaagttgtcctctgatacctaaggcagagtgaaaataccatgtkaactctaaattgtctttaaggtctgattagacataaaagtttttgccactagtctggtccatttttcaaagctattacacatcaaatataaattttcaat

SEQ ID NO: 60334 - DNA, 201 bp, Homo sapiens
aacatcacaaaattagagaaagcccagttagagggaccatctggatgtgtagaaaaagcagccacaaaaatatgttaatggcaataaaaatcctgccacayaaatttgcatttaattgaaaaatcaaccttataaaatgtgaaaacctttgttgaattataaaattatttatattccaagtttcttgaaaactgatcaaac

SEQ ID NO: 60335 - DNA, 201 bp, Homo sapiens
acacaggtgttgtacccactgatacttatcaatgaccaaacaggtgatcaaagcactaccccagtcagcatgacaaagcagaaagctgtgcgatttggagrtgcacattctgggtttaagtaccaggttctgccatgtgcttagccaggcattaggcaaattgccaccaaaaatatttgcttcttagcttgctttttgtga

SEQ ID NO: 60336 - DNA, 201 bp, Homo sapiens
aattaagaagaaaaaaactgccgttggcattagccatacttcctaagcttagtgtaaattaaagctttgcctgaaaattcataaaaccctgaaagcagctrgaaatgaaaactgacagtagaggtctgaaagactatgtctatatgaaggcatttctaactcaacataaaacaaaagatattcttaatgatgaagctgaat

SEQ ID NO: 60337 - DNA, 201 bp, Homo sapiens
cctgggaggcggagcttgcagtgagccgagatcgcgccactgcactccaacctgggagacacagcgagactccgtctcaaaaaaacaaaacaaaacaaaamaaaaaaaaaaaaaagataaattgttcaaaaagcaacttcacagggtagcactgaagatacttactgacctcaaaggggaaaaattaatttattcacttca

SEQ ID NO: 60338 - DNA, 201 bp, Homo sapiens
gttatcagatcagctgtcccagtatcacagtacttggattcaaataacccttattttccttattaatgccccgaagcacaagagtagtgatgtaacacttygagactatggttgaccttgtataactgaaatcacagaaagcaaaactggacaagggggactacagtatctattacatagtgcttttaaataggactatta

SEQ ID NO: 60339 - DNA, 201 bp, Homo sapiens
tttatataggcctaagagctgagaaatcccttaatgcatgattattgactgcttttatgcatatactttaaaagtcacaacaatattttaacattattatrctcattaacaaatgaggaatttaaaactcagtgcttttggtaacatttcagattttggataccttttgcccttacatctacttgatacctttatatcaaa

SEQ ID NO: 60340 - DNA, 201 bp, Homo sapiens
tcttaaatatcttcagtttagagtcatcattatgccattctggtgggttgtgggtcccttcatgtgggaccatgcacagttaaaactcaaacctcttgctsttcagctggtgctggtttatctggacccagatctctgagaatgaggcatcagcttgctggtgtctcttgggaaggggatgcaaaatgaagcttcttttac

SEQ ID NO: 60341 - DNA, 201 bp, Homo sapiens
ataaaaataagaggaataatttaatttctgtaaatgtttggtgttaggtgatatttcaatataactgatagctattaatgatatgtaatttatatttaatrtttaataaattagatgtagattatatatacttatttacttattataaacaactaattggcattcttttcagatatccaagccagttgctctcctttcttt

SEQ ID NO: 60342 - DNA, 201 bp, Homo sapiens
tgtttaataaattagatgtagattatatatacttatttacttattataaacaactaattggcattcttttcagatatccaagccagttgctctcctttctktatgtacctcactctccccaggcattaatgtcaagtgttttttgcagaggaaaatttaaccctcaacacgagcatatgcacaaattcaaacacatatcta

SEQ ID NO: 60343 - DNA, 201 bp, Homo sapiens
tgtacctcactctccccaggcattaatgtcaagtgttttttgcagaggaaaatttaaccctcaacacgagcatatgcacaaattcaaacacatatctaaaytgacattcacatgtcctttctctttccctacacacatattccagtccttcatccctaccccaatattttaggtaataaaggacctaacagtgacttaaac

SEQ ID NO: 60344 - DNA, 201 bp, Homo sapiens
tctttccatacagaaggaggtttgttaatactttactcacaagaagagttaattccccaaattttaacaaaaagttttaagtggctaatgttttttaaggsataataatgaatagtttattgtacagaaaatagctattggtatataatgccaaaaataatattggaacattatattacatatgattaacaatctccaaac

SEQ ID NO: 60345 - DNA, 201 bp, Homo sapiens
acaaggaaatataaaataagctaagaattatttatgtcactgatttacaggaaatcgaaaaatagaaaccaaattttcctacctattccttaaactattgsatcaaattcagtgtgtatcatgacaaatcaatgtatttgtttgataccaatattatttctccatgaccttttccttaatatgcatgtcccctattctatt

SEQ ID NO: 60346 - DNA, 201 bp, Homo sapiens
catatgttcatttgttggtgttctatcagcttcccggatgccccaccttgctagctggcactccctacaatgcttggcatactagaatactaactattccwataacatttgccttttcagccagttcctaatatttcagagaaaagaaacagtaccagggactaagtggatacatgatagaacccacagcttattaattaa

SEQ ID NO: 60347 - DNA, 201 bp, Homo sapiens
gaaacttacatctgtgctgaatgttcagcaatgcaaatttactaaacaactgttttgctcttgaaaacaaactgcatttttttaaaaaaatgagtagtagsgccaaaatttagtggtcaagaaaagtagatgtctaacagagcaacatatgtacaattttcaattgtctccattctgagtttccaagtcatcttcagtgac

SEQ ID NO: 60348 - DNA, 201 bp, Homo sapiens
attcaagttaaactgatcaaaactactcaggcagtgctgattttcagtcagctgctatggtgactgctgagcagggcagatttgctcactacccccatccrgtgcttccacgacatagaaacagcatagatcatgagctacatgccgaacttttgattagtggtactaagagctaaataggatccccataatttattttca

SEQ ID NO: 60349 - DNA, 201 bp, Homo sapiens
tggctcacacttgtcatcccagcactttgggaggccaaggcaggaggattcttgagcccaggagttcgagaccaatttgggcaatatagtgagacctcatytctactaaaaataaaaacaaattagtagagtatggtggcatgcatctgtagtcccacctacttgggaggccaaggtaggaggatcgcttgagcccaagaa

SEQ ID NO: 60350 - DNA, 201 bp, Homo sapiens
cacccggaattctttacccttttctaataagttggtcaccgtcagagtcccggaggttgccgcgaagtctgatccagcagaaggagcccgtgcctccgcasaagaggaagcagcagagggcaaggacgaaccattttccgcgctttggttcaaccgctttctattcttcttggaagacatggtcacaaggtaccctagccg

SEQ ID NO: 60351 - DNA, 201 bp, Homo sapiens
ctagagaagaataaaatatagaaattttaatatgcctaaggggttatagaaaggtattttaaaaatcatttctaagcagttatggatcaccttagatattwatttaaaccaaactacttatacagaccttgaaaatttccaggtaacactcagtgttactatctattactttatggctaaaggaaaattataaatgactgt

SEQ ID NO: 60352 - DNA, 201 bp, Homo sapiens
taagaagttaagtgtttcgagaaggagggaatggtcaacaataccaaaagttgctgtggtcacgtaaggtttatcaacacggagatgctcggagaccacaycaggaacagtttccatggaatgatggggtggaagtcaaagaggaataggctagggagagtatgtaagtggtgaggcggcagagaccactccatttaagaa

SEQ ID NO: 60353 - DNA, 201 bp, Homo sapiens
acagaggatgaatagtagcctttaaatgaactttgaaataaatataataaagtcagttataaagcagtgattatataattcttcactttatgaaaattgtwtctactatttatttttaatagtcaggaagtcaaaacatagtaaaatgtcatataagaaagtctcaactgagaaataatcccctaacacaacttactgagc

SEQ ID NO: 60354 - DNA, 201 bp, Homo sapiens
actatgtgctgtatattaattacctactttaatcatcatagcaacctgtcctcatttcacagactgggaaagtcaaccaaaaaggttaagtcataaagtargtgaggaagaggcgaggcacggtggctcacgcctgtaatcccagcactttgggaggccgaggcaggcagatcacgaggtcaagagttcaagaccagcctg

SEQ ID NO: 60355 - DNA, 201 bp, Homo sapiens
tctaatattacagtttattccattagtagaaataatatcattaggaacataccacctattcttctgtttatgactgcttctggattaatctgtctgaaaakgagaagctttggatatacatcagtaaagtttagcattaaaggttattttggatacgactaatattgttgttggaattaaactatgagaaaacaaattcct

SEQ ID NO: 60356 - DNA, 201 bp, Homo sapiens
tattgtgaagtttaaatgtgcataattcttatacaaatatttagcatagcataggagattggtcagggtggtgggaaaaattgtagaaagatgcaaacctycttggaaggctggaaggtttacaaaagcttcggaaaaggatttccgaaggaaaaaaaggaagtttaaatgtgcataattcttatacaaatatttagcata

SEQ ID NO: 60357 - DNA, 201 bp, Homo sapiens
atggcactcttctaaaatgtacggccgcgatctccgctctggagcgcggaggggtcatttgggcaacggacgaattaagcggcgtggagatgcggcagccrctgagctggggccgctggcgcgcgatgcttgcccgaacctacggccccgggccttcggcgggttaccgctgggcctcgggcgcacagggttacgtgcgga

SEQ ID NO: 60358 - DNA, 201 bp, Homo sapiens
cttgtttagatgccttggcaaaataaaaatgacaagctcaagtcagcctgtcaattcaaggcacaatatgaataccccaagacctccatggcaccatttawagagacccctatattctccagccacaaaggcaatattgaaaatcaggcctagatccaactgtaagaatatcagagctgcaaaggagactgaatagagttt

SEQ ID NO: 60359 - DNA, 201 bp, Homo sapiens
attaagcttatgttttgcagccttacccaatctatattgggcaaaaagcagtctgcaggtttgcaaggcttcctctctcctgcatcttgccttttcaaatraattgatttttttcatgtgaactcttatgggtcctctgaatttcagctgtacttacttgtagatgtaattgaagaaaaacacatttccaagccaaatata

SEQ ID NO: 60360 - DNA, 201 bp, Homo sapiens
gagcagaattaactttttagacgttcacccaatttcttgcttgttacagctaagcaaatagtttattcatgtggaatgagttatttgattaaatgattacrgtggttccaccctatctgcacaggatgtgttccaagacccccagtgggcacctgtaaccgcagatagtaccaaaccctatgtatatataccatgtttttt

SEQ ID NO: 60361 - DNA, 201 bp, Homo sapiens
atgttatgtaaggtggagataagtgttattaagaaaaacacatggtgccaagataaaaagaatgactgggtttgccatgtacattatgttcggtatgccchatatacattaacttctttatgcttgccatatacattaacttctgtatgcccaacacctaacaagcaataaatttctattgaatgaatgaacaaacttatg

SEQ ID NO: 60362 - DNA, 201 bp, Homo sapiens
acatcagacttgtaattggcaaatgtataggaaaattgtcataccattcaccattccaaaatatgatggaactaatctaaatatggtttaaaatcacatatttttataagttaaaaggatactataccttttgtagtatgtgaaaatcagatatgctttaatatggttaaaatcacatatttttataagttaaaaggttac

SEQ ID NO: 60363 - DNA, 201 bp, Homo sapiens
gataacatataccattatatgccacaaaaatggtactttacttctatagtcttcctctcaaacactcaaatccctatctggccatgaaaaaaacatcaggycaggtgcaatggctcacacttgtcatcccagcactttgggaggccaaggcaggaggattcttgagcccaggagttcgagaccaatttgggcaatatagtg

SEQ ID NO: 60364 - DNA, 201 bp, Homo sapiens
agacttgtaattggcaaatgtataggaaaattgtcataccattcaccattccaaaatatgatggaactaatctaaatatggtttaaaatcacatatttttataagttaaaaggatactataccttttgtagtatgtgaaaatcagatatgctttaatatggttaaaatcacatatttttataagttaaaaggttactatac

SEQ ID NO: 60365 - DNA, 201 bp, Homo sapiens
catcaggccaggtgcaatggctcacacttgtcatcccagcactttgggaggccaaggcaggaggattcttgagcccaggagttcgagaccaatttgggcartatagtgagacctcatctctactaaaaataaaaacaaattagtagagtatggtggcatgcatctgtagtcccacctacttgggaggccaaggtaggagga

SEQ ID NO: 60366 - DNA, 201 bp, Homo sapiens
agatttttcttttatgctttcagttgtttctaaccatgtttaacctatgggcaaatctcaattgtaagggaagtcagcatgtaattgaaaaatggcagacraatgccttatgttttaaaacattatactctttctatgcatctttccatagctattagagggaaaaaacaagagcatatccaggggatgggtaagacagtc

SEQ ID NO: 60367 - DNA, 201 bp, Homo sapiens
ctgttagacaatgaggaataagtaagtatcatactgatttctggcagtctctttcaggagggagggactttgccttttaatttcaattcaactatttatcaaaaaaaaaaaaaaaaggatagctggctttcaaaaagacctggaaataatactccaagtaatggaatttaatagctaccacattatttaagataaatgttc

SEQ ID NO: 60368 - DNA, 201 bp, Homo sapiens
cctaagagtataaaggtatccacaagattaaaattgacaaactgccttcttaaaaaatcgtattaccactggcaggaagagtatctgctgcattagccagmgaactataaagcagctgagccttatcagagatcatcagtgcactagagtcagagggaaacaccaggaaaacccacattctgcagattatttcccattata

SEQ ID NO: 60369 - DNA, 201 bp, Homo sapiens
gctagaaaaattttgcatgcaattactaaaaaatatattctcaaccactttgaccaattataggtggattttgtgaaatctacatatgtgtgtgttagtgraagttatgttaactttattttctgactttatactgcagttgaaaaatatgtggaagtttccaggaggcctgtcagagcctgaagaagatattggtgtgta

SEQ ID NO: 60370 - DNA, 201 bp, Homo sapiens
cacaacaactcacctacccagagatcatatatgcctcagtcatgtggaattaagaagaaaaaaactgccgttggcattagccatacttcctaagcttagtrtaaattaaagctttgcctgaaaattcataaaaccctgaaagcagctagaaatgaaaactgacagtagaggtctgaaagactatgtctatatgaaggcatt

SEQ ID NO: 60371 - DNA, 201 bp, Homo sapiens
ttaaaaatcatttctaagcagttatggatcaccttagatatttatttaaaccaaactacttatacagaccttgaaaatttccaggtaacactcagtgttamtatctattactttatggctaaaggaaaattataaatgactgtatttaattgggaagacaagtctgctttaatatattaccaagatattcttccattcatt

SEQ ID NO: 60372 - DNA, 201 bp, Homo sapiens
cctgcaaacgtgtgccagtgggcaattgaattacagttttgtttaataagtttgagggaggcaggagttacaagcagagacataaatcaatatgtggatgrtatacatttatttcgcctgaaaaggcaggatgttttgaagaggcaggatgtttaaagagggggcttactggctataggtagattcacagattctctaatt

SEQ ID NO: 60373 - DNA, 201 bp, Homo sapiens
cctgtagcaagtagacattcagaaactctccgttcagctctatttcaaaagattctactcaataatttagtgacagcctcacacttcaatggaaagttatrcaaataattatcattcacgggcacagactcttaagagttcccagttattactacagaattggtaatatatgcaaaaagagtatcctatgaagggcctgtt

SEQ ID NO: 60374 - DNA, 201 bp, Homo sapiens
gtcaccacgatatcctcaagctaaagacagcgagtgacataaagtagatattcaatatttttttaatgaatgggatggaaatgtgagtcttctgagagagmagtttcagtattgttgaggggcagcattgcacagtgagaagagtgtgcctgcctagaatccagacagactggctatcagtcccagttctaccagttagag

SEQ ID NO: 60375 - DNA, 201 bp, Homo sapiens
aatggcatgaacctgggaggcggagcttgcagtgagccgagatcgcgccactgcactccaacctgggagacacagcgagactccgtctcaaaaaaacaaamcaaaacaaaaaaaaaaaaaaaaaaagataaattgttcaaaaagcaacttcacagggtagcactgaagatacttactgacctcaaaggggaaaaattaatt

SEQ ID NO: 60376 - DNA, 201 bp, Homo sapiens
gggacctgaaaattcaggtgatcttcctggctgtttctgtttttgctgctgctgctgctgctggtggtggtctcagtactaccctttaaggaccaaaattyttagatttctagaaaaactataatagtaagggatccttatgaccttaataaatgaaagcaatgaagcatattagttatttaattaataattttatttgcc

SEQ ID NO: 60377 - DNA, 201 bp, Homo sapiens
cttttatttgtccactctaaaactacagaacatctgttacgtgccaagcattgtctttggtggtatggatataaaggtcagcagtgtaatgactttattcygaaggaattcagtctgatggaaaaatcatataaacaaggtggttactataaaacatggtacttccagtgccagcgatgtgaacaagacatttggggacct

SEQ ID NO: 60378 - DNA, 201 bp, Homo sapiens; identical to SEQ ID NO: 11613

SEQ ID NO: 60379 - DNA, 201 bp, Homo sapiens
gggaaggagcacatgtgaaatgtatggagtgatagaaatgttctataatgttaaagtgtgttatgggcatatgcatatgtcaaatcgcatgaaatgtacasttaagatttgtacatttcactttatgtactttacctcaatttttaaaagatgtcatcagacaaagagagcaaggtgagaaggacctgatcccataattcc

SEQ ID NO: 60380 - DNA, 201 bp, Homo sapiens
agaaagtagccttttaatttgattggaaggattgcctgggaaggagcacatgtgaaatgtatggagtgatagaaatgttctataatgttaaagtgtgttaygggcatatgcatatgtcaaatcgcatgaaatgtacacttaagatttgtacatttcactttatgtactttacctcaatttttaaaagatgtcatcagacaa

SEQ ID NO: 60381 - DNA, 201 bp, Homo sapiens
ccccagctcaactctgagggtattgatggcactcttctaaaatgtacggccgcgatctccgctctggagcgcggaggggtcatttgggcaacggacgaatyaagcggcgtggagatgcggcagccgctgagctggggccgctggcgcgcgatgcttgcccgaacctacggccccgggccttcggcgggttaccgctgggcc

SEQ ID NO: 60382 - DNA, 201 bp, Homo sapiens
ccacaccaggaacagtttccatggaatgatggggtggaagtcaaagaggaataggctagggagagtatgtaagtggtgaggcggcagagaccactccattyaagaagcttggcaatggatagagagacggttgcaggaagaaaatgtggagcttttgttctgatttaagatggaagagaaatgagcatgtttacatgtcaa

SEQ ID NO: 60383 - DNA, 201 bp, Homo sapiens
catggaatgatggggtggaagtcaaagaggaataggctagggagagtatgtaagtggtgaggcggcagagaccactccatttaagaagcttggcaatggayagagagacggttgcaggaagaaaatgtggagcttttgttctgatttaagatggaagagaaatgagcatgtttacatgtcaatgggaaggatctagttcaa

SEQ ID NO: 60384 - DNA, 201 bp, Homo sapiens
ggagctgtcatctaggaatggcttttaagtcaaacacatctggactcaaatatcggctctgccacttagcacctgtgtagcctgaatggaatcacgttaastttcctccctctataaaactgtcattactatacccatcggtcacggcttctgtagaaattagatgagctatatatactgctaacactagtgtgcagttac

SEQ ID NO: 60385 - DNA, 201 bp, Homo sapiens
attatttcccccaaaattcataaattgaagttctaacccccattgtcactatatttagagacagagcctttaaagaggtaaattaaggttaaatgaagacrtaaacgtgaggatctaatccaacagcactggcgtccttataaaaagaggcagagacaccagaagcacacatgcccaggggaaggactgtgtgaggacaca

SEQ ID NO: 60386 - DNA, 201 bp, Homo sapiens
aactcacctggaattgagacctcaagatgggtcccagaagcaagacccacagagaactaaatatcaaggtattaaaaacataatgggaaaaatattttaartgtaatggggtgttatgggctgaattatttcccccaaaattcataaattgaagttctaacccccattgtcactatatttagagacagagcctttaaagag

SEQ ID NO: 60387 - DNA, 201 bp, Homo sapiens
aatataaattaagtaatggctctcctcttagtagattttaacttttgctcttgttattctaaaggccaagaaagcagagaactcatcaaatgaggaggaarcgtcaagtgaaggcaacatgagggtgcatgctgtgggtgagtatgcatgaagcaagctgtttgtgactatatcaaggaagaaatggaatctgccactttg

SEQ ID NO: 60388 - DNA, 201 bp, Homo sapiens
ggcagagatcagtaactcacctggaattgagacctcaagatgggtcccagaagcaagacccacagagaactaaatatcaaggtattaaaaacataatgggraaaatattttaagtgtaatggggtgttatgggctgaattatttcccccaaaattcataaattgaagttctaacccccattgtcactatatttagagacag

SEQ ID NO: 60389 - DNA, 201 bp, Homo sapiens
gcaacagaaagaagacaaaggctatgggtgcaaatataagtaaacgtataactaatgaagctattatctccattttacatatgaagccagtactcaaaaawaaaaaatcaaagtccataatctttcccattctctgggctagataaagattattagcaggaaaattacctagtgcccacacagagtagtataatagtttgt

SEQ ID NO: 60390 - DNA, 201 bp, Homo sapiens
gagatcgagaccatcttggctaacacggtgaaaccccgtctctactaaaaatacaaaaaattagccgggcgcggtggcgggcgcctgtagtcccagccacwcgggaggctgaggcaggagaatggcgtgaacccgggaggcggagcttgcagtgagccgagactgcgccacttcagtctggcctgggtgaaagagcgagac

SEQ ID NO: 60391 - DNA, 201 bp, Homo sapiens
caagagatcgagaccatcttggctaacacggtgaaaccccgtctctactaaaaatacaaaaaattagccgggcgcggtggcgggcgcctgtagtcccagcyactcgggaggctgaggcaggagaatggcgtgaacccgggaggcggagcttgcagtgagccgagactgcgccacttcagtctggcctgggtgaaagagcga

SEQ ID NO: 60392 - DNA, 201 bp, Homo sapiens
accatttcttctaactctcacaaaactgaattagatgttttattagtcaaggttctccagagaaacagaacaaataggagataggtaggtaggtaggtagrtagatagatagatagatagatagatagatagatagatagatgatagatagatagagatatagataatgaggacttagtttacattaatggagccagtccc

SEQ ID NO: 60393 - DNA, 201 bp, Homo sapiens
gtttactgtggcatacaggggaaaaacaactgggaaggcaaagaaagagaaatagaaatggcctcacatgatacacatactgcagcaaaccctgcaataawtccatttttcaagttcccactgcttcctcccatcttcacgatgtgctatggtgtagtggttatagaggggaattctggggcagactgcctggacttgaat

SEQ ID NO: 60394 - DNA, 201 bp, Homo sapiens
ttttttgcctcctactatcatttgttaagatgctcacacatagacctaaaatttctctaattcttgataatgtcttatttacaaaagcaaaaatgggagargagaattaaagagctaaagagattatggtaactcatattataatgtactaccatttctggctctcttttctaaaataaagcaataatgtaggttgtgctt

SEQ ID NO: 60395 - DNA, 201 bp, Homo sapiens
ttggttcccttttacagctttataactaattattttttgcctcctactatcatttgttaagatgctcacacatagacctaaaatttctctaattcttgatratgtcttatttacaaaagcaaaaatgggagaagagaattaaagagctaaagagattatggtaactcatattataatgtactaccatttctggctctcttt

SEQ ID NO: 60396 - DNA, 201 bp, Homo sapiens
ggctctttgcaggagccttcagtatcccatcgtgtaggcctctggtctacagggctgcccacagcatggtatctggattcctccagagcgagtgaccaggyagaaagagagaaaaagccaagactgaggccccaatgtcttttataacctaacctcagaagttatatatcatgatttctgcctcattctattggtcacact

SEQ ID NO: 60397 - DNA, 201 bp, Homo sapiens
gtctatatcacataatagagggattatagataagttacacaagtgtggctgtcagccatggtagctgatttggaatcccatcctgtaagttacagttggakaccctagaaaaaacacccttactaagctttggtttcctcttatgtaaatgataatagctaacatttattgagtgtctgctacgtggcaggggtgttctat

SEQ ID NO: 60398 - DNA, 201 bp, Homo sapiens
aggtaattgaagagatatatagtataatttggactgattctaatgcactagataaaagaatgtaacatattcttgtattgggtaatttaatgatttctaayaggtccacttctaataagaagaaagaaattagtgtttgaatccagaaagaagaaaaatacaaagaaaaaacatgaaaaaggaaaagggaaataagttgcc

SEQ ID NO: 60399 - DNA, 201 bp, Homo sapiens
ttgacttcaactttctgctaaacaacactttccaaaattgtaaagtacaaatgctttgcaaaagtttaaaaaacacagaaaataatttcaaaactcaaagytaccattatttaaatgcattttgttttattttcacccagtctctgcataaataactttttcttaaacacaattgagattctgcttccacttaacattctg

SEQ ID NO: 60400 - DNA, 201 bp, Homo sapiens
ccagcctccagaactgtgagaaaattaatttctgctgtttaagccacccaatttgtggtattttgttacgccagccctaggaaactaatacattgggtaakcaaggaagagggtcctacaggccaggtcctggccaagatcaatacagacactctgtttttactgcagctttttcactcacccatacttacctccttcctg

SEQ ID NO: 60401 - DNA, 201 bp, Homo sapiens
gctcatctattatagaggcacgttaatattcttggtggtcacaatttttaattgtgggttgtttgtgataaagacatactctaatcccaacctaagagatkaagttattttctcagtaatcagtctgtaagtctacctctgtgtaattgagatattttggaagttggagctcctggtgtgaaagcaattattcagtttagc

SEQ ID NO: 60402 - DNA, 201 bp, Homo sapiens
tttccctgcctgcctgaattctccagatgaaaatggattctgtgtagttgggagattccaaatagatttccagagttaaataaatagaaatatgcccatartgataaaacataatttcaattgcagaatatttctgaaagtaaaagagctgccattttttgtgtgcatttcttcctgcttgggcagtaggcggatggaggg

SEQ ID NO: 60403 - DNA, 201 bp, Homo sapiens
ttttccaactacagaaataattttaggaactattccaaatttcagaacgtttttatatgaagctgaaaaggtcttagctaattacaaactaggttgctggkaacagtgaagttgtattcagaggtattaattaggcctaaattatcttttaccctcagacaactttcaaaaatattttagaatagtgaaaagtgattttaa

SEQ ID NO: 60404 - DNA, 201 bp, Homo sapiens
ttcaagaaccacaataatataactggtgtgtgggaaaagccttagacccagagttcatctggagacaacttacttaacctctctgagcctcacttgtctcrtttctaaacttaaagagttcgttcggaactaactaaactcaaatgaaaggcaaataccaaaagtgagacagatcaagcacaaacgccagcatcccttaca

SEQ ID NO: 60405 - DNA, 201 bp, Homo sapiens
ggcataggcggggaagagaagtatcagcatcatctcactgataaaaacagctgatgtcttcttacagtctgaaaatgaagccattgatttcaaaagcaaawgttttattatactttgaaaaacactctggattggatcattcaaggttatgatagcctgagataactgcagcctcaaactcccgggctcaagcaatcctcc

SEQ ID NO: 60406 - DNA, 201 bp, Homo sapiens
cttcatacgcatctttaacaccaatgtgtatgttcactggatccacgctgtaattatctaatacagagcacatcatcaatccttctgcaagttgctaaacwtctgctgatgctgcaaatttaatccccaggcattagtcctcactcgtggtcatgttctccacactttcattactgactagattgtttttccagtgctttt

SEQ ID NO: 60407 - DNA, 201 bp, Homo sapiens
ggagtgcagtggcacaatctcagctcactgcaacctctgcctcctgggttcaagcgattctcctgcctcaacctcctcagtagctgggattacaggcgtgygccaccacgcccagctaatttttgtatttttagtagagacgaggtttcaccatgttggtcaggctggtctcgaactcctgacctcgtgatccgcccacct

SEQ ID NO: 60408 - DNA, 201 bp, Homo sapiens
ttttttttttttttttgagatggagtcttgctctgtcacccaggctggagtgcagtggcacaatctcagctcactgcaacctctgcctcctgggttcaagmgattctcctgcctcaacctcctcagtagctgggattacaggcgtgcgccaccacgcccagctaatttttgtatttttagtagagacgaggtttcaccatg

SEQ ID NO: 60409 - DNA, 201 bp, Homo sapiens
cattcttttatacttttttagaagcctgaaggtcctgtcctgaggaaggaacttagataaaacaaatataagtttcacactttaagaccaggagggtcaayttctatgtttttcaaaaagatctgtctgtgggactattgggtaagtttcagtttgatctaactctgacatgaatggcctttttgaacttagaattcccag

SEQ ID NO: 60410 - DNA, 201 bp, Homo sapiens
gcctcaacacgaggtatttattactatgagacttcactgctgcatcagttagtagcttcttaatggccaagtcaaaggaaaccaaagaaagtgttctatgycagcttgccattacacagagtgagaagaaatgctgctttgctgtcaattctgttttattggcccacttggacaagagggaaagcccccaacatttcttct

SEQ ID NO: 60411 - DNA, 201 bp, Homo sapiens
aatcggacactactattttcccctggtggggggcctcaacacgaggtatttattactatgagacttcactgctgcatcagttagtagcttcttaatggccragtcaaaggaaaccaaagaaagtgttctatgccagcttgccattacacagagtgagaagaaatgctgctttgctgtcaattctgttttattggcccactt

SEQ ID NO: 60412 - DNA, 201 bp, Homo sapiens
aactcaagatggattaaagacttaaacataagacctaaaaccataaaaaccctagaagaaaacttaggcaataccattcaggacataggcatgggcaaagrcttcatgactaaaacaccaaaagcaatggcaacaaaagccaaaattgattaatgggatctaattaaactaaagagcttctgcacagcaaaagaaactatc

SEQ ID NO: 60413 - DNA, 201 bp, Homo sapiens
atgaatgtacatgctcaataagtagtagttattacaattctttttcatggttttgttattgaaacagcaaggttccagtctaggtcctgctgctcacttcrtagaaagccaatcactgagacaacaagtattgccaatgaagaaggctttaatcaggtgctgcagctgaggagatgggagcacagtctcaaatccatctca

SEQ ID NO: 60414 - DNA, 201 bp, Homo sapiens
gcagctggagtggaaagtgagtacaagagtcccacctagcagtgggagatggtagaggatgtttgcacgcttctggaaataacccagtcaagaaggaaatrttagtggggagcagagaatgcgcacaactgccagagggcgttcttcgatacatgtcccacccagaggagagggattggacttaggttaggagcacaggaa

SEQ ID NO: 60415 - DNA, 201 bp, Homo sapiens
tcacttgagcctaggaggcagaggttatagtgaaccaagattgcgccattgcactccagcctgggcaacagagcaagactctgtattaaaaaaaaaaaaargaaaaaaaaaaacttcatttgctgagttagaaccaaagacccacaaagacccacaggaattcctatgtgtcacactaaaaatgatgatgataatgacaga

SEQ ID NO: 60416 - DNA, 201 bp, Homo sapiens; identical to SEQ ID NO: 11629

SEQ ID NO: 60417 - DNA, 201 bp, Homo sapiens
tatatttctgttatcccagttgtctcaattatttgtgtctttatagggctgcctcttatttttgccctaattttctctcccttcccccctttatgtcttayatctgccccgccgtgcttttcttaaaactttgctctgcctcttctatcttcttttcttcctttttcctaatactttttttctcaacagggtctccttcca

SEQ ID NO: 60418 - DNA, 201 bp, Homo sapiens
aagtctccaatcttgctagaaataggaccatccctctaatagaaattaatactccagacatgcccttttctacttaggcttagtgccctgtctcacacagwctgaattaattctaattttttttgtttttgagatggagtttcactcttgttgaccaggctggagtgcaatggcacaatctcagctcactgcaacctccgc

SEQ ID NO: 60419 - DNA, 201 bp, Homo sapiens
attaacagtatataagcatattctcactcatatggaagcgaaaaagttgatctcatagaagtaagaagtagaacagaggatacttgaggctgggaagggtraggagaagaaaggaatagggagctatttgttaaaggacgtaaaactatagctaataggaagaataagttctagtgctctataccactgtaggatattata

SEQ ID NO: 60420 - DNA, 201 bp, Homo sapiens
aaaaacagcttcagaaacaatgagagtttgaatatctgccaacaaacatttccaaataaagctatactgaaaagacaccgcgaattcaaaggccttttttwattcatttttctctcttgttttgttgtaagaaatacagtgggtctttattaatcatgttataaattaataagacctccaataaaactgaaagtcaaaatt

SEQ ID NO: 60421 - DNA, 201 bp, Homo sapiens
tttgaatatctgccaacaaacatttccaaataaagctatactgaaaagacaccgcgaattcaaaggcctttttttattcatttttctctcttgttttgttrtaagaaatacagtgggtctttattaatcatgttataaattaataagacctccaataaaactgaaagtcaaaattctcaagctttgccacctacaaatgaa

SEQ ID NO: 60422 - DNA, 201 bp, Homo sapiens
ctctgcttcttacaatcagtgtaagctttggcagttacttcccacctgcatgactcagtttactcatctgtttagcaaaatggggataataatacacacaratgaggtcgttgtaggaatgaaatgtgatgtttattaaatgccaagtatagcacctggcagagaagtaaacacataggaaagttgactggttgctcataa

SEQ ID NO: 60423 - DNA, 201 bp, Homo sapiens
acttcaagaaaatacatttctgttgttttaagccacccagcttgtggtaatttgttatgacagcccaggaaactaatgcaaacctcttatggctctatagraccacgtgattgtacggcactaagataatctaaccctttatatttctgttatcccagttgtctcaattatttgtgtctttatagggctgcctcttatttt

SEQ ID NO: 60424 - DNA, 201 bp, Homo sapiens
ttttttattcaaaacaccctctttggaaagatttaagttaatatttctgttcatttaataagatctagcaaagcagagcagtttatttcatctacttatcrtccaatcaactagtgccactttccacattttggagaagaatattcacatgttatttatgaaccttgcctttttctttcagagaatttttcacacagccat

SEQ ID NO: 60425 - DNA, 201 bp, Homo sapiens
ctgagggccaaagagcagcgcactgaaccacagaggattattctcaggcctgaaacatgatggaatttggcctgctctgttttgaacttgcttggaacaartgacccttgtccacttatgtattccttccattttctccatttcagaatgaaactgtttatactatgccattgtatttggggagaggtaactggttttcta

SEQ ID NO: 60426 - DNA, 201 bp, Homo sapiens
atagctagaataaactcctgcaagagtccatagtcagaaaatgacccagagggttaataatcaacacagaactgagagatctgaaattgttcagtgtcaarttatgatggtactgtgggggtaaggaaattccacaggcagagatcagtaactcacctggaattgagacctcaagatgggtcccagaagcaagacccacag

SEQ ID NO: 60427 - DNA, 201 bp, Homo sapiens
aatcccagcactttgggaggccgaggcagatcacctgaggtcaggagttcaagaccagcctggccaacatggtgaaaaaatacaaaaattagccaggcgtrgtggcacacgcctgtaatcccagctacttgggaggttaaggcaggagaatcgctggaacccaggaggcagaggttacagtgagctgagattgggccactg

SEQ ID NO: 60428 - DNA, 201 bp, Homo sapiens
cactagtcctggctgggcaccgtggctcatgcctgtaatcccagcactttgggaggccgaggcagatcacctgaggtcaggagttcaagaccagcctggcmaacatggtgaaaaaatacaaaaattagccaggcgtggtggcacacgcctgtaatcccagctacttgggaggttaaggcaggagaatcgctggaacccagg

SEQ ID NO: 60429 - DNA, 201 bp, Homo sapiens
gtaatatctgtcaatgacatttggggtgccccatcaagactgtcaggttactgctccttggaagccctccaatgctccatggaactattctttggaagccytccaagccctgtccataaagttctaattggctttctagtgactcactgcaaagtattaatggacagccaaatacatcagacattagagaaaagctttcaa

SEQ ID NO: 60430 - DNA, 201 bp, Homo sapiens
ccttactagtgaaatgattacaataatgtgcttacctgatagaactgttcagaaggtttaaagaatatgtgtgtgcaaagctcttagaatagtgcctagarcttaagtactttggatgtagtaaagttagctattatcaactacctaatttaaaaatgcctcctatctctctttccattgcattatgtacataatcatcac

SEQ ID NO: 60431 - DNA, 201 bp, Homo sapiens
ccaagccccagagggcgtgtaaccatactcttagctccaccgtccgcagacagcagtgtgttatcagctcagtgagccctttgcctcatcacgtagggcarctgccttccgccagcaagggcaaagggccagtgcgaccgcctttttggatacctgcacgtagtgtgtccgagttcttgtccagtgcccaagaggaatgag

SEQ ID NO: 60432 - DNA, 201 bp, Homo sapiens
caattagtgccgggataatcctttaacccaaaactcacccatggcttcaccctcaatgaatgggagctgtgggagggtagatcagagtattctttctttaytcctgcagtggaggaaattaaatttagatgcttgttttgctgggttatgtcttaatatgtttccttttctttccttaagttaggcttgaattttatgagc

SEQ ID NO: 60433 - DNA, 201 bp, Homo sapiens
attgtgactttttacatttataaagactcatctcatcttgattaacaccagggtaaaaagtattaaaacatcttatctttcattaactttttattacgttyctgtttcagttcctccagtgttttctaggtcatgcaattatgaaaataagttagcatttttatcttacatctcaaacaactaatgtattcagtgttctat

SEQ ID NO: 60434 - DNA, 201 bp, Homo sapiens
gtatggccagtagatgagaaccaggttgtaccaacatgactgctgggtacacccctatagatttagggtgggggaaggacagttcctgtgaagacagaaamcttgtgaatcaacatcccaaaagctgtcaaccttacccacaaatactttatttcgttggcagtttttatctgtattctatttatatcacatatacagcaa

SEQ ID NO: 60435 - DNA, 201 bp, Homo sapiens
gacaggaatgctgctaagcatcctacaaggcacaggacagccccccacaacaaagaatcatcaagccaaaatgttaacagtgccaagataaagaaaccctkcactaaaccatactattttgtatttctatagttttcaaaaccagtagaatagtaataacatactgatctaaaatataaggctaggcacagtggctcatcc

SEQ ID NO: 60436 - DNA, 201 bp, Homo sapiens
gattttccacacccagaaactcttaagagagaaactatgtgtccttgtgcttaggcagtgtctagtaagtactcaatgaatgaatttaaaaaaaatggatkagtgatgcaagttctggccaactggacattctttccttttgattcattcagctacatttagatttagggaaatgaagggaacttgtgagatcatgtgaga

SEQ ID NO: 60437 - DNA, 201 bp, Homo sapiens
agaagtcttctgtgttgattgtagcgtggtgtgagaccacaggaaaagcagttagagattttccacacccagaaactcttaagagagaaactatgtgtccytgtgcttaggcagtgtctagtaagtactcaatgaatgaatttaaaaaaaatggattagtgatgcaagttctggccaactggacattctttccttttgatt

SEQ ID NO: 60438 - DNA, 201 bp, Homo sapiens
tgcatgttgatgacaaaaaatctcccacatttggtcacagaagtcttctgtgttgattgtagcgtggtgtgagaccacaggaaaagcagttagagattttycacacccagaaactcttaagagagaaactatgtgtccttgtgcttaggcagtgtctagtaagtactcaatgaatgaatttaaaaaaaatggattagtgat

SEQ ID NO: 60439 - DNA, 201 bp, Homo sapiens
ttgattgcttgcatgttgatgacaaaaaatctcccacatttggtcacagaagtcttctgtgttgattgtagcgtggtgtgagaccacaggaaaagcagttwgagattttccacacccagaaactcttaagagagaaactatgtgtccttgtgcttaggcagtgtctagtaagtactcaatgaatgaatttaaaaaaaatgg

SEQ ID NO: 60440 - DNA, 201 bp, Homo sapiens
agctaagggtctacttctaagcccactcccatggctctttgcaggagccttcagtatcccatcgtgtaggcctctggtctacagggctgcccacagcatgrtatctggattcctccagagcgagtgaccaggcagaaagagagaaaaagccaagactgaggccccaatgtcttttataacctaacctcagaagttatatat

SEQ ID NO: 60441 - DNA, 201 bp, Homo sapiens
gccacgccaagccccagagggcgtgtaaccatactcttagctccaccgtccgcagacagcagtgtgttatcagctcagtgagccctttgcctcatcacgtrgggcaactgccttccgccagcaagggcaaagggccagtgcgaccgcctttttggatacctgcacgtagtgtgtccgagttcttgtccagtgcccaagagg

SEQ ID NO: 60442 - DNA, 201 bp, Homo sapiens
aggaagcaagaaatcaaacagaagaaaaaagacaaaggggattaccagggcgtggtgaccccaggtatggaccccaggagaaaagctgcccagcagccggrgatacaccagtccaaaggaagcaagaactccgaggctctgggagtgccacttccaaggggcgaaatggacacgagggatttccttacggggttgttgatg

SEQ ID NO: 60443 - DNA, 201 bp, Homo sapiens
gaacttaaagtataattaaaaaaaaaaaaaacggcagtgatcctgagctctggggagactgcaatgagcagagccctcctgccaacttgtattggacttgkagcaggattgcaaaattgacttctgtttctttaagccactgagatttagcattatttcttactgtagtatcagctaatagctacctttttctctattcaa

SEQ ID NO: 60444 - DNA, 201 bp, Homo sapiens
tcagaataaacacaatgtcaggtgggaggtggagccatacagaaacctagggactaagtgaaaaatcagtgtgtgcactgagagaactccagtctcttcaytgatttcacagaatgctagcaaccaggtttatatttgcttctcaaggtaagaggtatgaatttctcctctagagaaaagaaaatctccctgtaatatctg

SEQ ID NO: 60445 - DNA, 201 bp, Homo sapiens
tatacttgtttcattttataaaatccaaattcagtttaaacctgtggctacagagtgtgaggaatattataaacatgtttacatgatagtgtgtgaagaaraagaataatgaatattaaatgttaccttaggcataaatatggttacattatcatttgtttgaagaatgaacttttttttcttttaaggctgaaaaatcat

SEQ ID NO: 60446 - DNA, 201 bp, Homo sapiens
tccctggatggatccatcccatctggagctctggaatgagacacagtgagattagtgagtggtatgataagacgagaaactctgaaaggcatgattaagakatggtgaaaggtggctattgcacaagcttgggtaagataagcctgggggatcctctaaatataattaaagtaatccctcaattacacattatagaaaagg

SEQ ID NO: 60447 - DNA, 201 bp, Homo sapiens
tattgtcttactattaacaacatgaagccaatcattcagatattattaagttactgcaacgtcacaaacgccaggactttaggtgagccatcctaagagcrgattcagggtttgtgaagccaagagtttatacatatgtttggaaccttcttttttaaaaatataaaagtcaaaatcaagtctagaactttgtatggaggc

SEQ ID NO: 60448 - DNA, 201 bp, Homo sapiens
gtcagccatggtagctgatttggaatcccatcctgtaagttacagttggataccctagaaaaaacacccttactaagctttggtttcctcttatgtaaatrataatagctaacatttattgagtgtctgctacgtggcaggggtgttctatgcagtttatcatgttaactaacttaaaactcagaacaattgcagagatag

SEQ ID NO: 60449 - DNA, 201 bp, Homo sapiens
tgggctggtcttgaacttctggcctcaagtgatccacccacctcggcctcccaaagtgctgggattacaggtgtgagccaccgtgcctggcctgtttctgmtacctttgtgatatccaatgctgtgtgtcaccctttcagccaacctgtttgcttgaggttagtgagactgtagtactgcttggagaggggtcatcctaaa

SEQ ID NO: 60450 - DNA, 201 bp, Homo sapiens
taagaataaaaataagcattgcttgagattttttttttttttgagacagagtctcattctgtcacccaggctggagtgcagtggtgtgaccttgggtcccygcaacctctacctcctgggctggagcaattcttctgcctcagcctcctgagtggctaggattacaggtgtgcaccaccacgcctggctaattttttgtac

SEQ ID NO: 60451 - DNA, 201 bp, Homo sapiens; identical to SEQ ID NO: 11642

SEQ ID NO: 60452 - DNA, 201 bp, Homo sapiens
atgtgtaagaaaataagaactaggtaggggtaaggaaacaatcatggtgaataagcggtcaggcatctgctgcagtgatctggtgagtttccattcttttmtacttttttagaagcctgaaggtcctgtcctgaggaaggaacttagataaaacaaatataagtttcacactttaagaccaggagggtcaacttctatgtt

SEQ ID NO: 60453 - DNA, 201 bp, Homo sapiens
tatgaaccttgcctttttctttcagagaatttttcacacagccattgagcaattagagtgctggcatttccttcctaggtcttttgagatttaatccccartagctcctcatggcacagattcacatatcaactaagtaaaaataatagtgatgacagaaataaaatgaatagtgatgcatctggacaacttgaaaacatt

SEQ ID NO: 60454 - DNA, 201 bp, Homo sapiens
agaatgatgaggattaatgagttttactacttgggctgagctgctgtatacttgtttcattttataaaatccaaattcagtttaaacctgtggctacagaktgtgaggaatattataaacatgtttacatgatagtgtgtgaagaaaaagaataatgaatattaaatgttaccttaggcataaatatggttacattatcat

SEQ ID NO: 60455 - DNA, 201 bp, Homo sapiens
tgtctttatagggctgcctcttatttttgccctaattttctctcccttcccccctttatgtcttacatctgccccgccgtgcttttcttaaaactttgctytgcctcttctatcttcttttcttcctttttcctaatactttttttctcaacagggtctccttccattcctgatgaaaatctattttctggttctcttgcc

SEQ ID NO: 60456 - DNA, 201 bp, Homo sapiens
atcactgagacaacaagtattgccaatgaagaaggctttaatcaggtgctgcagctgaggagatgggagcacagtctcaaatccatctcactaactgactwaaactaggggtttacatagcaagggaaaaatgtaacaatgtgtaagaaaataagaactaggtaggggtaaggaaacaatcatggtgaataagcggtcagg

SEQ ID NO: 60457 - DNA, 201 bp, Homo sapiens
gcatccagacatgaataacaaaaaccagtttttaattttttcagacaaatgcaagattattatctgatcattccaaaccaactgctgaaacggtagcaccygacaacactgcaatccccagtttaagggctgaagctgaagaaaatgaaaaagaaacagcagtatccacagaagacgattcccaccataaggtaaaagtaa

SEQ ID NO: 60458 - DNA, 201 bp, Homo sapiens
tttacttgattggaagctggcatttggtatgttttttaaaaccccaggcaattttgttgtgctgctgccagggctgaggaccactgtcataataatggggmcctgagaaagctctgtcagttgccagaagtcgttaagcttcctattatgaggacttgccataggacacaaataagcccaaagattacagtacattttctg

SEQ ID NO: 60459 - DNA, 201 bp, Homo sapiens
aaagaaaatgaagtataaaggtataattttttttaatcaataaaacaggccaggcacagtggctcatccctgtaatcctagcactttagggggctgaggcrggcagatcactttgagctcaggagtttgataccagcctgggtatcatggcgaaaccctatctccaggaaaaaaaaaaaaatcaataggagagatgtaagg

SEQ ID NO: 60460 - DNA, 201 bp, Homo sapiens
ctatgtaccccatgaatatgtataattgttatttgtcaatttaaaaataaaattaaaaaagaaaatgaagtataaaggtataattttttttaatcaataaracaggccaggcacagtggctcatccctgtaatcctagcactttagggggctgaggcaggcagatcactttgagctcaggagtttgataccagcctgggta

SEQ ID NO: 60461 - DNA, 201 bp, Homo sapiens
atgttttataattttatcttttaattccatttctcaatgaactttttgaagtccccttatcacaattatcaaagctatgtaatattcattaaaaaaaaaaagctgctgtgaagatagcagaatatggctacaccacagctcccaagtttacatgttaaggtccagcttcccacagatactcctccaactttctcattcttg

SEQ ID NO: 60462 - DNA, 201 bp, Homo sapiens
gggtgcagcaaaccactatggcatgtgtatacctatgtaacaaacctgcacattctgcacatgtatctcagaacttaaagtataattaaaaaaaaaaaaaacggcagtgatcctgagctctggggagactgcaatgagcagagccctcctgccaacttgtattggacttgtagcaggattgcaaaattgacttctgtttct

SEQ ID NO: 60463 - DNA, 201 bp, Homo sapiens
ggatgtgaagaaataggaacgctttcatattgttggtgggagtaaattagttcaatcattgtggaagacagtgtggcaattcctcaaggatctagaactayaaataccatttgatacagcaatcccattactgggtatatacccaaagggttacaaatcattctactataaagatgcattcacacatatgtttattacagc

SEQ ID NO: 60464 - DNA, 201 bp, Homo sapiens
ttccaaacaatagaaaaagagggactcctccctagctcattttatgaggccagcatcatcctgataccaaaacctgaaggatatacaaaaaaaaaaaaaaattcaggccaatatcactgatgaacatggatgcgaaaatcctcaataaaatactggcaaaccaaatccaggagcacatcaaaaagcttatctaccacaatc

SEQ ID NO: 60465 - DNA, 201 bp, Homo sapiens
aatcaattgaacccaggaggcagagattgcagtgagctgagatcactccactgcactccagcctgggcaacagagtgagactccgtctgaaaaaaaaaaaatacttagggtgcatatccacggtctccagcagcattttcttcaagatcaaatagatgctggctgagaaattttgagagtctataatgaaaacagaaacca

SEQ ID NO: 60466 - DNA, 201 bp, Homo sapiens
ataaaaacattggggaaaaactcacatcagagttcttactagcaacactggaaattataagaaaatagaccaatgttttaaaaaaaattctgagaaaaaaatactccaatctagaattctatatctattcaaactatgtatcaagtaaagggtaaaatacagatatttttctaatatgcaataccttaaaaattctgtctc

SEQ ID NO: 60467 - DNA, 201 bp, Homo sapiens
agaaagaaaagacaaaaaatagaagggcaaaaatcattaaggaactaacacataaaatgctccccagaactgaaatatataaatttccaaattcaaagggmctaatgagttcctaaactaaatgtaaaagtatccaaactaaggcagagatggtaatatttcagaagactagggccaaatgtaaaaacataaaagcatcca

SEQ ID NO: 60468 - DNA, 201 bp, Homo sapiens
ggtcaagtgactacatctaaaacaatcaggtatggccagtagatgagaaccaggttgtaccaacatgactgctgggtacacccctatagatttagggtggsggaaggacagttcctgtgaagacagaaaacttgtgaatcaacatcccaaaagctgtcaaccttacccacaaatactttatttcgttggcagtttttatct

SEQ ID NO: 60469 - DNA, 201 bp, Homo sapiens
tttcagacaaatgcaagattattatctgatcattccaaaccaactgctgaaacggtagcacctgacaacactgcaatccccagtttaagggctgaagctgragaaaatgaaaaagaaacagcagtatccacagaagacgattcccaccataaggtaaaagtaacatcatttatattaatacaattttttaattctccaaag

SEQ ID NO: 60470 - DNA, 201 bp, Homo sapiens
ggccacatctgtaaggcagaccaacagggaaaacctcactgtgtctgccaggatccagtgacttgtcctccaacaaaaccccttgatcaagtaagtattcygcaaaatagtctttaagtggctccaaaaggttagtgactgaaataaaaatatttgccattgaaatttttgcttaaaaaaggtagatacctaggttatcat

SEQ ID NO: 60471 - DNA, 201 bp, Homo sapiens; identical to SEQ ID NO: 11628

SEQ ID NO: 60472 - DNA, 201 bp, Homo sapiens
caatcaaatgtaaaagatcaacccaagactcacacttcatgtcaaattataattgtgcttcctaaaccctactaccttaagtgtgtgtgtgtgtgtgtgtggttgagaaaaaagtgtgagacatctcttacaggaaacaaatactcagtggcaagataagaggtgctcattaatgtccttcatcattatgtaagtttaaac

SEQ ID NO: 60473 - DNA, 201 bp, Homo sapiens
acaatcaaatgtaaaagatcaacccaagactcacacttcatgtcaaattataattgtgcttcctaaaccctactaccttaagtgtgtgtgtgtgtgtgtgtggttgagaaaaaagtgtgagacatctcttacaggaaacaaatactcagtggcaagataagaggtgctcattaatgtccttcatcattatgtaagtttaaa

SEQ ID NO: 60474 - DNA, 201 bp, Homo sapiens
acagcagtgtgttatcagctcagtgagccctttgcctcatcacgtagggcaactgccttccgccagcaagggcaaagggccagtgcgaccgcctttttggrtacctgcacgtagtgtgtccgagttcttgtccagtgcccaagaggaatgaggtcacacagatgaattgaaggatggcgaatgtggagaattttttttttc

SEQ ID NO: 60475 - DNA, 201 bp, Homo sapiens
tctcctaggtatcaggcatttttaccagtaccatttcttctaactctcacaaaactgaattagatgttttattagtcaaggttctccagagaaacagaacmaataggagataggtaggtaggtaggtaggtagatagatagatagatagatagatagatagatagatagatgatagatagatagagatatagataatgagg

SEQ ID NO: 60476 - DNA, 201 bp, Homo sapiens
ccttgcctttttctttcagagaatttttcacacagccattgagcaattagagtgctggcatttccttcctaggtcttttgagatttaatccccagtagctyctcatggcacagattcacatatcaactaagtaaaaataatagtgatgacagaaataaaatgaatagtgatgcatctggacaacttgaaaacattatttat

SEQ ID NO: 60477 - DNA, 201 bp, Homo sapiens
ttacaattgtctctcacaggtcatgctactggtctgtcctccacacagctgtcacacatacaaatctggttatatcatcacccctgtccacacatgtgtgyacacacacagacatacacacatgcgtgcacacacagacacttacaataattctttgggtccctatagctctatggctggaatttttaattccttgtttaa

SEQ ID NO: 60478 - DNA, 201 bp, Homo sapiens
tgataattcttactccccttttaagttgtaccatttgtaagaaaatagggtagcattccatgtgcctaattccactgttatgtgtgatgaatgtcggaaayactcctggcattaaaaggagcctaaatgtgtggccagaatggactttaatgttccactggacaatttttctgacctcacagcaaaacttaaattacatta

SEQ ID NO: 60479 - DNA, 201 bp, Homo sapiens
tttctctgagaaagagaaaatagtagcacagataccatagtaggacttgagcaaagaaaaataaatatggccaaaataatgtctcccactataacacaggrcagggtgtggtggaccctttctgaaggattggcaaatgtctgagaaaaagaacaggcaactgtctccctggatggatccatcccatctggagctctggaa

SEQ ID NO: 60480 - DNA, 201 bp, Homo sapiens; identical to SEQ ID NO: 11643

SEQ ID NO: 60481 - DNA, 201 bp, Homo sapiens
aatgtctataccccaaatacaacaaaaagttcagaaaaataaataaatgtaaatatgagaaaatcctgtgttctctttctctgagaaagagaaaatagtarcacagataccatagtaggacttgagcaaagaaaaataaatatggccaaaataatgtctcccactataacacaggacagggtgtggtggaccctttctgaa

SEQ ID NO: 60482 - DNA, 201 bp, Homo sapiens
gcccagcagccggagatacaccagtccaaaggaagcaagaactccgaggctctgggagtgccacttccaaggggcgaaatggacacgagggatttccttasggggttgttgatgtagctctgttgttgttattgttgttaccatattaagaggaaattttaaattttgttggaaaattcaggaagaataagtgatgggtgc

SEQ ID NO: 60483 - DNA, 201 bp, Homo sapiens
tgtatggaggctgcacaagtgaggggccttgaaactcaagcttcctagttttatggcacgtctatcctggccatattcaaatgtctataccccaaatacarcaaaaagttcagaaaaataaataaatgtaaatatgagaaaatcctgtgttctctttctctgagaaagagaaaatagtagcacagataccatagtaggact

SEQ ID NO: 60484 - DNA, 201 bp, Homo sapiens
cctggttgagataaacggaaacagttctcaaaacagtaatttatgaaaatagatattttatgagtacttgacacaagtctataattgctgagatatttaawaataaaattactaaccacattctattcaaatctctgtcacttctgtataatcactgtactccactgaatgtgtgtaaaatatgtatttgcagcttatagg

SEQ ID NO: 60485 - DNA, 201 bp, Homo sapiens
catcacaataatgaaaactgcataggaccaaacataaggtgcccccaaatacaatgccatcttcatctttctagtgagaacatcctcaaccaaagtgtttrgccaaacagcatgtacaaatgggtaatatattgtaatgtacacttgggatatttaatctatggttcacatacatatttaatatgttactttaatttaaat

SEQ ID NO: 60486 - DNA, 201 bp, Homo sapiens
aactgctgtcatgaagacctgttgttgctaagaggtcagatggttcaagagaaactggaaatttggattttgacatgaaacctctggaatttaaaatactrgtttaaaatgcacagtgcctaccaaaccaaacctatctgcaggccacccctaactcacagattgccagtaaagacctctaaatcagatgaacattaatac

SEQ ID NO: 60487 - DNA, 201 bp, Homo sapiens
aaaacttgtgaatcaacatcccaaaagctgtcaaccttacccacaaatactttatttcgttggcagtttttatctgtattctatttatatcacatatacarcaaccttatgggagaaaaatgtccttggtgagcctgagagttaaatcttcatgcacaagctactcaattaataggatgccatgtatttcattgcagagtc

SEQ ID NO: 60488 - DNA, 201 bp, Homo sapiens
attcagatcttagtgaagcctgaatcctgaaatgtgttttgtagaagtactttattacatatatgaaataaactataaagaaggtagtttttaaaaaaaawttcaaatcaaataatttgtatgttttccatgtttaaattatctaaagttattcaatctcctgagcctaacagcaatgtagaaacggaactttttgctttt

SEQ ID NO: 60489 - DNA, 201 bp, Homo sapiens
agtattaaaacatcttatctttcattaactttttattacgtttctgtttcagttcctccagtgttttctaggtcatgcaattatgaaaataagttagcatktttatcttacatctcaaacaactaatgtattcagtgttctatcccatgcaaaattccagaaatgcagcaaggagcaaaactagagaggggctgagctctt

SEQ ID NO: 60490 - DNA, 201 bp, Homo sapiens
tggcattgggatgcagcaggtgcctgctgacaccttaatttcagacctttagcctctagaacttcaagaaaatacatttctgttgttttaagccacccagyttgtggtaatttgttatgacagcccaggaaactaatgcaaacctcttatggctctatagaaccacgtgattgtacggcactaagataatctaacccttta

SEQ ID NO: 60491 - DNA, 201 bp, Homo sapiens
caacccatttggacgtctcatacgttttctaaatctgatctgtagctccatctgttaggtgagtattgttgcaggtttattgtcctcagctttctgaactrtaaactattttagaaaaaacagcttcagaaacaatgagagtttgaatatctgccaacaaacatttccaaataaagctatactgaaaagacaccgcgaatt

SEQ ID NO: 60492 - DNA, 201 bp, Homo sapiens
ccagagaaacagaacaaataggagataggtaggtaggtaggtaggtagatagatagatagatagatagatagatagatagatagatgatagatagatagakatatagataatgaggacttagtttacattaatggagccagtcccaagatctgcagtcagcaaattggaaagccaagagagccaattgtatagttcccgtt

SEQ ID NO: 60493 - DNA, 201 bp, Homo sapiens
catccctgtaatcctagcactttagggggctgaggcaggcagatcactttgagctcaggagtttgataccagcctgggtatcatggcgaaaccctatctcyaggaaaaaaaaaaaaatcaataggagagatgtaaggtaaaagtgagaaagtttcccagaatgatagacacactgttgaagagaagagcaaaaatgattag

SEQ ID NO: 60494 - DNA, 201 bp, Homo sapiens
ccagcagttcgagggtacaggaggctatgattgtgccactgcactccagcctgagtgacagagcaagaccctgtctcaaaaaaaaaaaaaaaaaaaaaaargatttgtgtgtagagatcacaaacgcaacttcagggaccaaacatgtacagtgtataggccgaactgtaactttataagaaagtagaaagtaatgggcta

SEQ ID NO: 60495 - DNA, 201 bp, Homo sapiens
ggcagaggttatagtgaaccaagattgcgccattgcactccagcctgggcaacagagcaagactctgtattaaaaaaaaaaaaaggaaaaaaaaaaacttyatttgctgagttagaaccaaagacccacaaagacccacaggaattcctatgtgtcacactaaaaatgatgatgataatgacagaggaaaatatgaagaaa

SEQ ID NO: 60496 - DNA, 201 bp, Homo sapiens
attaccatatataaaatattttattttaatacaataaaaatcatggaatatattttagtgggtttagtagtttaaggggaaaagatagcagcaatttaggrttcatacaattaatggaattattttcaattttagaatcctaaaatattagggttagaggatcatctaggtctcactcttcattgttcatcacttgagaaa

SEQ ID NO: 60497 - DNA, 201 bp, Homo sapiens
ttttcaatgattctttacaattagcattcactaggaggatagaatgttttaaattatcatcgctaatagagtccacatatttactttaagcatgaattacyatatataaaatattttattttaatacaataaaaatcatggaatatattttagtgggtttagtagtttaaggggaaaagatagcagcaatttaggattcat

SEQ ID NO: 60498 - DNA, 201 bp, Homo sapiens
atatttgtggaataaatgaataaataagtaaacattgaatttaaaatgtagaggaaagaaactgcgtttttcaatgattctttacaattagcattcactargaggatagaatgttttaaattatcatcgctaatagagtccacatatttactttaagcatgaattaccatatataaaatattttattttaatacaataaaa

SEQ ID NO: 60499 - DNA, 201 bp, Homo sapiens
tgcactgcttgatccaattaattctaactttttgtgcagttgagcatgtgtgctggggaagagggcggccctgcaaaaatttcacataatcattgcctcamaataaagaaaatgtaatggtaaaacaggtagagggccataaagcgtcttgatgtccaatgtagaaagagattaaatattattaatgtaaattgatagcga

SEQ ID NO: 60500 - DNA, 201 bp, Homo sapiens
ctgtctctatgaaaacttaaaaaaatagccaggggtggtggcatgtacctgtgatcccagctacttggtggacttaggtaggagaattactcgagcccagyaggtcgaggctgcagtgagctattgtgccactgcactccagcctgggtgacagggcaaggccctgtctcaaaaaataaataaatgaaaataaaatgtgaa

SEQ ID NO: 60501 - DNA, 201 bp, Homo sapiens
gactttgggcaaacaacttcatctctttgtgcctcagtctcttcattcatggaaatgggattataaaatcagtagctacctcagagatttgttgtaagaaktaagtgaagaaaagagccatgtttggtacattaaagcaatcaatcaatcgtagataatatgaaagtactggactaactatatgtccctattgaaactccg

SEQ ID NO: 60502 - DNA, 201 bp, Homo sapiens
gcccacacagagtagtataatagtttgttagggtgggccatgttggtaaggagtgatcttatatttgctagaggatgctgtcttcttccacaggtatggcracaatttctttcacaagctactcaattaaaaactggaataacctagcactacacttctatttatttccattatttttcagctcaccttctagattagtat

SEQ ID NO: 60503 - DNA, 201 bp, Homo sapiens
agcaacagaaagaagacaaaggctatgggtgcaaatataagtaaacgtataactaatgaagctattatctccattttacatatgaagccagtactcaaaawaaaaaaatcaaagtccataatctttcccattctctgggctagataaagattattagcaggaaaattacctagtgcccacacagagtagtataatagtttg

SEQ ID NO: 60504 - DNA, 201 bp, Homo sapiens
gcttgaacccgggaggcagagtttgcagtaagccaagatcccaacactgcactccagcctgggtgatagagtgagactcggtctcaaaaaaaaaaaaaaaatgaaagatgttcaaacaatgagcattcaaatctactcgcaattctcaccacacacacacacacaaaaatgatagtatgtgaggtaatgcattcgttaatc

SEQ ID NO: 60505 - DNA, 201 bp, Homo sapiens
tgcttgaacccgggaggcagagtttgcagtaagccaagatcccaacactgcactccagcctgggtgatagagtgagactcggtctcaaaaaaaaaaaaaaaatgaaagatgttcaaacaatgagcattcaaatctactcgcaattctcaccacacacacacacacaaaaatgatagtatgtgaggtaatgcattcgttaat

SEQ ID NO: 60506 - DNA, 201 bp, Homo sapiens
aatactggagatacagcaacgaaaagaaaatctctgccttcatgagtttacattctgggtgaagagacagactctaaacaaataagtatatatgtgtgtgygtatgtaatgtttgtatatgcatatatttgtacatacatatatatgcatatatgcaattatatatagtaaaatgagcatttatgtaaatataaccaaatc

SEQ ID NO: 60507 - DNA, 201 bp, Homo sapiens
ctctgggaaaggcatctctgaaagtaaggcagcagccccagtcaggggtttatagataaagctcccatctccttgggacagagcacctgggggaaggggcrgctgtgggcagagcagacttaaatgttcctgcctgccagctctgaagagagcagcagatctcccagcacagcactcaagctctgctaaggaacagactgc

SEQ ID NO: 60508 - DNA, 201 bp, Homo sapiens
gcactttagggggctgaggcaggcagatcactttgagctcaggagtttgataccagcctgggtatcatggcgaaaccctatctccaggaaaaaaaaaaaaatcaataggagagatgtaaggtaaaagtgagaaagtttcccagaatgatagacacactgttgaagagaagagcaaaaatgattagcaaatcggagaatcaa

SEQ ID NO: 60509 - DNA, 201 bp, Homo sapiens
agcactttagggggctgaggcaggcagatcactttgagctcaggagtttgataccagcctgggtatcatggcgaaaccctatctccaggaaaaaaaaaaaaatcaataggagagatgtaaggtaaaagtgagaaagtttcccagaatgatagacacactgttgaagagaagagcaaaaatgattagcaaatcggagaatca

SEQ ID NO: 60510 - DNA, 201 bp, Homo sapiens
ttttttcagacaaatgcaagattattatctgatcattccaaaccaactgctgaaacggtagcacctgacaacactgcaatccccagtttaagggctgaagmtgaagaaaatgaaaaagaaacagcagtatccacagaagacgattcccaccataaggtaaaagtaacatcatttatattaatacaattttttaattctcca

SEQ ID NO: 60511 - DNA, 201 bp, Homo sapiens
atacattatatgtagtgaagcatcactatgtaccccatgaatatgtataattgttatttgtcaatttaaaaataaaattaaaaaagaaaatgaagtataarggtataattttttttaatcaataaaacaggccaggcacagtggctcatccctgtaatcctagcactttagggggctgaggcaggcagatcactttgagct

SEQ ID NO: 60512 - DNA, 201 bp, Homo sapiens
aaatgataagtattacacccaggcagaagcttcacaaaccaagcatattttgctgtatctgtttttcttctgccaagggaattggtccatcagcctacacwccagaataaagacatgtaacagaattgcagcagacctgcaataaacatgtggcaagaatagaaaaaaaaaaaaatttgttgttgtaagcatctgatattt

SEQ ID NO: 60513 - DNA, 201 bp, Homo sapiens; identical to SEQ ID NO: 11632

SEQ ID NO: 60514 - DNA, 201 bp, Homo sapiens
tcccagttgtctcaattatttgtgtctttatagggctgcctcttatttttgccctaattttctctcccttcccccctttatgtcttacatctgccccgccrtgcttttcttaaaactttgctctgcctcttctatcttcttttcttcctttttcctaatactttttttctcaacagggtctccttccattcctgatgaaaa

SEQ ID NO: 60515 - DNA, 201 bp, Homo sapiens
ctccagagaaacagaacaaataggagataggtaggtaggtaggtaggtagatagatagatagatagatagatagatagatagatagatgatagatagatagagatatagataatgaggacttagtttacattaatggagccagtcccaagatctgcagtcagcaaattggaaagccaagagagccaattgtatagttcccg

SEQ ID NO: 60516 - DNA, 201 bp, Homo sapiens
gtccaaacatcttatttaaatctaagcatttgttttgttctcataggccagacatagatgtatgatataaagtaaatccattactcaaaatatcagtaatmtattaagattaaaaagcacagaacattgattccaaaagcttccagagaaaattcattcaccagatagttattgagtgtatcctgggtgccagaaattgac

SEQ ID NO: 60517 - DNA, 201 bp, Homo sapiens
gagattctgcttccacttaacattctgttctaggcatctgcttatatcctcaaaaactctagagaatatttttaaattgttggtataaatgaagtatattsctactaataatgatgacaacaagagtaactagcaaatttgtaaattagcatccagacatgaataacaaaaaccagtttttaattttttcagacaaatgca

SEQ ID NO: 60518 - DNA, 201 bp, Homo sapiens
cttcctggggatctccactattccaaaagaatcatgtgacctctgacaatgagcatatgccttggctcttggactcctaataggcaggaagtacatctttsatatcacccagaggcttctgctatatgtaacaaagaagttctgtatatgcttgaggattaattaacgtgttctctgctccttcccctgaattaggggttt

SEQ ID NO: 60519 - DNA, 201 bp, Homo sapiens
atgttgtttttagactttttaattacagccattctgactggtgtgaaatggcatcttattgtgagatggttttgatttaaattttcctgatgattagtaaygtggaactttatatatatttgttggccgcttatatatcaagacagggttttggaactgaaatgcatatttgaggattataagcatacagagaataattga

SEQ ID NO: 60520 - DNA, 201 bp, Homo sapiens
gagagaagtaaacatattcaagatatattttaagatataagcatactcaaatatatagcatgtggaaataagacaatatttgataggaaatatgtgggagycgagagcagacaggtgagagactgaaaagagaagtgcaatgcctaggtccctggctcagagcaggcagggtaaatagaggtaaatagaggcatcttccac

SEQ ID NO: 60521 - DNA, 201 bp, Homo sapiens
taatcccagctacttgggaggttaaggcaggagaatcgctggaacccaggaggcagaggttacagtgagctgagattgggccactgcaatccagcctgggygacagagtgagactctgtctcaaaaaataaaaaataaaaaactaaaataaaataaaatccactagttctaacctatctttctccttttagtttcacttat

SEQ ID NO: 60522 - DNA, 201 bp, Homo sapiens
cttatctgtaaaaatggggttcaggtaacaggtgcaggaatcctcatttattttgtgcccatgcataccatgcattgacacatacccatgctaatcgtcagaaaaccctccaagtgagactaacagggtaaacaactcagatgacgcaagttcccctaagccatttaaagacattatcctaagagtactggggggccacca

SEQ ID NO: 60523 - DNA, 201 bp, Homo sapiens
aggcagaacaatgaaaataataatcatttgcatgtgtaaggtacttcagagtttgcaaagagcttcctcacctcaccttgcaaggagctacctttgacatyggaaggaactggtattcccatcctatatatgaagtttggagagagaaagtaatttgttcaaggtagtatttagtacttggcaaagccagggcccaaagcc

SEQ ID NO: 60524 - DNA, 201 bp, Homo sapiens
tacaggggtagtagagaaacaaataaattaaggggtagggagaagagttaaaggcagaaaaagcagaggattaatctatctgataattacaggggctaggytttaaaaggtgtattgtcttactattaacaacatgaagccaatcattcagatattattaagttactgcaacgtcacaaacgccaggactttaggtgagcc

SEQ ID NO: 60525 - DNA, 201 bp, Homo sapiens
caaggttctccagagaaacagaacaaataggagataggtaggtaggtaggtaggtagatagatagatagatagatagatagatagatagatagatgatagatagatagagatatagataatgaggacttagtttacattaatggagccagtcccaagatctgcagtcagcaaattggaaagccaagagagccaattgtata

SEQ ID NO: 60526 - DNA, 201 bp, Homo sapiens
cttgctaatggttttggcaactggtctgttttgccttattttggttttcggttgctgtaaaacagtatgctctcacattaaatggcttaaaatcacatccytgtatttgctcataattctccaatctggattgggctccactgcatgattcttctgctgattttgtctggagttaattcatctggcttcagtgagctagga

SEQ ID NO: 60527 - DNA, 201 bp, Homo sapiens
tcaaggttctccagagaaacagaacaaataggagataggtaggtaggtaggtaggtagatagatagatagatagatagatagatagatagatagatgatagatagatagagatatagataatgaggacttagtttacattaatggagccagtcccaagatctgcagtcagcaaattggaaagccaagagagccaattgtat

SEQ ID NO: 60528 - DNA, 201 bp, Homo sapiens
attagtcaaggttctccagagaaacagaacaaataggagataggtaggtaggtaggtaggtagatagatagatagatagatagatagatagatagatagatgatagatagatagagatatagataatgaggacttagtttacattaatggagccagtcccaagatctgcagtcagcaaattggaaagccaagagagccaat

SEQ ID NO: 60529 - DNA, 201 bp, Homo sapiens
gcctcataagcggacctcagaataacaggatttctctctctctaatcttctatttttttacctgctactttttctccccaaggcaggactctaatcttccyctgcctttacctaccttgtgtgattgtaggtcataagacccccatttcagaaggggttctgccccatattctggaggaaggaatgttgcatggagaggcc

SEQ ID NO: 60530 - DNA, 201 bp, Homo sapiens
catgtatctatatatgtatatatttatctatatacgtatctacattacatacatatatgtatctatacacacacacacacacacacacacacacacacacatatgtttcatccacggttcctgtctcataattcccatagacctttttataatgttataatgttggtgcattttaggcctcataagcggacctcagaataa

SEQ ID NO: 60531 - DNA, 201 bp, Homo sapiens
acatgtatctatatatgtatatatttatctatatacgtatctacattacatacatatatgtatctatacacacacacacacacacacacacacacacacacatatgtttcatccacggttcctgtctcataattcccatagacctttttataatgttataatgttggtgcattttaggcctcataagcggacctcagaata

SEQ ID NO: 60532 - DNA, 201 bp, Homo sapiens
tacatgtatctatatatgtatatatttatctatatacgtatctacattacatacatatatgtatctatacacacacacacacacacacacacacacacacmcatatgtttcatccacggttcctgtctcataattcccatagacctttttataatgttataatgttggtgcattttaggcctcataagcggacctcagaat

SEQ ID NO: 60533 - DNA, 201 bp, Homo sapiens
taaatatattatatatttatagatacattattagtatatacatatatagatacgtgtatataatacatatatagatacatgtatataagtatatagattayatatgtacacatatagtatacatttagccctcaacctgtgggatctgacactatctccaggtgcacatacatagtatatacacatatgtatactatatat

SEQ ID NO: 60534 - DNA, 201 bp, Homo sapiens
taaacctgctttaaatatctttatctattttttcatccattttgtcaaggtgaccttcctaagaataaaaataagcattgcttgagattttttttttttttgagacagagtctcattctgtcacccaggctggagtgcagtggtgtgaccttgggtccctgcaacctctacctcctgggctggagcaattcttctgcctca

SEQ ID NO: 60535 - DNA, 201 bp, Homo sapiens
gctagtttactgtggcatacaggggaaaaacaactgggaaggcaaagaaagagaaatagaaatggcctcacatgatacacatactgcagcaaaccctgcaataaatccatttttcaagttcccactgcttcctcccatcttcacgatgtgctatggtgtagtggttatagaggggaattctggggcagactgcctggactt

SEQ ID NO: 60536 - DNA, 201 bp, Homo sapiens
gaaaaagttgatctcatagaagtaagaagtagaacagaggatacttgaggctgggaagggtgaggagaagaaaggaatagggagctatttgttaaaggacrtaaaactatagctaataggaagaataagttctagtgctctataccactgtaggatattatatatttcaaatagctagaaagaagacactgttcccaatac

SEQ ID NO: 60537 - DNA, 201 bp, Homo sapiens
ctgctccttggaagccctccaatgctccatggaactattctttggaagccctccaagccctgtccataaagttctaattggctttctagtgactcactgcraagtattaatggacagccaaatacatcagacattagagaaaagctttcaacaggaaaaacaaagatcaaaacaaactaactggggaaaaaaggaacaaga

SEQ ID NO: 60538 - DNA, 201 bp, Homo sapiens
acagaagaaaaaagacaaaggggattaccagggcgtggtgaccccaggtatggaccccaggagaaaagctgcccagcagccggagatacaccagtccaaargaagcaagaactccgaggctctgggagtgccacttccaaggggcgaaatggacacgagggatttccttacggggttgttgatgtagctctgttgttgtta

SEQ ID NO: 60539 - DNA, 201 bp, Homo sapiens
tcctgagctctggggagactgcaatgagcagagccctcctgccaacttgtattggacttgtagcaggattgcaaaattgacttctgtttctttaagccackgagatttagcattatttcttactgtagtatcagctaatagctacctttttctctattcaatagcacttgtgccctccacctacaaatttcaactctgatt

SEQ ID NO: 60540 - DNA, 201 bp, Homo sapiens
aggtcaatttccatgatttttcaggcacggaaatgcagatattggccattgaaagtccctggaactagctggaatgataaattatgacagatctgaaggayaggagatactggcaactgctgctctaatgccttgaaagcagatgccatattgttttcgagttgaatcaccagtgtccaacaaaatgtctctgacataaca

SEQ ID NO: 60541 - DNA, 201 bp, Homo sapiens
gtgagccgagacttcatcactgaactccaccctgggcaagaggctggagttaattaattaaaaattaatataatgaattaattttattaatgttttttaaytaataaaaaatattaacgacctgtcaaaccacagatagaaagtaaatagcagaggcaagacttgaatggaggcctcttacctccaagttcagttgttcaa

SEQ ID NO: 60542 - DNA, 201 bp, Homo sapiens
tgtttgtgctactactctggctactttctaaaagtgtcattttgcttcttgtttttttatagaggacatagatgaaaatctcttgttttgaacgaagattwtaaagaactcaactttccagcatcctcctctgttctaaccacttcagaaatatatgcagctgtgatacttgtagatttatatttagcaaaatgttagcat

SEQ ID NO: 60543 - DNA, 201 bp, Homo sapiens
ggtcagatgcccagaaaagtcttaagtcattgactctgagtatatcatatacactcacagggctgggacaccttgatgtcagatggtgactcagcagagarctcaaaatagaagaacgtctttttcacccttcagatgactttagggccaaaccatagagctctccccagagactcattaatactttaaaagctctaaagc

SEQ ID NO: 60544 - DNA, 201 bp, Homo sapiens
ggatcaataatggctttccttgatctgaagtctgaatagaggttaactctgtgtgtgtgcgtgtgtgtgtgtgtgtgtgtgtgtgtgtgtgtgtgtgtgtktttggtggtggtggctgggaggagcgggtgctggagagagaattctgacagcgtgaacacttgtgcaaagaccctggagcaagagggatcgtggcctatt

SEQ ID NO: 60545 - DNA, 201 bp, Homo sapiens
aactgtaaactattttagaaaaaacagcttcagaaacaatgagagtttgaatatctgccaacaaacatttccaaataaagctatactgaaaagacaccgcraattcaaaggcctttttttattcatttttctctcttgttttgttgtaagaaatacagtgggtctttattaatcatgttataaattaataagacctccaat

SEQ ID NO: 60546 - DNA, 201 bp, Homo sapiens
ggctagtttactgtggcatacaggggaaaaacaactgggaaggcaaagaaagagaaatagaaatggcctcacatgatacacatactgcagcaaaccctgcaataaatccatttttcaagttcccactgcttcctcccatcttcacgatgtgctatggtgtagtggttatagaggggaattctggggcagactgcctggact

SEQ ID NO: 60547 - DNA, 201 bp, Homo sapiens
taaaataaaatccactagttctaacctatctttctccttttagtttcacttattttgcttcaaaatttattactaaaaaaagcaattaattacattacacrttatatttaattttgttaaatatataatgtgtagtgtaattttgtgaaatataatgtgtaatgtataaacataatgtgtaatgtgtaacataataatgtc

SEQ ID NO: 60548 - DNA, 201 bp, Homo sapiens
ttatgaagagaatacttctttctataatatccattcttttgctttttcaaattcaccttgttgctttctttctctaagaagattttttttccccagctttmtataactttttcccaagttcaagcaaaatagttattttgcttttctgtttggactctctccaggctctcctaatatctggattcttaaaacattttttca

SEQ ID NO: 60549 - DNA, 201 bp, Homo sapiens
gaattctcccttcccctgcctttttgttctattcaggtccccagtggattgaattatgcccactcacattgggtagagcaatctgctttattctgtctacsaattcaaatgttaatttcttcagaacacaccctcagagacacacccaggaataatgtctaagtagatatctgggcatcccatggtctagtcaagttgaca

SEQ ID NO: 60550 - DNA, 201 bp, Homo sapiens
aggctgaggcgggcggatcacgagttcaagagatcgagaccatcttggctaacacggtgaaaccccgtctctactaaaaatacaaaaaattagccgggcgyggtggcgggcgcctgtagtcccagccactcgggaggctgaggcaggagaatggcgtgaacccgggaggcggagcttgcagtgagccgagactgcgccact

SEQ ID NO: 60551 - DNA, 201 bp, Homo sapiens
gagcactcctttcatttactcattcatttgctcaagaaatctttacaggccaggcgcggtggctcacgcctgtaatcccagcactttgggaggctgaggcrggcggatcacgagttcaagagatcgagaccatcttggctaacacggtgaaaccccgtctctactaaaaatacaaaaaattagccgggcgcggtggcgggc

SEQ ID NO: 60552 - DNA, 201 bp, Homo sapiens
aaggaaaaaaaaaaacttcatttgctgagttagaaccaaagacccacaaagacccacaggaattcctatgtgtcacactaaaaatgatgatgataatgacrgaggaaaatatgaagaaaatatgaaatggaagtcatctgttgtgaaatggagatgaaacatatacatatgttgccactccctgctaaaattccagaataa

SEQ ID NO: 60553 - DNA, 201 bp, Homo sapiens
taagtattacacccaggcagaagcttcacaaaccaagcatattttgctgtatctgtttttcttctgccaagggaattggtccatcagcctacactccagartaaagacatgtaacagaattgcagcagacctgcaataaacatgtggcaagaatagaaaaaaaaaaaaatttgttgttgtaagcatctgatatttggggat

SEQ ID NO: 60554 - DNA, 201 bp, Homo sapiens
gagttctggggtctttatgggcacaggatggggacggggcaggccgtaggtagttttggaaaaggcaatattcaattggtaaaaagacagtattcagaaakaaccaatcgggagagaatggaagttctcactttgggctgtgggtttcaggcttttcggcttgaaggtgggattttgccagcgacccgcccctgtatgcct

SEQ ID NO: 60555 - DNA, 201 bp, Homo sapiens
catttgtctgattctctgacagtcttctgccttcctaatcccaggtcaagaaaatttacctggatgaaaagaggcttttggctggggaccatcccattgaycttctcttaagggactttaagaaaaactaccacatgtatgtgtatcctgtgcactggcagtttagtgaacttgaccaacaccctatggataggtaagaac

SEQ ID NO: 60556 - DNA, 201 bp, Homo sapiens
taaaaacattggggaaaaactcacatcagagttcttactagcaacactggaaattataagaaaatagaccaatgttttaaaaaaaattctgagaaaaaaawactccaatctagaattctatatctattcaaactatgtatcaagtaaagggtaaaatacagatatttttctaatatgcaataccttaaaaattctgtctcc

SEQ ID NO: 60557 - DNA, 201 bp, Homo sapiens
ctaaaggccatgaaattatttttgatcaatatgtggcaaatacaattagctcagtgagacaaaaatgcccagtgactagtctaaaggacaacgtggaacayaatggaagaacacaaggcgttttaaagtctagatactggattgtcccacaaggtccttcaaaaataaaacacaggcatcttctttataattgaaacttga

SEQ ID NO: 60558 - DNA, 201 bp, Homo sapiens
tcagcacatttgctcagttcttaaaataagaagctaaaggccatgaaattatttttgatcaatatgtggcaaatacaattagctcagtgagacaaaaatgyccagtgactagtctaaaggacaacgtggaacacaatggaagaacacaaggcgttttaaagtctagatactggattgtcccacaaggtccttcaaaaataa

SEQ ID NO: 60559 - DNA, 201 bp, Homo sapiens
ttatagggctgcctcttatttttgccctaattttctctcccttcccccctttatgtcttacatctgccccgccgtgcttttcttaaaactttgctctgccycttctatcttcttttcttcctttttcctaatactttttttctcaacagggtctccttccattcctgatgaaaatctattttctggttctcttgcctatac

SEQ ID NO: 60560 - DNA, 201 bp, Homo sapiens
cctaggtatcaggcatttttaccagtaccatttcttctaactctcacaaaactgaattagatgttttattagtcaaggttctccagagaaacagaacaaayaggagataggtaggtaggtaggtaggtagatagatagatagatagatagatagatagatagatagatgatagatagatagagatatagataatgaggact

SEQ ID NO: 60561 - DNA, 201 bp, Homo sapiens
aaaaggtaggaaaatttctccttttatactatattcttgtttgattatttttaagttattgcgattattttccctttcttggttcccttttacagctttayaactaattattttttgcctcctactatcatttgttaagatgctcacacatagacctaaaatttctctaattcttgataatgtcttatttacaaaagcaaa

SEQ ID NO: 60562 - DNA, 201 bp, Homo sapiens
ggatcaactgataataacgcataaaaagctgttagcacagtgtctgacacataataaatgtgtgataaatgtagaagtagcagtagaagagattagacacmtacaaacaaccagaatcccgggccaaaaataagtgcacacctccattctttttatgggaaacctccttcttagataccaaccattataaccatggagtta

SEQ ID NO: 60563 - DNA, 201 bp, Homo sapiens
ggaagaaataaattctcccagggaagctcatcacattgttattataaacccaagattttaggccaggtgcggtggctcacgcctgtaatcccagcacttcrggaggctgagatgggcggatcacctgaggtcaggagctcaagaccagcctggccaacatggcaaaaccccgtctctactaaaaaatacaaaaattagccg

SEQ ID NO: 60564 - DNA, 201 bp, Homo sapiens
aatatggccaaaataatgtctcccactataacacaggacagggtgtggtggaccctttctgaaggattggcaaatgtctgagaaaaagaacaggcaactgyctccctggatggatccatcccatctggagctctggaatgagacacagtgagattagtgagtggtatgataagacgagaaactctgaaaggcatgattaag

SEQ ID NO: 60565 - DNA, 201 bp, Homo sapiens
caatccaaccactgtatgacactacccctcaaatgggaacacagtaaaacttaccatgcgtagtgaggatcaactgataataacgcataaaaagctgttarcacagtgtctgacacataataaatgtgtgataaatgtagaagtagcagtagaagagattagacacatacaaacaaccagaatcccgggccaaaaataagt

SEQ ID NO: 60566 - DNA, 201 bp, Homo sapiens
atgaagccaactctgaacacgctggttatctaaatgagaagcagagaaataaagtaagttatccacaggttagcttcttcaatgtctgtctacagggcatraggaagaaagacgtggtgggggggctacctacctctgcatactggcaaaagcccactatgcttccccatgcccggttagcccatgtggcttaacagaata

SEQ ID NO: 60567 - DNA, 201 bp, Homo sapiens
ttaatctttatgcccgagtttccttactagtgaaatgattacaataatgtgcttacctgatagaactgttcagaaggtttaaagaatatgtgtgtgcaaakctcttagaatagtgcctagaacttaagtactttggatgtagtaaagttagctattatcaactacctaatttaaaaatgcctcctatctctctttccattg

SEQ ID NO: 60568 - DNA, 201 bp, Homo sapiens
cagagcattttctaaaaaaggggagcattttttagaataaaagagatttgagcactcctttcatttactcattcatttgctcaagaaatctttacaggccrggcgcggtggctcacgcctgtaatcccagcactttgggaggctgaggcgggcggatcacgagttcaagagatcgagaccatcttggctaacacggtgaaa

SEQ ID NO: 60569 - DNA, 201 bp, Homo sapiens
gatggtcaggaagcactcactgaatggtagttctgtgaaatggaggtgagggtcacagatgggagtgcatggatggtacacaggtgaagtgcttagcataraacctggcatatagtaaaatctcaggaatgtatatgccattgaatgagctactattaaatggtctaagacaaaaatgtactttttcaataaaataatact

SEQ ID NO: 60570 - DNA, 201 bp, Homo sapiens
ctgttattgttttgcaagctcgaacaatatgctgaaagttccagtgaacaggtgaacttctaattgtatttttaaataatgcattcatcattttaaaagtytgccattgtctgaaatgactgacatcatgtttctttttacagagatttatcttttacccaccacaagtaccaccatttttccctcaggtcctctttcccc

SEQ ID NO: 60571 - DNA, 201 bp, Homo sapiens
tgaaactttccaaattttgatactgaaatatgaggctttaggcagtccccaggaatcagctattcaaacttctctcccatatagcttatagtggaacgtgrcaaggggctagcaaatttccctccaaatcttcagtgccctctcgcagtgtttctctgcacttactattaaaaaggtgtttgtgctgaattactttgaccg

SEQ ID NO: 60572 - DNA, 201 bp, Homo sapiens
ctgctgaccaggcacagtggcaaagagggatggtcaggaagcactcactgaatggtagttctgtgaaatggaggtgagggtcacagatgggagtgcatggrtggtacacaggtgaagtgcttagcatagaacctggcatatagtaaaatctcaggaatgtatatgccattgaatgagctactattaaatggtctaagacaa

SEQ ID NO: 60573 - DNA, 201 bp, Homo sapiens
gcaattgtttcccatattaaatgtgttggccctcaccaaggtacatgagaagcttggaccacgatctgaatcctaaagggacttctgctgggactgaatgyttgcattagcggttcacacaagaactaaatgctcatcaaagtacaccattattccccagaaggtcccaacaccatgagaatgaggctacttggaactgtt

SEQ ID NO: 60574 - DNA, 201 bp, Homo sapiens
aactgaactaggttggaatcctgacattgttttttttatttgtttttgaagtaacctagacaattctaatgtgcagccagggctcagaaccactatgatamtgctatccacttaatcacagagttgaatcactggaattttgctacattatttgccctcttcccaatttaagttaagcctttgccaagaagtctctgacaa

SEQ ID NO: 60575 - DNA, 201 bp, Homo sapiens
cttgaggggaaaagtcttttcccatggtgggaggagaagaattaacagctgtggaccagctgtgggcaagctgtgtcttttccttgcttgaaggcatcttyttaacattttctctctgaaggcataaataagcttccaggttttcaccctattttcaaagaacttttcaaactctagccttaaaatccattagggtttatt

SEQ ID NO: 60576 - DNA, 201 bp, Homo sapiens
ggttgggaacatttttctaccgagaagggcataaacaacttgttagaagatctgaagtgcacatagtcctcacttatccctctagaatgatcttcagtggmgaaggagacccccataaataaatccagtagaacttcccagtaggcctggcttcctgagagatgtccaaccaggccagggtctgtttcttacggggctcac

SEQ ID NO: 60577 - DNA, 201 bp, Homo sapiens
tcagtgttcagacagcttattaatgcttaagagaaaaggaaagagaaggaagatagaaagaagaagtacagcaaggcaagaagtgcccaggggagcaggtrtgctaagttgatttaagtggcatggcaatatacagaacttcaaaaataaaatttatcttttaaaatttaaatgtaaattaatgttctaaaaaactatagg

SEQ ID NO: 60578 - DNA, 201 bp, Homo sapiens
aggtatggatgactgcgtttacagtctggttcagtgttcagacagcttattaatgcttaagagaaaaggaaagagaaggaagatagaaagaagaagtacarcaaggcaagaagtgcccaggggagcaggtgtgctaagttgatttaagtggcatggcaatatacagaacttcaaaaataaaatttatcttttaaaatttaa

SEQ ID NO: 60579 - DNA, 201 bp, Homo sapiens
ttttgtttactacatttcccagaaaggaaatttttccatagttgtaataattgctaaaaatagcagtctacaggcttcctctgatataaacaaattcaacmgaagatacctggccttatttggatgcatggatgtacatactccaggaaatgataggccaagagtaataagaaaaagaaagtaacaagacaaacctctcct

SEQ ID NO: 60580 - DNA, 201 bp, Homo sapiens
tctggttctcttgcctatacagggtccatcctctggatgggaggaatatactccccatcccactgaagtcagctgtggtcaaatgacttatgttgatcaaygaaatgtaggcagaaatgataagtattacacccaggcagaagcttcacaaaccaagcatattttgctgtatctgtttttcttctgccaagggaattggtc

SEQ ID NO: 60581 - DNA, 201 bp, Homo sapiens
acccaggaggcagaggttacagtgagctgagattgggccactgcaatccagcctgggtgacagagtgagactctgtctcaaaaaataaaaaataaaaaacyaaaataaaataaaatccactagttctaacctatctttctccttttagtttcacttattttgcttcaaaatttattactaaaaaaagcaattaattacatt

SEQ ID NO: 60582 - DNA, 201 bp, Homo sapiens
acacttgggatatttaatctatggttcacatacatatttaatatgttactttaatttaaatattttatacttattaacatgactttttcctttctcacatwtcatgaaacaattttgttaaaactcttcatacgcatctttaacaccaatgtgtatgttcactggatccacgctgtaattatctaatacagagcacatcat

SEQ ID NO: 60583 - DNA, 201 bp, Homo sapiens
aataaaaaagcaagcccatttctgacaatgggagatgtcagaacatctcagaatccattaccaacacactaaagactggattttacatcacaattagtgcygggataatcctttaacccaaaactcacccatggcttcaccctcaatgaatgggagctgtgggagggtagatcagagtattctttctttactcctgcagtg

SEQ ID NO: 60584 - DNA, 201 bp, Homo sapiens
accaaagtgtttggccaaacagcatgtacaaatgggtaatatattgtaatgtacacttgggatatttaatctatggttcacatacatatttaatatgttaytttaatttaaatattttatacttattaacatgactttttcctttctcacatttcatgaaacaattttgttaaaactcttcatacgcatctttaacaccaa

SEQ ID NO: 60585 - DNA, 201 bp, Homo sapiens
cataagatcattgtattttttttttttttgagacagagtcttgctctattgcccaggctagagtgcagtgacatgacctcagctcactgcaacctccaccwcctgagttcaagtgattcttgtgcctcagcctcctgagtagctgggactacaggcatgtactaccatgcctggctgatttttgttgttttagtagagatg

SEQ ID NO: 60586 - DNA, 201 bp, Homo sapiens
cttaataataacatgataaagttgtttttctttcaaaatccaattccagaatacagtgatttggtttgaaactcacaaggtaagttaatttgaattaagtrcgatttttaaaacataaaaatgtctcctttcagaaccaatggaccaataaaaggccagttgatttcctttattgaatctgaatttactcatattgtgctg

SEQ ID NO: 60587 - DNA, 201 bp, Homo sapiens
aatattttagaatagtgaaaagtgattttaacaccaaggtaaggaaaccacctcaatatctactaaaaaattttgtttgaaaataatattcattttgaaaygaaaaatatttaataagagaaaatctcaaaccttaaatttctgtatcatttaaggctcttacatgtacagctagctcatctattatagaggcacgttaat

SEQ ID NO: 60588 - DNA, 201 bp, Homo sapiens
ggtaagaatttttttttttatgagcaatgcattcttgatttttctacccaatattaaaatgatttctgctctatttcattggatggtttaattaatgcagktctccttcactaactgaagaagccaatgaagtttgtctacattatatattgcacaaattggcaggatatttaaatatgtttttatttttatacgcatctg

SEQ ID NO: 60589 - DNA, 201 bp, Homo sapiens
tcttacattaggaagaatccactatctcactaatggaagaaaagattctttgagtgctgttctctgaaacacaccaaaaagatccagaaatgtttccttcmctctttaactgaaaaatgactttttttgttgtttacagtaagaaaatggcagcgtgtaatgataacttccagatctgaaaatgttaaattctaggagatg

SEQ ID NO: 60590 - DNA, 201 bp, Homo sapiens
tattaaaatgatttctgctctatttcattggatggtttaattaatgcaggtctccttcactaactgaagaagccaatgaagtttgtctacattatatattrcacaaattggcaggatatttaaatatgtttttatttttatacgcatctgtgaagaatctgaattgaacagtaagaattagaaaactatcttttgaatgac

SEQ ID NO: 60591 - DNA, 201 bp, Homo sapiens
aaactcatatagtataaaactataatactactttttcttaacttagatgtaaaccttaaagataaattcttctgtttgttaacacctttcagacttatgtrtatgaaggagtagaagccaaaaggatctttaaaaaggattgagcattattcttggcgcacagtccaaaatacaaattggacagaagatctatattgtacc

SEQ ID NO: 60592 - DNA, 201 bp, Homo sapiens
ttcttcagttccaaactccacactaaacaaagctaatacaaagactcctcttgaaccgatccactaaaactgctttcatttattgaacaaaaaataatttwaaaaaagcactatgtgccagacagcaagtatttaatgatgaacactattggtagagatatttaggtgattaagaatttcctcaaatggatacaaactctc

SEQ ID NO: 60593 - DNA, 201 bp, Homo sapiens
tgctctatttcattggatggtttaattaatgcaggtctccttcactaactgaagaagccaatgaagtttgtctacattatatattgcacaaattggcaggrtatttaaatatgtttttatttttatacgcatctgtgaagaatctgaattgaacagtaagaattagaaaactatcttttgaatgactgaatatagacctat

SEQ ID NO: 60594 - DNA, 201 bp, Homo sapiens
cacttcatcattaagaagtgcttctttaccttttgctacttgctttctctaaactatagtataagaatgccatctgctggccaaggatacagactctttcrgaggtttccaatgcagtgtctttgccgcatttcagtgtctagggagtgttccagaaaggtctgatataccgtagtctacactttaaaatgttaattatta

SEQ ID NO: 60595 - DNA, 201 bp, Homo sapiens
tctatataataagaacaattattattagtctcattttacacatgagaaaactgaggcagagagaggttatataacttgcccaaggtcaacagccataagtygctgaaccaggatttggacccaagcagttgtcctagagtccaaattcaattttacttgatgtggttatgtaggtaaattttcattcgaaatatcgtccat

SEQ ID NO: 60596 - DNA, 201 bp, Homo sapiens
aaagataaattcttctgtttgttaacacctttcagacttatgtgtatgaaggagtagaagccaaaaggatctttaaaaaggattgagcattattcttggcrcacagtccaaaatacaaattggacagaagatctatattgtaccagaactatttatttcaccccatcaagtataaggttactgattgattggtccttttat

SEQ ID NO: 60597 - DNA, 201 bp, Homo sapiens
taagtcgctgaaccaggatttggacccaagcagttgtcctagagtccaaattcaattttacttgatgtggttatgtaggtaaattttcattcgaaatatcrtccatcaaaatatatattaagcatgtcttatatgcaggcactatgtgccaggtgctgatctaggtgttacagctacaacaaagaacaagacagacaaaaa

SEQ ID NO: 60598 - DNA, 201 bp, Homo sapiens; identical to SEQ ID NO: 11652

SEQ ID NO: 60599 - DNA, 201 bp, Homo sapiens
aatacccagaaatccaacttacatgggatatgaaggacgtcttcaaggagaactacaaaccactgctcaatgaaataaaagaggatacaaacaaatggaakaacattccatgctcatgggtaggaagaatcaatatcgtgaaaatggccatcctcccaaagtaatttatagattcaatgccatccccatcaagctaccaat

SEQ ID NO: 60600 - DNA, 201 bp, Homo sapiens
caacttcagcaaagtctcaggatacaaaatcaatgtgcaaaaatcacaaacattcttatacaccaataacagacaaacagagagccaaatcatgagtgaastcccattcacaattgcttcaaagagaataaaatacccagaaatccaacttacatgggatatgaaggacgtcttcaaggagaactacaaaccactgctcaa

SEQ ID NO: 60601 - DNA, 201 bp, Homo sapiens
aaaatctccttaagctgataggcaacttcagcaaagtctcaggatacaaaatcaatgtgcaaaaatcacaaacattcttatacaccaataacagacaaacwgagagccaaatcatgagtgaagtcccattcacaattgcttcaaagagaataaaatacccagaaatccaacttacatgggatatgaaggacgtcttcaagg

SEQ ID NO: 60602 - DNA, 201 bp, Homo sapiens
tcaggcaggagaaggaaataaaggacattcaattaggaaaagaggaagccaaattgtccctgtttgcagatgacatgattgtatatctagaaaaccccatygtctcagcccaaaatctccttaagctgataggcaacttcagcaaagtctcaggatacaaaatcaatgtgcaaaaatcacaaacattcttatacaccaata

SEQ ID NO: 60603 - DNA, 201 bp, Homo sapiens
cctctctcaccactcctattcaacatagtgttggaagttctggccagggcaatcaggcaggagaaggaaataaaggacattcaattaggaaaagaggaagycaaattgtccctgtttgcagatgacatgattgtatatctagaaaaccccattgtctcagcccaaaatctccttaagctgataggcaacttcagcaaagtc

SEQ ID NO: 60604 - DNA, 201 bp, Homo sapiens
cgaaatatcgtccatcaaaatatatattaagcatgtcttatatgcaggcactatgtgccaggtgctgatctaggtgttacagctacaacaaagaacaagasagacaaaaatccctgtcatcatggaagggatacagataataaacaagagaatgaagtaaaatatatagtacattagatgatataagcgctattgagaaaa

SEQ ID NO: 60605 - DNA, 201 bp, Homo sapiens
cacaagacagggatgccctctctcaccactcctattcaacatagtgttggaagttctggccagggcaatcaggcaggagaaggaaataaaggacattcaaytaggaaaagaggaagccaaattgtccctgtttgcagatgacatgattgtatatctagaaaaccccattgtctcagcccaaaatctccttaagctgatagg

SEQ ID NO: 60606 - DNA, 201 bp, Homo sapiens
ttagcttagaatctagacatagaagacatattgaataagtaaaaattattgtgataagtattataaaggagtaacggtaggctttcatagaaatatatgcratcttgaattatactttccattgaactatttttcataagatgcttaattgtacagactttcttgaattattaaagggcctaactcacacatcagactcct

SEQ ID NO: 60607 - DNA, 201 bp, Homo sapiens
taggtattgatgggacgtatctcaaaataataagagctatctatgataaacccacagccaatatcatactgaatgggcaaaaactggaagcattccctttsaaaactggcacaagacagggatgccctctctcaccactcctattcaacatagtgttggaagttctggccagggcaatcaggcaggagaaggaaataaagg

SEQ ID NO: 60608 - DNA, 201 bp, Homo sapiens
gtggtgaacaagacaaatctattttgttcccatggaactttgaatctgcttagcttagaatctagacatagaagacatattgaataagtaaaaattattgygataagtattataaaggagtaacggtaggctttcatagaaatatatgcgatcttgaattatactttccattgaactatttttcataagatgcttaattgt

SEQ ID NO: 60609 - DNA, 201 bp, Homo sapiens
aaaaaccacatgattatctcaatagatgcagaaaaggcctttgacaaaattcaacaaccttcatgctaaaaactctcaatatattaggtattgatgggacrtatctcaaaataataagagctatctatgataaacccacagccaatatcatactgaatgggcaaaaactggaagcattccctttgaaaactggcacaagac

SEQ ID NO: 60610 - DNA, 201 bp, Homo sapiens
ggccctgaaaattatgtggcttgtcctatttctatggattgactattaataagtacaaaagatattttcctatgagcaactagagagaatggtagcaagayatctctaggcacctaaagaagggtgaatggatggatggaaaagatagttgcctgggataaaatggaagtgagataaggttatgtggtgatggggaaggga

SEQ ID NO: 60611 - DNA, 201 bp, Homo sapiens
aactagaaaatctagaagaaatggataaattcctcggcacatgcatcctcccaagactaaaccaggaagaagttgaatctctgaatagaccagtaacaggytcctaaattgaggcaataattaatagcttaccaaccaaaaaaagtccaggaccagatggattcacagccaaattctaccagaggtacaaggaggagctgg

SEQ ID NO: 60612 - DNA, 201 bp, Homo sapiens
ctcagagggccctgtgcttggtttaatgctcttttcttactgtcctaaaattctcaatactttttgaacaacttctgcattttcattttacacagggccckgaaaattatgtggcttgtcctatttctatggattgactattaataagtacaaaagatattttcctatgagcaactagagagaatggtagcaagacatctc

SEQ ID NO: 60613 - DNA, 201 bp, Homo sapiens
tataaacacctctacgcaaataaactagaaaatctagaagaaatggataaattcctcggcacatgcatcctcccaagactaaaccaggaagaagttgaatmtctgaatagaccagtaacaggctcctaaattgaggcaataattaatagcttaccaaccaaaaaaagtccaggaccagatggattcacagccaaattctac

SEQ ID NO: 60614 - DNA, 201 bp, Homo sapiens
caccatttatatcctttctagaattaaatttccactatttattagtattggagaacagcctattatttgttaagtgacttccatttcaacaaccgtttttygggaaaaccaaccttgtcattacaccaccctgcttggccaaaagagggtccctgacccaagagcagccaatctaccacaatttggccagatcatgagctc

SEQ ID NO: 60615 - DNA, 201 bp, Homo sapiens
gaacagaagaattaaatgtaggtcttgactttcagcctagatcattatgatctatgctattactcagcctgttataaacaaaaatatattaagaaaaaaaatgtccttaattcctcagtggcacccaagaatagcactctaaatgagtcaggtcagactgtaaaataatggtgttgagtgattagacacttatctatttct

SEQ ID NO: 60616 - DNA, 201 bp, Homo sapiens
actgtaatttaagacagaataggtatgcttctcatgttttaattcagttgaatttcagaagatctcaggaatgtacagaacgagaattaagaattaataadaataagaattaattaattgcttgacatagagtagttaggtgatttcctgaactttaagcttccacatcacagtatgaagttggttcaagataagaaatat

SEQ ID NO: 60617 - DNA, 201 bp, Homo sapiens; identical to SEQ ID NO: 11653

SEQ ID NO: 60618 - DNA, 201 bp, Homo sapiens
catactctgtagcccaatggcctaggttcaatcctcactctgtgactttaggtgaatcactgtgccattttacagtctcctcttctgcaaagtagagatartagtatcagtttcatagggtcaccatgaagattaaatgaaaaagtgtgtctacagaactcagaacagtgcctgacatgtgtaagaccctaataaatgcca

SEQ ID NO: 60619 - DNA, 201 bp, Homo sapiens; identical to SEQ ID NO: 11645

SEQ ID NO: 60620 - DNA, 201 bp, Homo sapiens; identical to SEQ ID NO: 11647

SEQ ID NO: 60621 - DNA, 201 bp, Homo sapiens
attagacacttatctatttctagtctcattgcaggctgacttttttcaccatttatatcctttctagaattaaatttccactatttattagtattggagarcagcctattatttgttaagtgacttccatttcaacaaccgtttttcgggaaaaccaaccttgtcattacaccaccctgcttggccaaaagagggtccctg

SEQ ID NO: 60622 - DNA, 201 bp, Homo sapiens
tccctgacccaagagcagccaatctaccacaatttggccagatcatgagctctgtgtagaaggaaaaatgacaactaactgaacctgcaagaacctctttytagggagtttgaatttgagaagtacacagttagtagttgatagcaaggaaaaaggcttaaagaggacaaatagagcagacaataagtagaagtcatgagt

SEQ ID NO: 60623 - DNA, 201 bp, Homo sapiens
agttagtagttgatagcaaggaaaaaggcttaaagaggacaaatagagcagacaataagtagaagtcatgagtacctgaaactatgaacaagcagtaaccrtagggtagatagcagaatgtcggggcagtcagaagcagttggagtagtagaagctgaaatatttacacatgcaatatggtatctgggatttgcttcaaat

SEQ ID NO: 60624 - DNA, 201 bp, Homo sapiens
atgggttttagaatcacagacttgcccaaattcttgtctgcccatttactgactaaaattcaagttctgattctctatttttctcatttgaaaaatggggwaaatgtaatgattttctgagcttgttgcaattgaggtattatgtataaaacatcgagtgtaatgcctggcatatacctggtactcaaatgtaacataaac

SEQ ID NO: 60625 - DNA, 201 bp, Homo sapiens; identical to SEQ ID NO: 11651

SEQ ID NO: 60626 - DNA, 201 bp, Homo sapiens
tgatagcaaggaaaaaggcttaaagaggacaaatagagcagacaataagtagaagtcatgagtacctgaaactatgaacaagcagtaaccatagggtagayagcagaatgtcggggcagtcagaagcagttggagtagtagaagctgaaatatttacacatgcaatatggtatctgggatttgcttcaaattgctttctcc

SEQ ID NO: 60627 - DNA, 201 bp, Homo sapiens
accttttctttgtacctttctagctaccctctataccctgaccccacatacataattgagctgtggcttctgactctactgggtttggggatgagaggcaktgagagtaaaatgaaggagtggttttaattaatggcacagctaaaactggattttgttctctctgcacatggcagatgtttaaagctcattctttctttt

SEQ ID NO: 60628 - DNA, 201 bp, Homo sapiens
caagcagtaaccatagggtagatagcagaatgtcggggcagtcagaagcagttggagtagtagaagctgaaatatttacacatgcaatatggtatctgggwtttgcttcaaattgctttctccccaatctagggttggggaggaagattgatacaagttggcaattcttgcagctgttgcaaagtgcctgacacataataa

SEQ ID NO: 60629 - DNA, 201 bp, Homo sapiens
tcactggagaaaacacctgaaagtcaaagaacagtactcttcctaaacttgaaaacaaaatgtcttttaggtaaaggagtatatgctcaatgccttcactkggttttaatttagaaacttttaaacaagattttttttaaaaaaaggatactgaagggcatcattgtgacacagaacttcctctctttaacatatacttgg

SEQ ID NO: 60630 - DNA, 201 bp, Homo sapiens
tattcaatctgcttgcctgcctcctctagtttgtgagctatatgagggcaaggatagggtcttatatctataccccacactgtatccctctaacacatagyaaatattaatgattgtaatttggggcatgctgggcagccccagcctcagaaagccagctttccccattctttcttaaacccagaagatctactgagggaa

SEQ ID NO: 60631 - DNA, 201 bp, Homo sapiens
aatcttattaaggttgctcagctctaagattctataattctgtactctacttaatttttctcaagttatggaaaaacaactttaatcagttctcttgatckgattgaacctgaacttctgtagaagcaatctgaatgttcttgtgcaaaggcaatgctaccgagttttcttcccaccctcaaaataaacaaacaaaacata

SEQ ID NO: 60632 - DNA, 201 bp, Homo sapiens
agaaaatctagaagaaatggataaattcctcggcacatgcatcctcccaagactaaaccaggaagaagttgaatctctgaatagaccagtaacaggctcckaaattgaggcaataattaatagcttaccaaccaaaaaaagtccaggaccagatggattcacagccaaattctaccagaggtacaaggaggagctggtacc

SEQ ID NO: 60633 - DNA, 201 bp, Homo sapiens
ggattacaggcaagaaccactgcaccaggcaactctttttcttttttgtttttttttgttttttgtttttttgtttttttgtttttttgttttttgagacrgagtctcgctctgtcgcccaggctggagtgcagtggcacgatctcggctcactgcaagctccgcctcccgggttcacgccattctcctgcctcagcctcc

SEQ ID NO: 60634 - DNA, 201 bp, Homo sapiens
aaaagatcaacaaaattgatggaccactagcaagactaataaagaagaaaagagagaagaatcaaatggatgcaataaaaaatgataaaggggataccacyaccaatcccacagaaatacaaactaccatcagagaatactataaacacctctacgcaaataaactagaaaatctagaagaaatggataaattcctcggca

SEQ ID NO: 60635 - DNA, 201 bp, Homo sapiens
gcaaagacttggaaccaacccaaatgtccaacaatgatagactggattaagaaaatgtggcacatatacaccatggaatactatgcagccataaaaaatgrtgagttcatgtcctttgtagggacatggatgaagctggaagccatcattctcagcaaactatcgcaaggacaaaaaaccaaagaccgcatgttctcactt

SEQ ID NO: 60636 - DNA, 201 bp, Homo sapiens
tacttccctccaagttgaaagtgtaatagagacataaaaaacccttcaaaaaatcaatgaattctggagctggttttttgaaaagatcaacaaaattgatrgaccactagcaagactaataaagaagaaaagagagaagaatcaaatggatgcaataaaaaatgataaaggggataccaccaccaatcccacagaaataca

SEQ ID NO: 60637 - DNA, 201 bp, Homo sapiens
cagcatcatcctgataccaaagcctgtcagagacacaacaaaaaaagagattttagaccaatatccctgatgaacatcgatgcaaaaatcctcaataaaayactggcaaaccaactccagcagcacatcaaaaagtttatccaccatgatcaagtgggcttcatccctgggatgcaaggctggttcaacatacacaaatca

SEQ ID NO: 60638 - DNA, 201 bp, Homo sapiens
caatcccacagaaatacaaactaccatcagagaatactataaacacctctacgcaaataaactagaaaatctagaagaaatggataaattcctcggcacaygcatcctcccaagactaaaccaggaagaagttgaatctctgaatagaccagtaacaggctcctaaattgaggcaataattaatagcttaccaaccaaaaa

SEQ ID NO: 60639 - DNA, 201 bp, Homo sapiens
ataaaggggataccaccaccaatcccacagaaatacaaactaccatcagagaatactataaacacctctacgcaaataaactagaaaatctagaagaaatrgataaattcctcggcacatgcatcctcccaagactaaaccaggaagaagttgaatctctgaatagaccagtaacaggctcctaaattgaggcaataatta

SEQ ID NO: 60640 - DNA, 201 bp, Homo sapiens
agaagaaaagagagaagaatcaaatggatgcaataaaaaatgataaaggggataccaccaccaatcccacagaaatacaaactaccatcagagaatactayaaacacctctacgcaaataaactagaaaatctagaagaaatggataaattcctcggcacatgcatcctcccaagactaaaccaggaagaagttgaatctc

SEQ ID NO: 60641 - DNA, 201 bp, Homo sapiens
ttttgttaccagccttctgtgagcccaagggctatttgctttatattgatcctatttggatccttctgcgaagcttaaaatggccatgagacacgggttargtcatggtgaaaatggtaagaagccactttagtttcttcctgccaaccttccttcttgaatcagacactttaatttcaattgctatgagatcacatagtg

SEQ ID NO: 60642 - DNA, 201 bp, Homo sapiens
tggatggtttaattaatgcaggtctccttcactaactgaagaagccaatgaagtttgtctacattatatattgcacaaattggcaggatatttaaatatgyttttatttttatacgcatctgtgaagaatctgaattgaacagtaagaattagaaaactatcttttgaatgactgaatatagacctattcataaagaaatt

SEQ ID NO: 60643 - DNA, 201 bp, Homo sapiens
agcagtaaccatagggtagatagcagaatgtcggggcagtcagaagcagttggagtagtagaagctgaaatatttacacatgcaatatggtatctgggatwtgcttcaaattgctttctccccaatctagggttggggaggaagattgatacaagttggcaattcttgcagctgttgcaaagtgcctgacacataataaca

SEQ ID NO: 60644 - DNA, 201 bp, Homo sapiens
ctatattcactggagaaaacacctgaaagtcaaagaacagtactcttcctaaacttgaaaacaaaatgtcttttaggtaaaggagtatatgctcaatgccytcactgggttttaatttagaaacttttaaacaagattttttttaaaaaaaggatactgaagggcatcattgtgacacagaacttcctctctttaacatat

SEQ ID NO: 60645 - DNA, 201 bp, Homo sapiens
ttctaactcctaaatctctaggagattacagatagcttacagatagctcctgatgtggtagagaggatccagaagatgttcagaggagggaaaccatattytcccttcttacattaggaagaatccactatctcactaatggaagaaaagattctttgagtgctgttctctgaaacacaccaaaaagatccagaaatgttt

SEQ ID NO: 60646 - DNA, 201 bp, Homo sapiens; identical to SEQ ID NO: 11655

SEQ ID NO: 60647 - DNA, 201 bp, Homo sapiens; identical to SEQ ID NO: 11656

SEQ ID NO: 60648 - DNA, 201 bp, Homo sapiens
cggggcagtcagaagcagttggagtagtagaagctgaaatatttacacatgcaatatggtatctgggatttgcttcaaattgctttctccccaatctaggrttggggaggaagattgatacaagttggcaattcttgcagctgttgcaaagtgcctgacacataataacatatgataggttcactgaataggaacacagga

SEQ ID NO: 60649 - DNA, 201 bp, Homo sapiens
acaaatcaccacagccagtcaactacctgagagactgttgagtcctcagctttaaacaaagttttctacttccctccaagttgaaagtgtaatagagacayaaaaaacccttcaaaaaatcaatgaattctggagctggttttttgaaaagatcaacaaaattgatggaccactagcaagactaataaagaagaaaagaga

SEQ ID NO: 60650 - DNA, 201 bp, Homo sapiens; identical to SEQ ID NO: 11657

SEQ ID NO: 60651 - DNA, 201 bp, Homo sapiens
aacccaagtcaatgggtcttgtttctaaaacacatgttcttttcactctaccatacgtttatttcagtgaccagatacatgtagttttctgacctagaaakaaagattggattcattatccataggcttctgagttcacaaatcaccacagccagtcaactacctgagagactgttgagtcctcagctttaaacaaagttt

SEQ ID NO: 60652 - DNA, 201 bp, Homo sapiens
cttcatctctttggaatgtagtttaatcatctttaaaatgagaggattgaactagatctccaaattttctttcagtgctaagattctatgatgtctgaatracatttagtgattccttcctttcttaagcagcctttttggtgtgggtcacaggggacaggacattagaacaatggaaggtaggatgggaagagggaaata

SEQ ID NO: 60653 - DNA, 201 bp, Homo sapiens
tacaggtgttaatatagtgaaaaggaagcttgcagctcatgacaatttgaagctgacaattacacaagaaggaaataaattcacagtcaaagaatcaagcrcttttcgaaacattgaagttgtttttgaacttggtgtcacctttaattacaatctagcagacggaactgaactcagggtaagaatttttttttttatgag

SEQ ID NO: 60654 - DNA, 201 bp, Homo sapiens
atctctttggaatgtagtttaatcatctttaaaatgagaggattgaactagatctccaaattttctttcagtgctaagattctatgatgtctgaatgacayttagtgattccttcctttcttaagcagcctttttggtgtgggtcacaggggacaggacattagaacaatggaaggtaggatgggaagagggaaatattta

SEQ ID NO: 60655 - DNA, 201 bp, Homo sapiens
tcataaagtcttactttacaagataattgctgttgtgaaaaagggaaaggtcatggtctcatttcccagatgttatttgatatatgctataaattatattrcctccaacatagtctgcactttgaacttagaaaaacaatcttcagacggcatgcattctaattcttgaaataagtatgcccacaaactgtaatttaagac

SEQ ID NO: 60656 - DNA, 201 bp, Homo sapiens
tctagctaccctctataccctgaccccacatacataattgagctgtggcttctgactctactgggtttggggatgagaggcattgagagtaaaatgaaggrgtggttttaattaatggcacagctaaaactggattttgttctctctgcacatggcagatgtttaaagctcattctttcttttatgcaagtttttacacca

SEQ ID NO: 60657 - DNA, 201 bp, Homo sapiens
gtcacaggggacaggacattagaacaatggaaggtaggatgggaagagggaaatatttacattataaagtatggctggtttcatgggtgtatggcttgtgyaggctcagagggccctgtgcttggtttaatgctcttttcttactgtcctaaaattctcaatactttttgaacaacttctgcattttcattttacacaggg

SEQ ID NO: 60658 - DNA, 201 bp, Homo sapiens
gacgaagattctgcagagtaatgtatgtttagtcagcactgaaacccaagtcaatgggtcttgtttctaaaacacatgttcttttcactctaccatacgtytatttcagtgaccagatacatgtagttttctgacctagaaataaagattggattcattatccataggcttctgagttcacaaatcaccacagccagtcaa

SEQ ID NO: 60659 - DNA, 201 bp, Homo sapiens
tcttaagactagtaattaaaactctttacttcacaccaagtttcctccccaagcttggcctgttcctggctggcagcctgaagtagggaaaggagagatayggtgaccttttctttgtacctttctagctaccctctataccctgaccccacatacataattgagctgtggcttctgactctactgggtttggggatgaga

SEQ ID NO: 60660 - DNA, 201 bp, Homo sapiens
tcacaggggacaggacattagaacaatggaaggtaggatgggaagagggaaatatttacattataaagtatggctggtttcatgggtgtatggcttgtgcrggctcagagggccctgtgcttggtttaatgctcttttcttactgtcctaaaattctcaatactttttgaacaacttctgcattttcattttacacagggc

SEQ ID NO: 60661 - DNA, 201 bp, Homo sapiens
attatattacctccaacatagtctgcactttgaacttagaaaaacaatcttcagacggcatgcattctaattcttgaaataagtatgcccacaaactgtartttaagacagaataggtatgcttctcatgttttaattcagttgaatttcagaagatctcaggaatgtacagaacgagaattaagaattaataagaataag

SEQ ID NO: 60662 - DNA, 201 bp, Homo sapiens
tgaaataatagagctagtagaaaatagtttgctttttaaagtgcttacttaataaaataaaaagtgggcaactcgaaataaaaaatcaaacaatatctaamatgtttaaaagatttttaaaaatcaaaatataaaataatatcaaaatttaaaaactgggattctgttccccaaagttctgttcaaatctgttagatttat

SEQ ID NO: 60663 - DNA, 201 bp, Homo sapiens
gaaaattatgtggcttgtcctatttctatggattgactattaataagtacaaaagatattttcctatgagcaactagagagaatggtagcaagacatctcyaggcacctaaagaagggtgaatggatggatggaaaagatagttgcctgggataaaatggaagtgagataaggttatgtggtgatggggaagggaaaaagg

SEQ ID NO: 60664 - DNA, 201 bp, Homo sapiens
gtcatgcaccctacaaagtgccaggatatttatccaaactcctggcaatgctaaacacaatgcaaaaagacatattagaaaacgaatcttattaactttarcttttcaactgtatttcatcataaagtcttactttacaagataattgctgttgtgaaaaagggaaaggtcatggtctcatttcccagatgttatttgata

SEQ ID NO: 60665 - DNA, 201 bp, Homo sapiens
acttggaaccaacccaaatgtccaacaatgatagactggattaagaaaatgtggcacatatacaccatggaatactatgcagccataaaaaatgatgagtycatgtcctttgtagggacatggatgaagctggaagccatcattctcagcaaactatcgcaaggacaaaaaaccaaagaccgcatgttctcacttataggt

SEQ ID NO: 60666 - DNA, 201 bp, Homo sapiens
gcgcccggcctctttttcttttttaatgaaataatagagctagtagaaaatagtttgctttttaaagtgcttacttaataaaataaaaagtgggcaactcraaataaaaaatcaaacaatatctaacatgtttaaaagatttttaaaaatcaaaatataaaataatatcaaaatttaaaaactgggattctgttccccaaa

SEQ ID NO: 60667 - DNA, 201 bp, Homo sapiens
tatgtaatttgttcataaaatatacatatcaggtattattattgtcttcattttattgatgagaaaactgaggctcagagagattgagtaagtaatgtgaygaagattctgcagagtaatgtatgtttagtcagcactgaaacccaagtcaatgggtcttgtttctaaaacacatgttcttttcactctaccatacgttta

SEQ ID NO: 60668 - DNA, 201 bp, Homo sapiens
ataccatctcacaccagttagaatggcaatcattaaaaagtcaggaaacaacaggtgctggagaggatgtggagaaataggaacacttttacactgttgakgggactgtaaactagttcaacccttgtggaagtcagtgtggcgattcctcagggatctagaactagaaataccatttgacccagccatcccattactggg

SEQ ID NO: 60669 - DNA, 201 bp, Homo sapiens
gcaaatccaaggcatagccagtcccaagttgatcactagtgcaaatcataaaatacctaagtaacttttaggtgactttctcataaacaccagaatgacaygggttttcttaacaaaatatcactggtttgagacctaggatgcttctaaaacattgttattgctcccagatttcctttctcagagaattaggagagaaac

SEQ ID NO: 60670 - DNA, 201 bp, Homo sapiens; identical to SEQ ID NO: 11654

SEQ ID NO: 60671 - DNA, 201 bp, Homo sapiens
gtacagaacgagaattaagaattaataagaataagaattaattaattgcttgacatagagtagttaggtgatttcctgaactttaagcttccacatcacartatgaagttggttcaagataagaaatataataaattctcgcccaaggacagacctgaatctctagctgcctagaggctgactcaactgaaatcatggcgt

SEQ ID NO: 60672 - DNA, 201 bp, Homo sapiens
aaagaccgcatgttctcacttataggtgggaattgaacaatgagaacacttagacacaggaaggggaacatcacacaccggggcctgttatggggtggggrgagggggtagggatagcattaggaggtatacctaatgttaaatgacgagttaatgggtgcagcacaccaacatggcacatgtgtacatatgtaacaaacc

SEQ ID NO: 60673 - DNA, 201 bp, Homo sapiens
atcattttcaacaaattttttaaaaactttttttagcctcaacatttttctatttaaattacatgtttgtaatgacaatttaactactgaatgttttatcrtaagttatgtctttctttaattagtaccacaatcacacaaattaaaacaagcacagagttgttaacatctccatgaaactaattttaaccatgactatat

SEQ ID NO: 60674 - DNA, 201 bp, Homo sapiens
tttttaaaaactttttttagcctcaacatttttctatttaaattacatgtttgtaatgacaatttaactactgaatgttttatcataagttatgtctttcyttaattagtaccacaatcacacaaattaaaacaagcacagagttgttaacatctccatgaaactaattttaaccatgactatatttctggacacgtaaca

SEQ ID NO: 60675 - DNA, 201 bp, Homo sapiens
catgtttgtaatgacaatttaactactgaatgttttatcataagttatgtctttctttaattagtaccacaatcacacaaattaaaacaagcacagagttrttaacatctccatgaaactaattttaaccatgactatatttctggacacgtaacatgaaagattcagaaagaagtgctgctcatctgccttaaaattcag

SEQ ID NO: 60676 - DNA, 201 bp, Homo sapiens; identical to SEQ ID NO: 11648

SEQ ID NO: 60677 - DNA, 201 bp, Homo sapiens
gacaatttaactactgaatgttttatcataagttatgtctttctttaattagtaccacaatcacacaaattaaaacaagcacagagttgttaacatctccrtgaaactaattttaaccatgactatatttctggacacgtaacatgaaagattcagaaagaagtgctgctcatctgccttaaaattcagcgtatggaaatt

SEQ ID NO: 60678 - DNA, 201 bp, Homo sapiens; identical to SEQ ID NO: 11650

SEQ ID NO: 60679 - DNA, 201 bp, Homo sapiens
tattgtctggaacagattttactggagaattgactggaaaagaagagtatgcaagacagtggcagaagatgaaagtttgaagcaaatggtggaaatcaatrgtcatggataaagcatagtgttccagagggcttctctcatccatatatatcctcattgaagattccattagaatgatggattgcgagaagtcctccctgc

SEQ ID NO: 60680 - DNA, 201 bp, Homo sapiens
aatgcctggcatatacctggtactcaaatgtaacataaacatgtacccttctcctctagagaaaatggggcaaagtatatcctgagtagatgggaaaactmttttcttaaaatacctctcatggagtctgcgtgagagagtgagccttggcctggtagatgagaatacttagttccagtccagtctgtgacataactagct

SEQ ID NO: 60681 - DNA, 201 bp, Homo sapiens
aaatgcaaatcaaaaccacaatgagataccatctcacaccagttagaatggcaatcattaaaaagtcaggaaacaacaggtgctggagaggatgtggagarataggaacacttttacactgttgaggggactgtaaactagttcaacccttgtggaagtcagtgtggcgattcctcagggatctagaactagaaataccat

SEQ ID NO: 60682 - DNA, 201 bp, Homo sapiens
cagccaaaagacacatgaaaaaatgctcatcatcactggccatcagagaaatgcaaatcaaaaccacaatgagataccatctcacaccagttagaatggcratcattaaaaagtcaggaaacaacaggtgctggagaggatgtggagaaataggaacacttttacactgttgaggggactgtaaactagttcaacccttgt

SEQ ID NO: 60683 - DNA, 201 bp, Homo sapiens
tgcagccaaaagacacatgaaaaaatgctcatcatcactggccatcagagaaatgcaaatcaaaaccacaatgagataccatctcacaccagttagaatgkcaatcattaaaaagtcaggaaacaacaggtgctggagaggatgtggagaaataggaacacttttacactgttgaggggactgtaaactagttcaaccctt

SEQ ID NO: 60684 - DNA, 201 bp, Homo sapiens
cagtaagaaaatggcagcgtgtaatgataacttccagatctgaaaatgttaaattctaggagatggaaaaacaaagaccatataagaaagtaatggaaaargttctcttaaaatttatagcgctgaataagttagatttaattctgatttcttctaacttaaaaaagttttggaataatcttgagaagctgtgtagttttc

SEQ ID NO: 60685 - DNA, 201 bp, Homo sapiens; identical to SEQ ID NO: 11644

SEQ ID NO: 60686 - DNA, 201 bp, Homo sapiens
ctcaaacaaatttacaggaaaaaaataaacaaccacatcaacaagtgggcgaaggatatgaacagacacttctcaaaagaagacatttatgcagccaaaaracacatgaaaaaatgctcatcatcactggccatcagagaaatgcaaatcaaaaccacaatgagataccatctcacaccagttagaatggcaatcattaaa

SEQ ID NO: 60687 - DNA, 201 bp, Homo sapiens
tttgcaatctactcatctgacaaagggctaatatccagaatctacaatgaactcaaacaaatttacaggaaaaaaataaacaaccacatcaacaagtgggygaaggatatgaacagacacttctcaaaagaagacatttatgcagccaaaagacacatgaaaaaatgctcatcatcactggccatcagagaaatgcaaatc

SEQ ID NO: 60688 - DNA, 201 bp, Homo sapiens
cgaaaatttttgcaatctactcatctgacaaagggctaatatccagaatctacaatgaactcaaacaaatttacaggaaaaaaataaacaaccacatcaamaagtgggcgaaggatatgaacagacacttctcaaaagaagacatttatgcagccaaaagacacatgaaaaaatgctcatcatcactggccatcagagaaa

SEQ ID NO: 60689 - DNA, 201 bp, Homo sapiens
aaactgtaatttaagacagaataggtatgcttctcatgttttaattcagttgaatttcagaagatctcaggaatgtacagaacgagaattaagaattaatwagaataagaattaattaattgcttgacatagagtagttaggtgatttcctgaactttaagcttccacatcacagtatgaagttggttcaagataagaaat

SEQ ID NO: 60690 - DNA, 201 bp, Homo sapiens
gaatgggcgaaaatttttgcaatctactcatctgacaaagggctaatatccagaatctacaatgaactcaaacaaatttacaggaaaaaaataaacaaccmcatcaacaagtgggcgaaggatatgaacagacacttctcaaaagaagacatttatgcagccaaaagacacatgaaaaaatgctcatcatcactggccatc

SEQ ID NO: 60691 - DNA, 201 bp, Homo sapiens
taatgataacttccagatctgaaaatgttaaattctaggagatggaaaaacaaagaccatataagaaagtaatggaaaaggttctcttaaaatttatagckctgaataagttagatttaattctgatttcttctaacttaaaaaagttttggaataatcttgagaagctgtgtagttttctccagggcgtttaatttaact

SEQ ID NO: 60692 - DNA, 201 bp, Homo sapiens
caacctacagaatgggcgaaaatttttgcaatctactcatctgacaaagggctaatatccagaatctacaatgaactcaaacaaatttacaggaaaaaaayaaacaaccacatcaacaagtgggcgaaggatatgaacagacacttctcaaaagaagacatttatgcagccaaaagacacatgaaaaaatgctcatcatca

SEQ ID NO: 60693 - DNA, 201 bp, Homo sapiens
gtgaacaggcaacctacagaatgggcgaaaatttttgcaatctactcatctgacaaagggctaatatccagaatctacaatgaactcaaacaaatttacargaaaaaaataaacaaccacatcaacaagtgggcgaaggatatgaacagacacttctcaaaagaagacatttatgcagccaaaagacacatgaaaaaatgc

SEQ ID NO: 60694 - DNA, 201 bp, Homo sapiens
acaaaagccaaaattgacaaatgagatctaattaaactaaagagcttctgcacagcaaaagaaactaccatcagggtgaacaggcaacctacagaatgggmgaaaatttttgcaatctactcatctgacaaagggctaatatccagaatctacaatgaactcaaacaaatttacaggaaaaaaataaacaaccacatcaac

SEQ ID NO: 60695 - DNA, 201 bp, Homo sapiens
caagcttggcctgttcctggctggcagcctgaagtagggaaaggagagatatggtgaccttttctttgtacctttctagctaccctctataccctgacccyacatacataattgagctgtggcttctgactctactgggtttggggatgagaggcattgagagtaaaatgaaggagtggttttaattaatggcacagctaa

SEQ ID NO: 60696 - DNA, 201 bp, Homo sapiens
ttaagaattaataagaataagaattaattaattgcttgacatagagtagttaggtgatttcctgaactttaagcttccacatcacagtatgaagttggttyaagataagaaatataataaattctcgcccaaggacagacctgaatctctagctgcctagaggctgactcaactgaaatcatggcgtttgacagcacttgg

SEQ ID NO: 60697 - DNA, 201 bp, Homo sapiens
gaaaaacaaaggggcatttaagaaaaaagaatactgtatatgtggaattaaagatgtgcttccttataaatatatgaatatacattttaatccttcatttratatttctagaatttgatttacttaacactgaaatgaacagtttgttaatcttattaaggttgctcagctctaagattctataattctgtactctactta

SEQ ID NO: 60698 - DNA, 201 bp, Homo sapiens
agctctaagattctataattctgtactctacttaatttttctcaagttatggaaaaacaactttaatcagttctcttgatcggattgaacctgaacttctrtagaagcaatctgaatgttcttgtgcaaaggcaatgctaccgagttttcttcccaccctcaaaataaacaaacaaaacataacttggaaaaataaacact

SEQ ID NO: 60699 - DNA, 201 bp, Homo sapiens
tgacaattacacaagaaggaaataaattcacagtcaaagaatcaagcgcttttcgaaacattgaagttgtttttgaacttggtgtcacctttaattacaayctagcagacggaactgaactcagggtaagaatttttttttttatgagcaatgcattcttgatttttctacccaatattaaaatgatttctgctctatttc

SEQ ID NO: 60700 - DNA, 201 bp, Homo sapiens
agttgaccctggtgtcgtagactcaagttcctctggaagcggtgagtgctgagtctggcaggaggggtgtgggagggatgggggatgtgggggccaccccrgcccataatggcaagccagcatcagcactggagggagatgggggctgcgggcaatggatgacacgtgcagatcacgccatctgcgtgtcacttggaaact

SEQ ID NO: 60701 - DNA, 201 bp, Homo sapiens
caaaaccagcctggccaacatggcataaccctgcctccacaaaaaatataaaatttagccgggcgtggtggcgggcgcctgtaatcccagctactcgggargctcaggcaggagaatcgcttgaacccaggaggcggaggttacagtgagccgagaccacaccactgcactccagcctgggcgacagaggaagactcagtc

SEQ ID NO: 60702 - DNA, 201 bp, Homo sapiens
ggccagaacacgtgggcaaggggccaggaggaggcctccggtcccctcttttctcagctccctccagccaggacacagctgggctcactgtggagctgtckgcagcagaaggacctgctgcctgatactctcccctcttaatgagaggggtcttgggaagcagaacaacaggccactgataccagatggcctgagcttaag

SEQ ID NO: 60703 - DNA, 201 bp, Homo sapiens
cagcatcacttgacgctggccagaacacgtgggcaaggggccaggaggaggcctccggtcccctcttttctcagctccctccagccaggacacagctgggytcactgtggagctgtcggcagcagaaggacctgctgcctgatactctcccctcttaatgagaggggtcttgggaagcagaacaacaggccactgatacca

SEQ ID NO: 60704 - DNA, 201 bp, Homo sapiens
ttggtagagacagggtttcaccatgttggccaggctggtctccacctcctgacctcaggtgatctgtccacctcggcctcccaaagtgctgggattacagrcgtgaggcacctcacccggccccctggctaattttttaaagtattttgtagagcttgggtcttactatgtcgcccgggctggtttcgaactcctgggatt

SEQ ID NO: 60705 - DNA, 201 bp, Homo sapiens
atcccagcactttgggaggccgaggcaggcagatcacctgaggtcaggagttcaaaaccagcctggccaacatggcataaccctgcctccacaaaaaatayaaaatttagccgggcgtggtggcgggcgcctgtaatcccagctactcgggaggctcaggcaggagaatcgcttgaacccaggaggcggaggttacagtga

SEQ ID NO: 60706 - DNA, 201 bp, Homo sapiens
tgtcttcaagtgggccgaggccagcttgctggagttgtctgaatgctgcagtagggcaggactggttcctccccatagctgtaaaccaccatgccaggccyggccacttatgctttgacaggctggctatgcacagggcttgggtctgtatgcacagcatcacttgacgctggccagaacacgtgggcaaggggccaggag

SEQ ID NO: 60707 - DNA, 201 bp, Homo sapiens
gccatggcatttgtaaactgtcatggcactggtggagtgtagcagtgaggatgacgggaggtcactctcgtagccatcttggttttggtgggatttggccrccttctttactgcaacctgttttatcaggaaggtctttgtgacctgtatcttgtgccgacctcctatctcatcctgtgacttacaataccctaaccgtct

SEQ ID NO: 60708 - DNA, 201 bp, Homo sapiens
tcagcctcccaaagtgctgggattacaggtgtgagccactgtgcccggccagttatataaatctttattatagagccttgttccccacctcaaactccagkcccgggagagcaagcctcatctctgttgttcacagctgtattttcagttcccagctcagtgtgagtcacacagtgggcactcttcaaagacttgctaagt

SEQ ID NO: 60709 - DNA, 201 bp, Homo sapiens
atgatatgctaaacaaggggtggattattcatgcctttccttcttagaccatatagggtaacttcctgatgttgccatggcatttgtaaactgtcatggcrctggtggagtgtagcagtgaggatgacgggaggtcactctcgtagccatcttggttttggtgggatttggccgccttctttactgcaacctgttttatca

SEQ ID NO: 60710 - DNA, 201 bp, Homo sapiens
gctggctaatttttgtttttgatagagacagtttcgccgtgttgcccaggctggtctcaaactcctgggctcaggcaattcaggcaatcctccgcctcaamctcccaaagtgttgggatcacaggcatgagccaccaggcccggcctggtctcaaactcctgggctcaggcaatcctccgcctcaaactcccaaagtgttg

SEQ ID NO: 60711 - DNA, 201 bp, Homo sapiens
ccacgcaggagagaaggtgagtggttctctcacaatgtcttcttcatggagtttaggccaaaggactccagggacaaggccctaaaccctgggcaccagcyacctccacagtgtccccacctcaggtcccctagctttcagacccattaccccctaaaatgaactcctcaccttccccaaacctgcttccatctggtgact

SEQ ID NO: 60712 - DNA, 201 bp, Homo sapiens
gaaaggtctcacccttgtcatgccttcgtcaccctggattccattccttgtgtaggagcttacaaggcctgtgactttgggcaagttgctcaacttctctytgcctcggtttctttagccataggatggggttagtaaatgttcatttcattgattctcgtctcacatttttttttcactctaatacttccaaaatcgaga

SEQ ID NO: 60713 - DNA, 201 bp, Homo sapiens
ttctatcaccttcacagagaggcctttcctgaccaccttatctaccaccacagccaccctactattgttagtgcaccctacacctgcacctgctttttctytttttcttttttttttttctgagacggagtctcgctctgttgcccaggctggagtgcagtggcacaatcttggctcactgtaacctccacctcctgagtt

SEQ ID NO: 60714 - DNA, 201 bp, Homo sapiens
ggtactccccacatccccaaactgggcttgagggacagacagaggcagagactgtcggacccctgctagtgggacctttgaagaccctgtgtccaaaccamcatggtgtgtggagtccctccaccaaggagggacacgcagctctacaagagccagactcagctaaggtgaacttgcaaccttgggcaagagtctttcctt

SEQ ID NO: 60715 - DNA, 201 bp, Homo sapiens
ggagcactcggacgaggctatctgggcagccctggagacggtgcagctcaaagccttggtggccagcctgcccggccagctgcagtacaagtgtgctgacygaggcgaggacctgaggtatggtcgtcccaccatggctgggacctgcaggtgggagaggaggggatggccatgccctccccaagggccttcaggaaatgc

SEQ ID NO: 60716 - DNA, 201 bp, Homo sapiens
aaacgcacgtcccagctaattgtcccaatcgttcccagcgtgggccagaaacagctcctgtgtctggcacgtgcccttctccggaagacccagatcctcaycctggacgaggctactgctgccgtggaccctggcacggagctgcagatgcaggccatgctcgggagctggtttgcacagtgcactgtgctgctcattgcc

SEQ ID NO: 60717 - DNA, 201 bp, Homo sapiens
aggtactccccacatccccaaactgggcttgagggacagacagaggcagagactgtcggacccctgctagtgggacctttgaagaccctgtgtccaaaccmccatggtgtgtggagtccctccaccaaggagggacacgcagctctacaagagccagactcagctaaggtgaacttgcaaccttgggcaagagtctttcct

SEQ ID NO: 60718 - DNA, 201 bp, Homo sapiens
gctcagttatcactgattgaagaaatgaatgagtgagtgaatgcctgaaggatgttcctggaagaactcagagtggggtgttgagagaggttgctggagaygtggcaggagccagatcaggggaaatggatggtcagagcggttaaggccacatagtcagtgggtgtcaaagtgggtatctgggccgtgttgcgtgacagg

SEQ ID NO: 60719 - DNA, 201 bp, Homo sapiens
agcaaggctgttgggggaaacagaggtaacttgactttgtacagtgttaaatgctgtttttccaacctcaagttcatagtaggtgctcagttatcactgaytgaagaaatgaatgagtgagtgaatgcctgaaggatgttcctggaagaactcagagtggggtgttgagagaggttgctggagacgtggcaggagccagat

SEQ ID NO: 60720 - DNA, 201 bp, Homo sapiens
aaagagagttaaatcacttgcccaaggtcacaagattagaacttgagtatgtccagctccagagtctatgcttgcagttgctatggagacagcccaagaargactttgatgcctagcaagctacaccgtgctagctagggtttctaataatccaaaaaaacagtgtgctggatacatggcaaggttctggaagtaaagttg

SEQ ID NO: 60721 - DNA, 201 bp, Homo sapiens
aactccatctcaataataacaacgacaacagcagtaataataataatagaagtgcacaatcaacgtaatgtgcttgaatcgtcctgaaaccatcccccggrccatccccctgcccccaggtccatggaaaaatcgtcttctacaaaactggtccctggtgccaaaaaggctggggaccactgccctacaggtatccaaata

SEQ ID NO: 60722 - DNA, 201 bp, Homo sapiens
gaataagttaaagtaatcaatagtgcacaagggaaattatagttaatgatcatttacttgtatatttcaagatagctagaagagaaggatggttgtgttcscaatacaaaagataaatatttgaggtgatgactatctcagttaccctgatttgatcattacatattgtctacagcaggggtccccaacccccgggccatg

SEQ ID NO: 60723 - DNA, 201 bp, Homo sapiens
tgcgtgcccacattgtgttgctgtgcatgctagcatgcttgtatgagtgtgcaaatgtgcatgcatgtgtgcacgctttgtgtgcatgtgtacatgcacaratgtgcacaggatagttcctcaaatagctagacaaggactgggaaaaagaacagccccacaggtcctcttggagactcccagagcaggaaagctcagctc

SEQ ID NO: 60724 - DNA, 201 bp, Homo sapiens
gtgcccggcctgggagaagaaccttctaggcggtgggaatggcatcagcaaaggtcctggggcaggagagtgcctggacctgggtttctcaacctcagcayggttgatattttgggctgaaactcctttgttgggggctgtcgtgtgcattgtgggatgtttagctgaccccagtctctacccactagatgccagcagcac

SEQ ID NO: 60725 - DNA, 201 bp, Homo sapiens
acagaggttaactaagcaaagaatgatccgcacatcgggcagtccctgaaccagaatacgtccagagaggctctggtacagccacggggtcaaagattaayagacagaaaaaggaaggtgaaggacagaaaacagaagtgaggtacagaaacagccggattggttacagctcagcgtttgctttattggaacatggtttga

SEQ ID NO: 60726 - DNA, 201 bp, Homo sapiens
aggatcataattaacagtagcactcctgccccagaggggctgaggcattaaacaagcccatatgtagaaagcacttaaaagggtgccgggcacacaactgyaccctgtaggtatttgtaatattatcattagttacttttccataaaggataagacagtagatgctttttacactggaggccacaccatctctcctgcaaa

SEQ ID NO: 60727 - DNA, 201 bp, Homo sapiens
ccaggctggccaagacgatgccaagggagggctggctgagaggagccccaaggttcagccctatcagctgtgctcacttctgtgcctcctgtatcagtccraggtcatgatcatctatagtctccaactctatcgcttggtctttgtggccaaaaatctcagacagccctgaaactccctaagaagagaaggaatatgccc

SEQ ID NO: 60728 - DNA, 201 bp, Homo sapiens
tgtctccaacgtgaggatcataattaacagtagcactcctgccccagaggggctgaggcattaaacaagcccatatgtagaaagcacttaaaagggtgccrggcacacaactgcaccctgtaggtatttgtaatattatcattagttacttttccataaaggataagacagtagatgctttttacactggaggccacacca

SEQ ID NO: 60729 - DNA, 201 bp, Homo sapiens
ggcctcccaaagtgctgggattacaggcgtgaggcacctcacccggccccctggctaattttttaaagtattttgtagagcttgggtcttactatgtcgcscgggctggtttcgaactcctgggattaagcaatcctcccacctcagcctcccagagtggcgggattacaggcagaggccactgcacctggcctggcatta

SEQ ID NO: 60730 - DNA, 201 bp, Homo sapiens
ccaggtgaggctggtggagggggtgggcaaagatgggaggcatggtgggacccggctctgacccaccgcccctccccgccaggaccccatcctgttccctsgctctctgcggatgaacctcgacctgctgcaggagcactcggacgaggctatctgggcagccctggagacggtgcagctcaaagccttggtggccagcct

SEQ ID NO: 60731 - DNA, 201 bp, Homo sapiens
gggattacaggtgcctgccaccatgcccggctaatttttgtatttttggtagagacagggtttcaccatgttggccaggctggtctccacctcctgacctyaggtgatctgtccacctcggcctcccaaagtgctgggattacaggcgtgaggcacctcacccggccccctggctaattttttaaagtattttgtagagct

SEQ ID NO: 60732 - DNA, 201 bp, Homo sapiens
gggcactcttcaaagacttgctaagtggagaatttctatgtccagtcattcctggatcacttcttcactccctcacgcagtcacaaagggagggctgcatktggaatttagcattcaacaggctggaagaggtccactgtgaccccagggttaaggcagatgtgaggctgccagagaaccaggttggtgtcacagaagcac

SEQ ID NO: 60733 - DNA, 201 bp, Homo sapiens
aggcagcaggcaggatttggtctctgggccacagtttgcctccccctggattatgtagccatgggacacagacagaacaagaaccctgcggggtcacccasaagccagtgagtagcagggcaatttgttcagtgggagagatttcttcctgcagcctctgcccctgggggggcgggggatggtgcctgggggcctctccga

SEQ ID NO: 60734 - DNA, 201 bp, Homo sapiens
cgtgttccaataaaactttatttataagaaaaggcagcaggcaggatttggtctctgggccacagtttgcctccccctggattatgtagccatgggacacrgacagaacaagaaccctgcggggtcacccagaagccagtgagtagcagggcaatttgttcagtgggagagatttcttcctgcagcctctgcccctggggg

SEQ ID NO: 60735 - DNA, 201 bp, Homo sapiens
caggcatgagacactgtgccggccacagtgaaattaataacacccccttcactctgggaaggctgggatttgatgataatttatttcagaaattcactaaytttttccataaatgaccagattgtgcatattttaggcctgtgggccacacagtctctgtcacaactgctcaaagcatgaaatagagaaatgaatggatgt

SEQ ID NO: 60736 - DNA, 201 bp, Homo sapiens
ttcagttcccagctcagtgtgagtcacacagtgggcactcttcaaagacttgctaagtggagaatttctatgtccagtcattcctggatcacttcttcacwccctcacgcagtcacaaagggagggctgcatgtggaatttagcattcaacaggctggaagaggtccactgtgaccccagggttaaggcagatgtgaggct

SEQ ID NO: 60737 - DNA, 201 bp, Homo sapiens
ctgcgggcaatggatgacacgtgcagatcacgccatctgcgtgtcacttggaaactggcaccgtgctgctcttctttctgctagccattcagcgaccactsactgagcgcccactttgtaccatcctgggtgtacaacagggaacactctaacacagtggtccccaagctttttggcaccagggactggttttgtggaaga

SEQ ID NO: 60738 - DNA, 201 bp, Homo sapiens
ggccccaaagcgggtgatgggagacagagatcatcaggcattagattcttataaggaacacgcaacccagattcctcacatgcacagttcacaagtgttcrtgctcctttgagaatctattgctgctgctgatttggcaggaggtggagctcaggcggtgatgggagtgatggggagtggctataaacacagatgacactc

SEQ ID NO: 60739 - DNA, 201 bp, Homo sapiens
tgcccacgtggggctgcacacactgcgctccaggatcagcatcatcccccaggtgaggctggtggagggggtgggcaaagatgggaggcatggtgggaccyggctctgacccaccgcccctccccgccaggaccccatcctgttccctggctctctgcggatgaacctcgacctgctgcaggagcactcggacgaggctat

SEQ ID NO: 60740 - DNA, 201 bp, Homo sapiens
atcctccgcctcaacctcccaaagtgttgggatcacaggcatgagccaccaggcccggcctggtctcaaactcctgggctcaggcaatcctccgcctcaamctcccaaagtgttgggatcacaggcatgagccaccacgcccggcctggcttcatctttaaaggacagttgcctcgttttcatgttgattcgtcctcattc

SEQ ID NO: 60741 - DNA, 201 bp, Homo sapiens
agaacaacagggctaccaagatcaaaaactctgctgtcccccgatgcctggaacctagaggcattaggttctcccctaggttctagtgatgcctagagccrtggggctgcgcactcatcaccattagcaatgcgctgtgtctttagagagagccttatgtagcttatgactgcggagaggacatgtgttagcaggactggg

SEQ ID NO: 60742 - DNA, 201 bp, Homo sapiens
tatgtggttagctcatgccagctgagacgcttggagtcagccagctactcgtctgtctgctcccacatggctgagacgttccagggcagcacagtggtccvggcattccgaacccaggccccctttgtggctcagaacaatgctcgcgtagatgaaagccagaggatcagtttcccgcgactggtggctgacaggtaggaa

SEQ ID NO: 60743 - DNA, 201 bp, Homo sapiens
gtatgtggttagctcatgccagctgagacgcttggagtcagccagctactcgtctgtctgctcccacatggctgagacgttccagggcagcacagtggtcygggcattccgaacccaggccccctttgtggctcagaacaatgctcgcgtagatgaaagccagaggatcagtttcccgcgactggtggctgacaggtagga

SEQ ID NO: 60744 - DNA, 201 bp, Homo sapiens
gtagctcaggcattaaccacctccaggtagccttcctgatggtgtcatacccaggtgggctcaggctgcctctgttctccgggcatcagaggcttcctccrtggggcacattatcccaggggcactcctgcagaagtccaggtacaggatgatggtggttggaccaggagtgagggtcagaggtgctgagaggcagacagg

SEQ ID NO: 60745 - DNA, 201 bp, Homo sapiens
agatggggaggggagagctgagtgcgagcccacgggtctggctttgttcttgtcgtctgtgagctgcccatcactcagacctgcaccccctccccctatcstctcaatggacagtggctccgtccctccaatgttcaggccacaggccctgggtcagttcaatgcctttttctctcacatcccatctgtcagcagatttgc

SEQ ID NO: 60746 - DNA, 201 bp, Homo sapiens
cagtgagtagcagggcaatttgttcagtgggagagatttcttcctgcagcctctgcccctgggggggcgggggatggtgcctgggggcctctccgatgcaraggccggccaggtcaggggtctcctgtaaatggcctcttgtgccctgcagctgccgggaaggattgcatcacgatacaaagtgccaccttcgcctggtcc

SEQ ID NO: 60747 - DNA, 201 bp, Homo sapiens
cccaagtctgaccaccttcggggtctgcagctgtgttacagaaaaggggtcctgatccagatcccaaaagagggttcttggatctcgtgcaagaaagaatycagggcgagtccataaagtgaaagcaagtgtttgtttgtttgttttttgagacggagtctcactctgccacccaggctggagtgcagtggtgcgatcgtg

SEQ ID NO: 60748 - DNA, 201 bp, Homo sapiens
agacgtgcagcggctgaccgagagcgtcctctacctcaacgggctgtggctgcctctcgtctggatcgtggtctgcttcgtctatctctggcaggtatgcsagaggaggaagaggggatttgaacggagtcccccaccccctccttctccccctcctccttccccctcccacccttcctcctcctgacttagcattcaaga

SEQ ID NO: 60749 - DNA, 201 bp, Homo sapiens
gcacgtgggtgtgcgcatgtttgcctctgtgcagtcgtatcccctgttcagtctctcgcatccatcacgatggttgacagttgagatactgaacaaccccstcaccacgaggcgctctcgtgttgcccttttgcaaccacacccacccttctcctgcctcgcccaccctgtccccaacccctggttcttctccttttaata

SEQ ID NO: 60750 - DNA, 201 bp, Homo sapiens
cttgcacgtgggtgtgcgcatgtttgcctctgtgcagtcgtatcccctgttcagtctctcgcatccatcacgatggttgacagttgagatactgaacaacmccctcaccacgaggcgctctcgtgttgcccttttgcaaccacacccacccttctcctgcctcgcccaccctgtccccaacccctggttcttctcctttta

SEQ ID NO: 60751 - DNA, 201 bp, Homo sapiens
ctcttcttgctgggtgacctgcggcttcggttttcctaggcccgggtgtcctttgaccgtctggtcaccttcctctgcctggaagaagttgaccctggtgycgtagactcaagttcctctggaagcggtgagtgctgagtctggcaggaggggtgtgggagggatgggggatgtgggggccaccccggcccataatggcaa

SEQ ID NO: 60752 - DNA, 201 bp, Homo sapiens
accttagtctctgtgatattccctgatcccccacagcacactctggccccagggcctttgcactgctgttccctctgctggaaagctctccccaggagtcyccagggctcatccctcacttctatcaccttcacagagaggcctttcctgaccaccttatctaccaccacagccaccctactattgttagtgcaccctaca

SEQ ID NO: 60753 - DNA, 201 bp, Homo sapiens
gcaaggaccctactctctctgtgcctcctgttcttgtctccaacgtgaggatcataattaacagtagcactcctgccccagaggggctgaggcattaaacragcccatatgtagaaagcacttaaaagggtgccgggcacacaactgcaccctgtaggtatttgtaatattatcattagttacttttccataaaggataag

SEQ ID NO: 60754 - DNA, 201 bp, Homo sapiens
cagagtgagactctgtctccaacaaataaataaaagtaaaaataaaattagactctgtatcgggaactgcctaggctcaaatcctccttctgaccacttaycagttgtgaatctgtgtgcaaggaccctactctctctgtgcctcctgttcttgtctccaacgtgaggatcataattaacagtagcactcctgccccagag

SEQ ID NO: 60755 - DNA, 201 bp, Homo sapiens
tgtgagcccccgcacccggccctatggatctcattgtgatttccccagttttgcttgcacgtgggtgtgcgcatgtttgcctctgtgcagtcgtatccccwgttcagtctctcgcatccatcacgatggttgacagttgagatactgaacaaccccctcaccacgaggcgctctcgtgttgcccttttgcaaccacaccca

SEQ ID NO: 60756 - DNA, 201 bp, Homo sapiens
aaacacaaagtagccatcaggaaacaaccaaacaaaacaaacaaaacatttactttccaacttcattcctttaacgttgtggtataggattttcttttttwaaattaaaatcagactctgggccaggcacagtggctcatgcctataatctcagcaatttggggggtgaggtaggtggatcacttgaggccaggagttcca

SEQ ID NO: 60757 - DNA, 201 bp, Homo sapiens
gaccttcacttgaccttgggcaggaagttcaccctctctgggcctcagtttcctctgtagaaagatgatgatgatgacgttgatacttccccatgtgctaytagggtacccagtaggcaagttaaccatgttttgaagttaccagtaaccctgaggcaccaccatagccactgtccacaaaacacaagaggagaacatttt

SEQ ID NO: 60758 - DNA, 201 bp, Homo sapiens
cccacgcaccccctcctcttcctgcaccccttccttttcctccttccccctcctcctcctcttcctctctcctgctccaccttcttcttcctttctgctcyctgtcatcttccctcccacttcttcccttctcccttcttctcctctaccgtcctccctctcttccctctgctcttccctctccttctcttccctttcttc

SEQ ID NO: 60759 - DNA, 201 bp, Homo sapiens
gaggctgtgggagaaccaggttggtgtcagagaggcacatgaaaggttttacccttgttctgccttcatcaccctggattccattcctggtgtagaagctyataaggcttcctcccctctccctctgccccagcctcctcctcctgccctcctcctcttgcacccctccctgcaccctccctcctcctgcatctctcccac

SEQ ID NO: 60760 - DNA, 201 bp, Homo sapiens
ctgaccgagagcgtcctctacctcaacgggctgtggctgcctctcgtctggatcgtggtctgcttcgtctatctctggcaggtatgccagaggaggaagasgggatttgaacggagtcccccaccccctccttctccccctcctccttccccctcccacccttcctcctcctgacttagcattcaagaggctggaagaggt

SEQ ID NO: 60761 - DNA, 201 bp, Homo sapiens
gatcttggaggattttcatttttgtcatctctgtggatcctcaaagagccctgagaggttggcctaagagactttactcacccacctcgcagacgcgtgargtggggctcagtgggtggagaagccacctggggcatccctctgccccggcctccccactttacttctctccttctgcccacccgccaggtcctggctctg

SEQ ID NO: 60762 - DNA, 201 bp, Homo sapiens
ttagggatcttggaggattttcatttttgtcatctctgtggatcctcaaagagccctgagaggttggcctaagagactttactcacccacctcgcagacgygtgaagtggggctcagtgggtggagaagccacctggggcatccctctgccccggcctccccactttacttctctccttctgcccacccgccaggtcctgg

SEQ ID NO: 60763 - DNA, 201 bp, Homo sapiens
tggcattagagggaatgaatatggtagtgcctgcttggtaccattcatggctgtgagcaccccgggaaaggataaggctgttcatttagcacagtgcctgygacatggtgagcactgggcagatgaccaccgttatctgtgttaatctggtgttttcgtgcatgttattcattattatgcctcccgtgctttagggatctt

SEQ ID NO: 60764 - DNA, 201 bp, Homo sapiens
acagcaaaggcagtattggtcttcccactgcacagtcatgtcctttcacaaagacaaagagaaatgtctgctcccactatagaaaaagagattattttatmataaacagtggctaataataacaataaaatagactaaaagtagccaccaccatctgtttttagcattgacatagtccatgccctctcttgttgaattccc

SEQ ID NO: 60765 - DNA, 201 bp, Homo sapiens
ggcacacaactgcaccctgtaggtatttgtaatattatcattagttacttttccataaaggataagacagtagatgctttttacactggaggccacaccayctctcctgcaaatattcatctctgcccttggagtgcagaagtggctgtagaccatactaagcaaacaggcatggtattcctccaataaaactctatttat

SEQ ID NO: 60766 - DNA, 201 bp, Homo sapiens
gattttacggcgaatttgttactgcagcgcagcctcgcctctctggactaacataaagggattttcaggccaggtgcctgaaccccagcactttgggaggytcaggcaggaggatccccagagcccaggagtttaagaacaacctgggtaacatagcaagaccctgactctataaaaatttttaaaaattagctgggcaca

SEQ ID NO: 60767 - DNA, 201 bp, Homo sapiens
gcgtgaggcacctcacccggccccctggctaattttttaaagtattttgtagagcttgggtcttactatgtcgcccgggctggtttcgaactcctgggatyaagcaatcctcccacctcagcctcccagagtggcgggattacaggcagaggccactgcacctggcctggcattagagggaatgaatatggtagtgcctgc

SEQ ID NO: 60768 - DNA, 201 bp, Homo sapiens
cccatccatccttctcagagcctgtatgtggttagctcatgccagctgagacgcttggagtcagccagctactcgtctgtctgctcccacatggctgagaygttccagggcagcacagtggtccgggcattccgaacccaggccccctttgtggctcagaacaatgctcgcgtagatgaaagccagaggatcagtttcccg

SEQ ID NO: 60769 - DNA, 201 bp, Homo sapiens
gggcttctttttgctctgcatgctctggttctactgaaggaagagagggacctgttggttgtatccaaatcccaatcccctgggcccaggtcctcagactrtcccattcctgcctcccctctttactcccctgggtctggcctcccagaaaaggttgggaaaccaggggggctgttgcaagccctcaagtggccttgccaa

SEQ ID NO: 60770 - DNA, 201 bp, Homo sapiens
gggtttcaccatgttggccaggctggtctccacctcctgacctcaggtgatctgtccacctcggcctcccaaagtgctgggattacaggcgtgaggcacckcacccggccccctggctaattttttaaagtattttgtagagcttgggtcttactatgtcgcccgggctggtttcgaactcctgggattaagcaatcctcc

SEQ ID NO: 60771 - DNA, 201 bp, Homo sapiens
aatcccacccaggtgttgtacacatctgtatttaaggcccacgtgacaccagccttgaatgtcttaggaagactgtagatttgattcttgaagcagcagtsagtcattgtaggtttgtttgcaacggcatgactgaagtgaaagctgtgctttcgctgttgggggaaatataaattagtacagtcactatggaaaatagta

SEQ ID NO: 60772 - DNA, 201 bp, Homo sapiens
tttttggtagagacagggtttcaccatgttggccaggctggtctccacctcctgacctcaggtgatctgtccacctcggcctcccaaagtgctgggattayaggcgtgaggcacctcacccggccccctggctaattttttaaagtattttgtagagcttgggtcttactatgtcgcccgggctggtttcgaactcctggg

SEQ ID NO: 60773 - DNA, 201 bp, Homo sapiens
ttgatctgggctcactgcaacctctgcctcctgggtttaagcgattctcttgcctcagcctcccaagtagctgggattacaggtgcctgccaccatgcccrgctaatttttgtatttttggtagagacagggtttcaccatgttggccaggctggtctccacctcctgacctcaggtgatctgtccacctcggcctcccaa

SEQ ID NO: 60774 - DNA, 201 bp, Homo sapiens
ggcaccaacatggctcactgcagcctcaacctcctgtactcaattaatcctcccacctcagcctccccagtagctagctgggaccacaggcgcaccacaamcatgcctggctaattttttctttttttttccccccgaaatggattttgctcttgttgcccagactggaatgcaatggcttgatctgggctcactgcaacc

SEQ ID NO: 60775 - DNA, 201 bp, Homo sapiens
ttgcccaggctagagtgcagtggcaccaacatggctcactgcagcctcaacctcctgtactcaattaatcctcccacctcagcctccccagtagctagctrggaccacaggcgcaccacaaccatgcctggctaattttttctttttttttccccccgaaatggattttgctcttgttgcccagactggaatgcaatggct

SEQ ID NO: 60776 - DNA, 201 bp, Homo sapiens
gggggctgggggcaaaagcctcgagaccactgtggcagctgttgtagggatgcagggagaaagtggggtggctgggaccagcgtggtggcaatgggaggayggggagtggatagattctgggtgttttgcagaaaatcaaacaaatttgctgtaggacccgatggtgggtgtgaggacagatgaacagttcaacactggaa

SEQ ID NO: 60777 - DNA, 201 bp, Homo sapiens
ttcgtcaccctggattccattccttgtgtaggagcttacaaggcctgtgactttgggcaagttgctcaacttctctctgcctcggtttctttagccatagratggggttagtaaatgttcatttcattgattctcgtctcacatttttttttcactctaatacttccaaaatcgagatgtctcttacatgtcttaatttaa

SEQ ID NO: 60778 - DNA, 201 bp, Homo sapiens
gctggccttagcttcccaaagtgctgggattacaggcgtgagatactgtggctggcgggttcatttcctatatgtggttgctaaaaaccaaattccagctycctgggggcgccccagcacccgtcggaacacctggagtgtttctgttcacagttccgctccagatgctgctgacagccaaaggctggacccggctgagcg

SEQ ID NO: 60779 - DNA, 201 bp, Homo sapiens
ctcacccttgtcatgccttcgtcaccctggattccattccttgtgtaggagcttacaaggcctgtgactttgggcaagttgctcaacttctctctgcctcrgtttctttagccataggatggggttagtaaatgttcatttcattgattctcgtctcacatttttttttcactctaatacttccaaaatcgagatgtctct

SEQ ID NO: 60780 - DNA, 201 bp, Homo sapiens
gatccgcccacctcagcctcccaaagtgctgggattacaggtgtgagccgccgtgccccgccacccacacacttttatgtgccatgtcgtcacgattcagygaggacggatccattaggagcacagactctggggtcagaggacttgggttcaaattatggacccaccactagccttgagaccttggtcaagccactgagc

SEQ ID NO: 60781 - DNA, 201 bp, Homo sapiens
ttgtcttatttttttgagacagagtctcactctgtcacccaggctgtagtgcagcggtgcaatcttggctcactgcaacctctgcctcctgggttcaagtrattgtcctgcctcaccctcccaagtagctgggattacaggtgcccaccagcatgcccagttaatttttgtatttttactagagatggggttttgccatat

SEQ ID NO: 60782 - DNA, 201 bp, Homo sapiens
tctaacgcctgcatgaccatagtaggttctgatcatgtaaaaggatgctgtttcatggaagggcttactgtgcaagacagccatgctggggccccaggggycagttcccacctgggtcaggggctcactgggctcacaacctggaatctcaactcctccaccctccacgaagggtgctactccatgccaagggcttattct

SEQ ID NO: 60783 - DNA, 201 bp, Homo sapiens
tttgtcttatttttttgagacagagtctcactctgtcacccaggctgtagtgcagcggtgcaatcttggctcactgcaacctctgcctcctgggttcaagygattgtcctgcctcaccctcccaagtagctgggattacaggtgcccaccagcatgcccagttaatttttgtatttttactagagatggggttttgccata

SEQ ID NO: 60784 - DNA, 201 bp, Homo sapiens
agtttgagttaatacatagaacatgcttagctcatagaaagtgctccagaaatgtttactaatgcttttattatttgcgttttcactctcacaacaacccytaagtgaggtgctagtactatcccattttacagatgcctcatcaggccccttcactgaatccctttcctccctccctctgaacctacagaggcttcctcc

SEQ ID NO: 60785 - DNA, 201 bp, Homo sapiens
gagagggtgggtgaaggcaggggtgctgggagacaaggttggggatgggatggcagggctagagctgctaatggctcatagggaggagcttggagtggttytaagtgtcatgggaaattggtggccacccagtcgctgcgagaaagccgtcagaatggaatcagtgggcctgggtcctgctgtgtgtccttgggagggcca

SEQ ID NO: 60786 - DNA, 201 bp, Homo sapiens
ttaggaggaagtgaggttaacagcaggaagaaaaggcctgggagttgaaggttcatccctggtgtgttagaggaacagcaagaagacgggtgtggctggaragggtgggtgaaggcaggggtgctgggagacaaggttggggatgggatggcagggctagagctgctaatggctcatagggaggagcttggagtggttcta

SEQ ID NO: 60787 - DNA, 201 bp, Homo sapiens
gaggaggcattattctaagagctttatatgtttttgttcgttttggtttgttgttgttgctgtttgagacaggatctcattttgttgcctaggcttgagtrcagtggcatgatcttggctcacttcagcctccatctccaggctcaagggattctcccacctcactttcccaattagctgggactacaagcatgcaccacc

SEQ ID NO: 60788 - DNA, 201 bp, Homo sapiens
ctgaggctcaaggggttgacatgacttgccaagttgacccagtcagtaaggacagagtggggatctgtttctgggtgtaataccaaagtcattgcacaggrcacatttgtcctttagagaaaggaagggcggcagatgcagcctgtcttctctggctggagctgagccacctgccttgcagagtgaccctaggcaggggct

SEQ ID NO: 60789 - DNA, 201 bp, Homo sapiens
cctcctgagtagctgggattacaggcacctgccaccacacccggctaatttttgtatttttagtagagacagggtttcaccatgttggccaggctgctatsaaacttctgacctcaatcacccccctcggcctcccaaagtgctgggactacaggcatgacccaccatgcccagccatcctgtgacctttatcagcatgaa

SEQ ID NO: 60790 - DNA, 201 bp, Homo sapiens
caccaaggggtgctcaggactcctttaccccacccctccctgggtcaccctgtccccctggaacagtgtgcaaaacgtctggggtccaggcaaagatctgygtccttaagatgaggctggagggaacgggaaggacagggcacatccctccttttctggaagcttcagaacctctcccagtccctccccactagcggaagg

SEQ ID NO: 60791 - DNA, 201 bp, Homo sapiens
atttgctttcagttactggccacacctgggggatagtggtggggaggtgtccttcctaggggagatggtacctgagggtaggtgagagttagccagaaaaragcattccagacacaaggaactgcttgagcaaggctgttgggggaaacagaggtaacttgactttgtacagtgttaaatgctgtttttccaacctcaagt

SEQ ID NO: 60792 - DNA, 201 bp, Homo sapiens
agctccagagtctatgcttgcagttgctatggagacagcccaagaaggactttgatgcctagcaagctacaccgtgctagctagggtttctaataatccaraaaaacagtgtgctggatacatggcaaggttctggaagtaaagttgccaagccaagctcactcacaatgactgaaaagtagcaactaacagcacatcaca

SEQ ID NO: 60793 - DNA, 201 bp, Homo sapiens
gtcacaacgtcaccagtttttcactgggcaccttcatactctgtggttcctaatgcaagccaatgacatcattcaggcatgagccaccatgcccggctggytgatactacctattctaatggttatgaccttactggcttttcactaggcaccttcacactctgcagtccctaatgcaagccaacagtttcaatggggcat

SEQ ID NO: 60794 - DNA, 201 bp, Homo sapiens
cagccagggtgttgacattgacacaacaatcttgctcgatttcccgttttacctgtactcctgtgtgtgtgtgtgtttattttgtcccatgcagttttatyacacatgtaggctcatgaatccacaccagggtgaggatacggaatagccaccaccattttccgaccacacccatcactctcgctcctgcccccagtgacc

SEQ ID NO: 60795 - DNA, 201 bp, Homo sapiens
ctcggacgaggctatctgggcagccctggagacggtgcagctcaaagccttggtggccagcctgcccggccagctgcagtacaagtgtgctgaccgaggcraggacctgaggtatggtcgtcccaccatggctgggacctgcaggtgggagaggaggggatggccatgccctccccaagggccttcaggaaatgcctcccc

SEQ ID NO: 60796 - DNA, 201 bp, Homo sapiens
gtttcaccctgtagatgctgactcaggccactgttccttttgtggccacagggcatgaatctctccggaggccagaagcagcggctgagcctggcccgggmtgtatacagaaaggcagctgtgtacctgctggatgaccccctggcggccctggatgcccacgttggccagcatgtcttcaaccaggtcattgggcctggt

SEQ ID NO: 60797 - DNA, 201 bp, Homo sapiens
tctgatggagaatacaccccaggcttctctcctggtttctggtggtcgccggcagtcgctggcattccttggcttgtagatacaccctcccatctgtgtcrccatcttcatatctcctgctgtgtctctgagtatcctctagtattcttatataaatggcagtcactgaatttaggacccatcccaaatgaattttggggg

SEQ ID NO: 60798 - DNA, 201 bp, Homo sapiens
ggaggctcaggcaggagaatcgcttgaacccaggaggcggaggttacagtgagccgagaccacaccactgcactccagcctgggcgacagaggaagactcrgtctcaaaaagtaaaaccttctccaggcagctgcccctctgatgatgcccccgccccatggtgaagcacaagagaccctgaattcttctgcctgacttta

SEQ ID NO: 60799 - DNA, 201 bp, Homo sapiens
gtgtgcgccaccatgcctggctaattttgtatttttagtagacagggttttaccatgttggccaagctggtatcgaactcctgacctcaggtgatccaccyacctcagcctcccaaagtgctgggattacagacatgagccaacgcgctcagcctgggctacttttttatgttactcatcataactgccattaaagcatga

SEQ ID NO: 60800 - DNA, 201 bp, Homo sapiens
cacagtcccggctcactacaacctccaccccctgggttcaagtgattctcctgtctcagcttcctgagtagctgggattacaggtgtgcgccaccatgccyggctaattttgtatttttagtagacagggttttaccatgttggccaagctggtatcgaactcctgacctcaggtgatccacccacctcagcctcccaaag

SEQ ID NO: 60801 - DNA, 201 bp, Homo sapiens
cgggcatcagaggcttcctccgtggggcacattatcccaggggcactcctgcagaagtccaggtacaggatgatggtggttggaccaggagtgagggtcaraggtgctgagaggcagacaggtttgggacgcagtttggtgagatgaatgggatttgctgaagggtggctgtcagggtgcagggaagaattctcaactgtc

SEQ ID NO: 60802 - DNA, 201 bp, Homo sapiens
agcctggacagcatagcaagatcccatctctacaaaaataccccaaattagccggcatggtggcgtacacctgtggtcccagctactcggagggtgaggcrggaggatcgcttgagtgcaggaggtcaaggctgcactgagccatcatcatgctactgcacttcaacatgggtgacagagtgagaccctgtctcaaaaaaa

SEQ ID NO: 60803 - DNA, 201 bp, Homo sapiens
agacggagtcttgctctgtcaaccaggctggagtgcagtagcacgatctcggcttatggctcactgcaacctctgcctcctgggttccagtgtttctcctractaagcctcctgagtagctaggactacaggtgcctgccaccacgcccagctaatttttgtatttttagtagagagtagggtttagtagggtttcaccgt

SEQ ID NO: 60804 - DNA, 201 bp, Homo sapiens
ccgtctgaaaataaacaaattcagctccaattcaaagtgtttaagcaacaagagaattgattggctcttgggaccagtatccctagatttctggcttcagrtatggctggatgtaggggtccaaacaagaaatcgctttatttccctcctctgtgacagcttcctgtccagcttagctgctgcccctggcagtaagatgat

SEQ ID NO: 60805 - DNA, 201 bp, Homo sapiens
cttactctcccctaaagatggagagatgggagctgagagagagaaattggttatgactctcgaatacaaagaataaaaaattcagctccaggccagatacrgtggctcatgcctgtaatcccagcactttgggaggccgaggcgggtggatcacttgaggtcaggagttcaagatcagcctggcgaacatggtgaaacccc

SEQ ID NO: 60806 - DNA, 201 bp, Homo sapiens
cgtgttgcccaggctggtctcaaactcctgggctcaggcaattcaggcaatcctccgcctcaacctcccaaagtgttgggatcacaggcatgagccaccasgcccggcctggtctcaaactcctgggctcaggcaatcctccgcctcaaactcccaaagtgttgggatcacaggcatgagccaccacgcccggcctggctt

SEQ ID NO: 60807 - DNA, 201 bp, Homo sapiens
gcctcctgggctcaagcaatcctcccacctcagcctcccgagtagctgggactacatgcacatgccaccatgctggctaatttttgtttttgatagagacrgtttcgccgtgttgcccaggctggtctcaaactcctgggctcaggcaattcaggcaatcctccgcctcaacctcccaaagtgttgggatcacaggcatga

SEQ ID NO: 60808 - DNA, 201 bp, Homo sapiens
gcttcttatttatacacacacacacatatatatagactgggtctggctttgtcacccaggctggaatgcagtggcacgaactcggctcactgcaacctctrcctcctgggctcaagcaatcctcccacctcagcctcccgagtagctgggactacatgcacatgccaccatgctggctaatttttgtttttgatagagaca

SEQ ID NO: 60809 - DNA, 201 bp, Homo sapiens
gtgcacatgtgagtttggcttcttatttatacacacacacacatatatatagactgggtctggctttgtcacccaggctggaatgcagtggcacgaactcrgctcactgcaacctctgcctcctgggctcaagcaatcctcccacctcagcctcccgagtagctgggactacatgcacatgccaccatgctggctaatttt

SEQ ID NO: 60810 - DNA, 201 bp, Homo sapiens
tactagctccctggggattgtataggagatgggggttctaaggctggctggggcctgtcggggaaatggtgctcctggtgggaggcacagcgggagaaccrgtgaggtctgcgtggtggtcccatctgccatgggcatgttttctgggagcctcgcctggccttgcctcaacccacccctcccactgggggctctctctgc

SEQ ID NO: 60811 - DNA, 201 bp, Homo sapiens
aaaaaaaaagaaaagaaaaaatattaatactagctccctggggattgtataggagatgggggttctaaggctggctggggcctgtcggggaaatggtgctyctggtgggaggcacagcgggagaaccggtgaggtctgcgtggtggtcccatctgccatgggcatgttttctgggagcctcgcctggccttgcctcaaccc

SEQ ID NO: 60812 - DNA, 201 bp, Homo sapiens
aattgtgacgatgaatttaattgatctgggctaagccatgagagctttgatttttagaaaatctttcaggcaattctaactacgtcttaaggatcaagaaycactaatctaattacacttgttatcacagtgaaataataataataattagtagtagtagcagtagtatttttgagacagtcttactccgtcatccaggct

SEQ ID NO: 60813 - DNA, 201 bp, Homo sapiens
tcacaagattagaacttgagtatgtccagctccagagtctatgcttgcagttgctatggagacagcccaagaaggactttgatgcctagcaagctacaccrtgctagctagggtttctaataatccaaaaaaacagtgtgctggatacatggcaaggttctggaagtaaagttgccaagccaagctcactcacaatgactg

SEQ ID NO: 60814 - DNA, 201 bp, Homo sapiens
cacagacagaacaagaaccctgcggggtcacccagaagccagtgagtagcagggcaatttgttcagtgggagagatttcttcctgcagcctctgcccctgkgggggcgggggatggtgcctgggggcctctccgatgcagaggccggccaggtcaggggtctcctgtaaatggcctcttgtgccctgcagctgccgggaag

SEQ ID NO: 60815 - DNA, 201 bp, Homo sapiens
ggagctggacccaccctggctggagagagtactagaagcctgtgccctgcagccagatgtggacagcttccctgagggaatccacacttcaattggggagyaggtgagagtttgggggtctttttgggacagggagacattgcagttgggagtcatttgggtccccgactcatcatgggcagtatgatggagaaatgagag

SEQ ID NO: 60816 - DNA, 201 bp, Homo sapiens
tggaatttagcattcaacaggctggaagaggtccactgtgaccccagggttaaggcagatgtgaggctgccagagaaccaggttggtgtcacagaagcacrtgaaaggtctcacccttgtcatgccttcgtcaccctggattccattccttgtgtaggagcttacaaggcctgtgactttgggcaagttgctcaacttctc

SEQ ID NO: 60817 - DNA, 201 bp, Homo sapiens
actttacttctctccttctgcccacccgccaggtcctggctctgtccagcggctccagaaaggccagtgcggtgggtgatgtggtcaacctggtgtccgtrgacgtgcagcggctgaccgagagcgtcctctacctcaacgggctgtggctgcctctcgtctggatcgtggtctgcttcgtctatctctggcaggtatgcc

SEQ ID NO: 60818 - DNA, 201 bp, Homo sapiens
ttgtatggtagcgaggtcacccagagagtcagggacatagttgaggctagatcccacaggcagtctatcagttctcaccgtgggcagatggaacatgaccragagattctcaacagcaggtgggcggggggtacaggaagaagcttctgttgccaggcaactggatcaacctcttttgccttggtgataaagcagccatat

SEQ ID NO: 60819 - DNA, 201 bp, Homo sapiens
gatcgcttgaggccaggagtctgagactagcctgggcaacacagcgagactccatctctttaaaactatgaaaattaacaaaacatggtggtacaaacctmtagtcctgactactcgggaggctgaggcggggggattacttgagcctaggagttcaaggctgcagtgagccatgatcatgccagtgtactccagcctggg

SEQ ID NO: 60820 - DNA, 201 bp, Homo sapiens
tgtggtggctcacacctgtaatccaagcactttggaaggccgaggagggaggatcgcttgaggccaggagtctgagactagcctgggcaacacagcgagaytccatctctttaaaactatgaaaattaacaaaacatggtggtacaaacctctagtcctgactactcgggaggctgaggcggggggattacttgagcctag

SEQ ID NO: 60821 - DNA, 201 bp, Homo sapiens
atgcctgacctatggtgggtgttcaagaaaacccttctagctgggtgtggtggctcacacctgtaatccaagcactttggaaggccgaggagggaggatcrcttgaggccaggagtctgagactagcctgggcaacacagcgagactccatctctttaaaactatgaaaattaacaaaacatggtggtacaaacctctagt

SEQ ID NO: 60822 - DNA, 201 bp, Homo sapiens
tgagccacccctcctggctgggatttcttctaagagcaagagatagccatggacaggccaacgacaagatataattagattaatgttttcaacagtcccgyctggctgcagctgtgcagagaacttcagatttgtaggagcaggaccttaagccagtggctgaacctctctgtgcctcagtttccttatctgtgaaatgga

SEQ ID NO: 60823 - DNA, 201 bp, Homo sapiens
agcttggaatttctttctttctttctttctttcttttttttttttttttttttttttgagacagagtttcgctcttgtcgcccagagaagagtgtaatggygcaatctcagctcactgcaacctccacctcctggcttcaaacgattctcttgccttagcctctcgagtagctgggactacaggtgcctgccaccacacgt

SEQ ID NO: 60824 - DNA, 201 bp, Homo sapiens
tggcaggcagtgagtgggggcgagataagaagcttggaatttctttctttctttctttctttcttttttttttttttttttttttttgagacagagtttcrctcttgtcgcccagagaagagtgtaatggcgcaatctcagctcactgcaacctccacctcctggcttcaaacgattctcttgccttagcctctcgagtag

SEQ ID NO: 60825 - DNA, 201 bp, Homo sapiens
tagcttagggtgccagagaaaggggtcccatgaggctggcaggcagtgagtgggggcgagataagaagcttggaatttctttctttctttctttctttctyttttttttttttttttttttttgagacagagtttcgctcttgtcgcccagagaagagtgtaatggcgcaatctcagctcactgcaacctccacctcctgg

SEQ ID NO: 60826 - DNA, 201 bp, Homo sapiens
atgatgaaatagagaccactgagaaaccataccatggttggtatggacaggatgctctgagaagtgacatttgagcttccccaaagaatgtgtgaaggaaycaatcatacaaagggcaggagaaagagcgctccaggcagagagagcagcaggtgcaatggctccgaggtgggaagtagcttagggtgccagagaaagggg

SEQ ID NO: 60827 - DNA, 201 bp, Homo sapiens
cagtgagctatgatcatgtcactgcaatccagcctgggtgacagagtgagaccctgcctcttaaaagaaagaatgatgaaatagagaccactgagaaaccmtaccatggttggtatggacaggatgctctgagaagtgacatttgagcttccccaaagaatgtgtgaaggaatcaatcatacaaagggcaggagaaagagc

SEQ ID NO: 60828 - DNA, 201 bp, Homo sapiens
gtaacttctaccccttccctgcccagacacggattctcgtgacgcacgcactccacatcctgccccaggctgattggatcatagtgctggcaaatggggcyatcgcagagatgggttcctaccaggagcttctgcagaggaagggggccctcgtgtgtcttctggatcaagccagacagccaggagatagaggagaaggag

SEQ ID NO: 60829 - DNA, 201 bp, Homo sapiens
ccaccaactcatttatccatccccacccactcatttatccatccatcccaggcactcatttatctgtccatcccatccactcatttatccatctatcccayccactcatttatctgtccaacccatccactcacccacctactcatttatccatcccattcgcttacccatccatctatcccacctaacaatacatccaac

SEQ ID NO: 60830 - DNA, 201 bp, Homo sapiens
ggactcacgggcacggctcaccagctctatcctcaggaactcgaagaccatcaagttccatggctgggagggagcctttctggacagagtcctgggcatcygaggccaggagctgggcgccttgcggacctccggcctcctcttctctgtgtcgctggtgtccttccaagtgtctacatttctggtgacgtcactctagtc

SEQ ID NO: 60831 - DNA, 201 bp, Homo sapiens
gctggtctcgaactcctgacctcaggtgatccacccgccttggcctcccaaagtgctgtgattacaggcatgagccactgtgcccggcccctcgtggaggytctgatggagaatacaccccaggcttctctcctggtttctggtggtcgccggcagtcgctggcattccttggcttgtagatacaccctcccatctgtgtc

SEQ ID NO: 60832 - DNA, 201 bp, Homo sapiens
gcctgcctgctggtggctttcagtgcctgcccccaaacctccagacagagccagaccctccctaacaaatgcatcaccgctatcactccttcttctcctcstcaaaaatggaaagacttcttcttgaaataattgtagattcacatgcagttctaggaaataaggcagccagctaccttgaacagtctgcccagtttctcc

SEQ ID NO: 60833 - DNA, 201 bp, Homo sapiens
caatggcacaacttcggctcactgcaacctccacctcccaggttcaagcaattatccagcctcagcctcctgagtagctgggattacaggcgtgcaccacracatctggctaatttttgtatttttagtagaaactgggtttcaccatgttggctgggctggtcctgaactcctgacctcaggtgatctgcccacctcagc

SEQ ID NO: 60834 - DNA, 201 bp, Homo sapiens
ggaactcctgggctcaagtgatcctctggcctctgcctcccaaagtgctggggttacaggtgtgagccactgtgcccagccaagaaactgaagtcttaaasagttaagagacttgtttgtgttttcatatctagcctgggacacaacctgggactcaaatctaggccaatctgagtctgaagcttacactgtttctcatct

SEQ ID NO: 60835 - DNA, 201 bp, Homo sapiens
catgattgacagcaccccaacccagccctttcccacaggaaaccagaagtagaaaacatggtagtcagataaaaaccatggctagggctaggcatggtggytcacacatctaatcacagcactttgggaggctgaggtgggcagatcacttgaggtcaggagttcgagaccagcctggtcaacatggtgaaactccgtcta

SEQ ID NO: 60836 - DNA, 201 bp, Homo sapiens
cacagggctactgccaaacaagttgccacaaacttgggagcccagcacaattgaaatttgttctgtcgcagttctgaggcctgaagtctaaaatcaaggtktcagcagtgttaactctttgtggaggtttttttggtttttttgtttgtttgtttgtttgttttttctgagacggagtcttgctctgtcaaccaggctgga

SEQ ID NO: 60837 - DNA, 201 bp, Homo sapiens
tccaaaagttctagtgaagtcccaggtctccctgtcattggcctgacttgggttatgtgttcatccctgaaccaactgcagtggtttggattggccatggrtgaaatttgccccaccccagaggagaagttagccccaccccaggcatacagattagcactgggaggaaggatgtgcatttctctcacagggctactgcca

SEQ ID NO: 60838 - DNA, 201 bp, Homo sapiens
cctagatttctggcttcaggtatggctggatgtaggggtccaaacaagaaatcgctttatttccctcctctgtgacagcttcctgtccagcttagctgctscccctggcagtaagatgatattccacagctccagcttggctacctccaacaaccaagtaccacttttccaaaagttctagtgaagtcccaggtctccctg

SEQ ID NO: 60839 - DNA, 201 bp, Homo sapiens
ccacctagtcatttatccatccctcccaccaactcatttatccatccccacccactcatttatccatccatcccaggcactcatttatctgtccatcccayccactcatttatccatctatcccacccactcatttatctgtccaacccatccactcacccacctactcatttatccatcccattcgcttacccatccatc

SEQ ID NO: 60840 - DNA, 201 bp, Homo sapiens
tccatccatcccacctagtcatttatccatccctcccaccaactcatttatccatccccacccactcatttatccatccatcccaggcactcatttatctrtccatcccatccactcatttatccatctatcccacccactcatttatctgtccaacccatccactcacccacctactcatttatccatcccattcgctta

SEQ ID NO: 60841 - DNA, 201 bp, Homo sapiens
atccatccatcccacctagtcatttatccatccctcccaccaactcatttatccatccccacccactcatttatccatccatcccaggcactcatttatcygtccatcccatccactcatttatccatctatcccacccactcatttatctgtccaacccatccactcacccacctactcatttatccatcccattcgctt

SEQ ID NO: 60842 - DNA, 201 bp, Homo sapiens
aggatggccagcaggaaaggacagcatccaatacggcagggtaaccaccagcttcacccacccctccccacccactgtgccacctccaggggcccaagtcytcccaccaaatgtagcacttggcagtgatactcacctttcttgagcacctactatgtgccagtagcattctagatgttcattttcttaatcctcacaacc

SEQ ID NO: 60843 - DNA, 201 bp, Homo sapiens
agccggcgtggtggcatgtgcctgtagtcccagctactcgggaggctgaggcacgagaatcacttgaacctcggaggcggaggttgcagtgagccgagatygtgccaaattaacctctagcaaatttaatgtgtctgaggttttttgttttttgcgggggggggggggtttgagacagaatcttgctctgtcgcccaggtc

SEQ ID NO: 60844 - DNA, 201 bp, Homo sapiens
aataagtaaatttaaaaaaaaaagccggcgtggtggcatgtgcctgtagtcccagctactcgggaggctgaggcacgagaatcacttgaacctcggaggcrgaggttgcagtgagccgagattgtgccaaattaacctctagcaaatttaatgtgtctgaggttttttgttttttgcgggggggggggggtttgagacaga

SEQ ID NO: 60845 - DNA, 201 bp, Homo sapiens
gaacccgtctctactaaaaataaaaaataagtaaatttaaaaaaaaaagccggcgtggtggcatgtgcctgtagtcccagctactcgggaggctgaggcasgagaatcacttgaacctcggaggcggaggttgcagtgagccgagattgtgccaaattaacctctagcaaatttaatgtgtctgaggttttttgttttttg

SEQ ID NO: 60846 - DNA, 201 bp, Homo sapiens
catggtgaacccgtctctactaaaaataaaaaataagtaaatttaaaaaaaaaagccggcgtggtggcatgtgcctgtagtcccagctactcgggaggctraggcacgagaatcacttgaacctcggaggcggaggttgcagtgagccgagattgtgccaaattaacctctagcaaatttaatgtgtctgaggttttttgt

SEQ ID NO: 60847 - DNA, 201 bp, Homo sapiens
gttcgagaccagcctggccaacatggtgaacccgtctctactaaaaataaaaaataagtaaatttaaaaaaaaaagccggcgtggtggcatgtgcctgtartcccagctactcgggaggctgaggcacgagaatcacttgaacctcggaggcggaggttgcagtgagccgagattgtgccaaattaacctctagcaaattt

SEQ ID NO: 60848 - DNA, 201 bp, Homo sapiens
aactgaagcgggtggatcactagctagaggtcaggagttcgagaccagcctggccaacatggtgaacccgtctctactaaaaataaaaaataagtaaattwaaaaaaaaaagccggcgtggtggcatgtgcctgtagtcccagctactcgggaggctgaggcacgagaatcacttgaacctcggaggcggaggttgcagtg

SEQ ID NO: 60849 - DNA, 201 bp, Homo sapiens
tccctcgtccaggtgaggtgggtgcaagggctggagccatcctgggagagtgcgtgggctacacctggctccagcttccctacccctgccatttgcagagragagggaagacagagtgggagggagagggatggtgtggagctggaaaagaggcgggtaggggcaagaacagaggcgggcagagagtacagcaaatacatc

SEQ ID NO: 60850 - DNA, 201 bp, Homo sapiens
ggctacacctggctccagcttccctacccctgccatttgcagaggagagggaagacagagtgggagggagagggatggtgtggagctggaaaagaggcggrtaggggcaagaacagaggcgggcagagagtacagcaaatacatctggaaggggtcagcctttggagggcaatgtgcagacctttccacacacacctcaga

SEQ ID NO: 60851 - DNA, 201 bp, Homo sapiens
ctgtgcctggccttgtaaaaactgttaatggcattttgattgtaattgctgaatattccaaaaaaaactcgaatgctcatgcatatgattgtttttgctarggctaggggccaggactttttccagtgtcttcaccttgtattccagggccttgcaaacaataggcaggtgcttagcaattacaacataaggcactcagac

SEQ ID NO: 60852 - DNA, 201 bp, Homo sapiens
ctactaaaaatacaaaaattagccaggcatggtgtcagtgtttgtaatcccagctacttgggaggctgaggaaggagaatcgcttgaacctgggaggtggrgtttgcagtgagcagagattgcaccactgcactccagcctgggtgacagagcaggactccgtctgaaaataaacaaattcagctccaattcaaagtgttt

SEQ ID NO: 60853 - DNA, 201 bp, Homo sapiens
tgacctcaggtgatccacccgccttggcctcccaaagtgctgtgattacaggcatgagccactgtgcccggcccctcgtggaggctctgatggagaatacrccccaggcttctctcctggtttctggtggtcgccggcagtcgctggcattccttggcttgtagatacaccctcccatctgtgtcaccatcttcatatctc

SEQ ID NO: 60854 - DNA, 201 bp, Homo sapiens
gtgatcctcccaccttggcctcccaaagttctgggattacagggcatgagcccctgtgccccacggcacagttaaatattaagggccagagcctttcacgygtaatgtttttatcctgccgtaatttcttcctctccaattatctggaagccaaaaaggcattgcaaggtctcaaaggctattatatgaagctagattctt

SEQ ID NO: 60855 - DNA, 201 bp, Homo sapiens
cgtaatttcttcctctccaattatctggaagccaaaaaggcattgcaaggtctcaaaggctattatatgaagctagattctttcaattgctgggaccagcraccaactaaaattagcttaaccaaaagaatagaatttaatggcttatatttccttgggggcatgggcccagttgtcatcaggacacagtgactctctcca

SEQ ID NO: 60856 - DNA, 201 bp, Homo sapiens
tttgaaatggagtctcggcttgctctgttgcccaggctggagtgcaatgacttgatttcagcccactgcaacctttatctcccacattcaagcaattctcytgtcagcctccccagtagctgggactacaggcatgtgccaccatgcccaactaatttttgtgtttttagtagagacggggtttcaccatgttgatcaggc

SEQ ID NO: 60857 - DNA, 201 bp, Homo sapiens
agatgagaaaacaaacagaatgagtggcatctctgcccaagcagtgtggcttcagagcccgtgtcctcaccatcagtcactcactctgtcacccaggctgragtgcagtggcgtgatcttggctcactgcaacctccacctcccagttcaagcaattcttatgcctcagtctcccaagtagctggaattacaggcactcgc

SEQ ID NO: 60858 - DNA, 201 bp, Homo sapiens
gctctgttctccagttgtgtgtgtgtgtgtgtgtgtgtgtgtgtgtgtattttttttttttttttttttgagacagagtctcactctgttgctcaggctgragtgcagtggctcaatctcagctcactgcaacctccacatcctgggttcaagcaattctcctgcctcagcctcccgtgcagctgagattacaggcgtgcg

SEQ ID NO: 60859 - DNA, 201 bp, Homo sapiens
gaggtgtccttcctaggggagatggtacctgagggtaggtgagagttagccagaaaagagcattccagacacaaggaactgcttgagcaaggctgttgggkgaaacagaggtaacttgactttgtacagtgttaaatgctgtttttccaacctcaagttcatagtaggtgctcagttatcactgattgaagaaatgaatga

SEQ ID NO: 60860 - DNA, 201 bp, Homo sapiens
agaaatagaactaccggggcgcagtggctcacgcctgtaatcccagcactttgggaggctgaggtaggtggatcacctgagagtttcaaacaagtcggacsaacatggtgaaaccccatctctactttaaaaatacaaaagccaggcatggtggcgcatgactgtaattccagctacttgggaggctgaggcaggaaaact

SEQ ID NO: 60861 - DNA, 201 bp, Homo sapiens
aagcacttagcatccagtcctaacccaagtttatctcacctcccccttccacttgagtccaatttcctctttgtattggtcagcttttgctgtgacaatgytatgtaacaaacaacccccagatcccagcagcttacaacagcaggtgtttcttccttatggatctgtgatttaactactacagctttgccttggatgatt

SEQ ID NO: 60862 - DNA, 201 bp, Homo sapiens
agaatcgcttgaacccgggaggcagaggtttcagtgagccaagattgtgccactgcactccagcctgggtgacagagtaagactccgtctcaaaaaaaacmaaaaaaaacctaaggtgttctggatttataaacccctctgaccctgagggtgtccgaagggcttgtggtaggcaataatttccagcactagagaggcagc

SEQ ID NO: 60863 - DNA, 201 bp, Homo sapiens
gagaatcgcttgaacccgggaggcagaggtttcagtgagccaagattgtgccactgcactccagcctgggtgacagagtaagactccgtctcaaaaaaaamaaaaaaaaacctaaggtgttctggatttataaacccctctgaccctgagggtgtccgaagggcttgtggtaggcaataatttccagcactagagaggcag

SEQ ID NO: 60864 - DNA, 201 bp, Homo sapiens
gataaaggataagagatggatggatgaatggatggatgggattgggtggaagaaaggataagaacagcagcatagcactaatgtaacagtaacataacagygttgagtttactgggaggatcaaatgagatcctgcaaagaaatgatttaatagagtgcctggtccattgcaaacactcaatacatgtctgctgctcttat

SEQ ID NO: 60865 - DNA, 201 bp, Homo sapiens
tgggattggagatggatggatggatgcatggatggatggatgggtgggatggggtggataaaggataagagatggatggatgaatggatggatgggattgrgtggaagaaaggataagaacagcagcatagcactaatgtaacagtaacataacagcgttgagtttactgggaggatcaaatgagatcctgcaaagaaatg

SEQ ID NO: 60866 - DNA, 201 bp, Homo sapiens
taaccagcctcatgtttttagggagaagatgcatggggctcctgctgcctcccacctgagaggtggtgtaggtttccagcctgggactggagggtgggttwggctgggctggggctctgccggggaggttctcaggatacatctctacctcctgaaggtggggacctgcacagcatagaccagtatctcctgcagacgggg

SEQ ID NO: 60867 - DNA, 201 bp, Homo sapiens
gtcatgttaaaagaaaaccagtagacacattaaggctgggcacggtggctcacacctgtaatcccagcactttgggaaactgaagcgggtggatcactagytagaggtcaggagttcgagaccagcctggccaacatggtgaacccgtctctactaaaaataaaaaataagtaaatttaaaaaaaaaagccggcgtggtgg

SEQ ID NO: 60868 - DNA, 201 bp, Homo sapiens
tggtggcgcatgcttgtaatcccagcttcttgggaggatgaggcgggaggattgcttgagcccgggaggcagaggttgcagcgagctgagattgcaccacygcactccagcctgggtgacagagagagactccatctcaaaaaacaaacaacaaaacccatggctaccactgtccccgacaattgtcctaggtcttctcta

SEQ ID NO: 60869 - DNA, 201 bp, Homo sapiens
cctgggggcctctccgatgcagaggccggccaggtcaggggtctcctgtaaatggcctcttgtgccctgcagctgccgggaaggattgcatcacgatacamagtgccaccttcgcctggtcccaggaaagccctccctgcctccacaggtacagaacgacacccgtagtaaccagcctcatgtttttagggagaagatgca

SEQ ID NO: 60870 - DNA, 201 bp, Homo sapiens
tcccaggtttaagtgattctcttgccttagcctccaaagtagctgagactacaggtgtgcgccacctcacctagctaatttttgtatttttagtagagatrgggcttagccgtgtcagccaggctggtctcgaacttctggcctcaagtgatccacatgctttggcttcccaaagtgttgggattacaggcatgagccact

SEQ ID NO: 60871 - DNA, 201 bp, Homo sapiens
ctgtcgcagttctgaggcctgaagtctaaaatcaaggtgtcagcagtgttaactctttgtggaggtttttttggtttttttgtttgtttgtttgtttgttttttctgagacggagtcttgctctgtcaaccaggctggagtgcagtagcacgatctcggcttatggctcactgcaacctctgcctcctgggttccagtgtt

SEQ ID NO: 60872 - DNA, 201 bp, Homo sapiens
atggtgcctgggggcctctccgatgcagaggccggccaggtcaggggtctcctgtaaatggcctcttgtgccctgcagctgccgggaaggattgcatcacsatacaaagtgccaccttcgcctggtcccaggaaagccctccctgcctccacaggtacagaacgacacccgtagtaaccagcctcatgtttttagggagaa

SEQ ID NO: 60873 - DNA, 201 bp, Homo sapiens
cactgccctacaggtatccaaataccacttgtgcccctcgaatagttacaactattacatatcaatgaaaactaaaagaaaacaattaaaatttaaaatamaaaagtaggactgaaaagctgccactggatgagggaatagggaaatggatggtggtctcagtggagaaagggaaacaagagttggactcaaagagataga

SEQ ID NO: 60874 - DNA, 201 bp, Homo sapiens
ctgagttcaagcattcctcccacctcagcctcatgagtagttcaagcaatcctcccacctcagcctcatgagtagctagaattacagccatgtaccaccayaactggctaatttttttttgtacttttagtagagatggggtttcaccatgttggccaggctggtcttgaacttctgacctcaagtgatccacccagctcc

SEQ ID NO: 60875 - DNA, 201 bp, Homo sapiens
caccaccatcaaggtcaccactcgggttgcatcgtttcccatgaactagaaagctttgtcctcacgcctcctatgcacagagcttggtagacaggaagctbttgccacacatcttgagacaccgacacccaaaacctgagttctttgctcttcttgctgggtgacctgcggcttcggttttcctaggcccgggtgtccttt

SEQ ID NO: 60876 - DNA, 201 bp, Homo sapiens
cctgtgacctggctctggtatccattagccccatctcccatcatcacctctcagctttactgcagccaccttagtctctgtgatattccctgatcccccayagcacactctggccccagggcctttgcactgctgttccctctgctggaaagctctccccaggagtccccagggctcatccctcacttctatcaccttcac

SEQ ID NO: 60877 - DNA, 201 bp, Homo sapiens
aatgcgctgtgtctttagagagagccttatgtagcttatgactgcggagaggacatgtgttagcaggactgggagtgggatctacggagggaagcacatgyggacatggcgggtgggccacatggaccgtgcaggcaccacagcttgcccaggctgccctatccatgcttgcgtgtctcactgttgccccacgtgtccccc

SEQ ID NO: 60878 - DNA, 201 bp, Homo sapiens
gcagctgcccctctgatgatgcccccgccccatggtgaagcacaagagaccctgaattcttctgcctgactttaaagtgccaagtgaccctgcccacacgstcctctggtcacactgagtgtcctctgagtcatgctattccctgtgcctgggttttagctgcccccgccacccccctaccccccagcccccaccccccac

SEQ ID NO: 60879 - DNA, 201 bp, Homo sapiens
actccagcctgggcgacagaggaagactcagtctcaaaaagtaaaaccttctccaggcagctgcccctctgatgatgcccccgccccatggtgaagcacargagaccctgaattcttctgcctgactttaaagtgccaagtgaccctgcccacacggtcctctggtcacactgagtgtcctctgagtcatgctattccctg

SEQ ID NO: 60880 - DNA, 201 bp, Homo sapiens
ggggaggaaggacagagggaaggagggaaggaaagaattgagggaggaagagaaggaatgagggagagaaggaagaaaggggggagggagggaaggaaatraaagagggaagaaagcaaaggaaagaggaagaaaggagatagggaaggaaggaaagaaaaggcgggaaagagagagggagagatgggggatggagggaag

SEQ ID NO: 60881 - DNA, 201 bp, Homo sapiens
ttcactcagtgcttctcaaagtgtgaccccaggaccagcagtagtatcacctggggactagttagcaaagtacattcttaggccccagcccaggactactkcctcagatactatgtgggtcggcccatgaatctaggttttaattaaccctccaagtaattctgatgtacacaaatgtttaggaaccactggcttacctct

SEQ ID NO: 60882 - DNA, 201 bp, Homo sapiens
ttccctacccctgccatttgcagaggagagggaagacagagtgggagggagagggatggtgtggagctggaaaagaggcgggtaggggcaagaacagaggygggcagagagtacagcaaatacatctggaaggggtcagcctttggagggcaatgtgcagacctttccacacacacctcagaacatgcatacttgtccatc

SEQ ID NO: 60883 - DNA, 201 bp, Homo sapiens
aatgaggcagaaggactcacgggcacggctcaccagctctatcctcaggaactcgaagaccatcaagttccatggctgggagggagcctttctggacagartcctgggcatccgaggccaggagctgggcgccttgcggacctccggcctcctcttctctgtgtcgctggtgtccttccaagtgtctacatttctggtgac

SEQ ID NO: 60884 - DNA, 201 bp, Homo sapiens
cattgctgggacccctgtgtgtacaaagctggtgtgatgaccagtccttgtgcccagagaagcatctccctgcagatgagagtaaccactcaccctgctgycgcttccctttgcaggtggcttgcggccaatgtggagctcctggggaatggcctggtgtttgcagctgccacgtgtgctgtgctgagcaaagcccacctc

SEQ ID NO: 60885 - DNA, 201 bp, Homo sapiens
gagtgagggtcagaggtgctgagaggcagacaggtttgggacgcagtttggtgagatgaatgggatttgctgaagggtggctgtcagggtgcagggaagarttctcaactgtccctgtcttcatctctctttttccctccgatcccaggaggagcaaatgaggcagaaggactcacgggcacggctcaccagctctatcct

SEQ ID NO: 60886 - DNA, 201 bp, Homo sapiens
cctcagcctcccaagttgctggaattacaggcgtgagccactatgcctggctaatttttgttaactattaacagtatgtaatgtcagttcatgacatctaygaaaaaaatatatatatacactcataagcatttgttatggaggaggcattattctaagagctttatatgtttttgttcgttttggtttgttgttgttgct

SEQ ID NO: 60887 - DNA, 201 bp, Homo sapiens
  misc_feature (1)...(201): n = A,T,C or G, or insertion/deletion polymorphism (see Tables 1-2)
gctcctctgactcagtttcccctcctgctccaggctccctggaggctgcccacatgtgcagctcagcccccctggcctcagggcgggcagatcgagttccnggactttgggctaagataccgacctgagctcccgctggctgtgcagggcgtgtccttcaagatccacgcaggagagaaggtgagtggttctctcacaatg

SEQ ID NO: 60888 - DNA, 201 bp, Homo sapiens
agtttgagaccagcctggccaacatggtgaaatcccgtgtctactaaaaatacaaaaattagccgagcatggtgacaggcacctgcagtcccagctactarggaggctgaggcaggagaattgcttgaacctgggaggtggaggttgcagtgagctgagatcgcaccactgcactccagcctgggcaatagagcaagactt

SEQ ID NO: 60889 - DNA, 201 bp, Homo sapiens
tggatgatggatggatggatggcaggatggggtggaaaaaaggataagggatggatggacggacagacagatggatgggatggggtagaaaaaaggatgasagatgatggagaggtgtaaatagaaggatgaggaaagatggaggaactaaaggaagggtggggagaaagatgggagagagatatcaggataagggaaaga

SEQ ID NO: 60890 - DNA, 201 bp, Homo sapiens
ccaggctacagtcgaacttgcgtaggcctcccaaagtgctgggattacaggtgtgagcagccacgccgggcccatctcacccatttttcagtgtatagttwctgtagtgttaggtacattcacactgttacacaacagaactacaactctgtacccatgaaaccctaactctccttgtcccctcccccagcgcccagccac

SEQ ID NO: 60891 - DNA, 201 bp, Homo sapiens
tccctgagaaggaccgtaccacttcagaagcccagacagaggttcctctggatgaccctgacagggcaggatggccagcaggaaaggacagcatccaatayggcagggtaaccaccagcttcacccacccctccccacccactgtgccacctccaggggcccaagtcctcccaccaaatgtagcacttggcagtgatactc

SEQ ID NO: 60892 - DNA, 201 bp, Homo sapiens
ctgagggttaggcacatacaccccaccattgggagagatactgactttgtcttcatttcctctaaatgacaggtccatcaagtcagtccctgagaaggacbgtaccacttcagaagcccagacagaggttcctctggatgaccctgacagggcaggatggccagcaggaaaggacagcatccaatacggcagggtaaccac

SEQ ID NO: 60893 - DNA, 201 bp, Homo sapiens
aaaccattatggatagagaacctgctgaagtccccccatggtgccctgctgagggataatttaccaaaattggtccagttagccaagatgattaggccccyataaggccagttcatggaatgaacaatatgccttccaattgatggatgtcttcaagtgggccgaggccagcttgctggagttgtctgaatgctgcagtag

SEQ ID NO: 60894 - DNA, 201 bp, Homo sapiens
cctcagtgctggcctcgtgggcttctctgtctctgctgccctccaggtactccccacatccccaaactgggcttgagggacagacagaggcagagactgtyggacccctgctagtgggacctttgaagaccctgtgtccaaaccaccatggtgtgtggagtccctccaccaaggagggacacgcagctctacaagagccag

SEQ ID NO: 60895 - DNA, 201 bp, Homo sapiens
tctgtcgcagttctgaggcctgaagtctaaaatcaaggtgtcagcagtgttaactctttgtggaggtttttttggtttttttgtttgtttgtttgtttgttttttctgagacggagtcttgctctgtcaaccaggctggagtgcagtagcacgatctcggcttatggctcactgcaacctctgcctcctgggttccagtgt

SEQ ID NO: 60896 - DNA, 201 bp, Homo sapiens
tctgaggaggtgacttaggaggaagtgaggttaacagcaggaagaaaaggcctgggagttgaaggttcatccctggtgtgttagaggaacagcaagaagaygggtgtggctggagagggtgggtgaaggcaggggtgctgggagacaaggttggggatgggatggcagggctagagctgctaatggctcatagggaggagc

SEQ ID NO: 60897 - DNA, 201 bp, Homo sapiens
ttctgtcgcagttctgaggcctgaagtctaaaatcaaggtgtcagcagtgttaactctttgtggaggtttttttggtttttttgtttgtttgtttgtttgttttttctgagacggagtcttgctctgtcaaccaggctggagtgcagtagcacgatctcggcttatggctcactgcaacctctgcctcctgggttccagtg

SEQ ID NO: 60898 - DNA, 201 bp, Homo sapiens
tgcaaacactcaatacatgtctgctgctcttattagccctatttcccagattggaaaaccaagactcaagggggtagaatgatctgttcaaggtcacgggmacagcaaaggcagtattggtcttcccactgcacagtcatgtcctttcacaaagacaaagagaaatgtctgctcccactatagaaaaagagattattttat

SEQ ID NO: 60899 - DNA, 201 bp, Homo sapiens
gttctgtcgcagttctgaggcctgaagtctaaaatcaaggtgtcagcagtgttaactctttgtggaggtttttttggtttttttgtttgtttgtttgtttgttttttctgagacggagtcttgctctgtcaaccaggctggagtgcagtagcacgatctcggcttatggctcactgcaacctctgcctcctgggttccagt

SEQ ID NO: 60900 - DNA, 201 bp, Homo sapiens; identical to SEQ ID NO: 11677

SEQ ID NO: 60901 - DNA, 201 bp, Homo sapiens
agcccccgcacccggccctatggatctcattgtgatttccccagttttgcttgcacgtgggtgtgcgcatgtttgcctctgtgcagtcgtatcccctgttyagtctctcgcatccatcacgatggttgacagttgagatactgaacaaccccctcaccacgaggcgctctcgtgttgcccttttgcaaccacacccaccct

SEQ ID NO: 60902 - DNA, 201 bp, Homo sapiens
ttcctgagtagctggaagctgggattacaagtgtgcagcctggttaatttttgtatttttagtagagatggggtttcaccatgttggccaagctggtctcraactcctgacctcaaatgatctgcccgcctcggcctcccagagtgttgggattacaggtgtgagcccccgcacccggccctatggatctcattgtgattt

SEQ ID NO: 60903 - DNA, 201 bp, Homo sapiens
ggcattagagggaatgaatatggtagtgcctgcttggtaccattcatggctgtgagcaccccgggaaaggataaggctgttcatttagcacagtgcctgtracatggtgagcactgggcagatgaccaccgttatctgtgttaatctggtgttttcgtgcatgttattcattattatgcctcccgtgctttagggatcttg

SEQ ID NO: 60904 - DNA, 201 bp, Homo sapiens
tcctgacacccatcaatccatggatctcaattatttatttatttatttatttgtttattttattttgagacagagtcttgctctgttgcccgggctggagkgcagtgctgccgtctcggctcactgcaacccccatctccgaggttcaagcagttctcctacctcagcttcctgagtagctggaagctgggattacaagtg

SEQ ID NO: 60905 - DNA, 201 bp, Homo sapiens
tgttggccaggccaggctggtcttgaacccccgacctcatgtaataagcccgcctcagcctcccaaagtgctaggattataggcatgagccaccgcgcctrgccgccttatttatttatttatttatttatttatttatttatttatatttattgagacagtgtctcactctgtcacccaggctggagtgcagtggcacga

SEQ ID NO: 60906 - DNA, 201 bp, Homo sapiens
gtgtaatggcgcaatctcagctcactgcaacctccacctcctggcttcaaacgattctcttgccttagcctctcgagtagctgggactacaggtgcctgccaccacacgtggctaatttttgtatttttagtagagacggggtttcactacgttggtccaggctggtctcaaactcctgagctcaggtgacacacccgcct

SEQ ID NO: 60907 - DNA, 201 bp, Homo sapiens
agtagagacagggtttcaccatgttggccaggccaggctggtcttgaacccccgacctcatgtaataagcccgcctcagcctcccaaagtgctaggattayaggcatgagccaccgcgcctagccgccttatttatttatttatttatttatttatttatttatttatatttattgagacagtgtctcactctgtcaccca

SEQ ID NO: 60908 - DNA, 201 bp, Homo sapiens
gtagcttagggtgccagagaaaggggtcccatgaggctggcaggcagtgagtgggggcgagataagaagcttggaatttctttctttctttctttctttcytttttttttttttttttttttttgagacagagtttcgctcttgtcgcccagagaagagtgtaatggcgcaatctcagctcactgcaacctccacctcctg

SEQ ID NO: 60909 - DNA, 201 bp, Homo sapiens
agaggaagaagggaggggaaggagagaaaaggagggagggaaggaaagataggaaaggggaggaaggacagagggaaggagggaaggaaagaattgagggmggaagagaaggaatgagggagagaaggaagaaaggggggagggagggaaggaaatgaaagagggaagaaagcaaaggaaagaggaagaaaggagataggg

SEQ ID NO: 60910 - DNA, 201 bp, Homo sapiens
agtagcttagggtgccagagaaaggggtcccatgaggctggcaggcagtgagtgggggcgagataagaagcttggaatttctttctttctttctttctttyttttttttttttttttttttttttgagacagagtttcgctcttgtcgcccagagaagagtgtaatggcgcaatctcagctcactgcaacctccacctcct

SEQ ID NO: 60911 - DNA, 201 bp, Homo sapiens
aggttctcagtaagtgtttgtgaactatggaagaaaggagggagggaagaaggaaaggaggagaggaagaagggaggggaaggagagaaaaggagggaggraaggaaagataggaaaggggaggaaggacagagggaaggagggaaggaaagaattgagggaggaagagaaggaatgagggagagaaggaagaaagggggg

SEQ ID NO: 60912 - DNA, 201 bp, Homo sapiens
atgaaatagagaccactgagaaaccataccatggttggtatggacaggatgctctgagaagtgacatttgagcttccccaaagaatgtgtgaaggaatcartcatacaaagggcaggagaaagagcgctccaggcagagagagcagcaggtgcaatggctccgaggtgggaagtagcttagggtgccagagaaaggggtcc

SEQ ID NO: 60913 - DNA, 201 bp, Homo sapiens
ctcggcatctagttagtgcttggcaggcagaaggttctcagtaagtgtttgtgaactatggaagaaaggagggagggaagaaggaaaggaggagaggaagragggaggggaaggagagaaaaggagggagggaaggaaagataggaaaggggaggaaggacagagggaaggagggaaggaaagaattgagggaggaagaga

SEQ ID NO: 60914 - DNA, 201 bp, Homo sapiens
aggaaatggcacgtccatccctcccctcccagcagcagcctctcctttgcctgccctgggattgtttttgcttttttccccccacagcacttcccacaacmtacagggtcctacaggaagcacccggcagggttgattgccttgttttccttaactggaagctttgcaacagcacaggccactgattgtggccaactcggc

SEQ ID NO: 60915 - DNA, 201 bp, Homo sapiens
actgcactgcagcctggacgacagagtgagactccttctaaaaaaaaaaaaaaaaaaaaaaaaaaattagatgagaccaacaagatatccatagataatgsaccatgttactttgcttgtgtacttttcctgcctcttggtagacagttcctaacatcaccgtgaggtcttggtgaaggaggagtggacactgaggttgct

SEQ ID NO: 60916 - DNA, 201 bp, Homo sapiens
ggagtcttgctctgtcaaccaggctggagtgcagtagcacgatctcggcttatggctcactgcaacctctgcctcctgggttccagtgtttctcctgactmagcctcctgagtagctaggactacaggtgcctgccaccacgcccagctaatttttgtatttttagtagagagtagggtttagtagggtttcaccgtgttg

SEQ ID NO: 60917 - DNA, 201 bp, Homo sapiens
gcaggtgcttagcaattacaacataaggcactcagacagggcttcatgtgcagtacataaatgtcatcattaggaagaaagagagggagagaggaagaacrtgggaaaattcagggcaattgatcaggttgaccccaccgttgctaaaaatcagatgagaccaggcggggcacggtggctcacgcctgtaatcccagcact

SEQ ID NO: 60918 - DNA, 201 bp, Homo sapiens
ccaaagtgctgggattacgggcatgagccactgtgcctggccttgtaaaaactgttaatggcattttgattgtaattgctgaatattccaaaaaaaactckaatgctcatgcatatgattgtttttgctagggctaggggccaggactttttccagtgtcttcaccttgtattccagggccttgcaaacaataggcaggtg

SEQ ID NO: 60919 - DNA, 201 bp, Homo sapiens
ggtttcaccatgttggctgggctggtcctgaactcctgacctcaggtgatctgcccacctcagcctcccaaagtgctgggattacgggcatgagccactgkgcctggccttgtaaaaactgttaatggcattttgattgtaattgctgaatattccaaaaaaaactcgaatgctcatgcatatgattgtttttgctagggc

SEQ ID NO: 60920 - DNA, 201 bp, Homo sapiens
taaaggataagacagtagatgctttttacactggaggccacaccatctctcctgcaaatattcatctctgcccttggagtgcagaagtggctgtagaccayactaagcaaacaggcatggtattcctccaataaaactctatttatggatgctgacatttgaagtgcatatcattttcatatgtcgtgaaatagtatcctt

SEQ ID NO: 60921 - DNA, 201 bp, Homo sapiens
ttctgatcatgtaaaaggatgctgtttcatggaagggcttactgtgcaagacagccatgctggggccccaggggtcagttcccacctgggtcaggggctcmctgggctcacaacctggaatctcaactcctccaccctccacgaagggtgctactccatgccaagggcttattctgtgacaagcctacacacttttttttt

SEQ ID NO: 60922 - DNA, 201 bp, Homo sapiens
cctcccacctcagcctcccgagtagctgggactacatgcacatgccaccatgctggctaatttttgtttttgatagagacagtttcgccgtgttgcccagsctggtctcaaactcctgggctcaggcaattcaggcaatcctccgcctcaacctcccaaagtgttgggatcacaggcatgagccaccaggcccggcctggt

SEQ ID NO: 60923 - DNA, 201 bp, Homo sapiens
ctgggtcaggggctcactgggctcacaacctggaatctcaactcctccaccctccacgaagggtgctactccatgccaagggcttattctgtgacaagccyacacactttttttttttttttttttttttttgagacagagtcttgctctgtcgcccaggctggagtgcagtggcgcgatcttggctcacttgcaagctct

SEQ ID NO: 60924 - DNA, 201 bp, Homo sapiens
ctcgtagccatcttggttttggtgggatttggccgccttctttactgcaacctgttttatcaggaaggtctttgtgacctgtatcttgtgccgacctcctrtctcatcctgtgacttacaataccctaaccgtctgggaatgcagcccagtaggtctcagcctcattttacccagtccctattcaagatggagttgctctg

SEQ ID NO: 60925 - DNA, 201 bp, Homo sapiens
cataaacaggccaggcacggtggatcacgcctggaatcccacccaggtgttgtacacatctgtatttaaggcccacgtgacaccagccttgaatgtcttargaagactgtagatttgattcttgaagcagcagtgagtcattgtaggtttgtttgcaacggcatgactgaagtgaaagctgtgctttcgctgttgggggaa

SEQ ID NO: 60926 - DNA, 201 bp, Homo sapiens
attcaagatggagttgctctggttcacgtgcctctgagagctgggctcctcgggatctcctgacatcctgccccttctatccccagctcctggggccctcygccctcactgccatcgctgtcttcctgagcctcctccctctgaatttcttcatctccaagaaaaggaaccaccatcaggtttggcttttgggaaagggac

SEQ ID NO: 60927 - DNA, 201 bp, Homo sapiens
ctgcccaaggacatgcgcccagcacacgcttccaacccagctgtgagggccagggagccgcatggaaagcaggacttctatggagaaaacctcagcgcagrcacactgggctctcacagctgccgagagcctgggctggtgtccagagagcctctctgtctccctctcccccacagggttctggtcatggacaaggggcag

SEQ ID NO: 60928 - DNA, 201 bp, Homo sapiens
ccagtccctattcaagatggagttgctctggttcacgtgcctctgagagctgggctcctcgggatctcctgacatcctgccccttctatccccagctcctrgggccctccgccctcactgccatcgctgtcttcctgagcctcctccctctgaatttcttcatctccaagaaaaggaaccaccatcaggtttggcttttgg

SEQ ID NO: 60929 - DNA, 201 bp, Homo sapiens
agggccagggagccgcatggaaagcaggacttctatggagaaaacctcagcgcagacacactgggctctcacagctgccgagagcctgggctggtgtccaragagcctctctgtctccctctcccccacagggttctggtcatggacaaggggcaggtggcagagagcggcagcccggcccagctgctggcccagaagggc

SEQ ID NO: 60930 - DNA, 201 bp, Homo sapiens
aaaccaggacagcctggatcacttgtcacagggaagtcacctaccctggagaggcagctgaccctcaccaagaactgcgtgagcaagaaataaagccttgygatcatttccgaagattttacggcgaatttgttactgcagcgcagcctcgcctctctggactaacataaagggattttcaggccaggtgcctgaacccca

SEQ ID NO: 60931 - DNA, 201 bp, Homo sapiens; identical to SEQ ID NO: 11749

SEQ ID NO: 60932 - DNA, 201 bp, Homo sapiens
agctcaagcagtcctcctgtctcagcctctcaaagtgctgggattacaggcatgagccacctcgtctagccaatactgctaattctaatagtcacaacgtyaccagtttttcactgggcaccttcatactctgtggttcctaatgcaagccaatgacatcattcaggcatgagccaccatgcccggctggctgatactacc

SEQ ID NO: 60933 - DNA, 201 bp, Homo sapiens
ggctggaccgcagtgatgtaatcatagctcactgcagcctcgacctcctgggctcaagcaatcctcctacctcagtctctcaagtagctgggactacaggygtgtgccaccatgcccagctaatgtttgtattttcagtagagatgggttttgccatgttgcccaggttggtctggaactcctgggctcaagtgatcctct

SEQ ID NO: 60934 - DNA, 201 bp, Homo sapiens
aaagaaactgaattcttttaaaatttattttattttgattttgagaaagtggctcgctcactcacccaggctggaccgcagtgatgtaatcatagctcackgcagcctcgacctcctgggctcaagcaatcctcctacctcagtctctcaagtagctgggactacaggcgtgtgccaccatgcccagctaatgtttgtatt

SEQ ID NO: 60935 - DNA, 201 bp, Homo sapiens
gtttgagtccaattaggttacagttcactatgtacggggaaaacctttaggccaaacttaaaatatgtaaggaggcagctttgggctaacctcaatttaayagaaggtaggtagacatgtatatgtagatatacaggtatgtagatgaatggataaatggatggatggatagatagataatattcctatttttacagctga

SEQ ID NO: 60936 - DNA, 201 bp, Homo sapiens
gtttcttttcttttcttctttcttttcttctctttctttctttcctttcttgacagagtcttgctctgtcacccaggatggagtgctgtggtccaatctcrcctcactgcaagctccacctcccaggtttaagtgattctcttgccttagcctccaaagtagctgagactacaggtgtgcgccacctcacctagctaattt

SEQ ID NO: 60937 - DNA, 201 bp, Homo sapiens
aaccctctggtcagagcaggcctttcctcccaaccccgggcaggtgggcatcgttggcaggaccggggcagggaagtcctccctggccagtgggctgctgyggctccaggaggcagctgagggtgggatctggatcgacggggtccccattgcccacgtggggctgcacacactgcgctccaggatcagcatcatccccca

SEQ ID NO: 60938 - DNA, 201 bp, Homo sapiens
gatggtgagtcattatatattacaatgcaataataatacaagtaggccgggcgcagtggctcacgcctgtaatcccagcactttgggaggccaaggtgggyggatcacctgagggcaggagttcgagaccagcctggccaccatggtgaaaccccatctctactaaaaatacagaaactagccaggcgtggtagtgggtgc

SEQ ID NO: 60939 - DNA, 201 bp, Homo sapiens
gttccagggcagcacagtggtccgggcattccgaacccaggccccctttgtggctcagaacaatgctcgcgtagatgaaagccagaggatcagtttcccgygactggtggctgacaggtaggaagagccagggcagagaagaccttgcaattcatccatatccttagagggtgagacctgaggtcatattgtatggtagcg

SEQ ID NO: 60940 - DNA, 201 bp, Homo sapiens
aggcgggctgaaccctaaccaaggtcatgtctcccctcttgcgtgtccagaataaacctcacggtgccccagggctgtctgctggctgttgtcggtccagygggggcagggaagtcctccctgctgtccgccctccttggggagctgtcaaaggtggaggggttcgtgagcatcgaggtgaggccacccccagcctgtctg

SEQ ID NO: 60941 - DNA, 201 bp, Homo sapiens
tagctcatgccagctgagacgcttggagtcagccagctactcgtctgtctgctcccacatggctgagacgttccagggcagcacagtggtccgggcattcygaacccaggccccctttgtggctcagaacaatgctcgcgtagatgaaagccagaggatcagtttcccgcgactggtggctgacaggtaggaagagccagg

SEQ ID NO: 60942 - DNA, 201 bp, Homo sapiens
tagcgagggaaggctttgcattcaagccgagatcataaggaaggagtgtctgggagaagagctgttcttttttttttttttttttttttttttttgaaacrgagtcttgctctatcacgcgggctggagtgcaatggcatgatctcggctcactgcaacctccaccttccggattcaagcaattctcctgcctcagcctcc

SEQ ID NO: 60943 - DNA, 201 bp, Homo sapiens
cagtgaaataataataataattagtagtagtagcagtagtatttttgagacagtcttactccgtcatccaggctggagtgcagtggtgcaatcttggttcwctgcaacctccgcctcctgggttcaagcaattctcctgccttagcctctcaagtagctgtgattacaggcgcccaccaccacgcctggctaatttttgta

SEQ ID NO: 60944 - DNA, 201 bp, Homo sapiens
aagcccgcctcagcctcccaaagtgctaggattataggcatgagccaccgcgcctagccgccttatttatttatttatttatttatttatttatttatttatatttattgagacagtgtctcactctgtcacccaggctggagtgcagtggcacgatctcagctcactgcatgctcaaactcctggactcaagtgatgctt

SEQ ID NO: 60945 - DNA, 201 bp, Homo sapiens
catctccaagaaaaggaaccaccatcaggtttggcttttgggaaagggacggaccaggcaggaagtagggaggaagccacaggtcctggtgtgggagatgsggaggggagagctgagtgcgagcccacgggtctggctttgttcttgtcgtctgtgagctgcccatcactcagacctgcaccccctccccctatcctctca

SEQ ID NO: 60946 - DNA, 201 bp, Homo sapiens
gggcttgtcaagagaatgggtccaaataacctgtgcagaaatctcagaaagtcacagcaacttaaaaatcatttattctaccccccacttccacattttcyagatatagaaaccaaagctgagagggggaagataaccatcccaaaatcaccacgttggtgggggagcagggttgccagagaaaacacaggacattcagtg

SEQ ID NO: 60947 - DNA, 201 bp, Homo sapiens
agagggggaagataaccatcccaaaatcaccacgttggtgggggagcagggttgccagagaaaacacaggacattcagtgaagtgtgagtttcagacaaamggaagaatttctcagtgtatgtcccaaatatttcacgagacttagactaaaaccttattcactctttatcttcaaatgtaactgggcattctgtatgatg

SEQ ID NO: 60948 - DNA, 201 bp, Homo sapiens
aatctgacaacccttgcgagggatgaaatgaagattaggaaaataattaaacgcaataagagaaaatgccaaatgagaacaactctattcccattttgcakacaagagaattgcacctaagggagatgacttgccccaaggccacactcaaaactctcagggtcaggatttgaaccaggtcccctgattccataggtctca

SEQ ID NO: 60949 - DNA, 201 bp, Homo sapiens
tatacagaaaggcagctgtgtacctgctggatgaccccctggcggccctggatgcccacgttggccagcatgtcttcaaccaggtcattgggcctggtggrctactccagggaacagtaagtttgggaacatgtgtcagacagtacagggcaaaggcagaggaagcacttagcatccagtcctaacccaagtttatctcac

SEQ ID NO: 60950 - DNA, 201 bp, Homo sapiens
agagaatgtgtgcttcgggcaggagctggacccaccctggctggagagagtactagaagcctgtgccctgcagccagatgtggacagcttccctgagggartccacacttcaattggggagcaggtgagagtttgggggtctttttgggacagggagacattgcagttgggagtcatttgggtccccgactcatcatgggc

SEQ ID NO: 60951 - DNA, 201 bp, Homo sapiens
accccatgtgtggggatgcctgaacacaggcacctcactcctgcactgcttcagggacctgtttctgggcacacccacacatcaccatgtgccgacaaacrcacgtcccagctaattgtcccaatcgttcccagcgtgggccagaaacagctcctgtgtctggcacgtgcccttctccggaagacccagatcctcatcctg

SEQ ID NO: 60952 - DNA, 201 bp, Homo sapiens
catcaccatgtgccgacaaacgcacgtcccagctaattgtcccaatcgttcccagcgtgggccagaaacagctcctgtgtctggcacgtgcccttctccgraagacccagatcctcatcctggacgaggctactgctgccgtggaccctggcacggagctgcagatgcaggccatgctcgggagctggtttgcacagtgca

SEQ ID NO: 60953 - DNA, 201 bp, Homo sapiens
ggatgtaggggtccaaacaagaaatcgctttatttccctcctctgtgacagcttcctgtccagcttagctgctgcccctggcagtaagatgatattccacrgctccagcttggctacctccaacaaccaagtaccacttttccaaaagttctagtgaagtcccaggtctccctgtcattggcctgacttgggttatgtgtt

SEQ ID NO: 60954 - DNA, 201 bp, Homo sapiens
ttcaatgcctttttctctcacatcccatctgtcagcagatttgcttggcatcaccttcaaaatgcatccaaaatgtcacacttcccagcataggctctccraaccccatgatctctaacccaggtcacagcagcaagcccctggctcactccccgcctctgccctcagcctctctccactcccagccagaggagacctatg

SEQ ID NO: 60955 - DNA, 201 bp, Homo sapiens
aataagcccgcctcagcctcccaaagtgctaggattataggcatgagccaccgcgcctagccgccttatttatttatttatttatttatttatttatttatttatatttattgagacagtgtctcactctgtcacccaggctggagtgcagtggcacgatctcagctcactgcatgctcaaactcctggactcaagtgatg

SEQ ID NO: 60956 - DNA, 201 bp, Homo sapiens
taataagcccgcctcagcctcccaaagtgctaggattataggcatgagccaccgcgcctagccgccttatttatttatttatttatttatttatttatttwtttatatttattgagacagtgtctcactctgtcacccaggctggagtgcagtggcacgatctcagctcactgcatgctcaaactcctggactcaagtgat

SEQ ID NO: 60957 - DNA, 201 bp, Homo sapiens
tctacctcgcagattcaagtgattctcctgccccagcctgccaagtagctgggaccacaggcatgcacaaccatgcccagctaatttttttttttttttttgtatttttagtagagatgagatttcaccatgttggccaggcaggtcttgaaccgctgacctcaggtgatctgcccaccttggcctcccaaagtgctgatt

SEQ ID NO: 60958 - DNA, 201 bp, Homo sapiens
ctgccctccaggtactccccacatccccaaactgggcttgagggacagacagaggcagagactgtcggacccctgctagtgggacctttgaagaccctgtrtccaaaccaccatggtgtgtggagtccctccaccaaggagggacacgcagctctacaagagccagactcagctaaggtgaacttgcaaccttgggcaaga

SEQ ID NO: 60959 - DNA, 201 bp, Homo sapiens
atacaagcaatcatgtcagttcccttttttatacaaagcgattttgtttctcttcctttgctatctctagtcctttcagcatggtgaaaacaagaaacggyggcatacctgagccatctccatgttttttattttttatttttatttatttatttatttgagatggagtctcactctgtcacccaggctggagtgcagtgg

SEQ ID NO: 60960 - DNA, 201 bp, Homo sapiens
ttgggaggccgaggcaggcagatcacctgaggtcaggagttcaaaaccagcctggccaacatggcataaccctgcctccacaaaaaatataaaatttagccgggcgtggtggcgggcgcctgtaatcccagctactcgggaggctcaggcaggagaatcgcttgaacccaggaggcggaggttacagtgagccgagaccac

SEQ ID NO: 60961 - DNA, 201 bp, Homo sapiens
tacaggtatgtagatgaatggataaatggatggatggatagatagataatattcctatttttacagctgaggaaactgaggcacagaggttaagtcagccyactcatccacagataaaacattcaaagagtctttagcatctgaattgtgcataatttatattctgccagttggactgacaaatctgatggtatacagtag

SEQ ID NO: 60962 - DNA, 201 bp, Homo sapiens
cccctggcctcagggcgggcagatcgagttccgggactttgggctaagataccgacctgagctcccgctggctgtgcagggcgtgtccttcaagatccacrcaggagagaaggtgagtggttctctcacaatgtcttcttcatggagtttaggccaaaggactccagggacaaggccctaaaccctgggcaccagctacct

SEQ ID NO: 60963 - DNA, 201 bp, Homo sapiens
acccctcccactgggggctctctctgcctccctctccctcatgtgtgctacaggtgaaggccacagtgcacctggcctacctgcgtgccgtgggcaccccyctctgcctctacgcactcttcctcttcctctgccagcaagtggcctccttctgccggggctactggctgagcctgtgggcggacgaccctgcagtaggtg

SEQ ID NO: 60964 - DNA, 201 bp, Homo sapiens
ctgtggcctacgtgccccaggaggcctgggtgcagaacacctctgtggtagagaatgtgtgcttcgggcaggagctggacccaccctggctggagagagtwctagaagcctgtgccctgcagccagatgtggacagcttccctgagggaatccacacttcaattggggagcaggtgagagtttgggggtctttttgggaca

SEQ ID NO: 60965 - DNA, 201 bp, Homo sapiens
ccggtccctgctgatgtacgcctttggactcctggaggtcagcctggtggtggcagtggctaccccactggccactgtggccatcctgccactgtttctcmtctacgctgggtttcaggtacggagaggtcagggaggcttccgggaccggctgaggtcaactcagccagtcccctgtctctggggaagactccatatatg

SEQ ID NO: 60966 - DNA, 201 bp, Homo sapiens
ggtgctgtggcctacgtgccccaggaggcctgggtgcagaacacctctgtggtagagaatgtgtgcttcgggcaggagctggacccaccctggctggagaragtactagaagcctgtgccctgcagccagatgtggacagcttccctgagggaatccacacttcaattggggagcaggtgagagtttgggggtctttttgg

SEQ ID NO: 60967 - DNA, 201 bp, Homo sapiens
ccagcctgtctgctaggatgtccccatcctgaaagtcccacttcctcgctgccttcccaccctccccatcccagccaagttcactttcactcattctctcyacctctcacccaccactgagagcccagctcccactgctcctcaaaacctatcccacctctgtccccatcatcctcctgtgaccaaagtaagttgtgtttt

SEQ ID NO: 60968 - DNA, 201 bp, Homo sapiens
gctgtctgctggctgttgtcggtccagtgggggcagggaagtcctccctgctgtccgccctccttggggagctgtcaaaggtggaggggttcgtgagcatygaggtgaggccacccccagcctgtctgctaggatgtccccatcctgaaagtcccacttcctcgctgccttcccaccctccccatcccagccaagttcact

SEQ ID NO: 60969 - DNA, 201 bp, Homo sapiens
ttctgcctgactttaaagtgccaagtgaccctgcccacacggtcctctggtcacactgagtgtcctctgagtcatgctattccctgtgcctgggttttagstgcccccgccacccccctaccccccagcccccaccccccacccccatctcaagcccctcccctccctcttctccagctccatccccccatcctctgcctg

SEQ ID NO: 60970 - DNA, 201 bp, Homo sapiens
gtccaaataacctgtgcagaaatctcagaaagtcacagcaacttaaaaatcatttattctaccccccacttccacattttccagatatagaaaccaaagcygagagggggaagataaccatcccaaaatcaccacgttggtgggggagcagggttgccagagaaaacacaggacattcagtgaagtgtgagtttcagacaa

SEQ ID NO: 60971 - DNA, 201 bp, Homo sapiens
ggtcagaggtgctgagaggcagacaggtttgggacgcagtttggtgagatgaatgggatttgctgaagggtggctgtcagggtgcagggaagaattctcarctgtccctgtcttcatctctctttttccctccgatcccaggaggagcaaatgaggcagaaggactcacgggcacggctcaccagctctatcctcaggaac

SEQ ID NO: 60972 - DNA, 201 bp, Homo sapiens
cccggcctccccactttacttctctccttctgcccacccgccaggtcctggctctgtccagcggctccagaaaggccagtgcggtgggtgatgtggtcaabctggtgtccgtagacgtgcagcggctgaccgagagcgtcctctacctcaacgggctgtggctgcctctcgtctggatcgtggtctgcttcgtctatctct

SEQ ID NO: 60973 - DNA, 201 bp, Homo sapiens
gactcacgggcacggctcaccagctctatcctcaggaactcgaagaccatcaagttccatggctgggagggagcctttctggacagagtcctgggcatccraggccaggagctgggcgccttgcggacctccggcctcctcttctctgtgtcgctggtgtccttccaagtgtctacatttctggtgacgtcactctagtct

SEQ ID NO: 60974 - DNA, 201 bp, Homo sapiens
actgttgccccacgtgtcccccccaccccccaggtcgcactggtggtgtttgctgtccacactctggtggccgagaatgctatgaatgcagagaaagcctytgtgactctcacagttctcaacatcctcaacaaggcccaggctttcctgcccttctccatccactccctcgtccaggtgaggtgggtgcaagggctggag

SEQ ID NO: 60975 - DNA, 201 bp, Homo sapiens
tcatgtctcccctcttgcgtgtccagaataaacctcacggtgccccagggctgtctgctggctgttgtcggtccagtgggggcagggaagtcctccctgcygtccgccctccttggggagctgtcaaaggtggaggggttcgtgagcatcgaggtgaggccacccccagcctgtctgctaggatgtccccatcctgaaagt

SEQ ID NO: 60976 - DNA, 201 bp, Homo sapiens
ccagtttcaccctgtagatgctgactcaggccactgttccttttgtggccacagggcatgaatctctccggaggccagaagcagcggctgagcctggcccrggctgtatacagaaaggcagctgtgtacctgctggatgaccccctggcggccctggatgcccacgttggccagcatgtcttcaaccaggtcattgggcct

SEQ ID NO: 60977 - DNA, 201 bp, Homo sapiens
agtagcagggcaatttgttcagtgggagagatttcttcctgcagcctctgcccctgggggggcgggggatggtgcctgggggcctctccgatgcagaggcyggccaggtcaggggtctcctgtaaatggcctcttgtgccctgcagctgccgggaaggattgcatcacgatacaaagtgccaccttcgcctggtcccagga

SEQ ID NO: 60978 - DNA, 201 bp, Homo sapiens
agaagccagtgagtagcagggcaatttgttcagtgggagagatttcttcctgcagcctctgcccctgggggggcgggggatggtgcctgggggcctctccratgcagaggccggccaggtcaggggtctcctgtaaatggcctcttgtgccctgcagctgccgggaaggattgcatcacgatacaaagtgccaccttcgcc

SEQ ID NO: 60979 - DNA, 201 bp, Homo sapiens
tggggtttcaccatgttggccaagctggtctcgaactcctgacctcaaatgatctgcccgcctcggcctcccagagtgttgggattacaggtgtgagcccycgcacccggccctatggatctcattgtgatttccccagttttgcttgcacgtgggtgtgcgcatgtttgcctctgtgcagtcgtatcccctgttcagtct

SEQ ID NO: 60980 - DNA, 201 bp, Homo sapiens
tcactgatttgtaggatcgcagaggtgggagatcaccaccatcaaggtcaccactcgggttgcatcgtttcccatgaactagaaagctttgtcctcacgcytcctatgcacagagcttggtagacaggaagctgttgccacacatcttgagacaccgacacccaaaacctgagttctttgctcttcttgctgggtgacctg

SEQ ID NO: 60981 - DNA, 201 bp, Homo sapiens
cttgttccccacctcaaactccagtcccgggagagcaagcctcatctctgttgttcacagctgtattttcagttcccagctcagtgtgagtcacacagtgrgcactcttcaaagacttgctaagtggagaatttctatgtccagtcattcctggatcacttcttcactccctcacgcagtcacaaagggagggctgcatgt

SEQ ID NO: 60982 - DNA, 201 bp, Homo sapiens
ctggaagcggtgagtgctgagtctggcaggaggggtgtgggagggatgggggatgtgggggccaccccggcccataatggcaagccagcatcagcactggrgggagatgggggctgcgggcaatggatgacacgtgcagatcacgccatctgcgtgtcacttggaaactggcaccgtgctgctcttctttctgctagccat

SEQ ID NO: 60983 - DNA, 201 bp, Homo sapiens
gttcctctggaagcggtgagtgctgagtctggcaggaggggtgtgggagggatgggggatgtgggggccaccccggcccataatggcaagccagcatcagyactggagggagatgggggctgcgggcaatggatgacacgtgcagatcacgccatctgcgtgtcacttggaaactggcaccgtgctgctcttctttctgct

SEQ ID NO: 60984 - DNA, 201 bp, Homo sapiens
aggtggaggttgcagtgagctgagatcgcaccactgcactccagcctgggcaatagagcaagactttatctcaaaaataaataaataaataaataaataawgcattgttcatcacactgtattacatttactcaattgcactgtttcctagaccggatgatgggcacactggagcaaggactctttaatttctatacttcc

SEQ ID NO: 60985 - DNA, 201 bp, Homo sapiens
caaaacagcaacatgatataatgtgttagcaatataacagtaacattacagtaacagaacaaggaagaattaattagttgatgaatagggtagaagaaatkgtgagagatggacagatgaatggatggaatgggatggaagaatgagagatggagggatgggattggagatggatggatggatgcatggatggatggatgg

SEQ ID NO: 60986 - DNA, 201 bp, Homo sapiens
gcgactggtggctgacaggtaggaagagccagggcagagaagaccttgcaattcatccatatccttagagggtgagacctgaggtcatattgtatggtagmgaggtcacccagagagtcagggacatagttgaggctagatcccacaggcagtctatcagttctcaccgtgggcagatggaacatgaccgagagattctca

SEQ ID NO: 60987 - DNA, 201 bp, Homo sapiens; identical to SEQ ID NO: 11664

SEQ ID NO: 60988 - DNA, 201 bp, Homo sapiens
cctgtagatgctgactcaggccactgttccttttgtggccacagggcatgaatctctccggaggccagaagcagcggctgagcctggcccgggctgtatamagaaaggcagctgtgtacctgctggatgaccccctggcggccctggatgcccacgttggccagcatgtcttcaaccaggtcattgggcctggtgggctac

SEQ ID NO: 60989 - DNA, 201 bp, Homo sapiens; identical to SEQ ID NO: 11666

SEQ ID NO: 60990 - DNA, 201 bp, Homo sapiens
atgtctgtggcttctcctcttccctctcccatccatccttctcagagcctgtatgtggttagctcatgccagctgagacgcttggagtcagccagctactsgtctgtctgctcccacatggctgagacgttccagggcagcacagtggtccgggcattccgaacccaggccccctttgtggctcagaacaatgctcgcgta

SEQ ID NO: 60991 - DNA, 201 bp, Homo sapiens
agacagatctcgggtacagcagaaagatctccccaataaatgcccacaaaccctctggtcagagcaggcctttcctcccaaccccgggcaggtgggcatckttggcaggaccggggcagggaagtcctccctggccagtgggctgctgcggctccaggaggcagctgagggtgggatctggatcgacggggtccccattgc

SEQ ID NO: 60992 - DNA, 201 bp, Homo sapiens
cgggtacagcagaaagatctccccaataaatgcccacaaaccctctggtcagagcaggcctttcctcccaaccccgggcaggtgggcatcgttggcaggaycggggcagggaagtcctccctggccagtgggctgctgcggctccaggaggcagctgagggtgggatctggatcgacggggtccccattgcccacgtgggg

SEQ ID NO: 60993 - DNA, 201 bp, Homo sapiens
ggtacagcagaaagatctccccaataaatgcccacaaaccctctggtcagagcaggcctttcctcccaaccccgggcaggtgggcatcgttggcaggaccrgggcagggaagtcctccctggccagtgggctgctgcggctccaggaggcagctgagggtgggatctggatcgacggggtccccattgcccacgtggggct

SEQ ID NO: 60994 - DNA, 201 bp, Homo sapiens
accctctggtcagagcaggcctttcctcccaaccccgggcaggtgggcatcgttggcaggaccggggcagggaagtcctccctggccagtgggctgctgcrgctccaggaggcagctgagggtgggatctggatcgacggggtccccattgcccacgtggggctgcacacactgcgctccaggatcagcatcatcccccag

SEQ ID NO: 60995 - DNA, 201 bp, Homo sapiens
ctttcctcccaaccccgggcaggtgggcatcgttggcaggaccggggcagggaagtcctccctggccagtgggctgctgcggctccaggaggcagctgagrgtgggatctggatcgacggggtccccattgcccacgtggggctgcacacactgcgctccaggatcagcatcatcccccaggtgaggctggtggagggggt

SEQ ID NO: 60996 - DNA, 201 bp, Homo sapiens
ttgagcccaggagctcgaggccaacctgggcaacatagtgagaccccaactccacaaaaaatgtaaaaggtaaaaaaaaaaaaagacgtagctcaggcatyaaccacctccaggtagccttcctgatggtgtcatacccaggtgggctcaggctgcctctgttctccgggcatcagaggcttcctccgtggggcacattat

SEQ ID NO: 60997 - DNA, 201 bp, Homo sapiens
ggctccaggaggcagctgagggtgggatctggatcgacggggtccccattgcccacgtggggctgcacacactgcgctccaggatcagcatcatcccccasgtgaggctggtggagggggtgggcaaagatgggaggcatggtgggacccggctctgacccaccgcccctccccgccaggaccccatcctgttccctggct

SEQ ID NO: 60998 - DNA, 201 bp, Homo sapiens
ggtgggcaaagatgggaggcatggtgggacccggctctgacccaccgcccctccccgccaggaccccatcctgttccctggctctctgcggatgaacctcracctgctgcaggagcactcggacgaggctatctgggcagccctggagacggtgcagctcaaagccttggtggccagcctgcccggccagctgcagtacaa

SEQ ID NO: 60999 - DNA, 201 bp, Homo sapiens
cagctcaaagtcctgagagccaaggcccctaccgcccacatcctctagctgttggctaatttatttcatcgtcttttaggtaattctccagaattccatckctttcctctttttcacctcccagttactcctgcactcagttcttcgtctttcctcctccactgtgtagaaactgttcttgctcacaccgccagtgaccga

SEQ ID NO: 61000 - DNA, 201 bp, Homo sapiens
cttgctcacaccgccagtgaccgactttcgctcagccttgtggatattttccagcccttatcttccctgcttctctgttgcatccttgtgacactggaatstttcccttttttcccttgaaaccgcccactcccaggacagcacagtcttcctgattctcatctctctcactctgtttcttctctgcctccttcggttacc

SEQ ID NO: 61001 - DNA, 201 bp, Homo sapiens
attagccaggcgtggtggcgcatgcctgtaaaatcgcagttgctcgggaggctgaggcacaagaatcatttgaacccaggaggcagaggttgcagtgagcygagatcacgccactgcactccagcctgggtgatagagcaagagtctgtctcaaataataattataattattattttatgcgtaatttccattccagcccc

SEQ ID NO: 61002 - DNA, 201 bp, Homo sapiens
gctgggattacaggtgtgagccaccacgcccggctaatttttgtatttttagcaaggacgaggtttcaccatgttggccaggctggtctcgaactcctgasctcaggtgatccgcccgcctcagcctcccaaagtgctgggattacaagcatgagtcaccccgcctgaccacactgtgggatgtttggcagcatccctggc

SEQ ID NO: 61003 - DNA, 201 bp, Homo sapiens; identical to SEQ ID NO: 11758

SEQ ID NO: 61004 - DNA, 201 bp, Homo sapiens
cttgttcgtcgcccagactagagaacagtggcacaatctctgctcactgcaacctccgcctcctgggttcaagcgattctcctgcctcagcctcccgagtrgctgggattatagacaacgcaccaccacactcggctaatttttttttgcatttttggtagagacggggtttcaccatgttgtccaggctggtcttgaact

SEQ ID NO: 61005 - DNA, 201 bp, Homo sapiens
tctcccattgttgtgggcacaaacaacagaagtcattgagattcctttttttttgctttttgagatagctgggtctcactctgttgcccaggttggagtgyagtgatgcaatcacggctcactgcagcttcaacctcccaggctcaaatggtgttcccatctcagcctcctaactgggactacaggcgacgccaccatgcc

SEQ ID NO: 61006 - DNA, 201 bp, Homo sapiens
tgaggcagcagggagttgcccaggccggagtgcagtggtgccttcacagcccactgcagcttcgacctctcaggctcgaatggtcctcccacctcagcctygcgagtagctaggactacaggcaagagccaccatgccctgctagtttttattttttgtagaggccaggtctcactctgtgagccgggctggtgactctct

SEQ ID NO: 61007 - DNA, 201 bp, Homo sapiens
taggggtggtggtggtggtggtggttgagacagggtctctgttgcccaggctggagtgcaatgatgcaattatagctcattgcagcctcgaagtcctgggytggagcgttcttcctggctcagcctccctagtagctgggaccacaggtgtgtaccaccacgcccagcttatttttaaattcttgtatagatgaggtttta

SEQ ID NO: 61008 - DNA, 201 bp, Homo sapiens
tacagtcatagctcactgcagcctctaactcctgggctcaggcagtcctcccagtttagcctcccgagtagctgtgactccaggtggatgtgtgctactgygtctagccttctcagaagtcttaagtcattcactcagtgtctgtgttgtccttcaggagaagtttgaagtgcagcactctgaaggctaccggcagatctc

SEQ ID NO: 61009 - DNA, 201 bp, Homo sapiens
taccacacccggctaatttttgtatttttagtagagatgggatttcaccatgttggccaatctggtctcatactcctgacctgaggtgatctgcctgcctyggtctccgaaagtgctgggattacgggcttgagccaccatacccagccagagatgatgaattcttttatgttcttgatttatttggttttcttaggtggt

SEQ ID NO: 61010 - DNA, 201 bp, Homo sapiens
caggctgaagtggtatgatcatggcttactgcagcctcgacttactggattaatgtgattcttacacctcagcctcccaaagtgctgggattacaggcatragtcactgctcccgggcatattttcatttagtgttctaaatacactgctatgttggaattgttttttcaataataaaagcattagtgtgtcactgtcata

SEQ ID NO: 61011 - DNA, 201 bp, Homo sapiens
aatcccagcactttgggaggctgagggcagcggatcaattgagctctggaggttgaggccgcagtgagccgtgttcccagccactgcactccagcctgggygatgaagcgagaccttgtctcagaaaaaaaaggggcagctttcagattcaggaattctgcaaggtgtgtgactaccatctctctgggccccaagccgtag

SEQ ID NO: 61012 - DNA, 201 bp, Homo sapiens
tttttttcttttttttttttttttttttttttttttgagccagaggtctcactctcgcccaggctgaagtggtatgatcatggcttactgcagcctcgacytactggattaatgtgattcttacacctcagcctcccaaagtgctgggattacaggcatgagtcactgctcccgggcatattttcatttagtgttctaaat

SEQ ID NO: 61013 - DNA, 201 bp, Homo sapiens
aaggtcaaattcagtacttaatgctgataaaataagagaacccttgcaagtcatgttgcctgctttctgccacagagagtactgcaatagaactttctgaygttttcatgttgtttatttatttattttttgagacagagtcttgctcttgtgcccaggctggagtgcagtggtacaatttctgctcactgcaacctctgc

SEQ ID NO: 61014 - DNA, 201 bp, Homo sapiens
tatgggtgcccgccaccacgcccagctaatttttgtatttttttttagtagagacggagtttcaccatattggccaggctggtctcgaactcctgccctcrtgatctgcctgcctcagcctcccagtgtgctgggattacaggcgtgagccactgcacctggctttttcatattctttcacatgctcctcatgtgtcgcct

SEQ ID NO: 61015 - DNA, 201 bp, Homo sapiens
gggacatggatgaaattggaaatcatcattctcagtaaactattgcaagaacaaaaaaccaaacaccgcatattctcactcataggtgggaattgaacaaygagaacacatggacacaggaaggggaacatcacactctggggactgttgtggggtggggggaggggggagggatagcattgggagatatacctaatgcta

SEQ ID NO: 61016 - DNA, 201 bp, Homo sapiens
gtctggaaagcatactttatttatttttgagacagtcttgctctgtcacacaggctggagtgcagtggcgtgatctcagctcactgcactcactgcttgtsccccaggctcaagcgattgtcttgcctcagcctcccaagcagctgggactacaggcgctcaccaccacgcatggctaattttttgtatttttaatagaga

SEQ ID NO: 61017 - DNA, 201 bp, Homo sapiens
gcatattctcactcataggtgggaattgaacaacgagaacacatggacacaggaaggggaacatcacactctggggactgttgtggggtggggggaggggrgagggatagcattgggagatatacctaatgctagatgacgagttagtgggtgcagcacaccagcatggcacatgtatacatatgtaactaacctgcacat

SEQ ID NO: 61018 - DNA, 201 bp, Homo sapiens
agccactgtacctggcctattctcactttctaattcaggccacgttcctttctcttttcttttttttttttttttttttgagatggagtcttgatctgtcrcccaggcttgagtgcagtggcgtgatctcggctcactgcaagctctgcttcccaggttcacgctattctcctgcctcagcctcccgagtagctgggacta

SEQ ID NO: 61019 - DNA, 201 bp, Homo sapiens
ttggactgcagctcctgcacctgcgcctccagcttcttcttcttatgttccacctcctgcttggcctggcccaggacccgcagctccccggccaggtctgygttctctttctccagcgtctgcttattcttgtctaggttcgccttggcctggcgaaggaagcagaggggagggataacagggaggctgtggccgggagaa

SEQ ID NO: 61020 - DNA, 201 bp, Homo sapiens
ggatgggagagaccccggctgggaaagcccacctggctataaaggatgggacttcccgcagtgcagcgatcaggaataaatacttaaagctgcagccactycaaagtaaacactcctagcccagcttcacagagaagcttctggacttgcagccctactagagaactctccatccttctctctctagatgtgacccttaag

SEQ ID NO: 61021 - DNA, 201 bp, Homo sapiens
tgaatttggccaggtacaatggctaacgcctgtaatcccagcactttgagaggccgaggcaggcagatcacctccagtcaggagatcgagaccagcctggscaacatggtgaaaccccgtcactactaaaaatacaaaaattagctgggtgtggtgccgcatgcctgtagtcccagctactcgggagactgaggcaggaga

SEQ ID NO: 61022 - DNA, 201 bp, Homo sapiens
gctgtgatcatatgcctcattcgacccataattaagaaggcttccagtgtgtgtaccaaatgggctgccggttggacttttgttttttggggttttttttktgtgtgtgtatgtgtgtggaagggtcccactgtgtcacccaggctgcagtgcagtggcacaatctcggctcactgcaacctccacgtgtcacgttggagt

SEQ ID NO: 61023 - DNA, 201 bp, Homo sapiens
tggagctggaaaccatcaaggtgaggggctgagaggaagtgtgctcaggtgtagacaggcgtccaacacaggcatggcatgcttggctggaagaaggaacmctgcaatgagggactccagaccccaggcccatgctcatctctggaagggcctgtggggcagacgtgatctttgaactctttgtgcctctagtgggtggtg

SEQ ID NO: 61024 - DNA, 201 bp, Homo sapiens
ctgttgccaggctggagtgcagtggcgtaatcccggctcactgcaacctccacctcctgggttcaagtgattctcctgcctcagcctcctgagtagctgarattacaggcacacaccgccatgcctggctaatttttgtatttttagtagagatggggtttcaccatgttttccaggatggtcttgatctcttgacagtgt

SEQ ID NO: 61025 - DNA, 201 bp, Homo sapiens
tgatatgtgtgaaggaggcccatgttgccgtgtggatgaggcttggagaggtttacgtggcttgctttggctgtggacaccttgggtagaatgatttgtckgaagaatgatggaggctataggaatctcaaccctgttgagagtaggcaagattcaaggtgctcagggggcagaggcactcaggacataattaaaacagtt

SEQ ID NO: 61026 - DNA, 201 bp, Homo sapiens
agacaacataggaagtgtacttagcctggaggccagcacagaataagtatgtaatggatgttattgctgcagctggcaacagggaatcattgagaagtgcrctggactgtttctttggtaattaacaagatctccctctctgtctctctcctctccttttctctccctttcccttcctccatcttctccctcccttctgtc

SEQ ID NO: 61027 - DNA, 201 bp, Homo sapiens
cctctttggcttccaaggcctcttcaagggcccgagccagggacagggccttggtttccttctccctggcttctgcctcagctctgtccctctcatccgcrtatttggaagagatgtttttctcctcggctaacaactacaacacaagacccagaggtgacttctaggcatatccggggtcagcgtcactgaattgtaaat

SEQ ID NO: 61028 - DNA, 201 bp, Homo sapiens
tgggattacaggtgcccaccaccacacctggctaatttttgtattttaagtagagatgtggttttgccatgttgaccaggctggtctcgaactcctgaccstcaagtgagcctcctgcctcggcctcccaaagcacggagattacaggtgtgagccaccacacctggccaaatccttgtgcttcgaaaccactagacctgc

SEQ ID NO: 61029 - DNA, 201 bp, Homo sapiens
caattacagctcactggagccttgacctcctggggcaagtgattctcccacctcagcctcctgagtgtctgggactataggcatgtgccactatacctggstaatttttgtattttttgtagatacagggtttttccatgttgcctaggctggtctcaaagtcctggactcggtctgtccaccttggcctcccaaagtgct

SEQ ID NO: 61030 - DNA, 201 bp, Homo sapiens
aaactctaattaatatgcaatgttgaggtgtggaaggggaaatgtactgacatctgtaatttgctctgaaatgtacccaagagataaggcatgatagatasaattagtctttataaataaatatgtgggccgggcatagtggctcatacctataatcccagcactttgggaggccaaggcaggcagatcatgtgaggccag

SEQ ID NO: 61031 - DNA, 201 bp, Homo sapiens
tttccaggttggacacgagttgccgctggttgtccaaatcaacaaccaggtcgtccagctcctgctgaagcctgttcttggtcttttccagtttatcatamgcggccgccttctcctcgtactgctgggtgaggttctcgatctccttctggaacctcttcttcccctcttccagagcttccacggtgctggcaaagtcct

SEQ ID NO: 61032 - DNA, 201 bp, Homo sapiens
gctacatgaaaggctgaagcaggagaatcgcttgaacccagtggtggaggttgcggggagctgagatcacaccactgcactccagcctgggtgacagagcyagatcctgtctcaaaataagtatctgataaagttcatataatacagtgtcaatgactgaatccaggtggtggccttaaaggtgttcaccgtacaattctg

SEQ ID NO: 61033 - DNA, 201 bp, Homo sapiens
cacaccaaccatgagagtggtgataggaatgaaaaaggccacccgacctccctctgctggcctccccggcagcacgcacctgtctctgcagttgcctcctyttctcctcattctgctcgtcccgggcttggagatccctttcgaactggcccttgagcgcctgcatgttgacttccagccgcagtttggcgtcctccgtgg

SEQ ID NO: 61034 - DNA, 201 bp, Homo sapiens
ttggaattttacagaatgaaatcttagggaagagtggtattaaaagtatagaaactgaattacttggaatactactcaataggtattcagtaaatacattyagtgaataaataagcacctcattccttcttcaggctagaaactaaggcatcaccatgtgtgcaggtgaccctcatggtgctggtacccagaaaagtcaca

SEQ ID NO: 61035 - DNA, 201 bp, Homo sapiens
gagacagccaccaaatcctgaatggttccagaaaaaccccagctgaacccacaccaatggcaggtgcaggcttgcttcctggagcccgctctgctgacttyggtggcctgaggggaactgtgccctccctccacccatgccccaagctcctagtgtcacccacctgcagtttgcgtagctgcttgatggcttcctccctcc

SEQ ID NO: 61036 - DNA, 201 bp, Homo sapiens
atggctccccacagagtggagaggggatgcaggcacaggccagagccacgcgtcatactctgcagagctgattccccaacccagcgtccatggccagagtrggggacaccccacgccctctacctgatcaaatttcctctgcttcttttccaggttggacacgagttgccgctggttgtccaaatcaacaaccaggtcgtc

SEQ ID NO: 61037 - DNA, 201 bp, Homo sapiens; identical to SEQ ID NO: 11757

SEQ ID NO: 61038 - DNA, 201 bp, Homo sapiens
gcatcttccagctctctttgaaagtccttcatctgagcctgcatgagtcaacagggaggacaagctcagatgtccttactcccccaagttctgctgcccarttcagctttgcacacccaccccttggattttctgcagttgaccacaaagaagttcccattgcacgagcatggctctcagttccaggtggctggtggtgcg

SEQ ID NO: 61039 - DNA, 201 bp, Homo sapiens
gttcctccttctcgaggtccgcttgtttgcgagccctctcagcggcggcgaggtcctaggtgggagggaggaaggctgttgtctgccagggaaaggccaakccccaccaagagtccaccctgacaactcagccacccttgaaagtacatgttcttcctctgagctcaggggaggccccgtgaatacatagaggagggaagc

SEQ ID NO: 61040 - DNA, 201 bp, Homo sapiens
tccatgttgccctgctcctcctccagctcctcctccagctgggcgatccgggcctccaggcggcgcttctcgtcctggagtgcgttcctgggggaagggcrgccatggtgggggcctctaccctcccccgccttaaaagatgccccctccttggagtcatgcctcaggggtattgccctcatcatctaatgggtgaaactg

SEQ ID NO: 61041 - DNA, 201 bp, Homo sapiens
gcagcctgggcactggtgtaagggccctggatctctactctcaggccccaccaccctcttgtccctcaatccagggcctgcacacaggaagccgccacgcrtgtgttgactggtgcaggatcctgctgcaggagagacagtaggcagcgtgactgtggtgtccaggcggccctcacctgctgtgtggctttgcggacccgg

SEQ ID NO: 61042 - DNA, 201 bp, Homo sapiens
ctctccttcatcctgtaaaactccactcaagagcttcttccaggccgggcgtggtggcgcacgcctgtaatcccagcacttttggaagcagaggcaggtaratcacttgagctcaggagttcgagacctgcctggccaacatggtgaaaccccgtctctattaaaaatacaaaaattagccgggcagtggtggcacgtgcc

SEQ ID NO: 61043 - DNA, 201 bp, Homo sapiens
caaaaaaccaaacaccgcatattctcactcataggtgggaattgaacaacgagaacacatggacacaggaaggggaacatcacactctggggactgttgtrgggtggggggaggggggagggatagcattgggagatatacctaatgctagatgacgagttagtgggtgcagcacaccagcatggcacatgtatacatatg

SEQ ID NO: 61044 - DNA, 201 bp, Homo sapiens
gtttaatagttatatttagaacgtttgacagtcttctccaagaacaagagtttctcagcaccatcagctgtttgattgctctcatggtccttcttctataygtccctcaaacgaaactactcacttttaactgaggacaggcactttgtataagaataaccttgaaaagtgtgcaggacctaattggaagtaactaaaaat

SEQ ID NO: 61045 - DNA, 201 bp, Homo sapiens
ttatttatttatttattttgacacagagtctcggtctgtcactcaagctggagtgcagtggcgccatctcggctcactgcaagctccacctcctgagttcrcaccattctcctgcctcagcctcctgagtagctgggactacaggcacccgccaccacacccagctaatttttcgtattttagtagagacggggtttcacc

SEQ ID NO: 61046 - DNA, 201 bp, Homo sapiens
acacacggcacaaataagatgcagatattcaagttgaagtcaacaaatcattgccagtcttaaggcatgagtgattgaatttaatcagctgaaattggttkcgggggtgggtggagaaggtttttcaaagcaagacgatctgcttttcaatatgtcaggcttggtcatttgagaagccacaggattctggtctgctgtggt

SEQ ID NO: 61047 - DNA, 201 bp, Homo sapiens
tcggatgaggtagaagcccagttcaccattatagaatcaataaagttctaggtcaccaaagttttatgtatttatgttttgagacaaggtctctctctgtygcccctgctggagtgcagtggcacgatcacttcagcctccccagtagctgggactacagtcatgtgccaccatgactcactaatttgtgtattctttgta

SEQ ID NO: 61048 - DNA, 201 bp, Homo sapiens
gtttgaggacatcctgggcaacatagtgagactcccgtctctagaaacaaatataaaaactagccggctatggtagcttgtgcctgtggtcacaactactygggaggttgaggtaagaaggtgaaagaatcgctgggcgcattggctcacgcctgtaatcccagcactttgggaggctgaggtgggcggatcacctgaggt

SEQ ID NO: 61049 - DNA, 201 bp, Homo sapiens
gctccagcctgggcaacagagtgagacttcatctcaaaaaagaaaaaaaaaggtgaaaggatgacttaaacccagggtgtcgaggttgcagggaaattcakaaatgccactgaagggccaggcatggtgtccaacacctacaatcccagcactttgggaggcagaagcaggtgcatcacctgaagtcgggagttcgagacc

SEQ ID NO: 61050 - DNA, 201 bp, Homo sapiens
aaaggtgaaaggatgacttaaacccagggtgtcgaggttgcagggaaattcagaaatgccactgaagggccaggcatggtgtccaacacctacaatcccarcactttgggaggcagaagcaggtgcatcacctgaagtcgggagttcgagaccagcgtggccaacatggtggaatgctgtctctactaaaaatacaaaaat

SEQ ID NO: 61051 - DNA, 201 bp, Homo sapiens
acagtgtttatgcccttcacaagaaggggttgtgagcagggcagctgggctggtactgggcattttgaacttccactgagaggttaaatatgatctcttcyacctgcttaagtgcatcttatgcctggcacaatgcctcatgcctgtaatctcagtaactcaggaggctgaggcgggaggatctcttgagcccaagagttt

SEQ ID NO: 61052 - DNA, 201 bp, Homo sapiens
tacaggtgcctactaccatgctgggctaatttttgtattttcaatagagatgaggtttcaccatgttggtcaggctggtctcgaactcctgacctcaggcratccacctgccttggcctcccaaagtgctggcattataaacatgagccactgcgcctggctgaggacttgaattcctgaatcctttttctggcacagatt

SEQ ID NO: 61053 - DNA, 201 bp, Homo sapiens
aaaaattttttgtaattaaaaaagaattttttttttttttttaagccaagcatgattgtgcatagtcctagctattcaggaggctgaggtggaaggattgsttgaggctgcagtgagccgtgatctttttccaggcagctcccaaacattttaaaaaatttttcgtaattaaaaaaaattttttgcattaaaaattttttt

SEQ ID NO: 61054 - DNA, 201 bp, Homo sapiens
cagtctgggcaacattggtaaaaccccatctccaccaaaaaaaatagaaaaatgagccaggcatggtagcatgtgcctatagtcccagctactcaggaggstgaggaaggagaatcacttgaaccctggaggcagagattgcagtgagccaaaattgtgcctctgcacagcagcctgggtgacagagcaagactccatatc

SEQ ID NO: 61055 - DNA, 201 bp, Homo sapiens
ctgcaaactgggttcggaactccacacccgcatacctggcctcctgctcgacctgctcctccagctgtgcaatcttggcctccagcgccgcgatggtggayttgaacttggacttgacggccccctccatctcgtggagcttgctccggagctccttgttctgccgctcgagctgctgccgggcactctcattcttctggg

SEQ ID NO: 61056 - DNA, 201 bp, Homo sapiens
tccctgacttcactatgactcctgctgtccatcacccccctgcaaactgggttcggaactccacacccgcatacctggcctcctgctcgacctgctcctcyagctgtgcaatcttggcctccagcgccgcgatggtggacttgaacttggacttgacggccccctccatctcgtggagcttgctccggagctccttgttct

SEQ ID NO: 61057 - DNA, 201 bp, Homo sapiens
agggtcgggtccaatggaggtgttggcctcggttggtgccagagggttcagcatagaaatggaaaaaaaatagaagtgtacagaggtgcacggaggtaggrtgatgaggcagtgggagcttgtgcacgtttcatgatcatttctgcttttgagttaagtaggaagtaaggtccccagctgagagagaatggggaggagcga

SEQ ID NO: 61058 - DNA, 201 bp, Homo sapiens
ttgcaaaggagtgtcctgtctcagcctcacgagtagctgggattacaggcatctgccaccacgcctagctgatttttgtgtttttagtagagatgaagttycaccatgttggccaggctggtctcgaactcctgacctcaggtgatcagcccacctcagcctcccaaagtgctgggattacaggcgtgagccaccgcgctt

SEQ ID NO: 61059 - DNA, 201 bp, Homo sapiens
cctggattcaagtgatccccttgtctcagcctcccgagtagctgggattacaggcatgccccacgtgcttggctaatttttgtatttttagtacagatggkgttgcactatgttggtcaggcttgtctccaactcctgatgtcaatgatcttcctgccttggcctcccaaggtgctgggatttgggattacaggcatgaac

SEQ ID NO: 61060 - DNA, 201 bp, Homo sapiens
gcccacgttgcttagagcacactgaggtcaaagtgagatttaaagctgccagaagctagttattagtttgtttcatggccacaagtagctattaatatctyacaaaagtatcctaagagcctcagtagggaaatggtaagcatgggtggccctgcacacatatctctctgcttggagaagcaactcagagaacattccatg

SEQ ID NO: 61061 - DNA, 201 bp, Homo sapiens
ctggagtgcaggggtgcgatcttggctcactgcaacctctacgtcctggattcaagtgatccccttgtctcagcctcccgagtagctgggattacaggcakgccccacgtgcttggctaatttttgtatttttagtacagatggtgttgcactatgttggtcaggcttgtctccaactcctgatgtcaatgatcttcctgc

SEQ ID NO: 61062 - DNA, 201 bp, Homo sapiens
ccaattctttagtcaaaaggaacaactcggctgggcatggtggctcacacctgtaatctcagcactttgggaggctgaggcgggcggatcatgaggtcagsagatcgagaccatcctggctaacatggtgaaaccgtgtctctactaaaaatacaaaaaattagccgggcgtgctggcgggtgcctgtagtcccagctact

SEQ ID NO: 61063 - DNA, 201 bp, Homo sapiens
cctctctgcgctggttctctcttgagtttatcacctcgacttcacaggaagggctggtcacgtgaggggagactttgggtaggaggaagagagtgggcagragaaggaaaaatcagatctgcctgctgccagccttcaccgttcagaagaaacacttaactcttttcagcaaccgcaacaaataattatgttgggctctgg

SEQ ID NO: 61064 - DNA, 201 bp, Homo sapiens
gttttgaagattaattagatcccagctactcctaaagcctcttgttacccgaccaccccagcctccatcacctcgttggtatacaacccgttttttttttkttttttttgtttttgtttttgagacagagtctcactctcgcccaggttggagtgcagtggtgcgattttggctcactgcaacctccgcttcccgggttca

SEQ ID NO: 61065 - DNA, 201 bp, Homo sapiens
cgcacctcctaaagcatctcagattcatttctttcctgaggattaagtttttaaaccttcctggccaagataacagtgttttaagaggctcttttcttttwttattattattattattattactcttttctttttttgagatggagtcttgctctgtcacccaggctggagtgcagtggcaggatctctgctcactggaac

SEQ ID NO: 61066 - DNA, 201 bp, Homo sapiens
agtagagacaaagttgcacgatgttggccaggctggtctcaaacccctgacctcaagtgatccacctgcctcagcctcccaaagtgctaggattacaggcrtgagccaccgtgcctggcctctcaaactgatttttagaataaccctgagtcacttgtaaactaaatcatatttactaaataataatgtatcttaaaagtt

SEQ ID NO: 61067 - DNA, 201 bp, Homo sapiens
acaaggcaggaggatcgcttgagcccaggaatttgagaccagcctaggcaacatagtaagaccccatctcttaaaaaaaaaattagcttggcgtagtggcstatacctgtagtcccagctagtcaggaggctgaggcaggaggatcagtgccgcctaggagttcaaagatgcagtgagctatgattgtgtcactgcactcc

SEQ ID NO: 61068 - DNA, 201 bp, Homo sapiens
gacagggacctctaaatggcacagtcaacacaaaaatcccacactatgtgtgccactgcactacactctatgtgacaggaaaataaaagcaacctcaggcyttcaaccagataacgaagcattgaagatgagctgacagcccagaggagaggtagctgatgggaagaggagaaactgggatgttatctagaatcctgacac

SEQ ID NO: 61069 - DNA, 201 bp, Homo sapiens
agagaacagtggcacaatctctgctcactgcaacctccgcctcctgggttcaagcgattctcctgcctcagcctcccgagtggctgggattatagacaacrcaccaccacactcggctaatttttttttgcatttttggtagagacggggtttcaccatgttgtccaggctggtcttgaactcctgacctcaggtgatcca

SEQ ID NO: 61070 - DNA, 201 bp, Homo sapiens
ggtgcagtgaagtggctcacacctgtaatcccagcactttgggaggcagaagtgggtggatcacttgaggccaggagttcacaagaccaaactgggcaacrtggtgaaaccctatctatactaaaaatacgaaaattagccgggcatggtcgcggatgcctgtagtcccagctgcttgggtggctgaggcacaagaatcac

SEQ ID NO: 61071 - DNA, 201 bp, Homo sapiens
gtgtgccactacacccactaattttgtatttttagtgagaaacggggtttcaccatgttggccatgctggtcttgaactcccggcctcaagtgatcctccygcctcagcctcccagagtgctggaattacaggcctgagccaccgtgcctggcccctgattggtcttgacaggtgtttttaatgtcccaagtctccgtaaa

SEQ ID NO: 61072 - DNA, 201 bp, Homo sapiens
ggaattacaggcctgagccaccgtgcctggcccctgattggtcttgacaggtgtttttaatgtcccaagtctccgtaaatgtgggatggagcttctctcaraggctcttccccccaactcccaaccaggtggaatcgtcttccagaacaaaatctcccagtgctttgtggtgtactgaaatcatgtctaagaacagagaac

SEQ ID NO: 61073 - DNA, 201 bp, Homo sapiens
gaagtttcaccatgttggccaggctggtctcgaactcctgacctcaggtgatcagcccacctcagcctcccaaagtgctgggattacaggcgtgagccacygcgctttgccccaggagtcttcacagtgagaacagctctcctccactgacccctcaaccctgggagatgcttccaggcccctgctgtactttgggagcct

SEQ ID NO: 61074 - DNA, 201 bp, Homo sapiens
tgagaatgaagcggggaaaatatctaggacccgagggataaaggttcactctgcctggtgctgtcctagacactggagattttttttttgagaccgagttktggtctgtcacccaggctgaagtgcagtggtgcgatctcagctcactgtaacctgtgtctcccaggttcaagcgattctcctgcctcagcctccctagta

SEQ ID NO: 61075 - DNA, 201 bp, Homo sapiens
gtttggtgtgagctgcctattagacatccatgtgggaacgggagggtggtctgaggttctaggaagaagctagggcttctcagagatgaactgaggagtcwttagatatacatggaattctaaagcgccaagattagttgagacctctcacctagcgctggggagagatgaaaacaactaaggccgtgcagtggtccatgc

SEQ ID NO: 61076 - DNA, 201 bp, Homo sapiens
ggaacgggagggtggtctgaggttctaggaagaagctagggcttctcagagatgaactgaggagtcattagatatacatggaattctaaagcgccaagatkagttgagacctctcacctagcgctggggagagatgaaaacaactaaggccgtgcagtggtccatgcctgtaatcccagcacgtggggaggctgaggcggg

SEQ ID NO: 61077 - DNA, 201 bp, Homo sapiens
gttctaggaagaagctagggcttctcagagatgaactgaggagtcattagatatacatggaattctaaagcgccaagattagttgagacctctcacctagygctggggagagatgaaaacaactaaggccgtgcagtggtccatgcctgtaatcccagcacgtggggaggctgaggcgggtggatcacaagatcaggagtt

SEQ ID NO: 61078 - DNA, 201 bp, Homo sapiens
attagttgagacctctcacctagcgctggggagagatgaaaacaactaaggccgtgcagtggtccatgcctgtaatcccagcacgtggggaggctgaggcrggtggatcacaagatcaggagttcaagaccagcctgggcaacatggtgcaaccccgtctctactaaaaatataaaaataggccaaaaatagcttgaactg

SEQ ID NO: 61079 - DNA, 201 bp, Homo sapiens
cagtggtccatgcctgtaatcccagcacgtggggaggctgaggcgggtggatcacaagatcaggagttcaagaccagcctgggcaacatggtgcaaccccrtctctactaaaaatataaaaataggccaaaaatagcttgaactgggaggcagaggttgcagtgagctgagatagtgctactgcactccagcctgggcaac

SEQ ID NO: 61080 - DNA, 201 bp, Homo sapiens
ccagaaggttaagggacttggcccactctgtggcatctaggaagtttggggctgggacttgtgcccaggtgtgtctgacccttcgcacctcctggatccgyggtgctggagggatgctgcggtttgtcctcttggataactctgcttttctcttcgccagcgccacgatcatgtctctcgaagactttgagcagcgcttga

SEQ ID NO: 61081 - DNA, 201 bp, Homo sapiens
gctgtgaatgtctgagactgggtttgttatctctccttaacccacccacctacccaagagttttacttgttttttttttttttttgagtctcgctctgtcrcccaggctggagtgcagtggcgccatctcggctcactgcaagctccgcctcccgggttcaagccattctcctgcctcagcctcctgactagctgggacta

SEQ ID NO: 61082 - DNA, 201 bp, Homo sapiens
ggctcaccgcaacctctgcctcctgtgctcaggtgatcctcccatctcagcctcctgagtagctgggaacacaggcatgtgccaccacagctggctgatatttttctatttttagtagagacggagtttctccatgttacccaggctggtctcaaactcccaggctcaagcgatctgcctaccttggcctgtcaaagtgct

SEQ ID NO: 61083 - DNA, 201 bp, Homo sapiens
ctgcaacttccacctcccaggttcaagtgattctaccgcctcagtctcctgagtagctgggagtatgggtgcccgccaccacgcccagctaatttttgtatttttttttagtagagacggagtttcaccatattggccaggctggtctcgaactcctgccctcatgatctgcctgcctcagcctcccagtgtgctgggatt

SEQ ID NO: 61084 - DNA, 201 bp, Homo sapiens
agcgattcacctgccttggcctcccaaagtgctgggattataggtgtgagtcccgtgcccagccaagcttgagtttcatttgggttgtgctttcaccaaaygattgcagcaatgcaagagggggaaccggatgttgaggatgcgcgacgggggttactagacagctggtttggagctgggtcagaggctgatggcattaat

SEQ ID NO: 61085 - DNA, 201 bp, Homo sapiens
gactccagaccccaggcccatgctcatctctggaagggcctgtggggcagacgtgatctttgaactctttgtgcctctagtgggtggtgctttttgttttkttttttttttttttttgagatggagtttcactcttgttgcccaggctggagggcagtggcgcgatcttggctcactgcaacctccacctcccaggttcaa

SEQ ID NO: 61086 - DNA, 201 bp, Homo sapiens
tcaccatgttggccatgctggtctcgaactcctgacctcaagtgatccacccacctcggcctcccaaagagctgggattacaggtgtgagccactgcaccyggctcagttttttaaatggaaaggaaaatgtctgtcctttagagctacttttaagaacctcctataaatcccatgattgcatactggttcagggaagtaa

SEQ ID NO: 61087 - DNA, 201 bp, Homo sapiens
tggctaaattttttgtatttttagtagaaacggggtttcaccgtgttagctaggatggtcttgatctcctgacctcaggatccgcctgcctcagcctcccaaagtgctgggaatacaggcgtgagccactgtgcccagcctgttttttttttgagatggagtcttgctctgttgcccaggctggagtgcagtggcacaatc

SEQ ID NO: 61088 - DNA, 201 bp, Homo sapiens
agccctttgagaggctgaggagggagaattgcttgagaccaggagttcaaggccagcctgggcaacatagcgagactctgtctctacaaaaaaataaaaayaaaaaattcattggacatggtagtgcacacctgtagtctaagctactcaagaggctgaggcaggagcattgcttgagcccaggaggttgaggctgcagtg

SEQ ID NO: 61089 - DNA, 201 bp, Homo sapiens
gtacaggtgcgtgtcaccgtgctcggctaattttttgtattttttctagagacaggttttgccatgttgccgagtttggtctcaaactctgagcttcaagygatcctcacccttcatcctcccaaagtgctgcgacgacaggtgtgggctaccatgcctggccaagaaggtcatttttatcatttgattctacagctgcta

SEQ ID NO: 61090 - DNA, 201 bp, Homo sapiens
ggctggtgattttgggttttttttttttttgcttgttttttttaagtgtcgtggtctcactctgtggcctgggcgggagtgcagcggcgtgatcatagctyactgcagcctcaacctcctggtctcaggcagtcttcttgcctcaccctcccaagtagctaggactacaggtgcatgccaccacgcctggctgttttcaca

SEQ ID NO: 61091 - DNA, 201 bp, Homo sapiens
ctgtatctcctcacccccattcgccttagaggtgagttttcaagatttgaattggaagaaggtgaaatggacaagggcagccttgagaaggacacagaggrgctccctggttaaaaggcgagacagcaccccctgctggtgtgaatgttcatggactgagttttccccactgcagggactgctgcatctgttttgctgatc

SEQ ID NO: 61092 - DNA, 201 bp, Homo sapiens
ctttatactccacgcattcaataactttggggttgtattgtaggcagtgtgagtggtgtttcccacgtggtgtttcccacagactattagttgttttttgtttttgtttttgttttaagacagtcttgctctgtcgcccaggctggagtgcagtggtgcgatctctgctcactgcaacttccacctcccagattcaagtga

SEQ ID NO: 61093 - DNA, 201 bp, Homo sapiens
cagtgtctgcacaatccattgatagaactggaggatgtgtctgtgtttcctgttgggtttttctcatctcttacatcatacaaacttcaatttttaccttsaatacaggggtagtaggggtggtggtggtggtggtggttgagacagggtctctgttgcccaggctggagtgcaatgatgcaattatagctcattgcagcc

SEQ ID NO: 61094 - DNA, 201 bp, Homo sapiens
ccaaagtgctgggattccaggtgtgagccactgtacccagccaccatctgacgttttgtggaaagtgtttgctgactcattggacaagaccttgtgttttmactcaaaaaatcaaggaaatcctgtatttttcttaagatactggttttgatgagtcaagatgttcttcccagtcatgttcgagggcagggggcagtggcc

SEQ ID NO: 61095 - DNA, 201 bp, Homo sapiens
ggctaggctggcctccaactcctggcctcaagtgattttcccatctcagcctcccaaagtgctgggattccaggtgtgagccactgtacccagccaccatytgacgttttgtggaaagtgtttgctgactcattggacaagaccttgtgttttaactcaaaaaatcaaggaaatcctgtatttttcttaagatactggttt

SEQ ID NO: 61096 - DNA, 201 bp, Homo sapiens
gaaaaaatctttttgaaaatttctattcaagccaggtttttagaaatgtatccgggatgtgtttgtgcgtcattcaaggcatattagcatctggtcacaakatggagtcctttgtttccatgtttcctgtctcccaaatctgtctgatcccatggagttggtggtatacggcatcgtttgtgttgaacagagcctttgcag

SEQ ID NO: 61097 - DNA, 201 bp, Homo sapiens
aatgaagtaaccagggtgaccatcaagtaaaattaaagcacaagatcattgtaggaggcttccttgtcaaagacgtgaacgtgggatttccaacgcaccayggtgtgtccactcatcactgcatgttaggaactgctgtctctttgggacacgagttaaaagaacacactaatttctggagtgtgcctgcagcttcacggc

SEQ ID NO: 61098 - DNA, 201 bp, Homo sapiens
cttgtccaggctggagtgtagtggtgcaatttcggctcaccgcagcctccgcctcctaggttcaagcgattctcttatctcagcttcccaagtagctgggrctacaggagtgtgccactacacccactaattttgtatttttagtgagaaacggggtttcaccatgttggccatgctggtcttgaactcccggcctcaagt

SEQ ID NO: 61099 - DNA, 201 bp, Homo sapiens
cttgccctgtcttgtccaggctggagtgtagtggtgcaatttcggctcaccgcagcctccgcctcctaggttcaagcgattctcttatctcagcttcccargtagctgggactacaggagtgtgccactacacccactaattttgtatttttagtgagaaacggggtttcaccatgttggccatgctggtcttgaactccc

SEQ ID NO: 61100 - DNA, 201 bp, Homo sapiens
acctggctgaattttttgtatttttaatagagacggggttttgccatgttgcccagtgtggtcttgaactcctggcctcaagtgatcctcccatctcggcytcccagaatgctgggatttcaagcatgagccatcgttcccatgccccattgtgttgcactaacccaagcggaggtcctgattggtctttttttttttttt

SEQ ID NO: 61101 - DNA, 201 bp, Homo sapiens
gctggagtgcagtggcatgatcttggctcactgcaacctctgcctcctgagttccagcagtccttgagcctcagtattgagtagctgggactacatgcacrtgcacactgccacgcctggctaatttttgtatttttagcagagatgggattttgccatgtgacccaggctggtcttgaactcctggcctcaaacgatcca

SEQ ID NO: 61102 - DNA, 201 bp, Homo sapiens
ctacttctgtcctagttaagggaaacttattttatggaaccagctcctgtaggcatgtgagttgccctacaggaaaaaaaaagtgtgttggggccaggcgyggtggctcaggcctagaatcccagcactttgggaggcctatgcaggcaggtcacttgaggtcaggagtttgagaccagcctggccaacatggtgaaaccc

SEQ ID NO: 61103 - DNA, 201 bp, Homo sapiens
taaaaataggccaaaaatagcttgaactgggaggcagaggttgcagtgagctgagatagtgctactgcactccagcctgggcaacagagcaagactctgcycaaaagagaactaagttgataccctggggcggtctagtggcaagcaggtttcgaggtgagggatcagcagaggagaggaagagggacaaccccacaggtc

SEQ ID NO: 61104 - DNA, 201 bp, Homo sapiens
cattttgttactaagttattttctggaagaacagcaaaaatttcaggttgaaaacagaactttccaagtgctactgaaattccgcagagaattacgctgcratggtgggtttcttaccctagaaacatcctaacctgtatccacagaagatgtccttttatttttttaaaagatcaataaaatcaagagaaacgaatgttg

SEQ ID NO: 61105 - DNA, 201 bp, Homo sapiens
gcatgctatccctgcagaggctgggaaaagtcatatgtactgctgggaaggcaggttaatgtcaggaggaccatggagatgctaagagcagctcacacttyaggtgcttgccctaggccaggaaccagcagggcactttgctgtgtttacgttcagttctcacaacatacctgcactgtaggcatcacagagcttgcttct

SEQ ID NO: 61106 - DNA, 201 bp, Homo sapiens
agctcacactttaggtgcttgccctaggccaggaaccagcagggcactttgctgtgtttacgttcagttctcacaacatacctgcactgtaggcatcacasagcttgcttcttacaagccagaactgatgctggaagaggttccctgacttcactatgactcctgctgtccatcacccccctgcaaactgggttcggaact

SEQ ID NO: 61107 - DNA, 201 bp, Homo sapiens
atagcttgaactgggaggcagaggttgcagtgagctgagatagtgctactgcactccagcctgggcaacagagcaagactctgctcaaaagagaactaagytgataccctggggcggtctagtggcaagcaggtttcgaggtgagggatcagcagaggagaggaagagggacaaccccacaggtcgggggacaagcaggtg

SEQ ID NO: 61108 - DNA, 201 bp, Homo sapiens
acagtgggtcaagagatgaggtctatttgtcatcctgatcttggtttcaatgaaagctttgcacaaagatatccaagcctccagattttgcaagaatctcrtggaaatgtgcaagggtttaaaaattggggtgggcagaggggcgcattgggcagaaaagaaatggatactgagacaacacacagctgcgaagctgaaggc

SEQ ID NO: 61109 - DNA, 201 bp, Homo sapiens
ctctgctcaaaagagaactaagttgataccctggggcggtctagtggcaagcaggtttcgaggtgagggatcagcagaggagaggaagagggacaaccccmcaggtcgggggacaagcaggtgtggatggtgtcggggaagtccagggaagcaagtgaattaggccagaggcatgatggactgcgtcacgtgctgctgccc

SEQ ID NO: 61110 - DNA, 201 bp, Homo sapiens
agggaagcaagtgaattaggccagaggcatgatggactgcgtcacgtgctgctgccctgtcaggggacctctggccattagtgtcacccatgggaggcttytgggagagtgatgggtgggggcgaggggaaccagcaactcttcacatacagttttttttttttttttttttttgagaccgagtctcactctgtcacccag

SEQ ID NO: 61111 - DNA, 201 bp, Homo sapiens
tttttttgagaccgagtctcactctgtcacccaggctggactgcaacctctctctcccggttttaagccattcttgtgcctcagcctcctgagtagctggractataggcatgcaccaccacacctggctaatttttatattttttggtagagacagggtttcggcattcacatccagttttgtagtaagggtagcaaggt

SEQ ID NO: 61112 - DNA, 201 bp, Homo sapiens
tgcagttgaccacaaagaagttcccattgcacgagcatggctctcagttccaggtggctggtggtgcgctgggagcaccattctgggtgggctccacagamctgcctgagaagctgagcccctgatgtgatctgagggcagtggccaaatacctaataatgctgccctacccagggcaggagacagccaccaaatcctgaa

SEQ ID NO: 61113 - DNA, 201 bp, Homo sapiens
cagtctgctgggttttgctttgttctgggttgttgttgggttttttttgtttgtttgttttggtttttggttttcttgccgtggtgcaaaactgtagaaavttgcttattcactggccttggttccattgaagtctgcgtctcgagtgtccgtttcctcctcagaaccatctgcattttcaataactctacgtcctccaga

SEQ ID NO: 61114 - DNA, 201 bp, Homo sapiens
ctctgggccccggtgctagccagtttgtcacagctgttatgtcagcttaatttggtttgctctgtctgaaggttggggaagcgcctggaatttgggaagcygccttcacacatgtcttcatcgccgctgccgtcagcccagggggtagtcaagatgttgctttaggaaaaccacggaagctgaaggtcttggtgttggtgc

SEQ ID NO: 61115 - DNA, 201 bp, Homo sapiens
actgtgcctggccctttgtatatttttactactaatcttttctcctgcattgaaaataattttttccgtggtaatcttttgtttgttgactttgtctattstatcattttccatacaaatatttccttttttctcttttgaaaaaaaattttttatacatgtatttttcatttttaggtcatcagttacatctttttttaa

SEQ ID NO: 61116 - DNA, 201 bp, Homo sapiens
agaggtggtagggtaagaaatgtgtagaaaactatgcaggggcctgatcacattggatcttgcacatctttttccaaacctcaggaggagtcattctgctkttgttgttactggttcctcacttccgcactttattgtatgctgacaaccttccataccatgggactgagactgccctcaatagtatcaccaatgtctttt

SEQ ID NO: 61117 - DNA, 201 bp, Homo sapiens
gagtgaacaagagggtcgggtccaatggaggtgttggcctcggttggtgccagagggttcagcatagaaatggaaaaaaaatagaagtgtacagaggtgcmcggaggtaggatgatgaggcagtgggagcttgtgcacgtttcatgatcatttctgcttttgagttaagtaggaagtaaggtccccagctgagagagaatg

SEQ ID NO: 61118 - DNA, 201 bp, Homo sapiens
ttttctttaggtggatagcccagttgtgccagcactgttaaacactgcctttttttttttttttttttttttttttttttttgagactgggcctcgctccrttgcccagagtagagtgccatggtgcaattacagctcactggagccttgacctcctggggcaagtgattctcccacctcagcctcctgagtgtctgggac

SEQ ID NO: 61119 - DNA, 201 bp, Homo sapiens
ctcggttggtgccagagggttcagcatagaaatggaaaaaaaatagaagtgtacagaggtgcacggaggtaggatgatgaggcagtgggagcttgtgcacrtttcatgatcatttctgcttttgagttaagtaggaagtaaggtccccagctgagagagaatggggaggagcgatcataagttcaaagaaaaagtgaaaag

SEQ ID NO: 61120 - DNA, 201 bp, Homo sapiens
cagttgtgccagcactgttaaacactgcctttttttttttttttttttttttttttttttttgagactgggcctcgctccattgcccagagtagagtgccrtggtgcaattacagctcactggagccttgacctcctggggcaagtgattctcccacctcagcctcctgagtgtctgggactataggcatgtgccactata

SEQ ID NO: 61121 - DNA, 201 bp, Homo sapiens
agaatcccttgaacttgggaggcagaggttgcagtgagccaagattgcgccactgcactccagcctgggccacagagagaccctgtctccaaaaaaaagargtgcttccacaagtgtcagtgccacccaggctgagcgagtgacttgtcccttgctttctctgtcctggagtcgcctggagaatgatgcctgttcacccta

SEQ ID NO: 61122 - DNA, 201 bp, Homo sapiens
ttaacgcacagacatgactataggttggtgagttacatgctcttccctttgcacacccaggcctggacgactccaccggggggacccccctcacacctgcrgcccggatatcagccctcaacattgtgggagacctactgcggaaagtcggggtaagaccacactttcctggcgtttggtgccttcctgcctgtctttcag

SEQ ID NO: 61123 - DNA, 201 bp, Homo sapiens; identical to SEQ ID NO: 11755

SEQ ID NO: 61124 - DNA, 201 bp, Homo sapiens
cagcctctgcctcctggattcaagcgattctcatgcctcagcctcccgagtagctgggattacaggcaggcacctgttaccatgcccagctaattttgtakttttagtagaaacaagattttgccatgttggccaggctggtcttgaactcctgacctcaactgatcgaactgcctcggcctctgaaagcactgggattac

SEQ ID NO: 61125 - DNA, 201 bp, Homo sapiens
tacttgagaggcttatgcaggaaaattgtttgaatccgggaggcggaggttgcagtgagctgagatcgcaccgctgggtgacaaagtgagacttggtctcaaaaaaaaaaaaaaaaaaatcttgaaagcctagggcaaagaatttggcctttcagcttttatgttaattacagggagggatccttttgtgcttaagtaaaa

SEQ ID NO: 61126 - DNA, 201 bp, Homo sapiens
ctaatttttgtatttttagtagagacttttcaccatgttggccagactggtctcaaacccctgacctcaggtgatccacccacctctgtctcccaaagtgytgggattacaggcatgagccaccgtgcctggccagaaggtttttttaatatttaattgaacagggagatcatcgcctctcctccaggaacgcaactagag

SEQ ID NO: 61127 - DNA, 201 bp, Homo sapiens
aaattcctgacctcaagcaatcctcccatctcgacctctcagagtgctgggattataggcttgagccagtgcaactggcctttttttttttttttcttttytttttttttttttttttttttttgagccagaggtctcactctcgcccaggctgaagtggtatgatcatggcttactgcagcctcgacttactggattaat

SEQ ID NO: 61128 - DNA, 201 bp, Homo sapiens
ttaaaaaattttttgtaattaaaaaagaattttttttttttttttaagccaagcatgattgtgcatagtcctagctattcaggaggctgaggtggaaggabtggttgaggctgcagtgagccgtgatctttttccaggcagctcccaaacattttaaaaaatttttcgtaattaaaaaaaattttttgcattaaaaatttt

SEQ ID NO: 61129 - DNA, 201 bp, Homo sapiens
ctcccaggttcaaactattctcctgcctcagctgcccaagtagctgggattacaggcgcccgccaccatgcccgactaatttttgtatttttagtagagaygaggtttcaccatgttagccaggctgctctcgaactcctgacctcaagtgatccacccatcttggcctccctaagtgctgggattacaggcgtgagctgc

SEQ ID NO: 61130 - DNA, 201 bp, Homo sapiens
gtcctgattggtcttttttttttttttcttttttgagacagagtcatgctcttgccctgtcttgtccaggctggagtgtagtggtgcaatttcggctcacygcagcctccgcctcctaggttcaagcgattctcttatctcagcttcccaagtagctgggactacaggagtgtgccactacacccactaattttgtatttt

SEQ ID NO: 61131 - DNA, 201 bp, Homo sapiens
aaaaaattttttgtaattaaaaaagaattttttttttttttttaagccaagcatgattgtgcatagtcctagctattcaggaggctgaggtggaaggattrgttgaggctgcagtgagccgtgatctttttccaggcagctcccaaacattttaaaaaatttttcgtaattaaaaaaaattttttgcattaaaaatttttt

SEQ ID NO: 61132 - DNA, 201 bp, Homo sapiens
gattggttgagcctgggaggttgaggctgcagtgagctgtgatctcaccagtgcactccagcctgggtgacacagcgtctaaaaaagtaaaaaacaaaacaaaaaaaaaaactgagatgggatcttactttgtggcccaggctggtctcaaactcctgatgtcaagccatcctcctgccttggcctcccagagtgctggga

SEQ ID NO: 61133 - DNA, 201 bp, Homo sapiens
aactgccttctcttttggccgggtgctcatacctgtaatcccagtgctttgggaggccaaggtgggagattacttgagctcaggagtctgacaccagcccrggcaacatggtgaaaccccctgccccgacttggcctctacaagaatgcaaaaattagccaggcctgatggtgtacactggtggtcccagctactcaggag

SEQ ID NO: 61134 - DNA, 201 bp, Homo sapiens
ctttttttttttttggagacagggtctcactctgtcacccaggctagactgcggtggtgtgatctcggctcactgcaacctccgcctcctgggctccagcratccttccacctcagcctaccaagtagctgggactacacatgcaggccaccacacccagctaatttttgtttgcatttttcatagagacagggtctcact

SEQ ID NO: 61135 - DNA, 201 bp, Homo sapiens
ccaccttgacctcccaagtgctgggggttacaagcgttagcaatcatgcctggcctttttttttttttggagacagggtctcactctgtcacccaggctaractgcggtggtgtgatctcggctcactgcaacctccgcctcctgggctccagcgatccttccacctcagcctaccaagtagctgggactacacatgcagg

SEQ ID NO: 61136 - DNA, 201 bp, Homo sapiens
acgcctggctaatttttgtatttttagcagagatgggattttgccatgtgacccaggctggtcttgaactcctggcctcaaacgatccacctgtcttagcytctcaaagtgttgggattacaggtgtgtgccagtgcacctggcctctgaggtggattttagctccagccagtaggacacccctgtctctccttaatgctg

SEQ ID NO: 61137 - DNA, 201 bp, Homo sapiens
ctctgagactgtagtctgcttctcattgagatttctagaggtgagttttcagattaattttccaggcgatcttcccaccttgacctcccaagtgctggggsttacaagcgttagcaatcatgcctggcctttttttttttttggagacagggtctcactctgtcacccaggctagactgcggtggtgtgatctcggctcac

SEQ ID NO: 61138 - DNA, 201 bp, Homo sapiens
cactgcactccagcctgggcgacagagctagactctgtctcaaaaacaaaacaaaacaaaaaacaacaaaaaaacaaaaaaagcacagatgttttttcttwtatttatttttggaaacagggtcttgctctgttacccaggctggagggcagtggtgccaccatagtgcattgcagcctgaaacttctgggagcaagtgat

SEQ ID NO: 61139 - DNA, 201 bp, Homo sapiens
gtctgggtggggccctggcatgtctgtgtggttttctttttctcattaaactcccaatgtacattttgatgagctgcttcatggaagagtcaaaactgtgkgtgcccagggctaggtatgatggacggtgaaaggggaagtgctggttgccttctttgggaagacaaacctaatgccatgaagcagttggggacgtgaagc

SEQ ID NO: 61140 - DNA, 201 bp, Homo sapiens
agcccttttttttctttttaaatctgtagaacctttgagaaactggcactaacttctagcccagactatgttcctgaaaccagccacccgatgggacagtrcagatctgatctctaacagtgtcattaattttcttgcctaaagaaaatcagggccaggctcagtggctcacacttgtaatcccagcactttgggaggctg

SEQ ID NO: 61141 - DNA, 201 bp, Homo sapiens
ccatcttaatgaataagtaaataagtaataaaattcctaaggggaggcttggtgtggtggctcatgcctgtaatcccagcacttttggaggctgaggcggrtggagcacttgaggtcaggagttcaaaaccagcctggccaacatggtgaaaccctgcctctactaaaatagaaaaattaggtgggcatggtggtgaacac

SEQ ID NO: 61142 - DNA, 201 bp, Homo sapiens
ctgagtagctgggattacaggcgtgtgccaccatgcccagctaattttttgtatttttagtcgagacggggtttcactgtgttaggatggtcttgatctcrtgacattgtgatccacccacctcggcctctcaaagtgctgggattacaggcgtgagccactgcaaccagcccttttttttctttttaaatctgtagaacc

SEQ ID NO: 61143 - DNA, 201 bp, Homo sapiens
atcctgagctttcttccatattagtacttacagttcttaacaactgcatcgttttccattcagtcctctgttgacattgaggtttccagttttccacattmgtgaatgatggtgtgcatctttgaacatgggtccttgcctgcctaagtatttttgtaggttgatcattgtaaacttggaaagcacaaagacagaagccag

SEQ ID NO: 61144 - DNA, 201 bp, Homo sapiens
catcttattttctagaagggtttttatcagttcctagatgccatatctggtaagttctttgtgcacagggaaagagcttttccctatgcctagcaaaatayattgctaaagattttaagatttgaaactcgtgttttggtcagggctcatatctgggaggtgtgtgtgtgtgcgtttggtttggcactgtttttatttata

SEQ ID NO: 61145 - DNA, 201 bp, Homo sapiens
tcagggaggggtagggaacctgcaggcatctggcatttagcctcactgtacaatcctcattttatttatttttgagacagggttttcactccatcactcargctggggtgtagtggcgcaatcttggctcactgcaacctccaccccaccctgggttcaagcgattctcctgcctcagcttccagagtagcagggattaca

SEQ ID NO: 61146 - DNA, 201 bp, Homo sapiens
cttcttacaagccagaactgatgctggaagaggttccctgacttcactatgactcctgctgtccatcacccccctgcaaactgggttcggaactccacacscgcatacctggcctcctgctcgacctgctcctccagctgtgcaatcttggcctccagcgccgcgatggtggacttgaacttggacttgacggccccctcc

SEQ ID NO: 61147 - DNA, 201 bp, Homo sapiens
caatcttggcctccagcgccgcgatggtggacttgaacttggacttgacggccccctccatctcgtggagcttgctccggagctccttgttctgccgctcragctgctgccgggcactctcattcttctgggccgtgctgcgctctgtggccagctcgttgctgagctgctcggcctggggaggagagtgaaggccatgag

SEQ ID NO: 61148 - DNA, 201 bp, Homo sapiens
tcttctgggccgtgctgcgctctgtggccagctcgttgctgagctgctcggcctggggaggagagtgaaggccatgaggcggactcagggaagcccaagasagcgcactgagaccatgcctcttcctgccttgtttggcctctgcacgagtcccttgatcccgggcaccctgtcctctccttcatcctgtaaaactccact

SEQ ID NO: 61149 - DNA, 201 bp, Homo sapiens
gcggcacgatctcagctcactgcaacttccacctcccaggttcaagtgattctaccgcctcagtctcctgagtagctgggagtatgggtgcccgccaccasgcccagctaatttttgtatttttttttagtagagacggagtttcaccatattggccaggctggtctcgaactcctgccctcatgatctgcctgcctcagc

SEQ ID NO: 61150 - DNA, 201 bp, Homo sapiens
atccgggcctccaggcggcgcttctcgtcctggagtgcgttcctgggggaagggcggccatggtgggggcctctaccctcccccgccttaaaagatgcccmctccttggagtcatgcctcaggggtattgccctcatcatctaatgggtgaaactgaggcttggagaagattagaagactcatctgtagttacacagccag

SEQ ID NO: 61151 - DNA, 201 bp, Homo sapiens
tagaggagggaagcgtgtgtctttctagacaggtggaccccagaggaggacgaaatgaaatctgggaatgcacagactggagctgccaaggggtgctaccrtgacacccgcatctgaggctctcctagcaaggcgaggctttacctcttgtagctgcatgaggtctgcttccaagctcttggctttcttctcattctcttt

SEQ ID NO: 61152 - DNA, 201 bp, Homo sapiens
cttgcttgagcccaggaattggaggctgcagtgagctatgatcacaccactgcactccagcctgggcaacaaagtgagaccctgtttcagaaataagtagmtttgggaggccaaggcaggtggatcacttgaggtgaggagttcgagaccagcctggccaacatggcgaaactgcatctctactaaaaatggaaaaattag

SEQ ID NO: 61153 - DNA, 201 bp, Homo sapiens
ggcaggcgaaacatggacgagaaaaaccacccagagccacttacgttcttgcccacgtcatccttggagctgaccaggtcttccatttcggctttgagcaytttgttggtccgctcgagttcctctttggcttccaaggcctcttcaagggcccgagccagggacagggccttggtttccttctccctggcttctgcctca

SEQ ID NO: 61154 - DNA, 201 bp, Homo sapiens
tcacccacctgcagtttgcgtagctgcttgatggcttcctccctccccttgatggcagagtcggcctgaagctccaggtctttcaggtccccttccagctkcttctttgctgcagctgccagggcacgttgctttcgctcgtcttccagttccgtctcatactcgtgaagctgggcgaggaatagagatgtgtgctgcccc

SEQ ID NO: 61155 - DNA, 201 bp, Homo sapiens
cagcctgggaggttgaggctgagtgagctgagattccaacactgcactccatcctgggtgacagcacgacgttgtctcagaagagaaaaaaactgccaccytttttttttttttttttttttttggtttgtttcttggggtttaagtgaattttgacactttgggagaccgagatgggtggatcacctgaagtcaggaatt

SEQ ID NO: 61156 - DNA, 201 bp, Homo sapiens
tggattattttattaaattgagatgaggtcttgatattgttgcccaggctggtctggaactcctgagctcaagcagttctcctaccttggcctcccaaagygctggcattacaggcgtgggccaccacacctggccttcaaggtggatttaaaaaagaaatttaagagtctctctcacccaggctggagtgcagtggcatg

SEQ ID NO: 61157 - DNA, 201 bp, Homo sapiens
agcctggaactcctggctcacatgatcctcctgccttagccttccaagaggttgggagtacaggtgtgcactatcctgcctggcttactaacaacaacaamaaaaaaacaccttttttttatagagacgggggtctctctcggctaggctggcctccaactcctggcctcaagtgattttcccatctcagcctcccaaagt

SEQ ID NO: 61158 - DNA, 201 bp, Homo sapiens
tcttttctttttttgagatggagtcttgctctgtcacccaggctggagtgcagtggcaggatctctgctcactggaacctccacctcccgggttcaagagwttcttctgtttcagcctcctgagtagatgggattacaggcatgtgccaccatgcccagctaatttttgtatttttagcagagatggggttttaccatgtt

SEQ ID NO: 61159 - DNA, 201 bp, Homo sapiens
tctcgaactcctggcttcaagtgatctacccgctgtggcctcccaaagtatcaggattacaggcatgagccacagcaccctgccaggcttgggtgttcaargaagagaaagaaggcagtgtggctgggacataagtgaatgagaggtggtagggtaagaaatgtgtagaaaactatgcaggggcctgatcacattggatct

SEQ ID NO: 61160 - DNA, 201 bp, Homo sapiens
acactcagagctctgactcgaagccctgctctgaaccctatgtatgtctctttccttttaccgtttttcctctaggaaatttgggaaattagggtgatatstgtgttttttccttaactcgaaaaattaaggagcacttggaaactgccttctcttttggccgggtgctcatacctgtaatcccagtgctttgggaggcca

SEQ ID NO: 61161 - DNA, 201 bp, Homo sapiens
attaacactctaccccctttttatttttttgagatggggtcttgttctgtcgcccaggctgggaggctggaatgcagtgatcttggctcactgcagcctcygcttctcaggcttaagtgatttttcctgcttcatccttctgagtagctgggactacaggcacgcaccgccgtgcccgtttgatttttgtttttgtttttt

SEQ ID NO: 61162 - DNA, 201 bp, Homo sapiens
aggcatggtggctcacgcccgtaatcccagcacttttggaggccaaggcgggcagatcatttgaggtcaagagttcgagaccagcctggacaacgtgatgraactctgtctctactaaaaatacaaaaattagccgggtgtggtggcacatggctataatcccagctactcaagaggccaaggcaggagaatcgcttgaac

SEQ ID NO: 61163 - DNA, 201 bp, Homo sapiens
ctaacttttgtattttaggtggagacacagtcttgccatgtcgcccaggctggtatcaaattcctggactcaagtgatccgcccacctcggctgatcccawagtgctgggattacaggtgtgagccaccgcgcctggtcaaaaatcctcttgttgaatataaaacctcccaaatttgaaatgtcactgaccaaatacaaaa

SEQ ID NO: 61164 - DNA, 201 bp, Homo sapiens
tattgcatcttggtgtgtcatggacatgtcaagctgtgaatgtctgagactgggtttgttatctctccttaacccacccacctacccaagagttttacttkttttttttttttttttgagtctcgctctgtcacccaggctggagtgcagtggcgccatctcggctcactgcaagctccgcctcccgggttcaagccattc

SEQ ID NO: 61165 - DNA, 201 bp, Homo sapiens
gcaacctcttcatcgtgggctcaagtgattctcccacctcatcctccggagtagctgggactaaaggcacctggctaacttttgtattttaggtggagacrcagtcttgccatgtcgcccaggctggtatcaaattcctggactcaagtgatccgcccacctcggctgatcccaaagtgctgggattacaggtgtgagcca

SEQ ID NO: 61166 - DNA, 201 bp, Homo sapiens
gccaccatgcccagctaattttttgtatttttagtcgagacggggtttcactgtgttaggatggtcttgatctcgtgacattgtgatccacccacctcggsctctcaaagtgctgggattacaggcgtgagccactgcaaccagcccttttttttctttttaaatctgtagaacctttgagaaactggcactaacttctag

SEQ ID NO: 61167 - DNA, 201 bp, Homo sapiens
ctggagtgtagtgacgtgatcttggctcactgcaacctcttcatcgtgggctcaagtgattctcccacctcatcctccggagtagctgggactaaaggcayctggctaacttttgtattttaggtggagacacagtcttgccatgtcgcccaggctggtatcaaattcctggactcaagtgatccgcccacctcggctgat

SEQ ID NO: 61168 - DNA, 201 bp, Homo sapiens
gatttctagaggtgagttttcagattaattttccaggcgatcttcccaccttgacctcccaagtgctgggggttacaagcgttagcaatcatgcctggcctttttttttttttggagacagggtctcactctgtcacccaggctagactgcggtggtgtgatctcggctcactgcaacctccgcctcctgggctccagcga

SEQ ID NO: 61169 - DNA, 201 bp, Homo sapiens
acccaattgcctaaggtagagccccagaagatgtcctcacctcctttttctctctcccctgccccgaaaagtcataattcatcaagttctggtaagtttgscttctaaatatttttggagtccatttctgttccctccatcttcattcctactttctttttttttagacaaggtctcactctcttgcccaggctggagtgc

SEQ ID NO: 61170 - DNA, 201 bp, Homo sapiens
ctcccatctcggcctcccagaatgctgggatttcaagcatgagccatcgttcccatgccccattgtgttgcactaacccaagcggaggtcctgattggtcttttttttttttttcttttttgagacagagtcatgctcttgccctgtcttgtccaggctggagtgtagtggtgcaatttcggctcaccgcagcctccgcct

SEQ ID NO: 61171 - DNA, 201 bp, Homo sapiens
tcaataataaaagcattagtgtgtcactgtcatagctttttaaaaatctgaaaccattttgttagtcaagagaaacatcctgtagagttccaagtctgctrggcaaggtcctgtgggtttccctttatttggggtttctacctggagtgtttcaccccagtaggtcttttttctgactggtatctactgttgaacctctct

SEQ ID NO: 61172 - DNA, 201 bp, Homo sapiens
gctgggtgcagtggtgcgtgcctataattccagctactccagatgttgaggcaggagagttgcttggacccgggaggtggagggtgcagtgagccaagatygcgctactgtactccagcctgggcaacagagtgagactccgtctccaaaaaaaaaaaaaaaggtgtcataaacctctgagactgtagcctgcttcttagc

SEQ ID NO: 61173 - DNA, 201 bp, Homo sapiens
gaggcaggagagttgcttggacccgggaggtggagggtgcagtgagccaagattgcgctactgtactccagcctgggcaacagagtgagactccgtctccaaaaaaaaaaaaaaaggtgtcataaacctctgagactgtagcctgcttcttagcttctcattgagattcctagaggtgcgttcgagttttcagagtaattt

SEQ ID NO: 61174 - DNA, 201 bp, Homo sapiens
ctggctcacatgatcctcctgccttagccttccaagaggttgggagtacaggtgtgcactatcctgcctggcttactaacaacaacaaaaaaaaaacaccttttttttatagagacgggggtctctctcggctaggctggcctccaactcctggcctcaagtgattttcccatctcagcctcccaaagtgctgggattcca

SEQ ID NO: 61175 - DNA, 201 bp, Homo sapiens
atcgagaccagcctggccaacatggtgaaaccccgtcactactaaaaatacaaaaattagctgggtgtggtgccgcatgcctgtagtcccagctactcggragactgaggcaggagaatcgcttgaacctggaaagcagaggttgcagtgagacgagattgcagcactgcattgcagcctgggtgatagagcgagactctg

SEQ ID NO: 61176 - DNA, 201 bp, Homo sapiens
ctcgggagggaggctgaggcaggagaatgacatgaacccaggaggcggagcttgcagtgagccgagatgtggccactgcactccagcctaggcgacagggygagactccgtctcaaaaaaaaaaaaaaaaaaaaatcaaggcccagagattcatgatcactgagaagaggaattcgcaaatgacccttttgttgacagagg

SEQ ID NO: 61177 - DNA, 201 bp, Homo sapiens; identical to SEQ ID NO: 11759

SEQ ID NO: 61178 - DNA, 201 bp, Homo sapiens
actctgtttcaaaaaaaaataaagaaaacgaagtttccacaccaaccatgagagtggtgataggaatgaaaaaggccacccgacctccctctgctggcctmcccggcagcacgcacctgtctctgcagttgcctcctcttctcctcattctgctcgtcccgggcttggagatccctttcgaactggcccttgagcgcctgc

SEQ ID NO: 61179 - DNA, 201 bp, Homo sapiens; identical to SEQ ID NO: 11760

SEQ ID NO: 61180 - DNA, 201 bp, Homo sapiens
aaaaaaataaagaaaacgaagtttccacaccaaccatgagagtggtgataggaatgaaaaaggccacccgacctccctctgctggcctccccggcagcacrcacctgtctctgcagttgcctcctcttctcctcattctgctcgtcccgggcttggagatccctttcgaactggcccttgagcgcctgcatgttgacttcc

SEQ ID NO: 61181 - DNA, 201 bp, Homo sapiens; identical to SEQ ID NO: 11761

SEQ ID NO: 61182 - DNA, 201 bp, Homo sapiens
ctcttccagctgcgtcttcatctcctccatctgggtctccagggcccgcttggacttctccagctcatggacctgccggcagagcgggcagccccattctrtgaggctcaacttcatgaagacgattgagaaacccaccgtgagcggcacctcaggagatcagggaggtggctttggcctcccacaggatgcatggccggg

SEQ ID NO: 61183 - DNA, 201 bp, Homo sapiens; identical to SEQ ID NO: 11763

SEQ ID NO: 61184 - DNA, 201 bp, Homo sapiens
agtcccagctagtcgggaggctgaggcaggagaatgatgtgaactgggaagggcggagcgtgtagtgagccgagattgcgccactgcactccagcctgggygacagagctagactctgtctcaaaaacaaaacaaaacaaaaaacaacaaaaaaacaaaaaaagcacagatgttttttcttttatttatttttggaaacag

SEQ ID NO: 61185 - DNA, 201 bp, Homo sapiens
tggtaagacagaatagtccttgcctataacttgagagataaaagtgtatttctgtccaggcactggagtccaaactcgcttcctgccggaacctcgtgtaygatcagtccccaaaccgaacaggtggcccagcctctgggcggagcagcaagaacagagatggcggggagagacggccaagcagcaccagcgtgcctttgg

SEQ ID NO: 61186 - DNA, 201 bp, Homo sapiens
ccatttattagtgaaagtgtttttaagcacagtcagggtgtaaacagtgcagcattcctgctcccctccgtgggagcagcgtctccttttcaattcatgtractacagaaggcacttggtgaactgtgcgtgtctgaggtgtggaaaccaggagagggggaaagaattctcaaaggcctgacgtgagaagttggaaaggtt

SEQ ID NO: 61187 - DNA, 201 bp, Homo sapiens
cggaagacaggtcttattttaggacatcaaagaagagagcagacttttgctccccacgcaagggttggataagaagccataaggatgaacacaactcagtraccaattctttagtcaaaaggaacaactcggctgggcatggtggctcacacctgtaatctcagcactttgggaggctgaggcgggcggatcatgaggtca

SEQ ID NO: 61188 - DNA, 201 bp, Homo sapiens
ccagatagtggaactgtcatattcattcagtgcagtgtcttcactggacaagggaggacagcactgctgagtgccctaaccacgtaagagtggcttttggyatgaaaggaagaaaaatccaagctacacacacagcctctgccatctcgtcaagatgcagtgataagggcgcacactgttgggtgtcatgtcacatgtgct

SEQ ID NO: 61189 - DNA, 201 bp, Homo sapiens
ctgcaggtgtgcaccaccatgcctggctaatttttatatttttaatagagatggggtttcaccatgttggccaggctggtcttgaactcctgaccccaggygatctgcctgcctcggcctcccaaagtgctgggattataggggtgggtcactgttgctggcccaattaattatttataacgtcgatttgctttctaatgt

SEQ ID NO: 61190 - DNA, 201 bp, Homo sapiens; identical to SEQ ID NO: 11762

SEQ ID NO: 61191 - DNA, 201 bp, Homo sapiens
gcctcccaggttcagcgattcccctgcttcagcctcctgagtagctgggactgcaggtgtgcaccaccatgcctggctaatttttatatttttaatagagrtggggtttcaccatgttggccaggctggtcttgaactcctgaccccaggcgatctgcctgcctcggcctcccaaagtgctgggattataggggtgggtca

SEQ ID NO: 61192 - DNA, 201 bp, Homo sapiens; identical to SEQ ID NO: 11764

SEQ ID NO: 61193 - DNA, 201 bp, Homo sapiens
tagggctttggcttattgctgagtgctgtgtgggcagcatcttatttaatcctcatgacagcctcgtgcaccccatgagctatgatgagtcccattctgcrggtaaagagcccatgccccagaaggttaagggacttggcccactctgtggcatctaggaagtttggggctgggacttgtgcccaggtgtgtctgaccctt

SEQ ID NO: 61194 - DNA, 201 bp, Homo sapiens
atcttatttaatcctcatgacagcctcgtgcaccccatgagctatgatgagtcccattctgcaggtaaagagcccatgccccagaaggttaagggacttgkcccactctgtggcatctaggaagtttggggctgggacttgtgcccaggtgtgtctgacccttcgcacctcctggatccgcggtgctggagggatgctgcg

SEQ ID NO: 61195 - DNA, 201 bp, Homo sapiens
atcaaattggaaaaggaagggttttttttctttttttttttttttcctgagacagagttttgcccttttagcccaggctggagtacaatggtgcggtctcygcacactgcaacctctgcctcctgggttcaagctattctcctgcctcagcctcccgagtagatgggactacaggtgcccacgaccacgcctggctaattt

SEQ ID NO: 61196 - DNA, 201 bp, Homo sapiens
actggggtggctaaggcacaagtattgcttgaacctgggaggtggaggttgcagtgaaccaagatcatgccactgcattccagcctgggtaacagagtgasactccatctcaatcaatcaatcaataactaacattctatgtggtgactgtggtggtggtagttacacaatacacatttgttaaaattaatggagcagtaa

SEQ ID NO: 61197 - DNA, 201 bp, Homo sapiens
tcctaggcgtgatcatagtgcacagccgccttaaactcctgggcttaagcgatcatcctggctcagcctcccaagtagatgggactataggtgtgcttcaycaggccaggcttttttttttttggcggaaacaggggtctcgctatgttgcccaggctggtcttgaactcctggactcaagtgatgcacctctgcctccca

SEQ ID NO: 61198 - DNA, 201 bp, Homo sapiens
tttttttgagatggagtttcgctcttcttgcccaggctgtagtgcaatggcatgatctcggctcaccacaagctccacctcctgggttcaatcgattctcytgcctcagcctcccgagtagctaggattacaggcatgcaccaccatgcccagctaattttgtatttttagtagagacggggtttctccatgttggtcagg

SEQ ID NO: 61199 - DNA, 201 bp, Homo sapiens
gcccactctgtggcatctaggaagtttggggctgggacttgtgcccaggtgtgtctgacccttcgcacctcctggatccgcggtgctggagggatgctgcsgtttgtcctcttggataactctgcttttctcttcgccagcgccacgatcatgtctctcgaagactttgagcagcgcttgaatcaggccatcgaaagaaat

SEQ ID NO: 61200 - DNA, 201 bp, Homo sapiens
tagtgcaatggcatgatctcggctcaccacaagctccacctcctgggttcaatcgattctcttgcctcagcctcccgagtagctaggattacaggcatgcrccaccatgcccagctaattttgtatttttagtagagacggggtttctccatgttggtcaggcagctctcgaactcccaacctcaggtgatccacttgcct

SEQ ID NO: 61201 - DNA, 201 bp, Homo sapiens
gcctcatgcctgtaatctcagtaactcaggaggctgaggcgggaggatctcttgagcccaagagtttgagattgcagtgagctgtgattgtaccactgcasttcggcctgagagacacagcaaaaacctgtgtcttaaaaaatcatgttgttatatgtgtttattaggttattattattttgagatggagtctcactttgt

SEQ ID NO: 61202 - DNA, 201 bp, Homo sapiens
aggcgtccaacacaggcatggcatgcttggctggaagaaggaaccctgcaatgagggactccagaccccaggcccatgctcatctctggaagggcctgtgsggcagacgtgatctttgaactctttgtgcctctagtgggtggtgctttttgttttgttttttttttttttttgagatggagtttcactcttgttgcccag

SEQ ID NO: 61203 - DNA, 201 bp, Homo sapiens
tttctggccaggcatggtggttcatacttgtaatcccagccctttgagaggctgaggagggagaattgcttgagaccaggagttcaaggccagcctgggcracatagcgagactctgtctctacaaaaaaataaaaataaaaaattcattggacatggtagtgcacacctgtagtctaagctactcaagaggctgaggcag

SEQ ID NO: 61204 - DNA, 201 bp, Homo sapiens
gaaaagctgggtaggaggaagattagtggtatgaactgcagtttggagaggataacaggccctccatggatcctgagtaaaatatcaagagaattactcastaattctctgcttcaagactgagctcttgggcctggcgtggtggctgatgcctgtaatgccagcactttgggagaccgaggcgggcggatcatgaggtca

SEQ ID NO: 61205 - DNA, 201 bp, Homo sapiens
gctgcagtgagctatgattgtaccattgcactccatcctgggtgacagagcaaaagttaaaaaataaaaaacctgagtagtggttgtttagaacacacatygttgagtttcccccaatccccatatccgtgacacggagaccttagtgtcatctgcctctccctgtacttggcccacttcacccatttgttaacagctgaa

SEQ ID NO: 61206 - DNA, 201 bp, Homo sapiens
agaactctccatccttctctctctagatgtgacccttaagtctttttcttttttagcactgttttccaagcgcttgactcagaaggatgctcaaattcagygcagaggagcagcagtttgactgttccctgtacgctccccacacagctctcttcgtcacagttttaactccaggttcaaaccctgatgggttggccagtt

SEQ ID NO: 61207 - DNA, 201 bp, Homo sapiens
gagacgggggtttcaccgtgttggccaggctgttctcaaactcctgacctcaagtgatctgcccgccttggcctcccaagtagctggaactacagccgtgyaccactatgccgggctaatttttgtattttggtttcgccatgttgccccaggctggtgattttttttttttttttaagcgttggcctgggctagagtgca

SEQ ID NO: 61208 - DNA, 201 bp, Homo sapiens
atttcctttttactttttttttttttttttttgagacaaagtcttgcttcattgcccaggctggagtgcagtggcaggatcttggctcactgcagcctccrcctcccgggttcaaccgattctcatgcctcagcctcctgagtagctaggattacaggcgcccaccaccatgcctggctaatttttgtgtttttagtagag

SEQ ID NO: 61209 - DNA, 201 bp, Homo sapiens
ctcctgagtagctaggattacaggcgcccaccaccatgcctggctaatttttgtgtttttagtagagacgggatattgccatgttggccaggctggtctcraactcctagcctcaagtgatcctcccgcctcggcctctttaggattacagggctgagccaacgagcttgaccacattttctttatatgtatatttttctt

SEQ ID NO: 61210 - DNA, 201 bp, Homo sapiens
tcctgtccagaaacgtcacagagtggttagggccaaataaaattccgaggggggccaggcgcagtggctcacgcctgtaatcccagcactttgggaggccraggcaggtggatcacttgaggtcaggagttcgagaccagcctggccaaaccaacatggtgaaaccctgtgtctactaaaactacaaaattagctggacgt

SEQ ID NO: 61211 - DNA, 201 bp, Homo sapiens
tacatatattgtacttactaagttcaaatttctgttctaaacgtttttacaaatgctgttaagtcatttagtcctctgcataatgtcgtttgtttgtttgyctgttctttaagacggagtcttgccctgtcgcctaggctagagtgcagtggtgtgatctcggctcactgcaaccgccacctcctggtttcccgtgattct

SEQ ID NO: 61212 - DNA, 201 bp, Homo sapiens
gtcgtttgtttgtttgtctgttctttaagacggagtcttgccctgtcgcctaggctagagtgcagtggtgtgatctcggctcactgcaaccgccacctccyggtttcccgtgattctcctgcctcagcctcctgagtagctgggattacaggtgcgtgccaccacatccggctaattttttgtatctttagtagagacggg

SEQ ID NO: 61213 - DNA, 201 bp, Homo sapiens
ggaagccttggacttgaatgcaaagatcccttgaacttggatctagtttgcctctgctgctcacatgcacatttagagatggccaaggcatacggtgtttytgcttccaagaaacagagtggttgtcctgtttagccatctcttacagtcacacagcttaaagaagataatgtttgcaaacaatttttgaaatgtctagca

SEQ ID NO: 61214 - DNA, 201 bp, Homo sapiens
ggctccatcctctttctcctcttccttcctccccatactcctctcctagatgaccctcgtttcttttctctctctctcctattcctccatcctgccacccscttctctgcgaccccagacccctcgattgcagcgttgcccctgccctcacacccactgtcccgcccctgcaggcctctttccaaaaacccaccctgctcc

SEQ ID NO: 61215 - DNA, 201 bp, Homo sapiens
cacttaagatcaggagttctttttatttttatttttattttttgagacggagtttcgctcttgttgcccaggctggagtgcaatggcatgatctcggctcrctgcaacctccaccttctgagttcaagcgattttcctgcctcagcctcccaagtagctggaactacaggcgctcaccaccatgcccggctaatttttgta

SEQ ID NO: 61216 - DNA, 201 bp, Homo sapiens
gtgctctgggaagactgcagctgtctcctcggggtaacccctccaaacaaagatgttaagatggggctggaacaacctctgcaagcgggtgggaggattasccagtcctgcacagcaagtgcctggccgggaacagggagggcaaccagggagggggcatgcggggctgggctgtgctatgcagactgggcggtggcttcc

SEQ ID NO: 61217 - DNA, 201 bp, Homo sapiens
tgaaggctttacggatattgagtcctgggttggaatcctggctctcccgctgtctggttgggtgaccttgtaaaatggggaatacatcattcgcctcatcytgcaagttgtataagaaataaatggctggtgcaggggcttatgcctgtaatcccagcactttgagaggctgaggtgggcggatcacttgaggtcaggagt

SEQ ID NO: 61218 - DNA, 201 bp, Homo sapiens
tgtgctctgtgagcagccaccacctgttgcagcctcctgccgggacccaccagccaccccacctcctctaggccccccagccctgtcctgccctgccccamggtctatatcgggagggctgggtcacagacctggccacagtgggtctttccacgtggggctgaagtttaggaaatgaggctggggccttctctacctccc

SEQ ID NO: 61219 - DNA, 201 bp, Homo sapiens
ccaccccacctcctctaggccccccagccctgtcctgccctgccccacggtctatatcgggagggctgggtcacagacctggccacagtgggtctttccaygtggggctgaagtttaggaaatgaggctggggccttctctacctccccatgtctttaccctccaatgccagccctgtgggctcctctgtcccagcctcaa

SEQ ID NO: 61220 - DNA, 201 bp, Homo sapiens
tgacactgctgcccgtggccagaactgatgctgccctttacgcctgccgcatcctgactgaggctggtgcccagctctccactcccgtgctcctgagtgtmctctgtgggtgactggcatgggcagcctggggacttggagggtggaggggtggtctggggagaagcaggggccgggctggggtttggggaggaaagagca

SEQ ID NO: 61221 - DNA, 201 bp, Homo sapiens; identical to SEQ ID NO: 11795

SEQ ID NO: 61222 - DNA, 201 bp, Homo sapiens
ggcagtttcgccagccagcagaaggcctccctttgcctccagctagatattttcacctgtaataactgcagcagccactaggaggcaatggcaattcacaragtggcttgcttggtgggagcactttctgaaataacttgttttgtgatcatataattttgttacatagtaaacattctcatacatatgtatatttatatt

SEQ ID NO: 61223 - DNA, 201 bp, Homo sapiens
ctggccaggctccgagcggggttggcggggaggggaggcgggagcgagggcgggcggtgggaggtgggggcgggaaggtccgaaggcggcggcctgaggcygcaccgggcacgggtcggccgcaatccagcctgggcggagccggagttgcgagccgctgcctagaggccgaggagctcacagctatgggctggaggcccc

SEQ ID NO: 61224 - DNA, 201 bp, Homo sapiens
tgtgtgtatatatatatatagtctctataaaaatcctccctcaggccgggcaccatggctcatgcctgtaatcccagcactttgggaggctgaggcgggcrgatcacttgaggtcaggagttcaagaccagcctggccaacactctactaaaaatacaaaaattagctaggtgtggtggtgggcatttgtaatcccagtta

SEQ ID NO: 61225 - DNA, 201 bp, Homo sapiens
ttactttgagccttggttctgtgtatcttttcttacttagcatacctatttcgcaggaagaaattgaaggtttgagttttaggagcttttccccagttgcrtgaccctgctagctgtggtctcaggcatggtctgtgttcttgcttagcattccagctgtccctccatctcactccctgcaacctggggttctcctgcttc

SEQ ID NO: 61226 - DNA, 201 bp, Homo sapiens
tccagggaatgcccttgtctgagggtgacaggcccacctctcgtctccacacagacccgcctctcaccccagtcctgacagccttcctggagacccaggcrggacttgtgggcatccttcactgctctgtggtcagtgagcccctggccacactggtgctgtcacatgggggtcatatcctggcctccacctccggggaca

SEQ ID NO: 61227 - DNA, 201 bp, Homo sapiens
gaggagctgccctttgcctggtccccaggtcctgtgctcttgtggcctggagtctggatgcagggctggcctggcgagagcgctcaagataacatagctgytaacattcccttccaagccctcggtcacccatgctgagtccagatcctagttaggacaatggccccgggatgatctaaatccctcccttttcagtacttt

SEQ ID NO: 61228 - DNA, 201 bp, Homo sapiens
cttgagcctgggaggtggaggttgcagtgagccaagatcaccacaacgcactccagcctgggtgacagactgagactctgtctcaaaaaaaaaaaaaaaaraaaagaaaagaagagaaaaaaccaaaagaaataaagcgtgctgagtgtgtctggcacacgataagccctcatcagtcttggtctcccactccagccttca

SEQ ID NO: 61229 - DNA, 201 bp, Homo sapiens
aggtcaccaaagcccccaacttgctgcgtgtggagattcacaaccctttgctggaagaggagggcttgtacctctgtgaggccagcaatgccctgggcaaygcctccacctcagccaccttcaatggccagggtgagtcaggcagggaatgggtggcctgggggcaggggctggagctctggactgttctgctccgaggag

SEQ ID NO: 61230 - DNA, 201 bp, Homo sapiens
ccatgtggcttttcgactgtgtcccctctacagtcagttattagcactgactgtgctaggaagtgagcaacacacatattcccagaccacatggagctcargagcttggggagagagacagggaagtggacgactacagggccttctgaaacgtgttgcagggagaagtgtcagtcaggggatgctaacctggctttgggt

SEQ ID NO: 61231 - DNA, 201 bp, Homo sapiens
ttggggcagccttcgggatctgcctttgtccagtgtattctgggagcctagccaggcttgtggggccctggagcatccgtgggatgagtgcccatgttctkcctccctgcagacccccctcgacaaccaacattcaccaccaggctggaccttgatgccgctggggccggggctggacggcgaggcctccttttgtgccgt

SEQ ID NO: 61232 - DNA, 201 bp, Homo sapiens
tggcctggcgagagcgctcaagataacatagctgctaacattcccttccaagccctcggtcacccatgctgagtccagatcctagttaggacaatggcccygggatgatctaaatccctcccttttcagtactttatgggttgaaccaacatttgtcaggagctaacacatgcaggcacagtgcctggaactggggttaca

SEQ ID NO: 61233 - DNA, 201 bp, Homo sapiens
gaggctgaggcaggaggatcacttgagcccaggagtttcaggctgcagtgagctatgattgtgcctctgcactccagcttggctgactgagccagatcctstttctaaaaaaataagaataaaacacttgaatacacagagagaggctttggaacaagatttaaggaaatgcagttctttgtgttgttggcctcttgctta

SEQ ID NO: 61234 - DNA, 201 bp, Homo sapiens
cccccgcgccctgttccagggtcgctgtgtccagaaccccaccattcttccatcaggttcacgattgcccttttcaggaccccaaatgggaggaacagggragctgggacaagatagctgccctggccatagcagagctgaccctgacatcccctgtggccagggacacatctgacccccagtgtgcccagcaggctgctt

SEQ ID NO: 61235 - DNA, 201 bp, Homo sapiens
gctctgtgagtgtgaaccccctcctccgccttagtctccccacatctcacacgcccacctcagttcttcctcctcttctgtctgccaagagtgaaggcttyacggatattgagtcctgggttggaatcctggctctcccgctgtctggttgggtgaccttgtaaaatggggaatacatcattcgcctcatcctgcaagttg

SEQ ID NO: 61236 - DNA, 201 bp, Homo sapiens
ccccagccagtctcagcctctgttccagccccggcgtaggcccaggcctggttctcccttgtattcacccaagtggggctggagtagaaagcgtctttccktcccctaaaagccccctccccagggctctctcctcagctggggtttccagggcgagggatctcaggggtggcaaaagcgggtcctgagcactgctgtctc

SEQ ID NO: 61237 - DNA, 201 bp, Homo sapiens
cacagggatcacggcatggccggaacccgacaggtgtccagtggggaactcggtacccagtagctagtggagcactgggcaaggagcattaagagtagggrgcgctggggtgagtcctgtctgggcagaggagcagtgcctcagactgggtggttgggagccataggggtggggagccagggccctcctgagtttgaatgc

SEQ ID NO: 61238 - DNA, 201 bp, Homo sapiens
agcaggtacccctgtccctggtccctgggcccagagggtgagtggagcattaggagcggggctgggctgaaactggctgagcgggataggggcaggggtcgggggggggctccatctgggtgcgagtggtggaccccaaaccaacccaagtccaagacactaatcaaagatggactcaactgaaacccttccaccaccccc

SEQ ID NO: 61239 - DNA, 201 bp, Homo sapiens
gcattcattgttttttaattatgaaactttgggagcaggctctatgctagcagtcagatgtgggaagccaaatagaaaagtagggtcttctggctgggcgyggtggctcactcctgtaatcccagcactttgggaggccgaggtgggtggatcacgaggtcaagagatcgagaccatcctggccaacatggtgaaatccca

SEQ ID NO: 61240 - DNA, 201 bp, Homo sapiens
gtggctcatgcctgtaattccagcactttgggaggccgaggcaggcagatcacctgaggtcaggagcttgagatcagcctggccaacgtggtgaaaccccrtctccactaaaaatacaaaaattagccgggtgtggtggcgcacacctgtggtcccagctactagggaggctgaggcaggataattgcttgaacctgggag

SEQ ID NO: 61241 - DNA, 201 bp, Homo sapiens
ccatttatatgaaattctagaacaggcaaaacttatctatagacagagaacaacagatcagtggctgtctggggttgggagtgggcaagtttggctggaarggcacagggctctttctgtgagtgagggaatgtgtctgcattatagtgatgcttatgtagttatatacacttatcgaaactcatcttactggccacttaa

SEQ ID NO: 61242 - DNA, 201 bp, Homo sapiens
caaggtggcagccagcccatacagcacctttgtctgagctagaaaatggtgctccttcttctgggaagactcagtaggcatcagggcacagcttagcttgrggagcatgagcctagcttgagttccacccaccctggtctggctgcccttgtgcagtgcacagtctgcacagctgcttggggcagccttcgggatctgcct

SEQ ID NO: 61243 - DNA, 201 bp, Homo sapiens
aatatacattatgtgtattcttatgcataatatattcatattctttatttatatacacatacgtgtgtgtgtgtgtgtgtgtgtgtgtgtgtgtgtgtgtrtatatatatatagtctctataaaaatcctccctcaggccgggcaccatggctcatgcctgtaatcccagcactttgggaggctgaggcgggcggatcact

SEQ ID NO: 61244 - DNA, 201 bp, Homo sapiens
ctgagtagctgggattacaggcacccaccatcctgcctggctaatttttgtgtttttgtagagacagggtttcaccatgttggccaggatggtcttgaacycctgacctcacgtgatccacctacctcggcctcccaaagtactgggattacaggtatgagccactacacctggctgatagaagactgttatctaagctat

SEQ ID NO: 61245 - DNA, 201 bp, Homo sapiens
agagtgacgtacccagcccagccaaggacaaaagtgtattcagcaggcactcaggcactttgggatcacccccttctcgcagggcagtgtgggacaaagcrgtgcagaggtcacgggttgtatcagggtatccagggaatgcccttgtctgagggtgacaggcccacctctcgtctccacacagacccgcctctcacccca

SEQ ID NO: 61246 - DNA, 201 bp, Homo sapiens
ggactctggttcctacaacttccgcttcgagatcagtgaggtcaaccgctggtcagatgtgaaaggcaccttggtcacagtaacaggtgataagtggggtrgcctggctgccccccgggagggattcccaagctgcttctggaccccttggctctcagccccagcccttgtcctgaatctaaccccagccagtctcagcct

SEQ ID NO: 61247 - DNA, 201 bp, Homo sapiens
aagtgctaagattacaggcatgagctaccatgcccagccaagccaggtgttggacataagcctgggctctggctctgaatcttcaaccatgctgcagccayctactaccaatagatctgatttggcattaaagggcaaaccctcctgatgcaccacaaagcccagagctacctacagtagtgtggggaaaggagaaccctg

SEQ ID NO: 61248 - DNA, 201 bp, Homo sapiens
gagctaccatgcccagccaagccaggtgttggacataagcctgggctctggctctgaatcttcaaccatgctgcagccatctactaccaatagatctgatytggcattaaagggcaaaccctcctgatgcaccacaaagcccagagctacctacagtagtgtggggaaaggagaaccctggaaggctttctatatagggca

SEQ ID NO: 61249 - DNA, 201 bp, Homo sapiens
taaatggctggtgcaggggcttatgcctgtaatcccagcactttgagaggctgaggtgggcggatcacttgaggtcaggagttcaagactagcctggtcartatggcgaaactccgtctctactaaaaatacaagaattagcacggcatgaaggcacacacctgtaatcccagctattcaggaggctgaggcaggagactc

SEQ ID NO: 61250 - DNA, 201 bp, Homo sapiens
aagtgtgcttgggctggccccgggcccggacttgcccacactgcccggctgccactccgctggcaaagcagagggcatggctccctccccctcggggacarcccagcccccagcccccagcccatagccgtagccccctctgcctggattctcgctctcacaaccagcttccatccgcaggccaccgtgtgacccgctcct

SEQ ID NO: 61251 - DNA, 201 bp, Homo sapiens
gggaatatccggcttaggagtcttcacctgcttctgcatacttccaaggggacatatgtccatcttggattggaggctctcagaggggttagttgtgtccrcttccagtggtctgaggcctcctgagactttttgtacattcaattaaagtgtaacatacagaaaagttcacacattataaatgcaactcaaggacttttc

SEQ ID NO: 61252 - DNA, 201 bp, Homo sapiens
ctgggtgtggtggcacacctgtaatcccagctacttgggaggctgaggcaggagaatcgcttgaacctgggaggcagaggttgcagtgagccaggatcacrccactgcactccagcctgggagacagagtgagactcagtctcaaaaaaaaaaaattgtttgagatggagtctcactatgttgcctaggctggtctggaac

SEQ ID NO: 61253 - DNA, 201 bp, Homo sapiens
caggtggcctgctgtacacagcctcaagaccctcactggtgtcctgtgccctccctctccccagctgtgaatgtgcaggtgtggcccggggctaccgtgcrggaggggcagctggtgaacctgacctgccttgtgtggaccactcacccggcccagctcacctacacatggtaccaggatgggcagcagcgcctggatgcc

SEQ ID NO: 61254 - DNA, 201 bp, Homo sapiens
ctggcctccttggcacaggtgtgcgggtgatcctggctccggaggctgccgtgcctgaaggtgcccccatcacagtgacctgtgcggaccctgctgcccaygcacccacactctatacttggtaccacaacggtcgttggctgcaggagggtccagctgcctcactctcattcctggtggccacgcgggctcatgcaggcg

SEQ ID NO: 61255 - DNA, 201 bp, Homo sapiens
gagccctggatgagggacccccctggctgggtcctgaccactccccaccctgtgtagatgccccacgccacgtcacactcactaccctgatggacacaggycctggacgactgggcctcctcctgtgccgtgtggacagtgaccctccggcccagctgcggctgctccacggggatcgccttgtggcctccaccctacaag

SEQ ID NO: 61256 - DNA, 201 bp, Homo sapiens
ctcacctgctcttggttttcccctgcaggagcctgggtccaggtgtcaccatcacctgagctccaagagggccaggctgtggtcctgagctgccaggtacmcacaggagtcccagaggggacctcatatcgttggtatcgggatggccagcccctccaggagtcgacctcggccacgctccgctttgcagccataactttg

SEQ ID NO: 61257 - DNA, 201 bp, Homo sapiens
tgagtccagatcctagttaggacaatggccccgggatgatctaaatccctcccttttcagtactttatgggttgaaccaacatttgtcaggagctaacacwtgcaggcacagtgcctggaactggggttacaggtcacacaagtccagtgcccataaggcttacgctttggtaggcgagatatgactgacacagtaaaacc

SEQ ID NO: 61258 - DNA, 201 bp, Homo sapiens
tgcccccagccagggtcagggaggggctcagggctttccaggactctgtggaactctacttgggaccactcaggagccagtgggctattcccaagcttgasttctaagccacatttataggtgggccacccaaggctcccaaaggccaaggggctccccagcagtaggagtagctcacccacatggagacaggtggcctgc

SEQ ID NO: 61259 - DNA, 201 bp, Homo sapiens
ctcaggtccaagtccacgagaggggctggagctcccactagagcgggctgtctggtctgagaaagctctgccttgagaagcctaatctggtggagggggcmcagctcccactggagggggcatggttccaccttggaaagccctataccaagtcagactgagaccttcccacaatgtgcagaggcccctcagaggtcccac

SEQ ID NO: 61260 - DNA, 201 bp, Homo sapiens; identical to SEQ ID NO: 11825

SEQ ID NO: 61261 - DNA, 201 bp, Homo sapiens; identical to SEQ ID NO: 11827

SEQ ID NO: 61262 - DNA, 201 bp, Homo sapiens
gactgcacgctcctggctgccagttgggccacatgtgcccagcaggctggcctgggcttcccacattgttgtgttccaacaagtagagcagaagctacaargcctcttgaggtctggctctgaagttgcacaacatcacttctttcttcaattggtcaaactgagtcacagattcaaggagtgaggaaataggttctgcct

SEQ ID NO: 61263 - DNA, 201 bp, Homo sapiens
attccacccaccttgccaagggacaaaaagttcccctctaaatgcaccaggctgtcagggatgaagcgttggctttggggcccccattcacacacatgacyttttctggggcacccaagcatcagcctgtcgtcaccaggtgccaccctggcgatctctgaaggctggagtcggagtgcctccctcagacatcctgttctg

SEQ ID NO: 61264 - DNA, 201 bp, Homo sapiens
cctcgagctgccttctgtacctgacatccacactgaagccagcccctctgtgttcagccttgctttactgaagaggtgtcgctgaggggctgctctggggygctgctctgctttcctgtccccaacttgttctgagctcgagccacctccatactggtgctcctggttctcaggcctttgaactcaaactgaatcacacca

SEQ ID NO: 61265 - DNA, 201 bp, Homo sapiens
tccacggggctatgctggaggatgagggtgtctatatctgtgaggcctccaacaccctgggccaggcctcggcctcagctgacttcgacgctcaaggtcagtgtgtgtgtgtgtgtgtgtgtgtgtgtgtgtgtgtgtgtgtcctttaaaagaggagaggaggtgggacagggttctagaagcctgggggcacgggaatag

SEQ ID NO: 61266 - DNA, 201 bp, Homo sapiens
ttataaacaccaaattttacaagtatgcccagtggataaaactaaacagggaatttcaggagaaagtgcagcaggggaggggaggtctgtggtctccccayttgcccccagccagggtcagggaggggctcagggctttccaggactctgtggaactctacttgggaccactcaggagccagtgggctattcccaagcttg

SEQ ID NO: 61267 - DNA, 201 bp, Homo sapiens
ggtgggacagggagagagcaagtcaaatgcagccagatgtttgggggctgtctggggaagagagggtgtagggaggaccataagcagctgctgaagctgcrgctactggggggatttgggaatatccggcttaggagtcttcacctgcttctgcatacttccaaggggacatatgtccatcttggattggaggctctcaga

SEQ ID NO: 61268 - DNA, 201 bp, Homo sapiens
gcatgccgcatgattccatttatatgaaattctagaacaggcaaaacttatctatagacagagaacaacagatcagtggctgtctggggttgggagtgggsaagtttggctggaagggcacagggctctttctgtgagtgagggaatgtgtctgcattatagtgatgcttatgtagttatatacacttatcgaaactcatc

SEQ ID NO: 61269 - DNA, 201 bp, Homo sapiens
gctggagtgcaatggcatgatctcggctcgctgcaacctccaccttctgagttcaagcgattttcctgcctcagcctcccaagtagctggaactacaggcrctcaccaccatgcccggctaatttttgtatttttagtagagatggggtttcaccatgttggccagactggtcttgaactcctgacctccagtgatctgcc

SEQ ID NO: 61270 - DNA, 201 bp, Homo sapiens
cctgaggtcgggagttcgagaccagcctgaccaacatggagaaaccccatctctactaaaaatacaaaattagccaggcgtggtggcgaatgcctgtaatsccagctactcgggaggctgaggcagaagaatcacttgaatctgggaggcagaggttgcagtgagcccagatcatgccattgcactccagtctgggtaaca

SEQ ID NO: 61271 - DNA, 201 bp, Homo sapiens
agtgtgcttgggctggccccgggcccggacttgcccacactgcccggctgccactccgctggcaaagcagagggcatggctccctccccctcggggacagcccagcccccagcccccagcccatagccgtagccccctctgcctggattctcgctctcacaaccagcttccatccgcaggccaccgtgtgacccgctcctg

SEQ ID NO: 61272 - DNA, 201 bp, Homo sapiens
caacccagcctccaccgtatcttaaccatcacctgcacccaactccaaccttcacccttacccccacccatcactcaacctcaatgtccaccccaatcccmgccttaatttgcttccagaattccaacctgatcatcaccctgacctcagccccagcccagcccaacgataatctctccttactctaaccccagcacaatt

SEQ ID NO: 61273 - DNA, 201 bp, Homo sapiens
tggggcaccttctctggggcaggtcgcagggctctgtggcaccctgaggcctgtatcaccctcccctctgtccccctgccgttcttcccccaggccaggcytcatggggcgtctccagtccccaggacgtgcagggtgtgaaggggtcttgcctgcttatcccctgcatcttcagcttccctgccgacgtggaggtgcccg

SEQ ID NO: 61274 - DNA, 201 bp, Homo sapiens; identical to SEQ ID NO: 11803

SEQ ID NO: 61275 - DNA, 201 bp, Homo sapiens; identical to SEQ ID NO: 11804

SEQ ID NO: 61276 - DNA, 201 bp, Homo sapiens; identical to SEQ ID NO: 11805

SEQ ID NO: 61277 - DNA, 201 bp, Homo sapiens
tttgcccaccgcctcatcccaccacgccgcggtcctccaagaaccttcccagcggttctctcctcctctcaggagtagaggccctctgagaccgacggggwgggacggctcgggccggtcatccgaggggccgcacggattccctcctccgcccagctccaccccctcgaggggcggcggtccgggagtggcgacccggct

SEQ ID NO: 61278 - DNA, 201 bp, Homo sapiens
ggcagcagggcagtgtgtatgttgtttatattgttgccttgtttggtgagatagagaagggcctctccagatagaaggtgtctgtttagcagtgctctggraagactgcagctgtctcctcggggtaacccctccaaacaaagatgttaagatggggctggaacaacctctgcaagcgggtgggaggattagccagtcctg

SEQ ID NO: 61279 - DNA, 201 bp, Homo sapiens
ctgctctaagtgtgcatttctcggggcagggcagaatttgggagcccagctggggcaccttctctggggcaggtcgcagggctctgtggcaccctgaggcytgtatcaccctcccctctgtccccctgccgttcttcccccaggccaggcctcatggggcgtctccagtccccaggacgtgcagggtgtgaaggggtcttg

SEQ ID NO: 61280 - DNA, 201 bp, Homo sapiens
gtgtgcttgggctggccccgggcccggacttgcccacactgcccggctgccactccgctggcaaagcagagggcatggctccctccccctcggggacagcccagcccccagcccccagcccatagccgtagccccctctgcctggattctcgctctcacaaccagcttccatccgcaggccaccgtgtgacccgctcctgc

SEQ ID NO: 61281 - DNA, 201 bp, Homo sapiens
aaatggtgaaacctcgtctctgctaaaaatacaaaagttagctgggggtggtagcgcgcgcctgtagtcccagctactcgggaggctgaggcaggagaatmgcttgaaccagggagtcggaggttgcagtgagccaagatcgcgccgctgcactccagcctggcgacagagggagactccatctcaaaaaaaaaaaaaaaa

SEQ ID NO: 61282 - DNA, 201 bp, Homo sapiens
gcttgggctggccccgggcccggacttgcccacactgcccggctgccactccgctggcaaagcagagggcatggctccctccccctcggggacagcccagcccccagcccccagcccatagccgtagccccctctgcctggattctcgctctcacaaccagcttccatccgcaggccaccgtgtgacccgctcctgctcct

SEQ ID NO: 61283 - DNA, 201 bp, Homo sapiens
cttgggctggccccgggcccggacttgcccacactgcccggctgccactccgctggcaaagcagagggcatggctccctccccctcggggacagcccagcccccagcccccagcccatagccgtagccccctctgcctggattctcgctctcacaaccagcttccatccgcaggccaccgtgtgacccgctcctgctcctc

SEQ ID NO: 61284 - DNA, 201 bp, Homo sapiens
ggcagcaagtgccccgggatttaccccgtgctggaggatgctggggaggtgggatttatccctttcctgcctggctctgttttctcagtctatgacgaagrtaacaatagatggttcctgtctcacagatttatgataaaaattaaaggagatgggccgggcgcggtggcttatgcctgtaatcccatcactttgggaggc

SEQ ID NO: 61285 - DNA, 201 bp, Homo sapiens
gtaccccttagacactccctgaccaggggcactccatggttgagggcctgcctttttggatatggtacactccgcacacattgagctcatatttgtggggyatgtgttccacagcgctctcatgctacctttcaaacctagacttgccttgccacctccccactccaactctgaacctcagctctgaacccctaaagacct

SEQ ID NO: 61286 - DNA, 201 bp, Homo sapiens
aagggaaacacaacaggtcacatcattccttttgcacctaccctgaccctaaacttggagagtccctcagaagcattcattgttttttaattatgaaactytgggagcaggctctatgctagcagtcagatgtgggaagccaaatagaaaagtagggtcttctggctgggcgcggtggctcactcctgtaatcccagcact

SEQ ID NO: 61287 - DNA, 201 bp, Homo sapiens
atttactgttttaactgtctttaagtgtacaccccatgacattaggtacatttgcaatattgtgtaaccatcaccactatttccagaactttttcattatmtgagagactcagcaatcattaaacattagctccccctccctgcagcccctggttacctctatcctattctactttcagtctctgaatatacgtagtctag

SEQ ID NO: 61288 - DNA, 201 bp, Homo sapiens
tgagactctgtctcaaaaaaaaaaaaaaaaaagaaaaagaaaaaagaaaagtacggtcttccaactttcggtatgtgcactgtccttccctcctcctgagkgcatggtagctaattgatcaagccaggtttttctttttgttttttgagatagggtgttgctctgttgcccaggccggagtgcaatggtatgttcatggct

SEQ ID NO: 61289 - DNA, 201 bp, Homo sapiens
gaagaaaccatcattctagctgggtgtcttggagtgagtaactgggcatctctgggctccagttcctgttggtttgggtggtggggagggggcagggaagwggggaagagggagaaacagctgttcatctgccttagggtggtatccttgaggggctgggaaagcagaacttgggatagggccaagggacacacaggcttt

SEQ ID NO: 61290 - DNA, 201 bp, Homo sapiens
ggagttcttctgttgttcacacctcatgtggctgcagttgcccagtggtctcagatgactgcacgctcctggctgccagttgggccacatgtgcccagcargctggcctgggcttcccacattgttgtgttccaacaagtagagcagaagctacaaggcctcttgaggtctggctctgaagttgcacaacatcacttcttt

SEQ ID NO: 61291 - DNA, 201 bp, Homo sapiens
tggccaacatggtgaaacctcgtctctactaaaaatacaaaaattagccgggtgtggtggcatatgcctgtaatcccagttactaaggaggctgaggcacyaggattgcttgaaccccgggggtggagttgtattgagttgtgattgtgccactgcactccagcctgggtgacagagtgagactgtgtctcaaacaaaaaa

SEQ ID NO: 61292 - DNA, 201 bp, Homo sapiens
gagatctcctttctgagcggtccctgctctttctgtttccagaacagttatctgggctgaagctggcctttgtggtgacaggctgagccaataggctggaytccggtggggctgacccctttggggttagggccgggctaagcataggtggcctctacattatgtgatgggagtggtcctggaaagggtcctcccccgcgc

SEQ ID NO: 61293 - DNA, 201 bp, Homo sapiens
agcagtgcagaggtcacgggttgtatcagggtatccagggaatgcccttgtctgagggtgacaggcccacctctcgtctccacacagacccgcctctcacyccagtcctgacagccttcctggagacccaggcgggacttgtgggcatccttcactgctctgtggtcagtgagcccctggccacactggtgctgtcacatg

SEQ ID NO: 61294 - DNA, 201 bp, Homo sapiens
gggtcgttgcgtctcttcattctccgttagtctgagactgttcctcagtctttccttgtcattcttgatgttgaaacttgcagagtgcaggcctgctgttstgaggaggtccctcactccacatttgcctgacttgaatggcctgagaccatgccctctgggtgggaaggccgcggacatgctgctctgccctgtcaggag

SEQ ID NO: 61295 - DNA, 201 bp, Homo sapiens; identical to SEQ ID NO: 11791

SEQ ID NO: 61296 - DNA, 201 bp, Homo sapiens
tctctgctggtgtctgactcagaggtctttaagagccctgccctcttattgggttggccagcagaggaggtggggacacaggctcggacttctagcaggtrctggggctaaagtgcccagaggtgtccctggaggcccctgtgagcccagccagcgcagtgcgcaccaccctcttaggcaacaggagcagcacaagaacct

SEQ ID NO: 61297 - DNA, 201 bp, Homo sapiens
tgcacaacatcacttctttcttcaattggtcaaactgagtcacagattcaaggagtgaggaaataggttctgcctcttaatgggaggagcagcaaagtcaytgtgcatgggtacagggagggagaaatttgtggtcattgtctgcaatcaccacactcccttcctccccacagaccctcccaagacgcccaccatgatggt

SEQ ID NO: 61298 - DNA, 201 bp, Homo sapiens
agaggtgaggggagggggctccatctcccaggccactctgcacaaaagcccagctcttaggcccaaaggcttccttccctgtatccctcctgctgcagcawgatttgcctgtcgactctaaactgattgctcggggcacccttgtgtggagagcttcagcgataaagcaaaagttagaaggtgtcatcttgggtgggtccc

SEQ ID NO: 61299 - DNA, 201 bp, Homo sapiens; identical to SEQ ID NO: 11794

SEQ ID NO: 61300 - DNA, 201 bp, Homo sapiens
cccaccttgccaagggacaaaaagttcccctctaaatgcaccaggctgtcagggatgaagcgttggctttggggcccccattcacacacatgactttttcyggggcacccaagcatcagcctgtcgtcaccaggtgccaccctggcgatctctgaaggctggagtcggagtgcctccctcagacatcctgttctgcgtcac

SEQ ID NO: 61301 - DNA, 201 bp, Homo sapiens
aattagccgggtgtggtggcgcacacctgtggtcccagctactagggaggctgaggcaggataattgcttgaacctgggaggcagaggttgtagcgagctsagattgcgccactgcactccagcctggctgacggagcaagactccgtctcaaaaaaaaaaaaaaaaaaaaaaaaaaaagctggccacagtggctcacacc

SEQ ID NO: 61302 - DNA, 201 bp, Homo sapiens
gatattttcacctgtaataactgcagcagccactaggaggcaatggcaattcacaaagtggcttgcttggtgggagcactttctgaaataacttgttttgygatcatataattttgttacatagtaaacattctcatacatatgtatatttatattatgcatatatgtttatgtatgagtatatacacatacaaatataca

SEQ ID NO: 61303 - DNA, 201 bp, Homo sapiens
agatttaaggaaatgcagttctttgtgttgttggcctcttgcttacaaactgggtaactattttcagagctagtttgatgctgcctttggccccctcccamtaggtagttggtcccttaccaatagcttccacaggccactaaagctagcagtggggtacccatgaccctgtgtgtggagctcatcccaaatagagcagga

SEQ ID NO: 61304 - DNA, 201 bp, Homo sapiens
aggtgaacagcagctaccctgcagtcagttccattaagtggctcaaggatggggtacgcctccaaaccaagactggtgtgctgcacctgccccaggcagcmtggagcgatgctggcgtctacacctgccaagctgagaacggcgtgggctctttggtctcaccccccatcagcctccacatcttcagtgagttcttgggaa

SEQ ID NO: 61305 - DNA, 201 bp, Homo sapiens
agcctcgacccctcccctgggctcaagcgatcttcccacctcagcctccagagtagctgggaccacaggcctgttttttaatttttcgtagagacagagtmttgcagtattgcccaggctcgtcttgaactcctgggctaaagtgatcctcctgcctcagcctcccaaagtgttgggttcacaggcatgagccactgtgtc

SEQ ID NO: 61306 - DNA, 201 bp, Homo sapiens; identical to SEQ ID NO: 11807

SEQ ID NO: 61307 - DNA, 201 bp, Homo sapiens
gctgctctggggcgctgctctgctttcctgtccccaacttgttctgagctcgagccacctccatactggtgctcctggttctcaggcctttgaactcaaaytgaatcacaccactggctttcctcgttctccagcttgcagatggcagattcgggaactttttggcctccataatcacgtgagccaattgctataataaat

SEQ ID NO: 61308 - DNA, 201 bp, Homo sapiens
ccaagttgcggggggcggggggcggggcactgtcccctcaactccaggctttcaaacagggacagagatctcctttctgagcggtccctgctctttctgtytccagaacagttatctgggctgaagctggcctttgtggtgacaggctgagccaataggctggactccggtggggctgacccctttggggttagggccggg

SEQ ID NO: 61309 - DNA, 201 bp, Homo sapiens
aaaatgtaaataaaccctttctcagagacttcggcagaaaattcctctgacctgcacttggacacagctcatctgggtttgggaggtgtcaactgtgtaargatgactctgatccccatgtggcttttcgactgtgtcccctctacagtcagttattagcactgactgtgctaggaagtgagcaacacacatattcccaga

SEQ ID NO: 61310 - DNA, 201 bp, Homo sapiens
gagcataatgttttcaaggttcacatatgttagaattcattcctccttatggccgattgatattccattgtatgtacataccacagtttgtttatccacakccattcactgatggacacttgacctgtttccaccttttagtggaatagtgctgccgtgaacattggtgtactctgttagagtccctgttttcagtacttt

SEQ ID NO: 61311 - DNA, 201 bp, Homo sapiens
aagcgaacacacccagatcaagaaatagaccatcctacagtccccccttacactctgtaccagttgcagcccccacaagggtaactactgtcttgacttcraacaccatagatttgatttgcctgtttttaaactttacataagtagaatcacagagtgtgtacaatgactttggaaaactgtttgacaatatctattaaa

SEQ ID NO: 61312 - DNA, 201 bp, Homo sapiens
tgggcatcgtgtagtgcatccccaccccaggctgggcgcgcctccctctcaggtgtcagggaggagagctgtgtgcaggaagcccccttccacctcccccrgcctccctaaggggctcagagagagtggggtgtggatttggctggtgaatgggagtcccccactccatttctcactttgcctggggaggctccagcgttg

SEQ ID NO: 61313 - DNA, 201 bp, Homo sapiens
agacacacacacgcacatacatacatataaatgtatggatatagacttgcatatatacaggtgcacttgtgtgtatgcacatccactctatgtggacatgkgcacttatacatatatggacactctatatacatatgcatatgttatttatgtatctacctacatatttatattcctgaagttgcagacatgaggcctctt

SEQ ID NO: 61314 - DNA, 201 bp, Homo sapiens
gctagcagtggggtacccatgaccctgtgtgtggagctcatcccaaatagagcaggagcaatggacagcattgggaagcagaaaactacagctggtggggyaggctggacgctggccaagcgtcacatgatcagctctcaatgggcataggaatgcatcaggcgcagggggcgggaaagggacggacatgggcagacagag

SEQ ID NO: 61315 - DNA, 201 bp, Homo sapiens
ccagaatacaatcacagttcacatattgcattgggtcgttgcgtctcttcattctccgttagtctgagactgttcctcagtctttccttgtcattcttgaygttgaaacttgcagagtgcaggcctgctgttgtgaggaggtccctcactccacatttgcctgacttgaatggcctgagaccatgccctctgggtgggaag

SEQ ID NO: 61316 - DNA, 201 bp, Homo sapiens
agtagtgtggggaaaggagaaccctggaaggctttctatatagggcagcatgtggggttgagaggagggacccttcccagcctcttcctctccccgcagcygcccgtctcctcatcagcccggcagccgaggtggtggaaggacaggcagtgacactgagctgcagaagcggcctaagccccacacctgatgcccgcttct

SEQ ID NO: 61317 - DNA, 201 bp, Homo sapiens
ggtgagttcctgtagtcccagctacctgggaggctaaggcaggagaatcgcttgaacccaggaggtggaagttgtagtgagccaagatagcgccactgcastccagcctgggtgacaagagtgagactctgtctcaaaaaaaaaaaaaaaaaagaaaaagaaaaaagaaaagtacggtcttccaactttcggtatgtgcac

SEQ ID NO: 61318 - DNA, 201 bp, Homo sapiens
tgcctaagcaaggtccccatctgtgccctgcctgcccacagatgcccctcaggacgctgtcctgtcctccttccgggactccagggccagatccatggctrtgatacagtgcactgtggacagtgagccacctgctgagctggccctatctcatgatggcaaggtgctggccacgagcagcggggtccacagcttggcatc

SEQ ID NO: 61319 - DNA, 201 bp, Homo sapiens
gcacagcccaaaacttgctgggctcaatcagcaccatcgggcggttgcaggtagaaggtgagtggaagagaggggaggaggaggggctctgatgctctcargtccaagtccacgagaggggctggagctcccactagagcgggctgtctggtctgagaaagctctgccttgagaagcctaatctggtggagggggcacagc

SEQ ID NO: 61320 - DNA, 201 bp, Homo sapiens
cacatacaaatatacattatgtgtattcttatgcataatatattcatattctttatttatatacacatacgtgtgtgtgtgtgtgtgtgtgtgtgtgtgtktgtgtgtatatatatatatagtctctataaaaatcctccctcaggccgggcaccatggctcatgcctgtaatcccagcactttgggaggctgaggcgggc

SEQ ID NO: 61321 - DNA, 201 bp, Homo sapiens
atggttccaccttggaaagccctataccaagtcagactgagaccttcccacaatgtgcagaggcccctcagaggtcccacccagaggctccagcccccaargcctacagatccccaatcatctctctatcctccgcccgcaggtgcacgcgtggtggcagagcctggcctggacgtgcctgagggcgctgccctgaacctc

SEQ ID NO: 61322 - DNA, 201 bp, Homo sapiens
caagaacctgctatgggcttcttgcccaagcttctcctcctggcctcattcttcccagcaggtaagctttgcgggcctagtgcctgtcttccagggtccarccttcataagtccagcccttggcagattagactatgcctgggtcacatgtttggttgctgaggtcaagggagggcccaatcgggcagtggccaggagctg

SEQ ID NO: 61323 - DNA, 201 bp, Homo sapiens
atgggcttcttgcccaagcttctcctcctggcctcattcttcccagcaggtaagctttgcgggcctagtgcctgtcttccagggtccagccttcataagtscagcccttggcagattagactatgcctgggtcacatgtttggttgctgaggtcaagggagggcccaatcgggcagtggccaggagctgggcaggaagctg

SEQ ID NO: 61324 - DNA, 201 bp, Homo sapiens
acatgtgcacttatacatatatggacactctatatacatatgcatatgttatttatgtatctacctacatatttatattcctgaagttgcagacatgaggyctctttaccgctaaattcctaagatcattctcttacatatccacaatgcaatgatcatgatcaggaaaattagcattgatagaagacttttttttttttt

SEQ ID NO: 61325 - DNA, 201 bp, Homo sapiens
acaagagtgagactctgtctcaaaaaaaaaaaaaaaaaagaaaaagaaaaaagaaaagtacggtcttccaactttcggtatgtgcactgtccttccctccycctgagggcatggtagctaattgatcaagccaggtttttctttttgttttttgagatagggtgttgctctgttgcccaggccggagtgcaatggtatgtt

SEQ ID NO: 61326 - DNA, 201 bp, Homo sapiens
caaccctttgctggaagaggagggcttgtacctctgtgaggccagcaatgccctgggcaacgcctccacctcagccaccttcaatggccagggtgagtcargcagggaatgggtggcctgggggcaggggctggagctctggactgttctgctccgaggaggatctaatcaggcaaaaccactctgtgcagcagtgggggc

SEQ ID NO: 61327 - DNA, 201 bp, Homo sapiens; identical to SEQ ID NO: 11813

SEQ ID NO: 61328 - DNA, 201 bp, Homo sapiens
ggccagggattcaagaccagcttggccaacatggtgaaacctcgtctctactaaaaatacaaaaattagccgggtgtggtggcatatgcctgtaatcccasttactaaggaggctgaggcactaggattgcttgaaccccgggggtggagttgtattgagttgtgattgtgccactgcactccagcctgggtgacagagtg

SEQ ID NO: 61329 - DNA, 201 bp, Homo sapiens
gggtttcaccatgttggccaggatggtctcaatctcttgaccttgtgatctgcatgcctcagcctcccaaagtgctgggattacaggcgtgagccaccgcrcccagctgttgtttgttcttttcagacagggtcttgctctgtcacccaggctggagtgcagtggtgcaatcatggctcactgcagcctcgacccctcccc

SEQ ID NO: 61330 - DNA, 201 bp, Homo sapiens
ccacaggcctgttttttaatttttcgtagagacagagtcttgcagtattgcccaggctcgtcttgaactcctgggctaaagtgatcctcctgcctcagccwcccaaagtgttgggttcacaggcatgagccactgtgtctggccaagttttaaattttgatgaagtccaacttacctatttttttttttcgtgcttttaat

SEQ ID NO: 61331 - DNA, 201 bp, Homo sapiens
ggccaggccaacacgtccctggagctgcggctggagggtaaggcagggcctaggccaagcccactgggatggaagcccactgtggtgtccggctgggcccrgctgatcctggcctccttggcacaggtgtgcgggtgatcctggctccggaggctgccgtgcctgaaggtgcccccatcacagtgacctgtgcggaccctg

SEQ ID NO: 61332 - DNA, 201 bp, Homo sapiens
cagccagaagtttgagcccaccggcgtcggccacctggagaccctccacatggccatgtcctggcaggaccacggccggatcctgcgctgccagctctccrtggccaatcacagggctcagagcgagattcacctccaagtgaagtgtgagttgtctggggacacacccttgtggctgagcgcatctgttgctcctgacag

SEQ ID NO: 61333 - DNA, 201 bp, Homo sapiens
tcctgttggtttgggtggtggggagggggcagggaagtggggaagagggagaaacagctgttcatctgccttagggtggtatccttgaggggctgggaaakcagaacttgggatagggccaagggacacacaggcttttctgaggcaggccaccaagtgagggcattcctgggcacagcctgagctgggaacgtggcctcc

SEQ ID NO: 61334 - DNA, 201 bp, Homo sapiens
ggactgagcttttaaaggggggcaagaagaagtgtgccatcctctgccctccccaagcaccttacccaataccccctactgtgacttgcagatgcccccargggtgtgaagatcctcctcagcccctcggggaggaacatccttccaggtgagctggtcacactcacctgccaggtgaacagcagctaccctgcagtcagt

SEQ ID NO: 61335 - DNA, 201 bp, Homo sapiens
tgaggccaggctgggcagagaaagggagacacaaagggttggggaacaggagctcccatgcagcttcagggttggcagcaagtgccccgggatttaccccrtgctggaggatgctggggaggtgggatttatccctttcctgcctggctctgttttctcagtctatgacgaagataacaatagatggttcctgtctcacag

SEQ ID NO: 61336 - DNA, 201 bp, Homo sapiens
ctgggaaagcagaacttgggatagggccaagggacacacaggcttttctgaggcaggccaccaagtgagggcattcctgggcacagcctgagctgggaacrtggcctcctggctctctgctggtgtctgactcagaggtctttaagagccctgccctcttattgggttggccagcagaggaggtggggacacaggctcgga

SEQ ID NO: 61337 - DNA, 201 bp, Homo sapiens
gctgagaacggcgtgggctctttggtctcaccccccatcagcctccacatcttcagtgagttcttgggaaggttgcgtattggccagagaatagggaggarctcaggcctcagggacggaggggagacagggcagggcagggccagcaactggcataacccagtgcttcctggatgcaggtgtggagtcccagccctgcct

SEQ ID NO: 61338 - DNA, 201 bp, Homo sapiens
gcactccctatgctgcccttgcagtggctgaggtccaggtgagcccagcaggtcccatcctggagaaccagacagtgacactagtctgcaacacacccaaygaggcacccagtgatctccgctacagctggtacaagaaccatgtcctgctggaggatgcccactcccataccctccggctgcacttggccactagggctg

SEQ ID NO: 61339 - DNA, 201 bp, Homo sapiens; identical to SEQ ID NO: 11828

SEQ ID NO: 61340 - DNA, 201 bp, Homo sapiens
acatccatgtcctggcttcccccaatgccctgagggtggacatcgaggcgctgaggcccagcgaccaaggggaatacatctgttctgcctcaaatgtcctrggctctgcctctacctccacctactttggggtcagaggtgaggggagggggctccatctcccaggccactctgcacaaaagcccagctcttaggcccaaa

SEQ ID NO: 61341 - DNA, 201 bp, Homo sapiens
ctggtcccaactccctgcgcctggagatccgagacctggaggaaactgacagtggggagtacaagtgctcagccaccaactcccttggaaatgcaacctcyaccctggacttccatgccaatggtaagatgggcactggcagccagggagagtggagggagcctgaggaggagcctgctccagtctgttccttctagaagt

SEQ ID NO: 61342 - DNA, 201 bp, Homo sapiens
tttttgtacattcaattaaagtgtaacatacagaaaagttcacacattataaatgcaactcaaggacttttccaaaagcgaacacacccagatcaagaaayagaccatcctacagtccccccttacactctgtaccagttgcagcccccacaagggtaactactgtcttgacttcgaacaccatagatttgatttgcctgt

SEQ ID NO: 61343 - DNA, 201 bp, Homo sapiens
caattaaagtgtaacatacagaaaagttcacacattataaatgcaactcaaggacttttccaaaagcgaacacacccagatcaagaaatagaccatcctayagtccccccttacactctgtaccagttgcagcccccacaagggtaactactgtcttgacttcgaacaccatagatttgatttgcctgtttttaaacttta

SEQ ID NO: 61344 - DNA, 201 bp, Homo sapiens
gtgtaacatacagaaaagttcacacattataaatgcaactcaaggacttttccaaaagcgaacacacccagatcaagaaatagaccatcctacagtccccscttacactctgtaccagttgcagcccccacaagggtaactactgtcttgacttcgaacaccatagatttgatttgcctgtttttaaactttacataagta

SEQ ID NO: 61345 - DNA, 201 bp, Homo sapiens
tctattaaagctaaaatacccttgccctatgaacctgaaattccacccaccttgccaagggacaaaaagttcccctctaaatgcaccaggctgtcagggawgaagcgttggctttggggcccccattcacacacatgactttttctggggcacccaagcatcagcctgtcgtcaccaggtgccaccctggcgatctctgaa

SEQ ID NO: 61346 - DNA, 201 bp, Homo sapiens
cacccacactctatacttggtaccacaacggtcgttggctgcaggagggtccagctgcctcactctcattcctggtggccacgcgggctcatgcaggcgcytactcttgccaggcccaggatgcccagggcacccgcagctcccgtcctgctgccctgcaagtcctctgtgagcagagggtccttggccagggctgcccag

SEQ ID NO: 61347 - DNA, 201 bp, Homo sapiens
ccggcggctgcacgcggagcctgtgcccactctcgccttcacccacgtggctcgtgctcaagctgggatgtaccactgcctggctgagctccccactgggsctgctgcctctgctccagtcatgctccgtgtgctctgtgagtgtgaaccccctcctccgccttagtctccccacatctcacacgcccacctcagttcttc

SEQ ID NO: 61348 - DNA, 201 bp, Homo sapiens
cagggctctctcctcagctggggtttccagggcgagggatctcaggggtggcaaaagcgggtcctgagcactgctgtctctgtcctcagaggagcccaggstgcccaccattgcctccccggtggagcttctcgagggcacagaggtggacttcaactgctccactccctacgtatgcctgcaggagcaggtcagactgca

SEQ ID NO: 61349 - DNA, 201 bp, Homo sapiens
ctcaagtgtgcttgggctggccccgggcccggacttgcccacactgcccggctgccactccgctggcaaagcagagggcatggctccctccccctcggggrcagcccagcccccagcccccagcccatagccgtagccccctctgcctggattctcgctctcacaaccagcttccatccgcaggccaccgtgtgacccgct

SEQ ID NO: 61350 - DNA, 201 bp, Homo sapiens; identical to SEQ ID NO: 11801

SEQ ID NO: 61351 - DNA, 201 bp, Homo sapiens
ctgctcgctctgtcaccttcaacagccagaagtttgagcccaccggcgtcggccacctggagaccctccacatggccatgtcctggcaggaccacggccgkatcctgcgctgccagctctccgtggccaatcacagggctcagagcgagattcacctccaagtgaagtgtgagttgtctggggacacacccttgtggctga

SEQ ID NO: 61352 - DNA, 201 bp, Homo sapiens
caaaaattagctgggcatggtggtgagttcctgtagtcccagctacctgggaggctaaggcaggagaatcgcttgaacccaggaggtggaagttgtagtgrgccaagatagcgccactgcagtccagcctgggtgacaagagtgagactctgtctcaaaaaaaaaaaaaaaaaagaaaaagaaaaaagaaaagtacggtct

SEQ ID NO: 61353 - DNA, 201 bp, Homo sapiens
cccctctgcctggattctcgctctcacaaccagcttccatccgcaggccaccgtgtgacccgctcctgctcctccaccccttaggactcagcggggctccrtcctctaggaagcccccatgcccaagagtcccccagagtccctgctttgctctcaggctgcagaactagctgtggcctccaccctgctcacccctcgtcc

SEQ ID NO: 61354 - DNA, 201 bp, Homo sapiens
tgcccggctgccactccgctggcaaagcagagggcatggctccctccccctcggggacagcccagcccccagcccccagcccatagccgtagccccctctkcctggattctcgctctcacaaccagcttccatccgcaggccaccgtgtgacccgctcctgctcctccaccccttaggactcagcggggctccatcctcta

SEQ ID NO: 61355 - DNA, 201 bp, Homo sapiens
gagcagtgcctcagactgggtggttgggagccataggggtggggagccagggccctcctgagtttgaatgccacctgcaaactggcctcctgcaggctgcygcctgtgactccgtgtaagcctctcatgccctgcagacgcgccccgcaacctgcgcctgacctacctcctggagagccatggcgggcagctggccctggt

SEQ ID NO: 61356 - DNA, 201 bp, Homo sapiens
gacctcctattaagttcacaggctgcctacttcccagactgcccctccaaattggaaatcccttctagaattgtccctaaatcctccttgctgtagtttcyttctttcctcctctctgccctggctgtgctaaagcaagggctagggaggaagacagaggaagcacccactctccatgaggttcccacgctcttgtggtct

SEQ ID NO: 61357 - DNA, 201 bp, Homo sapiens
gcagcaggcgggtggtgtaggatgtgcagagattgaggctgattggctgagacccggggactgtatggggctggggctggaagttggctgggaccccccakcactccctatgctgcccttgcagtggctgaggtccaggtgagcccagcaggtcccatcctggagaaccagacagtgacactagtctgcaacacacccaac

SEQ ID NO: 61358 - DNA, 201 bp, Homo sapiens
ctcagcctgaccaaccccaggcagctaggcaatgagcagtacagggtgcctaagcaaggtccccatctgtgccctgcctgcccacagatgcccctcaggaygctgtcctgtcctccttccgggactccagggccagatccatggctgtgatacagtgcactgtggacagtgagccacctgctgagctggccctatctcatg

SEQ ID NO: 61359 - DNA, 201 bp, Homo sapiens
gtgggacaaagcagtgcagaggtcacgggttgtatcagggtatccagggaatgcccttgtctgagggtgacaggcccacctctcgtctccacacagacccrcctctcaccccagtcctgacagccttcctggagacccaggcgggacttgtgggcatccttcactgctctgtggtcagtgagcccctggccacactggtgc

SEQ ID NO: 61360 - DNA, 201 bp, Homo sapiens
tcacagattcaaggagtgaggaaataggttctgcctcttaatgggaggagcagcaaagtcactgtgcatgggtacagggagggagaaatttgtggtcattktctgcaatcaccacactcccttcctccccacagaccctcccaagacgcccaccatgatggtcttcgtggagcctgagggtggcctccggggcatcctgga

SEQ ID NO: 61361 - DNA, 201 bp, Homo sapiens
caggagggtccagctgcctcactctcattcctggtggccacgcgggctcatgcaggcgcctactcttgccaggcccaggatgcccagggcacccgcagctmccgtcctgctgccctgcaagtcctctgtgagcagagggtccttggccagggctgcccaggaggagggtggtggagggtgcttctgggctctggtgggagt

SEQ ID NO: 61362 - DNA, 201 bp, Homo sapiens
gtccccccttacactctgtaccagttgcagcccccacaagggtaactactgtcttgacttcgaacaccatagatttgatttgcctgtttttaaactttacwtaagtagaatcacagagtgtgtacaatgactttggaaaactgtttgacaatatctattaaagctaaaatacccttgccctatgaacctgaaattccaccc

SEQ ID NO: 61363 - DNA, 201 bp, Homo sapiens
aaacccttccaccacccccaaatccttccaacctgcatcccaatcccagtcccgaccatcaccctgctctgaccctacctcagccccagccccagcccctrttccaaccttatctcaccctcacctcacttgcaccccaaccctaaccatttactcatctcatctaatcccaaccatccatcatcccaaccctaaccacaa

SEQ ID NO: 61364 - DNA, 201 bp, Homo sapiens
catcaccctgctctgaccctacctcagccccagccccagcccctattccaaccttatctcaccctcacctcacttgcaccccaaccctaaccatttactcrtctcatctaatcccaaccatccatcatcccaaccctaaccacaactccgactctatcatcctcatctcaacccagcctccaccgtatcttaaccatcacc

SEQ ID NO: 61365 - DNA, 201 bp, Homo sapiens
ccttgctcctgatgcaaaaccaggctgctcctgggcctccagggtagggcaagtggagagacactgctgagccccaaggacttcgttaaatggttccctcmacctcctactgcttcgaaggggcttgtccttgaggccaggctgggcagagaaagggagacacaaagggttggggaacaggagctcccatgcagcttcagg

SEQ ID NO: 61366 - DNA, 201 bp, Homo sapiens
tgacagagtgagactgtgtctcaaacaaaaaacaacaacaacaacaaaaacaaataaaggagatgacccaggtcaaggatttagaagagtgcctggcacawattaaacacttgaggccggatacagtggctcacacctgtaaccccagtgctttgggaggccaaggcaggagaattgcttgaggcaaggagttcgagacca

SEQ ID NO: 61367 - DNA, 201 bp, Homo sapiens
gtgtgtggagctcatcccaaatagagcaggagcaatggacagcattgggaagcagaaaactacagctggtggggtaggctggacgctggccaagcgtcacrtgatcagctctcaatgggcataggaatgcatcaggcgcagggggcgggaaagggacggacatgggcagacagagcatgccctgggtgaggattgaagggg

SEQ ID NO: 61368 - DNA, 201 bp, Homo sapiens
gctctatgctagcagtcagatgtgggaagccaaatagaaaagtagggtcttctggctgggcgcggtggctcactcctgtaatcccagcactttgggaggcygaggtgggtggatcacgaggtcaagagatcgagaccatcctggccaacatggtgaaatcccatctctactaaaaatacaaaaattagctgggcatggtgg

SEQ ID NO: 61369 - DNA, 201 bp, Homo sapiens
catgtgcacttatacatatatggacactctatatacatatgcatatgttatttatgtatctacctacatatttatattcctgaagttgcagacatgaggcytctttaccgctaaattcctaagatcattctcttacatatccacaatgcaatgatcatgatcaggaaaattagcattgatagaagactttttttttttttt

SEQ ID NO: 61370 - DNA, 201 bp, Homo sapiens
gaagcgttggctttggggcccccattcacacacatgactttttctggggcacccaagcatcagcctgtcgtcaccaggtgccaccctggcgatctctgaargctggagtcggagtgcctccctcagacatcctgttctgcgtcactccttgggagaagtcgtgtttacagatggtgggtgtcacccatgccaagcacttct

SEQ ID NO: 61371 - DNA, 201 bp, Homo sapiens
cagaatacaatcacagttcacatattgcattgggtcgttgcgtctcttcattctccgttagtctgagactgttcctcagtctttccttgtcattcttgatrttgaaacttgcagagtgcaggcctgctgttgtgaggaggtccctcactccacatttgcctgacttgaatggcctgagaccatgccctctgggtgggaagg

SEQ ID NO: 61372 - DNA, 201 bp, Homo sapiens
cttgaacactgactgggacaacagagtgacgtacccagcccagccaaggacaaaagtgtattcagcaggcactcaggcactttgggatcacccccttctcrcagggcagtgtgggacaaagcagtgcagaggtcacgggttgtatcagggtatccagggaatgcccttgtctgagggtgacaggcccacctctcgtctcca

SEQ ID NO: 61373 - DNA, 201 bp, Homo sapiens
agggcagtgtgggacaaagcagtgcagaggtcacgggttgtatcagggtatccagggaatgcccttgtctgagggtgacaggcccacctctcgtctccacrcagacccgcctctcaccccagtcctgacagccttcctggagacccaggcgggacttgtgggcatccttcactgctctgtggtcagtgagcccctggccac

SEQ ID NO: 61374 - DNA, 201 bp, Homo sapiens; identical to SEQ ID NO: 11816

SEQ ID NO: 61375 - DNA, 201 bp, Homo sapiens
acctcggccacgctccgctttgcagccataactttgacacaagctggggcctatcattgccaagcccaggccccaggctcagccaccacgagcctagctgyacccatcagcctccacgtgtcctgtaaggacttttgtcccatccaggtgtgggggaaggaatgcagtcccccagtcctgggctgtgtcacatgacagagc

SEQ ID NO: 61376 - DNA, 201 bp, Homo sapiens
ggcctatcattgccaagcccaggccccaggctcagccaccacgagcctagctgcacccatcagcctccacgtgtcctgtaaggacttttgtcccatccagrtgtgggggaaggaatgcagtcccccagtcctgggctgtgtcacatgacagagccctggatgagggacccccctggctgggtcctgaccactccccaccct

SEQ ID NO: 61377 - DNA, 201 bp, Homo sapiens; identical to SEQ ID NO: 11818

SEQ ID NO: 61378 - DNA, 201 bp, Homo sapiens
ctaccgctgcggtgtgggcccccctggtcgggcaccccgcctctccagacctatcaccttggacgtcctctgtgagtctggctggatgcagggtgggactsacaggaatgacagaagcccacagggatcacggcatggccggaacccgacaggtgtccagtggggaactcggtacccagtagctagtggagcactgggcaa

SEQ ID NO: 61379 - DNA, 201 bp, Homo sapiens
ccactcacccggcccagctcacctacacatggtaccaggatgggcagcagcgcctggatgcccactccatccccctgcccaacgtcacagtcagggatgcyacctcctaccgctgcggtgtgggcccccctggtcgggcaccccgcctctccagacctatcaccttggacgtcctctgtgagtctggctggatgcagggtg

SEQ ID NO: 61380 - DNA, 201 bp, Homo sapiens; identical to SEQ ID NO: 11824

SEQ ID NO: 61381 - DNA, 201 bp, Homo sapiens
ctatggtaccccttagacactccctgaccaggggcactccatggttgagggcctgcctttttggatatggtacactccgcacacattgagctcatatttgyggggtatgtgttccacagcgctctcatgctacctttcaaacctagacttgccttgccacctccccactccaactctgaacctcagctctgaacccctaaa

SEQ ID NO: 61382 - DNA, 201 bp, Homo sapiens
tgccaagggacaaaaagttcccctctaaatgcaccaggctgtcagggatgaagcgttggctttggggcccccattcacacacatgactttttctggggcayccaagcatcagcctgtcgtcaccaggtgccaccctggcgatctctgaaggctggagtcggagtgcctccctcagacatcctgttctgcgtcactccttgg

SEQ ID NO: 61383 - DNA, 201 bp, Homo sapiens
aaggctggagtcggagtgcctccctcagacatcctgttctgcgtcactccttgggagaagtcgtgtttacagatggtgggtgtcacccatgccaagcactyctaagggttaatgctcactggtttgcctggttcccaggacatttcctgatgcccctctggagggtgacgccaacaagccagtggagaagccatctttccc

SEQ ID NO: 61384 - DNA, 201 bp, Homo sapiens
gttcccaggacatttcctgatgcccctctggagggtgacgccaacaagccagtggagaagccatctttcccaggtgctgtcaggcgcccccggagctgctmggtgcatcctaggatccctcttcctcagctttggtttgatggcctcatctcctcccctgcaacctcaaaatgtaaataaaccctttctcagagacttcgg

SEQ ID NO: 61385 - DNA, 201 bp, Homo sapiens
ggtgcatcctaggatccctcttcctcagctttggtttgatggcctcatctcctcccctgcaacctcaaaatgtaaataaaccctttctcagagacttcggyagaaaattcctctgacctgcacttggacacagctcatctgggtttgggaggtgtcaactgtgtaaggatgactctgatccccatgtggcttttcgactgt

SEQ ID NO: 61386 - DNA, 201 bp, Homo sapiens
cctaagtagctgtcattccctccacatactatccatgagaaggggaggaatgtcaccttctgtcacgaggttggtgtcactggagtgtttgcaggtgatgrtcctctccaccagctggttgtaactcagtttcccaactgcacgcacagcctcaggactctgcttgggtagtgggatgtgggataccaaaaaaattgggat

SEQ ID NO: 61387 - DNA, 201 bp, Homo sapiens
ctgactggctgttcagcctaggctgcacacacccccactttcctctaccaggccacaccggaggcagtgctcacacaggcaagctaccaggccacaacaaygacacccacctcacctctggcacctctgagtaagtactgggcccacggccccatgccaggagggcttgttgattgcttgggggagggaaaaatgagtttt

SEQ ID NO: 61388 - DNA, 201 bp, Homo sapiens
tcttctcctggagaatgcgggtaatgtcacagaacacagattttcagagctggaaaatacttagagtctaatccagactcttcatttctcagaggaggcgrcagcctcataaaggtgaacggcccacccagggtcagatacaaaagctaagggcagaattggtgttacaacccaggactcccgacgcctttgcttttcatt

SEQ ID NO: 61389 - DNA, 201 bp, Homo sapiens
catgagctcatccgatgtgatcacttccttctgcggggggagcttcacctggaggcagaaggggtgatcacgtgtgtgctttcctccaaagagcactgaargaagaacccatggaaaggcaagggggagctccagtagtagggtggggtaggaaaaaaggcttgcaactggcacaagggaatgaatgtgaaatcttgcaag

SEQ ID NO: 61390 - DNA, 201 bp, Homo sapiens
gcaggcgcctataatcccagctactcgggaggcggaggcaggagaatcgcttgaacccgggaggtggagcttgcagtgagccaacataatgccactgcackccagcctgggcaacagagagagactccgcctcaaaaaaaaaaatgttagtatatttaatgaaatatttgggtcatacttgtaccaacaaatgattcctca

SEQ ID NO: 61391 - DNA, 201 bp, Homo sapiens
gccaggtcagaagctggggcagagccaggtcagaagctggactttgagactaggtctctgtggtcccacctggacccacagggaaggcagtgcataaaagyctcctgtgtttgaggctgagccgctgagaggctgagtggagttcactcacatggattgaggcccagttcctgggagaagagatgctgggcaggaaggtgt

SEQ ID NO: 61392 - DNA, 201 bp, Homo sapiens
ccacctgcagtgacaggacccgcgtccgcatccgcactggctgcgctgcctgctgctgttgatactcctcttgctgaagctgctgggccagctccaagtcrgtaagccccagcgggcctcgtggctgttgctgctgcagggacagagcaatcaggtagtcctggggagaacaagagttgtgcagtgggctgaggcccagag

SEQ ID NO: 61393 - DNA, 201 bp, Homo sapiens
ggcaggcgcctataatcccagctactcgggaggcggaggcaggagaatcgcttgaacccgggaggtggagcttgcagtgagccaacataatgccactgcaytccagcctgggcaacagagagagactccgcctcaaaaaaaaaaatgttagtatatttaatgaaatatttgggtcatacttgtaccaacaaatgattcctc

SEQ ID NO: 61394 - DNA, 201 bp, Homo sapiens
aggacttcgcttctgccatgtgactgagactctgttggacttctccaaattcagagttcagcctggcatgccggccaggagccccttggagagattcggcstgaggaaacaggaggcctcacgcttccttcggttctccctaaatctgctgggcaggtagccagaagaaactctgaagggtacagaaagccgagggccagg

SEQ ID NO: 61395 - DNA, 201 bp, Homo sapiens
caggcatggtggcaggcacctgtaattccagctacttgggagtctgaggcaggagaattgcttgaacctgggaggcggaggttgtagtgaaccaagatcaygccactgcactccagcctgggtgacacagtcagactaaaaaagtagttatcattttggcagatggaatagctttctgtagactggttgagaagccatcat

SEQ ID NO: 61396 - DNA, 201 bp, Homo sapiens
aggaaggagaatcacttgaacctgggaggcagaggttacagtgagctgagatcacaccactgcactccagcctgggtgacagagtaagactcggtctcaayaaataaataaataaaagcaatgtgggacttggaggctgaagaggtggacatgcatgaacagtggaggcggtgtatgtggctgcctttcccctgtattcca

SEQ ID NO: 61397 - DNA, 201 bp, Homo sapiens
tcttgtggttttcctaagtgccaggctttcctgtagtccctaccagacttttcaaatgcttcctcaggagaactgaagactggttaacttttttttctttyttttaagatagcagtggggaggggaagttctggggcagaagttggataaccagggcctgagaaataaagataagagggtatattcctcccccaggagaca

SEQ ID NO: 61398 - DNA, 201 bp, Homo sapiens
agctatcctccacctcagcctcccaagtagcagggaccacaggcgacgccaccatgcccggctaatttttgtatttttgagatttcaccatgtcgctcacrctggtcgtgaactcctgagctcaaaccatccacccgccttggcctttcaaagtgctgggattacaagcatgagccaccttgcatcccaattgtctctttc

SEQ ID NO: 61399 - DNA, 201 bp, Homo sapiens
ttttgatgacttgtacctgtgttatttcttttcttttctttttttttgagacggagtcttgctctgtcccaggctggagtgcagtggtgtgatctcagctyactgcaacgtccgcctcccaggttcaagcaattctcctacctcaccctcctcagtagctgggattataggcgcctaccaccacacctggctaatttttgt

SEQ ID NO: 61400 - DNA, 201 bp, Homo sapiens
gcaacgtccgcctcccaggttcaagcaattctcctacctcaccctcctcagtagctgggattataggcgcctaccaccacacctggctaatttttgtagtyttaatagagacgggggtttcaccatgttggccaggctggtctcgaactcctgaccataaatgatctgcttgccttggcctcccaaaattctgggattaca

SEQ ID NO: 61401 - DNA, 201 bp, Homo sapiens
aggtataagtgactctacaaagaaaagaacagagctcattggggggacagttgatacggaggcagttcactgccagaaatctcggtatgagcatgtggacwttttttttcttggagatggagtctcgctctgtcatccaggctggagtgcagtggcacaatctctgctcaccgcaagctctgcctcccaggttcacaccat

SEQ ID NO: 61402 - DNA, 201 bp, Homo sapiens
agccctggtcatgccactgcactccagcctgggtgacagagagagaccccatctctctcgctctctctctctctctctctacacacacacacacacacacrcgcacacacacaaacctagtttacgggttaaaataaactttctggctggtcgtggtggctcacacctataatcccaacaatttgggaggccgagacaggt

SEQ ID NO: 61403 - DNA, 201 bp, Homo sapiens
atagggacctcaccccagagcctcagtctgtacatacgtgtgactattcagggaccgggagttgagaaccagaaacccaccaatcctagtgttgccctggrtgggaggcagagaaggcagcagcacgtgaggtcaaggacattaccaagtctgaccttggcatttgttgcctgctctcatccccaacagtccataaataag

SEQ ID NO: 61404 - DNA, 201 bp, Homo sapiens
actccagcctgggcaatacagcgaggctccatctcaaaaaaaaaaaaaaaagaaaaaaagaaatgacaggtaaccaccttcctgcctctgacccacctccygctttttgcattcttcaattgggtcaaatacttaaccctattgcttcagggtaaggcaaacaacagatctcaggaaagaaggttttttttttttttagac

SEQ ID NO: 61405 - DNA, 201 bp, Homo sapiens
tcccagctactcaggaggctgaggtaggagaatcgcttgaatccgggaggcggaggttgcagtgagctcagattgcaccactgcactccagcctgggcaayacagcgaggctccatctcaaaaaaaaaaaaaaaagaaaaaaagaaatgacaggtaaccaccttcctgcctctgacccacctcccgctttttgcattcttc

SEQ ID NO: 61406 - DNA, 201 bp, Homo sapiens; identical to SEQ ID NO: 11879

SEQ ID NO: 61407 - DNA, 201 bp, Homo sapiens
ttttctttctttcttttttttttttttttttgagacggagttttgctcttcttgcccaggttggagtgcagtggcgcgatctcagctcactgcaacctccrcctcctgggttcaagcaattctcctgcctcagccttccaagtagctgggattgcaggcacccaccaccatgcctggcttatttttgtatttttagtagag

SEQ ID NO: 61408 - DNA, 201 bp, Homo sapiens
gcacttcagcctgggtaacagagcaagaccctgtctcaaaaaaagaaaaaaagaagtggtagtcagaaaataacataggcccatttttctgaaaaaaaaaattttttttttgagatagagtctggctctgttgcctaggctggagtgcagtggcgtgatctcagctcactgcagccttcaccttctgggttcaagtgattc

SEQ ID NO: 61409 - DNA, 201 bp, Homo sapiens
ttaaactgctgactgtggcttgagtgcttccaccaatagaatccagttattctgttgattgaattaggtctcctattagtagaactgtcccccaaaatctrtaaataaaaagttcaggaagggcgcagtggctcacgcctataatcccagcactttgggaggccaaggtggatggatcacttgaggtcaggagttcgagac

SEQ ID NO: 61410 - DNA, 201 bp, Homo sapiens
ctctgcttgggtagtgggatgtgggataccaaaaaaattgggatttttttttcttttttaaggaaggaaatgaacaaagctcacaaggactacaaccctakgatgaatggttcctaaacactttttttttttggtctctcaaaaaagaaaaaaatttcaggaaccattcatcatagggttgctatgttgcccagactggcc

SEQ ID NO: 61411 - DNA, 201 bp, Homo sapiens
ggcatttggcaggtcctggggatatctacactaggaaaactcaggaggattcagagagctcctcaccccaccccagatttccaggtggaggctgtggatgrcatcacatctgagaccagtggcatcttgcaggacctgctgttggccctggccaaggtgaggaggactgacctgcaaggaagggagtcacgttcaccaggc

SEQ ID NO: 61412 - DNA, 201 bp, Homo sapiens
aatctctgctcaccgcaagctctgcctcccaggttcacaccattctcctgcctcagcctcccaagtagctgggactacaggcacccgccaccatgcctggmtaatgtttggtatttttttagtagagacggggtttcaccgtgttagccaggatggcctcgatctcctgacctcatgatctgcccgcctcggcctcccaaa

SEQ ID NO: 61413 - DNA, 201 bp, Homo sapiens
cgcagtggcgcatgcctgtagtcccagctactcaggaggctgaggtaggagaatcgcttgaatccgggaggcggaggttgcagtgagctcagattgcaccmctgcactccagcctgggcaatacagcgaggctccatctcaaaaaaaaaaaaaaaagaaaaaaagaaatgacaggtaaccaccttcctgcctctgacccac

SEQ ID NO: 61414 - DNA, 201 bp, Homo sapiens
gggcgcagtggcgcatgcctgtagtcccagctactcaggaggctgaggtaggagaatcgcttgaatccgggaggcggaggttgcagtgagctcagattgcmccactgcactccagcctgggcaatacagcgaggctccatctcaaaaaaaaaaaaaaaagaaaaaaagaaatgacaggtaaccaccttcctgcctctgacc

SEQ ID NO: 61415 - DNA, 201 bp, Homo sapiens
ctgagcatattcttgccccatagaaaacccagtagttagccaggcacagtggctcacgcctgtaatcccagcactttgagaggctgaggtgggcggatcaygaggtcaggagttcaagaccaccctgaccaacatggtgaaaccccgtctctactaaaaatacaaaaattagccaggcatggtggcgtgcacctgtaatcc

SEQ ID NO: 61416 - DNA, 201 bp, Homo sapiens
taaaagtttttatttaaaaatctctcataacaacacattacttagtataatcaattataattcaggattttgatgacttgtacctgtgttatttcttttcytttctttttttttgagacggagtcttgctctgtcccaggctggagtgcagtggtgtgatctcagcttactgcaacgtccgcctcccaggttcaagcaatt

SEQ ID NO: 61417 - DNA, 201 bp, Homo sapiens; identical to SEQ ID NO: 11873

SEQ ID NO: 61418 - DNA, 201 bp, Homo sapiens
gaagttgaggctgaggtaagccctggtcatgccactgcactccagcctgggtgacagagagagaccccatctctctcgctctctctctctctctctctacwcacacacacacacacacacgcacacacacaaacctagtttacgggttaaaataaactttctggctggtcgtggtggctcacacctataatcccaacaatt

SEQ ID NO: 61419 - DNA, 201 bp, Homo sapiens
agttgaggctgcagtgagctgagatcgtgccactgccactgcacaccagcctgggtgacaggagtgagagcatgtctctctctctctctctctctctcacwcacacacacacacacacacacacacaaataaagagagagaagcaatgattaaccatcttaatctggagctccaaggcagattccaaagtgacagtcccaa

SEQ ID NO: 61420 - DNA, 201 bp, Homo sapiens
gaagttgaggctgcagtgagctgagatcgtgccactgccactgcacaccagcctgggtgacaggagtgagagcatgtctctctctctctctctctctctcwcacacacacacacacacacacacacacaaataaagagagagaagcaatgattaaccatcttaatctggagctccaaggcagattccaaagtgacagtccc

SEQ ID NO: 61421 - DNA, 201 bp, Homo sapiens
cccagcttgggaagttgaggctgcagtgagctgagatcgtgccactgccactgcacaccagcctgggtgacaggagtgagagcatgtctctctctctctckctctctctcacacacacacacacacacacacacacacaaataaagagagagaagcaatgattaaccatcttaatctggagctccaaggcagattccaaag

SEQ ID NO: 61422 - DNA, 201 bp, Homo sapiens
gtctgtacatacgtgtgactattcagggaccgggagttgagaaccagaaacccaccaatcctagtgttgccctgggtgggaggcagagaaggcagcagcaygtgaggtcaaggacattaccaagtctgaccttggcatttgttgcctgctctcatccccaacagtccataaataagttatccagcacatctcaggggtgga

SEQ ID NO: 61423 - DNA, 201 bp, Homo sapiens
gcaggtaggcagctgtacaggcaggaattgagggttgcttgtcagctggggctgccggtgggggaagatgctatttcgagttgtcttccactctgcgtggwtaatcctgccacctcacctcagctcccctgcactgcccaggagaccccagccaggcccaggaaggagggccatagacctcagaagggaggcatctaccgc

SEQ ID NO: 61424 - DNA, 201 bp, Homo sapiens
acacacccccactttcctctaccaggccacaccggaggcagtgctcacacaggcaagctaccaggccacaacaacgacacccacctcacctctggcacctytgagtaagtactgggcccacggccccatgccaggagggcttgttgattgcttgggggagggaaaaatgagttttccttttccaacatgagagtgcctcct

SEQ ID NO: 61425 - DNA, 201 bp, Homo sapiens
ctaggctgcacacacccccactttcctctaccaggccacaccggaggcagtgctcacacaggcaagctaccaggccacaacaacgacacccacctcacctytggcacctctgagtaagtactgggcccacggccccatgccaggagggcttgttgattgcttgggggagggaaaaatgagttttccttttccaacatgaga

SEQ ID NO: 61426 - DNA, 201 bp, Homo sapiens
cataggcccatttttctgaaaaaaaaaattttttttttgagatagagtctggctctgttgcctaggctggagtgcagtggcgtgatctcagctcactgcarccttcaccttctgggttcaagtgattctctggcctctgtgtcttaagtagctgggattacaggcgtaggccaccatatctggctaattctgaattgtttc

SEQ ID NO: 61427 - DNA, 201 bp, Homo sapiens
agggtccagggtctcgggggggtcataaggagtccctgaagggccaggaaattcagctctgtgggctcctgtttccttccccagggcaaccagtagcaccrtgtctgtgactggcgggaagatggcaccgtccctcacccaggagatcctcagccacctgggcctggccagcaaggtaggggctgttgggattttagagat

SEQ ID NO: 61428 - DNA, 201 bp, Homo sapiens
agagacggggtttcaccattttggtcaggctggtctcgaactcctacctcagatgatccacgcgcctcatcctcccaaagtgctgggattacaggcatgarccactgtgcctggcctgttatttctaaactgaacctttcattactttctttagccaaaaaacaggcctgctgcatgtacaggaggaagatagcaatgttt

SEQ ID NO: 61429 - DNA, 201 bp, Homo sapiens
acccaccaccatgcctggcttatttttgtatttttagtagagacggggtttcaccattttggtcaggctggtctcgaactcctacctcagatgatccacgygcctcatcctcccaaagtgctgggattacaggcatgagccactgtgcctggcctgttatttctaaactgaacctttcattactttctttagccaaaaaac

SEQ ID NO: 61430 - DNA, 201 bp, Homo sapiens
gtgccccaagtgctgcctgccttgcagtgactcacttcctctgtatgggctgctgaactgtcccaaggagaggacaggccatctccaggccttcagccccragtttagatatctgggcaggctttgtggatgggcaagcatacagggagcccaaatgtggaaggtaggttttttcaggtcaggtggaactgttaacactga

SEQ ID NO: 61431 - DNA, 201 bp, Homo sapiens
tcctgggttcaagcaattctcctgcctcagccttccaagtagctgggattgcaggcacccaccaccatgcctggcttatttttgtatttttagtagagacrgggtttcaccattttggtcaggctggtctcgaactcctacctcagatgatccacgcgcctcatcctcccaaagtgctgggattacaggcatgagccactg

SEQ ID NO: 61432 - DNA, 201 bp, Homo sapiens
gctgggcgtttggcacatgctatagtcccagctgcttgggaggctgaggcaggagacttgcttgaacctgggaggcggaggttgcagtgagctgaattcaygccactgcattccactctgggtgacagagcaagaaaaaagaatacttgtacaacaatgagagtattcagttaatgagtgactcttgcccaattctgtaac

SEQ ID NO: 61433 - DNA, 201 bp, Homo sapiens
ccatttattgtaggacctgatgaagtctctacaggcagcactttccggcaacctggagaggattgtgatggctctgctgcagcccacagcccagtttgacrcccaggaattgaggacagctctgaaggtagcaggaggggagacttgctggggtgtctggggaagggagaaggctgtcagccttgcttttgcaagacgaga

SEQ ID NO: 61434 - DNA, 201 bp, Homo sapiens
gataaacaaaaaataataattacaggcggtggctcacgcctgtaatcccagcactttgggagtccaaggcaggtggatcacgaggtcaggagttcgagacyagcctggccaacatggtgaaaccctatctctactaagaatacaaaaaattagccaggcatgatggcaggcgcctataatcccagctactcgggaggcgga

SEQ ID NO: 61435 - DNA, 201 bp, Homo sapiens
tagtggtgagcgcctgtaatctcagctacttgggaggctgaagcaggagaatctcgagcctgggaagcagaggttgcggtcagccgaggtgacgccactgygctccagtctgggtgacaaagtgagacctgcctcaaaaaaaataaataaacaggccaggcgcggtggctcatgcctgtaatctcagcactttgggaggcc

SEQ ID NO: 61436 - DNA, 201 bp, Homo sapiens
ccagggggtagtggtgagcgcctgtaatctcagctacttgggaggctgaagcaggagaatctcgagcctgggaagcagaggttgcggtcagccgaggtgaygccactgtgctccagtctgggtgacaaagtgagacctgcctcaaaaaaaataaataaacaggccaggcgcggtggctcatgcctgtaatctcagcacttt

SEQ ID NO: 61437 - DNA, 201 bp, Homo sapiens
tctctggcctctgtgtcttaagtagctgggattacaggcgtaggccaccatatctggctaattctgaattgtttctaaaaaggaaaaactcgggctgggcrctgtggcgcatgcctgtaatcccaggactttggtaggctgaggcgggtggattatttgaggccaggagttcaagaccagcctggccaacatggtgaaacc

SEQ ID NO: 61438 - DNA, 201 bp, Homo sapiens
aattttttttttgagatagagtctggctctgttgcctaggctggagtgcagtggcgtgatctcagctcactgcagccttcaccttctgggttcaagtgatyctctggcctctgtgtcttaagtagctgggattacaggcgtaggccaccatatctggctaattctgaattgtttctaaaaaggaaaaactcgggctgggcg

SEQ ID NO: 61439 - DNA, 201 bp, Homo sapiens
ttacaggcgtgagccactgcgcccagcccatattatccgtacttaaactgctgactgtggcttgagtgcttccaccaatagaatccagttattctgttgaktgaattaggtctcctattagtagaactgtcccccaaaatctataaataaaaagttcaggaagggcgcagtggctcacgcctataatcccagcactttggg

SEQ ID NO: 61440 - DNA, 201 bp, Homo sapiens
atccatacttttttttttttttttgagatggagtttcactcttgttgcccaggctggaggctggagtgcagtggcacaatctcggctcatggcaacctccrcctcctggattcaagcgattttcctgcctcagcctcccaaatagctgggattacaggcgcccgccaccacattatcctaattttttgtatttttagcaga

SEQ ID NO: 61441 - DNA, 201 bp, Homo sapiens
ccctggtcatgccactgcactccagcctgggtgacagagagagaccccatctctctcgctctctctctctctctctctacacacacacacacacacacacrcacacacacaaacctagtttacgggttaaaataaactttctggctggtcgtggtggctcacacctataatcccaacaatttgggaggccgagacaggtgg

SEQ ID NO: 61442 - DNA, 201 bp, Homo sapiens
cctctgctgtgaggaccatttattgtaggacctgatgaagtctctacaggcagcactttccggcaacctggagaggattgtgatggctctgctgcagcccrcagcccagtttgacgcccaggaattgaggacagctctgaaggtagcaggaggggagacttgctggggtgtctggggaagggagaaggctgtcagccttgc

SEQ ID NO: 61443 - DNA, 201 bp, Homo sapiens
catgatgatgatagattctggaacgtcatacccatggctccctaggccccaaccaatgatcctgattgactcctccctgactcattcctccctcctaggcmctgcagcgggcagaaggacctagcagagaggaaacatgggtcccagtcttcacccagcgaaatcctgaacacctcatccgaggtacacacaagccttctt

SEQ ID NO: 61444 - DNA, 201 bp, Homo sapiens
gatctcagcttactgcaacgtccgcctcccaggttcaagcaattctcctacctcaccctcctcagtagctgggattataggcgcctaccaccacacctggstaatttttgtagttttaatagagacgggggtttcaccatgttggccaggctggtctcgaactcctgaccataaatgatctgcttgccttggcctcccaaa

SEQ ID NO: 61445 - DNA, 201 bp, Homo sapiens
cgtctgggaggggccagagtcagacaactgctgggttcgtccctaagagaggtcatctgactggctgttcagcctaggctgcacacacccccactttcctytaccaggccacaccggaggcagtgctcacacaggcaagctaccaggccacaacaacgacacccacctcacctctggcacctctgagtaagtactgggccc

SEQ ID NO: 61446 - DNA, 201 bp, Homo sapiens; identical to SEQ ID NO: 11877

SEQ ID NO: 61447 - DNA, 201 bp, Homo sapiens; identical to SEQ ID NO: 11878

SEQ ID NO: 61448 - DNA, 201 bp, Homo sapiens
atggcaccgtccctcacccaggagatcctcagccacctgggcctggccagcaaggtaggggctgttgggattttagagatcacttttagtatctcagctcrggctgtgagaggatgggaggcaggaaagtggaggacaggccctgaggttatgctgaggaggtgtaggcagcctggccctggcccttgccaactaccctgt

SEQ ID NO: 61449 - DNA, 201 bp, Homo sapiens
ttgcaatgagccgagatcgcgccattgcactctaacctgggcaacagagtgagactctgtctcaaaaaaaagaaaagaaaaggtggtagattagatcctcyctaagatttcctccaactctgcaattctaaaatgtacaacatggggaaggaaggtgatcagtacaactgtaaacaactgcaatccggccctgaagttgaa

SEQ ID NO: 61450 - DNA, 201 bp, Homo sapiens
agttagctaggcatggtggcacatgcctgtagttccagctactttggaggctgaggcaggagaattgcttgaacctaggagggtgaggttgcagtgagccragatcatgccactgccctccagcctggcaacagagtgagactccatctcaaaaataaataaaaggctgggtgcagtgattcatgcctataattccagcac

SEQ ID NO: 61451 - DNA, 201 bp, Homo sapiens
cagagaagccccatagacccttaccctccctgctgtatcagaacccccaaatggagatccctgaatagtctggatttctggctgagtggatagctctggarccccttgggtaattcctcttcaacgcccagtcactcaccaagatgggccatgagctcatccgatgtgatcacttccttctgcggggggagcttcacctgg

SEQ ID NO: 61452 - DNA, 201 bp, Homo sapiens
gcctgtagttccagctactttggaggctgaggcaggagaattgcttgaacctaggagggtgaggttgcagtgagccgagatcatgccactgccctccagcytggcaacagagtgagactccatctcaaaaataaataaaaggctgggtgcagtgattcatgcctataattccagcactttgggaggccgaggtgggcggat

SEQ ID NO: 61453 - DNA, 201 bp, Homo sapiens
agtttgggaccagcctggccaacatggtgaaaccctgtctctactaaaaatacaaaaattagctgggtgtggtggtgggccctgtaatcccagctactcgrgaggctgaggaaggagaatcacttgaacctgggaggcagaggttacagtgagctgagatcacaccactgcactccagcctgggtgacagagtaagactcg

SEQ ID NO: 61454 - DNA, 201 bp, Homo sapiens
gtgctaaagtggttgtttcggaaaaagacgctaagttcaccctccttagcagctgctgtcagctcacacagtccgtggtaggtcagctgggccgcggtggwctccaggaactgctctgcaatcaggcctgccagaaagggacgagtcgggggaaacttggcttaaattcaaggtccacaacaggaaggaccatccagagag

SEQ ID NO: 61455 - DNA, 201 bp, Homo sapiens
ctcattcctccctcctaggcactgcagcgggcagaaggacctagcagagaggaaacatgggtcccagtcttcacccagcgaaatcctgaacacctcatccraggtacacacaagccttcttgtccccctagcttgctctaatgatcagtttgggctgaggaaggtggggagggcccatcctttccagagataattaatccc

SEQ ID NO: 61456 - DNA, 201 bp, Homo sapiens
ctcggtatgagcatgtggactttttttttcttggagatggagtctcgctctgtcatccaggctggagtgcagtggcacaatctctgctcaccgcaagctcygcctcccaggttcacaccattctcctgcctcagcctcccaagtagctgggactacaggcacccgccaccatgcctggctaatgtttggtatttttttagt

SEQ ID NO: 61457 - DNA, 201 bp, Homo sapiens
ctgtgtttagacctgagggagccagctgtgaggctggagcagttgctgcatggcggggcgggggctccacagggctgttcacctgctgctctgtgcagagrcagcctcaagtccagctgctggggttgcatcacctgcagctaaaacagccacagggcccaggctgccaaaaggcaacagaagcaatctaagaaaccaggc

SEQ ID NO: 61458 - DNA, 201 bp, Homo sapiens
gggaagttgaggctgaggtaagccctggtcatgccactgcactccagcctgggtgacagagagagaccccatctctctcgctctctctctctctctctctwcacacacacacacacacacacgcacacacacaaacctagtttacgggttaaaataaactttctggctggtcgtggtggctcacacctataatcccaacaa

SEQ ID NO: 61459 - DNA, 201 bp, Homo sapiens
agaagagattctagaagaaggggtgtcaggattgggacagagagtagggagaggaagacaggaaggggctccaggggagagggacaggcaggggaaggacyctgagagaagaaaccttgaagagaccagtgcaggaataacaggtgttctggacccggcaaagcatgaggtggaaaccgggagtgtgggcgcccaggcagc

SEQ ID NO: 61460 - DNA, 201 bp, Homo sapiens
acatagtgagactctatctccacaaaatatttttaaaaattagctgcacctgtagttccagctagctaggaggctgaggtgggaggatcgcttgagcctgrgaagttgaggctgaggtaagccctggtcatgccactgcactccagcctgggtgacagagagagaccccatctctctcgctctctctctctctctctctac

SEQ ID NO: 61461 - DNA, 201 bp, Homo sapiens
atgtctaatcttggcctatgttcttcttttgagacaaggtcttgccctgtagcctaggctgtgcagtgatgtcatcatggctcactgcagccttgaccctyctgggctcaatcagtcctcccacctcagcctcctaagtagctgggactacaggtgtgccaccaccatgcccagctaaattttgtattttttgtagagatg

SEQ ID NO: 61462 - DNA, 201 bp, Homo sapiens
tcaccccagcttgggaagttgaggctgcagtgagctgagatcgtgccactgccactgcacaccagcctgggtgacaggagtgagagcatgtctctctctckctctctctctctcacacacacacacacacacacacacacacaaataaagagagagaagcaatgattaaccatcttaatctggagctccaaggcagattcc

SEQ ID NO: 61463 - DNA, 201 bp, Homo sapiens
gggctggcattttgcaggtgctgattgtgtgccacagcctatcctgagcagggcacacatatttcaattaatcctcacaaccatatccatccgtatcttayagatgaaaaaactgaagcccagagaagttaagtaccttgcttgaggtcacgtagctagtaagttatacagtctccctacacaacacttcacgatgtaaga

SEQ ID NO: 61464 - DNA, 201 bp, Homo sapiens
tcccagatgctggagaaggggctgtaggacaggccactcctctcctgtactccccataggtgagctatctggcaacctggctgcctaagttctattccctyggggtctttcctcttgcccccaccagtgcctcagtctctcaggggagagacccagatgtgatcattaaaaaaagagaagcaggccaggtacggtgactca

SEQ ID NO: 61465 - DNA, 201 bp, Homo sapiens
ggccacattaccttatttatttatttatttatttatttatttttatgagttcaatagtttttggggacaaggtggtgtttggttacatggataagttcttyagtggacacattacttcatttaatcatcccaggaaacctgtcctcggaggccccagcatgtcccacagcctccgtctctctcaatcctcccatttagaga

SEQ ID NO: 61466 - DNA, 201 bp, Homo sapiens
ttggccctggccaaggtgaggaggactgacctgcaaggaagggagtcacgttcaccaggcaaggagacacgctggagcagggagcattgctgtcctgtaayggacaagagagggctttaggggagaccagccttcgcttgttggtctgaagataaaaaggtgcccttcaaagagccctctaagaacagtttctcctcctag

SEQ ID NO: 61467 - DNA, 201 bp, Homo sapiens
agccaacataatgccactgcactccagcctgggcaacagagagagactccgcctcaaaaaaaaaaatgttagtatatttaatgaaatatttgggtcatacktgtaccaacaaatgattcctcatttacgtgaaattctgattaagctgcatgtcctgtatatttatttatttaatctaatacccctactttacagggcact

SEQ ID NO: 61468 - DNA, 201 bp, Homo sapiens
cactcctttccctccccagaacagaaactggggaggagagaggaagtctcagcttgctgcttatgtaaccatcctatatacaccgtctaaacctcaagccrctctccttcccagggcttacacaccagggcttacacaggggtggaggaatgagctgtggtgagaactaacttagttggctcccaggggccctgaaactaa

SEQ ID NO: 61469 - DNA, 201 bp, Homo sapiens
cttgtatgtcaggcgccacagtaggtgtgtcaaacccattctcacaacacccctgtgaggcaaggcttattatttccattttccagatgaggaaactgggrctcagggagattaagaggcttgcccaaggtcactcagctcatgacggaggtggtattctcatctaggtcagccgatccccccaagtcgtattttttttta

SEQ ID NO: 61470 - DNA, 201 bp, Homo sapiens
tttctctcttgactctgttcatcaacttccactcccaaatacttgtgcccttccttctccacagatatacacaatccctgggcactctccacctaggtcakctggctctagtaaggcagcagtcaagggagtttctgggctgggaccccctctggggtgcaggctggggtgccctgctggtatgtgccccaacaggttttt

SEQ ID NO: 61471 - DNA, 201 bp, Homo sapiens
agattcggcgtgaggaaacaggaggcctcacgcttccttcggttctccctaaatctgctgggcaggtagccagaagaaactctgaagggtacagaaagccragggccagggggaccccggctgcggagctgcagtaccgtgtttacccagcctaactgcggtcacccagtctcctgcatgtgtctgaggtcagcctcgggg

SEQ ID NO: 61472 - DNA, 201 bp, Homo sapiens
attgcttgaaccagggagtcggaggttgcaatgagccgagatcgcgccattgcactctaacctgggcaacagagtgagactctgtctcaaaaaaaagaaamgaaaaggtggtagattagatcctctctaagatttcctccaactctgcaattctaaaatgtacaacatggggaaggaaggtgatcagtacaactgtaaaca

SEQ ID NO: 61473 - DNA, 201 bp, Homo sapiens
ggtcagatacaaaagctaagggcagaattggtgttacaacccaggactcccgacgcctttgcttttcattctccagccttgcagagaagccccatagaccyttaccctccctgctgtatcagaacccccaaatggagatccctgaatagtctggatttctggctgagtggatagctctggaaccccttgggtaattcctct

SEQ ID NO: 61474 - DNA, 201 bp, Homo sapiens
caggaattgaggacagctctgaaggtagcaggaggggagacttgctggggtgtctggggaagggagaaggctgtcagccttgcttttgcaagacgagagtycccctctcgtcgtcccatattgtttcttagaaggagaagcagccagcgtctgcccctctgtctgccatcctaatgacacggccagtctgagagtagactc

SEQ ID NO: 61475 - DNA, 201 bp, Homo sapiens
ctggctaattcttgaaaaaaaaaatggttttttttagagacaggggtattattatgttgcccaggctggcctcgaactcctggcctcaagtgatcctcccrctttggcatctcaaagtgctgggattacaggtgtgagcacccggccaatgaacatattttctaggacaaagataaactctcctctgactcctgcagaatg

SEQ ID NO: 61476 - DNA, 201 bp, Homo sapiens
actctgcttgggtagtgggatgtgggataccaaaaaaattgggatttttttttcttttttaaggaaggaaatgaacaaagctcacaaggactacaaccctrtgatgaatggttcctaaacactttttttttttggtctctcaaaaaagaaaaaaatttcaggaaccattcatcatagggttgctatgttgcccagactggc

SEQ ID NO: 61477 - DNA, 201 bp, Homo sapiens
ctctagcagttaaaatgtatgcagtaaaaagctctctgaggcacatgtgctctctgcacttttcctaagtgccctacacacctggtctacctgcagctgcktttctggggagccactcccaccttctgctccaggccccttgcccagggaatgactcaggtgaaagtcagagtcacaaaagcagctgtctccatccacatt

SEQ ID NO: 61478 - DNA, 201 bp, Homo sapiens; identical to SEQ ID NO: 11892

SEQ ID NO: 61479 - DNA, 201 bp, Homo sapiens
ggttaaatggattaagggcggtgcaagatgtgctttgttaaacagatgcttgaaggcagcatgctcgttaagagtcatcaccaatccctaatctcaagtamtcagggacacaaacactgcggaaggccgcagggtcctctgcctaggaaaaccagagtcctttgttcacttgtttatctgctgaccttccctccactattg

SEQ ID NO: 61480 - DNA, 201 bp, Homo sapiens
ttgcagtgagtcgagatcacgccactgcattccagtctgggtgacagagcaagactctgtctcaaaaaaaatgaaaaaaaatgaaaataggcctggcatartagttcatgcctgaaacactttgggaggctaaggcaggagtattacttgaggccagtagttcaagatcagtctacacaacatagcaagaccctgactcta

SEQ ID NO: 61481 - DNA, 201 bp, Homo sapiens
aatttgaaaaattatattaaaaaaagaaacaagaagatttaaatattccagaactaggcatccatgagacaatgccattaaaacatataacataaatgtgmcagatacttagtatttcctttctcttttcttttttcctttcttatctttttttttttttttttgagacagggtctcactctgtcactcaggctggagtgc

SEQ ID NO: 61482 - DNA, 201 bp, Homo sapiens
gctgagatcgcaccactgcactccagcgtgggcgatgaagtaaggccgtgtctcaaaaaaaaaaaaaaaagaattcgactgacagagatctacattctctrtttctctattcagtgaaatctacaatacaaaatttatttgcattgccatgtatagggatcatttgcatagttatcagttttttacaacttaactctaaaa

SEQ ID NO: 61483 - DNA, 201 bp, Homo sapiens
tgtgacaagttccaatttcttttcaagtcaattgaactgaaatctccttgttgctttgaaatcttagaagagagcccactaattcaaggactcttactgtrggagcaactgctggttctatcacgtatgtactctttgttctttttctcccatttggtcttcaaacactctgtgtttgtaacttgttctgcctgctaggtt

SEQ ID NO: 61484 - DNA, 201 bp, Homo sapiens
gctgcaatggtggcttcatgacaacggctttccagtacatcattgataacaagggcatcgactcagacgcttcctatccctacaaagccatggtgcgtctwaagcaaactttttgtgctgccccatgatctcatgttatccactgactgactgtgctgggcttgccaccatgccaattgcttgagaagcagtattgtgtgt

SEQ ID NO: 61485 - DNA, 201 bp, Homo sapiens
cttctcttctagatgagaatcttgatgatgcttcaagtatgcatactctaagttaccagaaagactataaatcagaacatgtaataaagggggccgggcgyggtggctcatgcctgtaatcccagcactttgggaggccaaggcaagccgatcacctgaggtcaggagttcgaggctagcctggccaacatggcaaaatgc

SEQ ID NO: 61486 - DNA, 201 bp, Homo sapiens; identical to SEQ ID NO: 11881

SEQ ID NO: 61487 - DNA, 201 bp, Homo sapiens
ttgctgaatgtagagttgccacaaaccttcaatttgtaaaaaatgcaatatctagctgggtgcagtggctcatgcctataattccagcgctttgggaggcmaaatcaggaggatgactggagcctaggagattgaggttacaattagctatgatcataccacctgtattacagcctagacaacagagcaaaacactgttcc

SEQ ID NO: 61488 - DNA, 201 bp, Homo sapiens
aaaaaacaacaacaacaacaacaacaaaaaaaaacacacaaaacagtgacttaattataattcaaaataattattagaccaagattttcactatttttaaycctaataacaaggttctagtcttcatttctctcctagttgaatgactttgggcaaatcttttcatatctagtggctgttttctcctttgtaatgaagata

SEQ ID NO: 61489 - DNA, 201 bp, Homo sapiens
cccgggaggcggaggttgcagtgagccgagatcatgccattgcactccatcctggacaacaagagtgaaactccatctcaaaaaaaaaaaaaaaaagtgcmggaaactcaaagaacctatgaaaggccagaaagtcggtgaggtttgtttattgtgtaaccacaaacatcaccaaaaccacagagaggactgctcaaccta

SEQ ID NO: 61490 - DNA, 201 bp, Homo sapiens
caaaaccacagagaggactgctcaacctatgatgccactgagcagacacaatatttgacataaacactacagtttgaacaggtgacactggggaccagatrttagaatatctgctgctgctcctgctcctgctggtgctgctgctgctgggagacatctctactgccattctcaccaaaaggaggattttacatacttctg

SEQ ID NO: 61491 - DNA, 201 bp, Homo sapiens; identical to SEQ ID NO: 11884

SEQ ID NO: 61492 - DNA, 201 bp, Homo sapiens
taagacagtccagaaaatgtgaacattgataggatgtctgatgacattaagaaattattgtcttaatttcttatgacaataaagtggctcacacctgtaawcccagtacttagggaggctgaggtgggcagattacctatggtcaggagttcgagacaagcctggccaatgtggtgaaaccccatctctactaaaaataca

SEQ ID NO: 61493 - DNA, 201 bp, Homo sapiens
gaccttgtatctgttttagggttcttgtggtgcttgctgggctttcagtgctgtgggggccctggaagcacagctgaagctgaaaacaggaaagctggtgwctctcagtgcccagaacctggtggattgctcaactgaaaaatatggaaacaaaggctgcaatggtggcttcatgacaacggctttccagtacatcattga

SEQ ID NO: 61494 - DNA, 201 bp, Homo sapiens
ctgatgaagtactcttcttaatatatcagtagtacaaataaggaagtagcattcatgcttaaaaacagattttaatgactgggcgtagtggctcatacctrtaatctcagcactttggaaggccgaggtgggtggatcacctgaggtcaggagtttgagaccagcctggccaacgtggtgaaaccctgtctctaccaaaaa

SEQ ID NO: 61495 - DNA, 201 bp, Homo sapiens
ggaggctgaagcaggagaatcgcttgaactcaggaggtggaggtgcagtgagccgagatcacgccactgtactccagcctcggcaacggagcaagactccrtcccaaaattaaacagattttaagcaaactatccttaaaattatttctctgtatttaaactttttcttctgcagcctcccatgctcaaccttattctcag

SEQ ID NO: 61496 - DNA, 201 bp, Homo sapiens
tgaccctgccaaatccccctctgtgagaaacacccaagaattatcaataaaaaaataaattaaaaaaaaaaaaaaaaagaatgcctgaactaagcaagtasaataatgaaatactttttaaaaacttcactgtatgcccaatataaagggaaattattaacaataagtaatttcaaacttatagagataaaaaattatcta

SEQ ID NO: 61497 - DNA, 201 bp, Homo sapiens
agactgtggatatttaaacaggtcagttaagaagagcccatgtattcaaaaattcaggagataaactgatttttcagaggtttgtctctcttaaggatgatttttttttttttttgagagagagagaaagagatttcctttgattagatttgttggcaaatcctggaaagtccctgttttctaaccctctagatgtgtttg

SEQ ID NO: 61498 - DNA, 201 bp, Homo sapiens
ctatgctgtttaaattactatagttttgtaatatattttgaaaccaggcattttgtaatgcctccagctttgttcctcttgctaaagattactttgactayttaaggacttttgtagttccgcatgaatttgaggattgttttttctatttctgtgaagaataacattagaattttgatagaaattgcactgaatttctag

SEQ ID NO: 61499 - DNA, 201 bp, Homo sapiens
cctgacttttgattcgtatcctacctttataattgatctcaaagtgcacttctttttttttttttcctttcttgcacttagttagatttgtttgcctttayaccattgcttctcatcttgtggtttggaagtaagcccatcatgcatgcccattatgtccattactggggtaacagtaaaaccttgctccaagggaaagaa

SEQ ID NO: 61500 - DNA, 201 bp, Homo sapiens
cagcactttgggaggccaagggggaaggatcctttaaggccaggaatttgagaccagcctaggcaacatagggagaccctgtctctacaaaaaaaaaaaataataataaaataaaaataaaaataagctggttgtggtggtgcaggcttgcagtcctagctactcgggcagctgagatgggaggatagtttgagcccaaga

SEQ ID NO: 61501 - DNA, 201 bp, Homo sapiens
atcgcttgagcctgggaggttgaggctacagtgagccatgatcacaccactgcacttcagtctgagtgacagaaggaaaccctgtctcaaaacaaacaaamaaaaagaagtaaatggtactgctaatctcttattcttttccacctacatatttttctttcaattagttttggatttcttacccgaggttctctaaaataa

SEQ ID NO: 61502 - DNA, 201 bp, Homo sapiens
cttcatcatatttatacttctttttgcaggatcagaaatgtcaatatgactcaaaatatcgtgctgccacatgttcaaagtacactgaacttccttatggsagagaagatgtcctgaaagaagctgtggccaataaaggcccagtgtctgttggtgtagatgcgcgtcatccttctttcttcctctacagaagtggtaaaa

SEQ ID NO: 61503 - DNA, 201 bp, Homo sapiens
atgcaatatctagctgggtgcagtggctcatgcctataattccagcgctttgggaggccaaatcaggaggatgactggagcctaggagattgaggttacarttagctatgatcataccacctgtattacagcctagacaacagagcaaaacactgttccttaaaaaaaaaaaaaagctaatatctgcaaagcacaataaag

SEQ ID NO: 61504 - DNA, 201 bp, Homo sapiens
ctgggtgcagtggctcatgcctataattccagcgctttgggaggccaaatcaggaggatgactggagcctaggagattgaggttacaattagctatgatcrtaccacctgtattacagcctagacaacagagcaaaacactgttccttaaaaaaaaaaaaaagctaatatctgcaaagcacaataaagcaaagcacaataa

SEQ ID NO: 61505 - DNA, 201 bp, Homo sapiens
ggctatggtgatcttaatgggaaagaatactggcttgtgaaaaacaggtaatatatttacactttatatttaattggaatcaggaatttgagggagtttcrgcaaatactctcatgattttgatgatgatcattatgatcacgatattgacaatgatgaactttatagcttcttacaaagtgacattctaaattactcagt

SEQ ID NO: 61506 - DNA, 201 bp, Homo sapiens
aaatcacctaacgatgcatttctcagaacatattccagtcattaaacaatgcctgactgtatatttgctttgtagaccagtgaagaagtgatgtctttgaygagttccctgagagttcccagccagtggcagagaaatatcacatataagtcaaaccctaatcggatattgcctgattctgtggactggagagagaaaggg

SEQ ID NO: 61507 - DNA, 201 bp, Homo sapiens
tgggaggctaaggcaggagtattacttgaggccagtagttcaagatcagtctacacaacatagcaagaccctgactctacaaaaaaattaaaaagtagccragagttgtggcacacacctgcggtcctagttgttacagaggctgaggagggaggattgcttgagccaggagtttgaggctgcagtgaggtatgattgcat

SEQ ID NO: 61508 - DNA, 201 bp, Homo sapiens
tctcaggtgtctactatgaaccatcctgtactcagaatgtgaatcatggtgtacttgtggttggctatggtgatcttaatgggaaagaatactggcttgtkaaaaacaggtaatatatttacactttatatttaattggaatcaggaatttgagggagtttcagcaaatactctcatgattttgatgatgatcattatgat

SEQ ID NO: 61509 - DNA, 201 bp, Homo sapiens
ttttaaatggtgtcatttgtcttccaacaataaaccagcatttcttaggttctccactgcatgcaaaaacacaaactttgagtccctgagccaaaatttcwaacagcttccctttgcctttgtaattgaagtacatgttcctccacctgctgttctaagctgttcacaacatggccccaaaccagctttctatcctctttt

SEQ ID NO: 61510 - DNA, 201 bp, Homo sapiens
gttgtgttaaaagcagtaagacaggttttcctaggaaatcatacaaggagctgggatttggggagctttatctaaatctctttataactaaatgttttccrtgtaaaagttggtgtttttaaaattcaatttaattttttttttgagatagggtcttgatatgtcatccaggctgaaacacagtggcataatcatggctca

SEQ ID NO: 61511 - DNA, 201 bp, Homo sapiens
tttcttaggttctccactgcatgcaaaaacacaaactttgagtccctgagccaaaatttctaacagcttccctttgcctttgtaattgaagtacatgttcytccacctgctgttctaagctgttcacaacatggccccaaaccagctttctatcctctttttccactattctactaaagatatccagttttcctttcaact

SEQ ID NO: 61512 - DNA, 201 bp, Homo sapiens
ctgggcatggtggtgggtgcctgtaatcccagctacttgagaggctgagacaggagaattgcttgaactcaggaggtggaggttgcagtgagccgagatcrtgccattgcactccagcctgggcaacaagaacgaaactctgtctcaagaaaaaaaaagagacaatctaaaagatattctagtagtctatatgtgtggtga

SEQ ID NO: 61513 - DNA, 201 bp, Homo sapiens
aaggtaaataaagaaacctacacccagatacatgtaacgaagttgtaaaacatcaaaaagaaagagcaaatcatggctgggtgtatggttcatgcctgtartcccagcactttgggaggccaagggggaaggatcctttaaggccaggaatttgagaccagcctaggcaacatagggagaccctgtctctacaaaaaaaaa

SEQ ID NO: 61514 - DNA, 201 bp, Homo sapiens
tgcagccttgtcctcctagactcaagcaattctcccacctcaccctccccctcagctgggactacaagcatgcaccaccatgcccagctaattaaaaaaawtttttttgcagagacagggtctcactatattgcctaggctggtcttgaactcctggcctcaagtgatcctcccgcctcagcctcccaaagtgctgggatt

SEQ ID NO: 61515 - DNA, 201 bp, Homo sapiens
gggaatgcactcatacgatctgggcatgaaccacctgggagacatggtaggtacattacaagaaatcccactttcacgtctgggtaaatatcatttccttyctgtctccccaaaagcaatttgaaggtaaacaacaataacaaaggaatgtatagtacaaagttggaaaacagtagaattgaaggacgtaagaacgtgtac

SEQ ID NO: 61516 - DNA, 201 bp, Homo sapiens
tcctttctgtctccccaaaagcaatttgaaggtaaacaacaataacaaaggaatgtatagtacaaagttggaaaacagtagaattgaaggacgtaagaacktgtacagaaatttcttacttagttctattttgactgctttctttctttaacaaatcacttctttagaggaaattttaaactcagagactaccattgtttt

SEQ ID NO: 61517 - DNA, 201 bp, Homo sapiens
aaaatgcaatatctagctgggtgcagtggctcatgcctataattccagcgctttgggaggccaaatcaggaggatgactggagcctaggagattgaggttrcaattagctatgatcataccacctgtattacagcctagacaacagagcaaaacactgttccttaaaaaaaaaaaaaagctaatatctgcaaagcacaata

SEQ ID NO: 61518 - DNA, 201 bp, Homo sapiens
gggcaacatggtgaaaccccttatctacaaaaaacaaaaaacaaaatcagccaggcatggtggtgtgcacctgtagtcccagccactccagaggctgaggygggaggatcacttgagcccaggaggtcaaggctgcagtgagccatgattgcatcactgcactccagcctgggtgacagaatgaaaccctgtctccaaaag

SEQ ID NO: 61519 - DNA, 201 bp, Homo sapiens
cttatattatagtgagagagacaggaaataagaaaataaacaagcagatatgtagtatgctagatggtgataagtgttgtagataaaaataacagaaggcwtggagagtaggaagggccctgggtggtggtggtggtaagaagtctatctatatgacaggagggttagggaaggcctcacggataagggtgccatttgagc

SEQ ID NO: 61520 - DNA, 201 bp, Homo sapiens
caggctggtcttgaactcctgagctcaagtcatctacccgcctgagcttcccaaagtgctggaattacaggcatgagccactgcacctggcctgttgtttwgctttcattcatgtgttcactggagtagcattttaatttcctccaagagctttccctttgcattcacaacatggctaactggttcaagaagtctagcttt

SEQ ID NO: 61521 - DNA, 201 bp, Homo sapiens
aagcataatcatttctagctttgatgtaaaatgagagatgtataactcttcctttcacttgaacacttagaagccactgtaaggttgttttttgtttttgktttttgagacagtctccctctgttgcccaggctggagtacagtggtgcaatcttggctcactgaaacctctgcctcccaggttctaagcaattctcctgc

SEQ ID NO: 61522 - DNA, 201 bp, Homo sapiens
ttatgtatggaatacaatatgtaccacacttttttatccattcgtcttttaatggacactttataaggttgattccgtatcttggctattgtgaataatgytacaatgaacatggaagtgcagctatctcattgacatactgattgcgcttccttgggacatatacccagaagtgagattgctggatgatatggtaattat

SEQ ID NO: 61523 - DNA, 201 bp, Homo sapiens
ttttttaataaattctagaaagtattacctaaagactattgacaggtttttatagcaagttgccatacttatttaagtctagattgacaatttagtatgayccatctgctttcttaatgggagaatgtgggtatttaatatcacaaataatcccctattggttttcagattctgttctgtcctgcaaaactttaccactgt

SEQ ID NO: 61524 - DNA, 201 bp, Homo sapiens
atacataatatacaatacatattatgtatgcatacataatatacaatacatattatgtatgcatacataatctataatatacataatatataatataatayataatatacatatataatatataatatattatgtatacataatatacatatataatatataatatattatgtatacataatatacatataatatataata

SEQ ID NO: 61525 - DNA, 201 bp, Homo sapiens
aaattagcctggcgtggtggtgggcgcctgtaatcccagctactcgggagggtgaggcaggagaatcacttgaacctgggaggcagaggttgcagtgagcygagatcttgccactgcactccagcctgggcgatagagtgagaccctgtcttaaaaaaaaaaaaaaaaaaaagtgtataggaggatgtgtaggttatatgc

SEQ ID NO: 61526 - DNA, 201 bp, Homo sapiens
aattagcctggcgtggtggtgggcgcctgtaatcccagctactcgggagggtgaggcaggagaatcacttgaacctgggaggcagaggttgcagtgagctsagatcttgccactgcactccagcctgggcgatagagtgagaccctgtcttaaaaaaaaaaaaaaaaaaaagtgtataggaggatgtgtaggttatatgcg

SEQ ID NO: 61527 - DNA, 201 bp, Homo sapiens
gctagtcgctgaatttctgttgatgtctcttgaattaaatacagaagtggcattttaaagagtagttaattgcctcatttgaaacagatgtctgatcattraaaaaaaaaaaacgtaaaaaggaaaattacctacctaaagatgtgaaagcaatagatgagaattgtcttttaactatctgtaaagactgtggatatttaa

SEQ ID NO: 61528 - DNA, 201 bp, Homo sapiens
ggtgggcgcctgtaatcccagctactcgggagggtgaggcaggagaatcacttgaacctgggaggcagaggttgcagtgagctgagatcttgccactgcastccagcctgggcgatagagtgagaccctgtcttaaaaaaaaaaaaaaaaaaaagtgtataggaggatgtgtaggttatatgcgaatactcagtaatttat

SEQ ID NO: 61529 - DNA, 201 bp, Homo sapiens
aaaaatactactgacttttgtatgttgactttgtgtcttacaactttactgaattcatgtatcagttctaatagttttttgatggagtctttcttctctcttttttttttttttttttgaggcggattcatgctctgtcgcccaggctggagtgcagtggcgcaatctcggctcactgcaacctccgcctcccaggttcaa

SEQ ID NO: 61530 - DNA, 201 bp, Homo sapiens
gtatacataatatacatataatatataatatattatgtatacataatatacatataatatataatatattatgtatacataatatacatataatatataattattatgtatacataatatacatataatatataatatattatgtatacataatatacatataatatataatatattatgtatacataatatacatataat

SEQ ID NO: 61531 - DNA, 201 bp, Homo sapiens; identical to SEQ ID NO: 11896

SEQ ID NO: 61532 - DNA, 201 bp, Homo sapiens
ctgagatgggaggatagtttgagcccaagagtttgaggctgtagtgagctatgatcataccactgcactccagcctgggcaaaagagcaagaccctgtctaaaaaaaaaaaaaaaaaatgctgggcgcggtggcttacaccaataatcgcaggactttgggaggctgataggggaggattgcttgagcccaggaattcaat

SEQ ID NO: 61533 - DNA, 201 bp, Homo sapiens; identical to SEQ ID NO: 11897

SEQ ID NO: 61534 - DNA, 201 bp, Homo sapiens; identical to SEQ ID NO: 11900

SEQ ID NO: 61535 - DNA, 201 bp, Homo sapiens; identical to SEQ ID NO: 11901

SEQ ID NO: 61536 - DNA, 201 bp, Homo sapiens; identical to SEQ ID NO: 11903

SEQ ID NO: 61537 - DNA, 201 bp, Homo sapiens
caggaggcatccagtagaaaacattgttatcagaggagatgacagctccatacgtgttgttgcccctgaagaccttccagtgggacaagaggtggagacgraatgcagtgatactgatgatcctgaccttgtataggcctaggctaatgtgtgtgtgtgtttgtattttagtttttaacaaaaaagtgtaaaaacttttaa

SEQ ID NO: 61538 - DNA, 201 bp, Homo sapiens
atttgctttgtagaccagtgaagaagtgatgtctttgatgagttccctgagagttcccagccagtggcagagaaatatcacatataagtcaaaccctaatyggatattgcctgattctgtggactggagagagaaagggtgtgttactgaagtgaaatatcaagtgagtattaccatcccaagcctctgaaccctaggtag

SEQ ID NO: 61539 - DNA, 201 bp, Homo sapiens
actgaagtgaaatatcaagtgagtattaccatcccaagcctctgaaccctaggtagagctctttaaatgcttagtctagctacagaatttgacagtgaatyttacagtcccacgtgttactttctagttatttttgttattcttgtcttcccaactaaattataagttccttaagggcaaggatcacatattatattttat

SEQ ID NO: 61540 - DNA, 201 bp, Homo sapiens
tcagcccccacagtgcttttctaagtgatcatagagccacctacttagacaaacactgaactaagcaaataggtgtttaacacagacttttattgctcacrctatgcattgactgcactggactctccaataagccaattgcttgagaagcagtgttgtgtgagagagccctggtgatcaggaagtttctccatttcactt

SEQ ID NO: 61541 - DNA, 201 bp, Homo sapiens
ttatctctatgtaatatttccctacagtccacctgaaagtctgaggggccattgtcctggcaagttttgcatgtatgaggatgttcacaatttgaaagaayagaatagttctgtatttcctccattattgctgaaacccgggactgttaggatttggaagatttgcaaaggaaggagccttagacacatgaaaaagttaaa

SEQ ID NO: 61542 - DNA, 201 bp, Homo sapiens
cacgatctcagctcactgcaacctctgcctcctgggttcaagcaattctcctgcctcagcctcctgagtagctgggactacaggtgcgtgccaccatgccyagctaatttttgtatttttagtagagatggggtgtcaccatgttggccaggatggtctcgatctcttgaccttgtgacccgcccgccttggcctcccaaa

SEQ ID NO: 61543 - DNA, 201 bp, Homo sapiens
agtcaaaccaattttaccttatctatgtccttgattctgttccttctctgtttcttctattacggctctagttcaggcatctctagtgtggactattgctrtacccttctaactggtctcctttactctctattttcttcccctttaccctcaaatccatctttcatactgctgccaaacttatttgtctaaaatatgaac

SEQ ID NO: 61544 - DNA, 201 bp, Homo sapiens
aaaagtcaaacttacagaaacagacagtagaatgatagctgccagggactggaggctgggtaatgaggagatgctgatcaaagagtgtaaactttcaggtrtaagatgaacagattctgggaatcaaaggtacagcacgggtggagatggatgtgttatttcatttgattatgtcaatcattgcacaatgtgcacatacat

SEQ ID NO: 61545 - DNA, 201 bp, Homo sapiens
ggaagttagcaggactcagtcaaaaagaggtctgggatcttttgcaaaactgggggcaattgatcttggtcggtaaaactgagaaaagtaaattgtttagwtgttgaatggggtctgggattccttggtctcactgactgaattcatactgctagtaactagaccctcaattcaattttcatactagaactcaggtccaaa

SEQ ID NO: 61546 - DNA, 201 bp, Homo sapiens
acttgtttatctgctgaccttccctccactattgtcccatgaccctgccaaatccccctctgtgagaaacacccaagaattatcaataaaaaaataaattaaaaaaaaaaaaaaaaagaatgcctgaactaagcaagtagaataatgaaatactttttaaaaacttcactgtatgcccaatataaagggaaattattaaca

SEQ ID NO: 61547 - DNA, 201 bp, Homo sapiens
ggaggatcacctgaggttgggagttcgagaccagcctggccaacatggagacactccatctctactaaaaatacaaaattatccgggcatgatggcgcacrcctgtaatcccagctactcaggaggctgaggcaggagaatcacttgaacctgggaggtggaggttgcagtgaggcgaggttgtgccattgcactccagcc

SEQ ID NO: 61548 - DNA, 201 bp, Homo sapiens
actatagttttccttaggtattaagtctattcatcaatatagcactaaagctttccaaaccattattttgagttacctgaaatccctggagaaattattaycttatttcattctaattttgttttacggcctttcatatgtaatcacttataggagaaaaacaatgagataaaaagttgataacatggtttgattgtacgc

SEQ ID NO: 61549 - DNA, 201 bp, Homo sapiens
ggcttgcagtcctagctactcgggcagctgagatgggaggatagtttgagcccaagagtttgaggctgtagtgagctatgatcataccactgcactccagyctgggcaaaagagcaagaccctgtctaaaaaaaaaaaaaaaaaatgctgggcgcggtggcttacaccaataatcgcaggactttgggaggctgatagggg

SEQ ID NO: 61550 - DNA, 201 bp, Homo sapiens
tttaccactgttgccaaagtgaagaagggaacgccctaggtagactgaattccttcttaaatgcaggaatctcctttgtaattatttctcacatgggaaaycagtttagtccactttttagacagcccttttataaaattctgccttgctttgaaacaaaaatctgcctccctgtaacttctagtttttaccattctcttt

SEQ ID NO: 61551 - DNA, 201 bp, Homo sapiens
attatgtatacataatatacatatataatatataatatattatgtatacataatatacatataatatataatatattatgtatacataatatacatataawatataatatattatgtatacataatatacatataatatataaatattatgtatacataatatacatataatatataatatattatgtatacataatatac

SEQ ID NO: 61552 - DNA, 201 bp, Homo sapiens
gtggtataatgatacatgtctaaatggctatgggactgttgaagaggaaatgcctaacagcctaaacctccacagagaagacactatttgaatcaagtttycagatgtatggaattgttcatgtattggaggaggaaagtgtgttagaggttggaaagttgctctcaatgacccaaaaaacatatgcaatggcacatttct

SEQ ID NO: 61553 - DNA, 201 bp, Homo sapiens
gggaaagtaagctgtatttattctttttttttttgagatggagtctcactctgtcaccaggctagagtgcagtggcatgatctcagctcaccgcaacctcygcctttaaggttcaagcaattcttctgcctcagcctcccgagtagatgggactacaggcatgtgccaccatgcccagccaatttttgtatttttagtaga

SEQ ID NO: 61554 - DNA, 201 bp, Homo sapiens
aaggaaggaaaaaaaagaaaggtattaattttaaaatgaaaaaaaagtcattacaaatcctattcattttttaaatcctgcctcaaatactatctccttcrtaccccattcacttagaattgtttctctaattcctaagctttggcaatgctttatgaattctattatagtattttacacatatcccttgtgttatagcta

SEQ ID NO: 61555 - DNA, 201 bp, Homo sapiens
catgttgtggctagtttgctcttttatctaggccactcaaatcatatcagcaataaggctgtttcactttttttctttacttttttcttctttctttcttkttgttgttgttgttgttgttgttgttgttgagacaggtctcactttgtcacccaggctggagtgcagtggcacaatctcagctcactgcaacctccgcct

SEQ ID NO: 61556 - DNA, 201 bp, Homo sapiens
acggactcagcccggctcagtggctcacgcctgtaatcccagcactttgggaggccgaggtgggaggatcacctgaggttgggagttcgagaccagcctgsccaacatggagacactccatctctactaaaaatacaaaattatccgggcatgatggcgcacacctgtaatcccagctactcaggaggctgaggcaggaga

SEQ ID NO: 61557 - DNA, 201 bp, Homo sapiens
ctcaagtgatcctcccatctcagcctacacggtgactacaggcacacaccaccactttttttttctttgtatttttagcagagatgggttttgccatgttrcccaagctgatctcaagctcctgagctcaagtgatcctcctacctccacctcccaaagtcctgggattataggcatgagccctcgtgttcagcccccaca

SEQ ID NO: 61558 - DNA, 201 bp, Homo sapiens
ctttattacatttggatgaggaaaattttcttatacaaaaacagtatagattgattatacggaaaagctgaataaaatgttctacctcaacataaaaaaawttcatatagaaaaactcactataaacaagactaaaggacaagtggaatttcataggcttatgcaaaggaagaaaaaataaaataaaagacaagtggaaga

SEQ ID NO: 61559 - DNA, 201 bp, Homo sapiens
aatgcttagtctagctacagaatttgacagtgaatcttacagtcccacgtgttactttctagttatttttgttattcttgtcttcccaactaaattataarttccttaagggcaaggatcacatattatattttatttatacagttggccctccatatccacagcttccacatctgcagattccaccaaccgtggatcaaa

SEQ ID NO: 61560 - DNA, 201 bp, Homo sapiens
gctggggtgcagtggcgtgacctctgctcaccacaacctctgcttctggggttcaagcaattctcctgcctcagcctcctgagtagctgggattacaggcrtgtgccaccacgcccgggtaattttgtatttttagtagagtcggggtttttccatgttggtcaggctggtctcaaactcccgacctcaggtgatctgcct

SEQ ID NO: 61561 - DNA, 201 bp, Homo sapiens
tcatgtgacaagttccaatttcttttcaagtcaattgaactgaaatctccttgttgctttgaaatcttagaagagagcccactaattcaaggactcttacygtaggagcaactgctggttctatcacgtatgtactctttgttctttttctcccatttggtcttcaaacactctgtgtttgtaacttgttctgcctgctag

SEQ ID NO: 61562 - DNA, 201 bp, Homo sapiens
caggaggtggaggttgcagtgagccaagattatgccactgcactccagcttgggcaaaagagtgagactccgtctcaaaaaacaacaacaacaacaacaacaaaaaaaaacacacaaaacagtgacttaattataattcaaaataattattagaccaagattttcactatttttaaccctaataacaaggttctagtcttc

SEQ ID NO: 61563 - DNA, 201 bp, Homo sapiens
gaggtggaggttgcagtgagccaagattatgccactgcactccagcttgggcaaaagagtgagactccgtctcaaaaaacaacaacaacaacaacaacaamaaaaaacacacaaaacagtgacttaattataattcaaaataattattagaccaagattttcactatttttaaccctaataacaaggttctagtcttcatt

SEQ ID NO: 61564 - DNA, 201 bp, Homo sapiens
ttgagttgattattgtatatggggtgacataagggttcaatttcatttttctgcatttggatagccagttttcccaatactatttattaaacagactatcytttccccattgtgtgttcttggcacctttgctgaaaattgattgaccataaagttgcaggttatttctgggctctatatcctattccattggtaaatgtg

SEQ ID NO: 61565 - DNA, 201 bp, Homo sapiens
aggtggaggttgcagtgagccaagattatgccactgcactccagcttgggcaaaagagtgagactccgtctcaaaaaacaacaacaacaacaacaacaaamaaaaacacacaaaacagtgacttaattataattcaaaataattattagaccaagattttcactatttttaaccctaataacaaggttctagtcttcattt

SEQ ID NO: 61566 - DNA, 201 bp, Homo sapiens
acaggaaattcacagaaaattcaaacggtcaataaatgtgtgaaaagatcctcaacctcattagtaattaggaaaatgcaaatttaaaagatgatagttcrtcttgctcccaccccacccaggtaatcattctcaattggatatatttgagtgtatccttttttccatgaatatactaacacatacacacacacacacaca

SEQ ID NO: 61567 - DNA, 201 bp, Homo sapiens
tgtgaaaagatcctcaacctcattagtaattaggaaaatgcaaatttaaaagatgatagttcgtcttgctcccaccccacccaggtaatcattctcaattrgatatatttgagtgtatccttttttccatgaatatactaacacatacacacacacacacacacacacacgcatattactaaactatacatatagtatata

SEQ ID NO: 61568 - DNA, 201 bp, Homo sapiens
cagtggcataatcatggctcactgcagccttgtcctcctagactcaagcaattctcccacctcaccctccccctcagctgggactacaagcatgcaccacyatgcccagctaattaaaaaaaatttttttgcagagacagggtctcactatattgcctaggctggtcttgaactcctggcctcaagtgatcctcccgcctc

SEQ ID NO: 61569 - DNA, 201 bp, Homo sapiens
tttgaggtttggattggtgaactcagctagaaaacatacttgcatttgcccgaataatgaataaccaagaaaaaaactgacaaacgattttctgcaaactraagcaaagcatttaggccggggagggagagtttgtaacctgactccttccacctttagcgagttggagcttgtgcgagttctttccactctgtgtatttc

SEQ ID NO: 61570 - DNA, 201 bp, Homo sapiens
aggtagaagaattgctctcgtttgtctgtccattcatcctcctctcctcactttatctatcccacgcgacttcagggtagactcctgctggcaggcaggakcataagtccgcggacagaacggaggcctggagtggaggaatgtggtttgaggtttggattggtgaactcagctagaaaacatacttgcatttgcccgaat

SEQ ID NO: 61571 - DNA, 201 bp, Homo sapiens
cgtcggcggcacgtgcggggtcgtggacgacgagccccggccgactgggaaagcggagaccgaagacgaggacgaagggactgagggcgaggacgaagggsctcagtggtcgccgcaggacccggcactgcaaggcgtaggacagcccacaggtagaagaattgctctcgtttgtctgtccattcatcctcctctcctcac

SEQ ID NO: 61572 - DNA, 201 bp, Homo sapiens; identical to SEQ ID NO: 11917

SEQ ID NO: 61573 - DNA, 201 bp, Homo sapiens; identical to SEQ ID NO: 11919

SEQ ID NO: 61574 - DNA, 201 bp, Homo sapiens
aatgtttttccaattcacattttgcttataaatatacatatatgtcctatgtatatatttgcatattaccacaaatgcctgatgagtgctaatctttaaawaaaagagaaaaagtaagtggattaaatgttcttctgagcatagatggagtttttcagcttagtagttggcaactccaacatccatgtctctgttgaagcg

SEQ ID NO: 61575 - DNA, 201 bp, Homo sapiens; identical to SEQ ID NO: 11920

SEQ ID NO: 61576 - DNA, 201 bp, Homo sapiens
ttgtaaaaaaatatcaggatcagttactagtgcaaagtaagttttaaaacacctatttgcagaccttataatttaaatgggcctttcaacaggtctgggaraaaaatatgtctcataaaagattaatgtgtttttaggctaaataatctaattagccaatgaatcagagatttatgcctgtttttgtcacctgcagacctg

SEQ ID NO: 61577 - DNA, 201 bp, Homo sapiens
gggccctcacaaagtcgtctctggtgaagaggtggcgtgcggggtgggggttggtggagggtgaaggcataagcaaacatattttaaaatccagatcgtargaagtgtcacctggcccctcacccaggcatgctttctgggggaagcgcagggccaagctttccctagaaaagctggggcgaagagagagcaggcggcggc

SEQ ID NO: 61578 - DNA, 201 bp, Homo sapiens
aaagaagttggaaagcatccggaaaagaaagcttgtaagagggacgtgtgggagaactagaagggacgcttctggctggggccaactgaagtggggaagayctggggaggagcgaggaaaggacccagatctacttggagccaaccaagagaccggacgggagtggggcggaaaggcggagaccagttcgagcactaacgc

SEQ ID NO: 61579 - DNA, 201 bp, Homo sapiens
ttttaaggtggaaattttttattgctggaaaattcctatttataattaaaacaaaactttactggaaacaacatcattccaaagtctgacaatataattayctcctacacaattagataggttaaaatgtcaaaacagttgattaaaagttatgagtcagagtcatttctaagcccccagtttgactctcgctatgacatc

SEQ ID NO: 61580 - DNA, 201 bp, Homo sapiens; identical to SEQ ID NO: 11935

SEQ ID NO: 61581 - DNA, 201 bp, Homo sapiens
gcccattcaaatcaaggagcaaaaattggattatgaaactcactacaagaaccccatattacatgtcacttttactagtgccttgtacaaatttactcctrtggtcttgtttctacattcaaatgtttttccaattcacattttgcttataaatatacatatatgtcctatgtatatatttgcatattaccacaaatgcct

SEQ ID NO: 61582 - DNA, 201 bp, Homo sapiens
aaaaagcgcaattccctccttatgctctagggaattgagccgcgtcccagatcacccattccagaaatgtgaaaccgggccctcacaaagtcgtctctggkgaagaggtggcgtgcggggtgggggttggtggagggtgaaggcataagcaaacatattttaaaatccagatcgtaggaagtgtcacctggcccctcaccc

SEQ ID NO: 61583 - DNA, 201 bp, Homo sapiens
tgtgaaacttttgcaaattcttaacttgaactattaagaataaaaaaggaaaggaaagaaaaaaaaaaaaaaaacaccaagtcgcacatcatttgttgtaraccatcgccaccttgtgtttggagaaagatgtactaaagtctgagaatcttttaaggtggaaattttttattgctggaaaattcctatttataattaaaa

SEQ ID NO: 61584 - DNA, 201 bp, Homo sapiens
actgacaaacgattttctgcaaactaaagcaaagcatttaggccggggagggagagtttgtaacctgactccttccacctttagcgagttggagcttgtgmgagttctttccactctgtgtatttctttttaatgattttgtgtgcgccttttgtgcgggttgcaacgttgcgctgagttttgtaaccgctgcctgtgcgt

SEQ ID NO: 61585 - DNA, 201 bp, Homo sapiens
ataacatatgaatcagtgaaacaaataagaacacataaggtgtaaatagaaattgacaccttgatgcttatctctcactttaaaatgcagacaacttgttytttttttcagacagtccctctgttcatagaggacaataatgtgtttaataggtcaaactgttaattgttccaataattttatgtcaaatgttttgagttt

SEQ ID NO: 61586 - DNA, 201 bp, Homo sapiens
aaagctttccagccagtgtttccagcagcaagcatcctaacccaggcctcggaatctgaagatacagtgctcaaatatcagtgcttctgagctactaaccrttgtaattgcccaagtagatggccaatgaattgcaataattcataattcagtttttggttattaataagatttattgtatcttacacaaaagagcattat

SEQ ID NO: 61587 - DNA, 201 bp, Homo sapiens
accatatgtcatatttacaaaattataaaagaatttgctcaaattatattgggagttaacaaagaatataattttattcttgagtttggtaattagataamtatagatgaatgatatttcttgaaaacaaacacacacaaaagtcttttcatggaaagagaactcacatgaaacccataaagtaaagaatggaaagcaaag

SEQ ID NO: 61588 - DNA, 201 bp, Homo sapiens
ataaaaataattccagtacaaaaccatatgtcatatttacaaaattataaaagaatttgctcaaattatattgggagttaacaaagaatataattttattmttgagtttggtaattagataactatagatgaatgatatttcttgaaaacaaacacacacaaaagtcttttcatggaaagagaactcacatgaaacccata

SEQ ID NO: 61589 - DNA, 201 bp, Homo sapiens
tagaagaaataaaagaggtcaacttctacagctcaagacaatgagatgtgcagatttgtagatgtgaagggaaaagaaaaaaccatcatggatgactccaragatctgtattgttcttctgtttttttgtttttgtttttgttttgggtggggagatattttgtgcaacttatatgtgtgctgtgttctacctagagatca

SEQ ID NO: 61590 - DNA, 201 bp, Homo sapiens
ttgccataattgcaataaacagcaatggtgggctgagctagggtgatagctatagaagaaataaaagaggtcaacttctacagctcaagacaatgagatgkgcagatttgtagatgtgaagggaaaagaaaaaaccatcatggatgactccaaagatctgtattgttcttctgtttttttgtttttgtttttgttttgggt

SEQ ID NO: 61591 - DNA, 201 bp, Homo sapiens
cagtatgtttgcattttgctcagagtaagatggggagcgaaaggaactgagcacaggagagacatgcttacctaacattttaattggaagccattgtagargaggacccaatagaagaccattgccataattgcaataaacagcaatggtgggctgagctagggtgatagctatagaagaaataaaagaggtcaacttcta

SEQ ID NO: 61592 - DNA, 201 bp, Homo sapiens
tgttccactaaagtaggcagtatgtttgcattttgctcagagtaagatggggagcgaaaggaactgagcacaggagagacatgcttacctaacattttaaytggaagccattgtagaagaggacccaatagaagaccattgccataattgcaataaacagcaatggtgggctgagctagggtgatagctatagaagaaata

SEQ ID NO: 61593 - DNA, 201 bp, Homo sapiens
atatttctgtgacatgggtgaactcatatgacattggcagaaagtgagtgatgtcattaaagatggaagatgttttggttcatctacgtgttttctcaacraagtaaattatgctttctcataggaacagcagaacataaaatatagtaactcatgaacacagcaagtcacagaggaattcagaaccatacgcaatgccca

SEQ ID NO: 61594 - DNA, 201 bp, Homo sapiens; identical to SEQ ID NO: 11930

SEQ ID NO: 61595 - DNA, 201 bp, Homo sapiens
aagattgcgtgtgctgggactatcaaggaaattaagcaaagatatcatagtagggaaatgtagtctgttctgccatgcacatatttctgtgacatgggtgractcatatgacattggcagaaagtgagtgatgtcattaaagatggaagatgttttggttcatctacgtgttttctcaacgaagtaaattatgctttctca

SEQ ID NO: 61596 - DNA, 201 bp, Homo sapiens
gaatcaaattaatttctggttatttttttttcctacctactagactaaaggactgaaagttaaagtcatcttctcacattgtgggaactagtcttgctccyccagaactcatttaaacgcagaatttaatcattcaattcagtggcctaacttgccacttgcaacaacaacctctcacaataaattatttgtctacattag

SEQ ID NO: 61597 - DNA, 201 bp, Homo sapiens
  misc_feature (1)...(201): n = A,T,C or G, or insertion/deletion polymorphism (see Tables 1-2)
accaacatcgaagtgaaacagcggaaccagaggggatccaggaacaatggcagctttcttgccatcaaagctgctgatggcacatatattcttaatggtgnctacactttgtccaccttagagcaagacattatgtacaaaggtgttgtcttgaggtacagcggctcctctgcggcattggaaagaattcgcagctttagc

SEQ ID NO: 61598 - DNA, 201 bp, Homo sapiens
gtaagttttaaaacacctatttgcagaccttataatttaaatgggcctttcaacaggtctgggaaaaaaatatgtctcataaaagattaatgtgtttttargctaaataatctaattagccaatgaatcagagatttatgcctgtttttgtcacctgcagacctggatatcatgatatcatcacaattccaactggagcca

SEQ ID NO: 61599 - DNA, 201 bp, Homo sapiens
gcaataagattttgttctagaggaaggtgaagcaagagggctgaatagaagatttttttctaatgagatgtatttcttatatccttggtatacatgattgytaaaaagaaagaaatttatgatgtcatttgttactaatgtatctaataatatacatcagtggttggcaaacttcttttgtaaaaagccaaatggtaaata

SEQ ID NO: 61600 - DNA, 201 bp, Homo sapiens
atgcagcagtcagaatgccagaattcaaatgtggattacgtggctctccaccactagctcccagggtattaagtgcagggaacaggaagacccccagcctytatgcttagacattgtgccactttagaatagtgtccaactctaatcctttcaacaatcttgtccaattatgtatttagagagattgtctaggcctttcca

SEQ ID NO: 61601 - DNA, 201 bp, Homo sapiens
taccagatttcctcatttcatggctacttgttgaatacttactttggtatagacgtcgtgaaaattgtgaatagaatattgtgtctataacatatgaatcwgtgaaacaaataagaacacataaggtgtaaatagaaattgacaccttgatgcttatctctcactttaaaatgcagacaacttgttctttttttcagacag

SEQ ID NO: 61602 - DNA, 201 bp, Homo sapiens; identical to SEQ ID NO: 11918

SEQ ID NO: 61603 - DNA, 201 bp, Homo sapiens
attatgccctcaagaataaattcatttaacattgtaatatttttaaaatattttccataatactaggaggtaggagaatatttaattagaatttattaaayatgattgagaagatgtgaaacttttgcaaattcttaacttgaactattaagaataaaaaaggaaaggaaagaaaaaaaaaaaaaaaacaccaagtcgcac

SEQ ID NO: 61604 - DNA, 201 bp, Homo sapiens
tggcctccagccaggaggtggcacttgcaaaagaatgccaactgtgttggtagttttgggattcgtgcttgccttatgttaccatgggtaggggagtcggsgggaagggagtggcgtactctggtatttcaggcaatgtgcagggccatggagctcccaggagtctctgtccattgtatcacactaccagggcagatgaag

SEQ ID NO: 61605 - DNA, 201 bp, Homo sapiens
gcccagattccacctctgtctgtgtgcaaggacagtgtgtaaaagctggttgtgatcgcatcatagactccaaaaagaagtttgataaatgtggtgtttgygggggaaatggatctacttgtaaaaaaatatcaggatcagttactagtgcaaagtaagttttaaaacacctatttgcagaccttataatttaaatgggcc

SEQ ID NO: 61606 - DNA, 201 bp, Homo sapiens
aagaagtttgataaatgtggtgtttgcgggggaaatggatctacttgtaaaaaaatatcaggatcagttactagtgcaaagtaagttttaaaacacctatytgcagaccttataatttaaatgggcctttcaacaggtctgggaaaaaaatatgtctcataaaagattaatgtgtttttaggctaaataatctaattagcc

SEQ ID NO: 61607 - DNA, 201 bp, Homo sapiens; identical to SEQ ID NO: 11922

SEQ ID NO: 61608 - DNA, 201 bp, Homo sapiens; identical to SEQ ID NO: 11923

SEQ ID NO: 61609 - DNA, 201 bp, Homo sapiens
tggagcaagtcatgtcttgcgtggatggcggctggcaaagagagagagcctgtgcaggggaactcctctttataaagccatcagatctgatgagacttatycactatcacaacaacagcacagaaaagacccgcccccatgatgcatttacctcccactgcatcccacaacacacaggaattatgggaactacaattcaag

SEQ ID NO: 61610 - DNA, 201 bp, Homo sapiens
acagtgttctactagcagcagctagctgggttccagacagcctgcactcagaattccaaactgccccaggccagaagcattctgggctgagagagaaactscggctttcaggccacacctcttctggtcctccagcaaagcgtgggcatccagcttctgtgcctgtggctatagcacagttcccacttgactctcaattct

SEQ ID NO: 61611 - DNA, 201 bp, Homo sapiens; identical to SEQ ID NO: 11926

SEQ ID NO: 61612 - DNA, 201 bp, Homo sapiens
ggcaagtttgctgtttggctccccacttgtgagtacaagcagcagccccagtggtgatcagagggcaactccctgcctgctggggtaatgttacagggagragtatagctgcctctgctgtacaaatgaatccacatggggagtcgggggtagcaggtggcagtaagccccactcagcccccacacacttggcaaggcagg

SEQ ID NO: 61613 - DNA, 201 bp, Homo sapiens; identical to SEQ ID NO: 11927

SEQ ID NO: 61614 - DNA, 201 bp, Homo sapiens
taccatgggtaggggagtcggggggaagggagtggcgtactctggtatttcaggcaatgtgcagggccatggagctcccaggagtctctgtccattgtatyacactaccagggcagatgaaggggcaaagccaggtggggactgggtcaggcaagtttgctgtttggctccccacttgtgagtacaagcagcagccccagt

SEQ ID NO: 61615 - DNA, 201 bp, Homo sapiens
aagcccccagtttgactctcgctatgacatcttgggaaaactacttaacccttttgagtctcatttctgcatcagttacacaaagggagtcgatctggcaratcatactcctctgagttctgtgagggcatgatgtggagggaatatcaattttgagtctaaatgcaagctacaataatttttctgtctccaatatttgca

SEQ ID NO: 61616 - DNA, 201 bp, Homo sapiens
ttagtgcagtacaaatccccacagtaagtgacatggaggatatacatgagaaatgccctgaccctcattaactatacatgccatttgagaaaatgagatayataaatctaaaatgatagctcataagattaaaaagtcacttttagatcttgcctcattcaccagaattcttttctttttaatagcttagattgatttgat

SEQ ID NO: 61617 - DNA, 201 bp, Homo sapiens
ctactttcattgaccttagctggaggagacataggtcaatagataaataatttttaaaaatatctaatttcttcagatgtctatacgtagtactgaaaaayatgccaaagtgaagggtaaatgcatgaaatgcataatgtgtagagggtactgtgtttaattagcatggtcaggaaagtagagagaaaatgtttacactta

SEQ ID NO: 61618 - DNA, 201 bp, Homo sapiens
tgagaatcttttaaggtggaaattttttattgctggaaaattcctatttataattaaaacaaaactttactggaaacaacatcattccaaagtctgacaayataattacctcctacacaattagataggttaaaatgtcaaaacagttgattaaaagttatgagtcagagtcatttctaagcccccagtttgactctcgct

SEQ ID NO: 61619 - DNA, 201 bp, Homo sapiens
aggaaggaaacctgaggcacaaatattgaatctgaagaccgaattattttcttaaattatttggcaataagattttgttctagaggaaggtgaagcaagasggctgaatagaagatttttttctaatgagatgtatttcttatatccttggtatacatgattgctaaaaagaaagaaatttatgatgtcatttgttactaa

SEQ ID NO: 61620 - DNA, 201 bp, Homo sapiens; identical to SEQ ID NO: 11929

SEQ ID NO: 61621 - DNA, 201 bp, Homo sapiens
cccgaggccttccacgtggagcctgatgatctcattcaggatttgagccctcgcctgtgaaagagtgactcagggcctctgcctgccactcttgctccaakattttactacaattgggtaggattatgtgcgaaattgccttgttcagactgtgggatttcaaagagaacagaagaaatcctgctcacacacagaaagatc

SEQ ID NO: 61622 - DNA, 201 bp, Homo sapiens
agcccaggccctacccgaggccttccacgtggagcctgatgatctcattcaggatttgagccctcgcctgtgaaagagtgactcagggcctctgcctgccrctcttgctccaagattttactacaattgggtaggattatgtgcgaaattgccttgttcagactgtgggatttcaaagagaacagaagaaatcctgctcac

SEQ ID NO: 61623 - DNA, 201 bp, Homo sapiens
ttgaactccttttcttttacattaattggcaactgcctgctttgagtttagtgttttcagttatgaatgaagcttaaatctaacacttcacatgcttgcarttgctcgctattactcttttatatgcaaagaaaagctttttggacagtcaagcgctcctctgtgcgactaggcttcacatacagctcatagttagataca

SEQ ID NO: 61624 - DNA, 201 bp, Homo sapiens
gcagaggagcaatggtgacctgggaaggtaccctgagcggctacgctaggatctctgttctgcagacttctgtcccctttcccccttataaggctgacccrggcgggctgaaggcggtggggccccttcgcagaacctgcttgggaggtctttcccgggtttgccccgcctcccagtttgcactccctctcgcggccataa

SEQ ID NO: 61625 - DNA, 201 bp, Homo sapiens
atccatattttattttattattattttttttgagatggagtctcactctgtctcccaggctggagtggagtggcacaatctcggctcactgcaacttctgyctcctgggttcaagcgattctgctacctcagcatgcccagtagctgggattacaggtgcatgccaccacacccggctaatttttgtatttttagtagaga

SEQ ID NO: 61626 - DNA, 201 bp, Homo sapiens
agtattattttgtcagaggcagttttctttctttaaagtttaattggatttttgtttatggtaatacaaacacataattaaaaagtagttgatttaaaaamgcattttattatgccctcaagaataaattcatttaacattgtaatatttttaaaatattttccataatactaggaggtaggagaatatttaattagaatt

SEQ ID NO: 61627 - DNA, 201 bp, Homo sapiens
ccgctgcctgtgcgtgcatcctgcgctcacgggagggcggatgtggagagggcagaggagcaatggtgacctgggaaggtaccctgagcggctacgctagkatctctgttctgcagacttctgtcccctttcccccttataaggctgacccaggcgggctgaaggcggtggggccccttcgcagaacctgcttgggaggtc

SEQ ID NO: 61628 - DNA, 201 bp, Homo sapiens
ttttttgagatggagtctcactctgtctcccaggctggagtggagtggcacaatctcggctcactgcaacttctgcctcctgggttcaagcgattctgctrcctcagcatgcccagtagctgggattacaggtgcatgccaccacacccggctaatttttgtatttttagtagagacggggtttcactatgttggccatgc

SEQ ID NO: 61629 - DNA, 201 bp, Homo sapiens
ggttgcaacgttgcgctgagttttgtaaccgctgcctgtgcgtgcatcctgcgctcacgggagggcggatgtggagagggcagaggagcaatggtgacctrggaaggtaccctgagcggctacgctaggatctctgttctgcagacttctgtcccctttcccccttataaggctgacccaggcgggctgaaggcggtgggg

SEQ ID NO: 61630 - DNA, 201 bp, Homo sapiens; identical to SEQ ID NO: 11932

SEQ ID NO: 61631 - DNA, 201 bp, Homo sapiens
catctcctagattggggaagagggaactgagggaggagggaaggagacccagggcagctccaggatagggaaatgttgaagaagggactgcgttctccaaycgaaccctccctcctgggaaccgcagcccagcgcggtaactgagttaccgcaaccgggcggtggggaggaagggtggtccaggaaaccggcgagggagaa

SEQ ID NO: 61632 - DNA, 201 bp, Homo sapiens
ggcttccctgaagccacaaagtaaggatgcagcagtcagaatgccagaattcaaatgtggattacgtggctctccaccactagctcccagggtattaagtrcagggaacaggaagacccccagcctctatgcttagacattgtgccactttagaatagtgtccaactctaatcctttcaacaatcttgtccaattatgtat

SEQ ID NO: 61633 - DNA, 201 bp, Homo sapiens; identical to SEQ ID NO: 11933

SEQ ID NO: 61634 - DNA, 201 bp, Homo sapiens; identical to SEQ ID NO: 11934

SEQ ID NO: 61635 - DNA, 201 bp, Homo sapiens
ctgagttgcttctctctgccattcttgctcatttgatttttcctgatgagtggaaagcaatgtttttgtttttgtttttcaagtaagcaatctcgctaggwaaaaagaagttggaaagcatccggaaaagaaagcttgtaagagggacgtgtgggagaactagaagggacgcttctggctggggccaactgaagtggggaa

SEQ ID NO: 61636 - DNA, 201 bp, Homo sapiens
aagcaatgtttttgtttttgtttttcaagtaagcaatctcgctaggaaaaaagaagttggaaagcatccggaaaagaaagcttgtaagagggacgtgtggragaactagaagggacgcttctggctggggccaactgaagtggggaagatctggggaggagcgaggaaaggacccagatctacttggagccaaccaagaga

SEQ ID NO: 61637 - DNA, 201 bp, Homo sapiens
tgagactgtcctcttaggagtctacgttgtaccaaaaagatatatacaaggcatttcaccagtgtttttgcagttaaccttttttaattggctagcatggkttatcttactcatttctactgtaatttaaatatctcaagtttcacagttctattttaaaagcattagaaaaaagcttgattaaagtcacatgaagtcttc

SEQ ID NO: 61638 - DNA, 201 bp, Homo sapiens
tatgacatcttgggaaaactacttaacccttttgagtctcatttctgcatcagttacacaaagggagtcgatctggcagatcatactcctctgagttctgygagggcatgatgtggagggaatatcaattttgagtctaaatgcaagctacaataatttttctgtctccaatatttgcaatacttctgggtatataacctg

SEQ ID NO: 61639 - DNA, 201 bp, Homo sapiens
tatatacaaggcatttcaccagtgtttttgcagttaaccttttttaattggctagcatggtttatcttactcatttctactgtaatttaaatatctcaagkttcacagttctattttaaaagcattagaaaaaagcttgattaaagtcacatgaagtcttcttatgtcaacaataatgaatgtagatgctccaaagcatat

SEQ ID NO: 61640 - DNA, 201 bp, Homo sapiens
atggtttatcttactcatttctactgtaatttaaatatctcaagtttcacagttctattttaaaagcattagaaaaaagcttgattaaagtcacatgaagkcttcttatgtcaacaataatgaatgtagatgctccaaagcatatgtgaaggcacaccctgccaaaaaagttagatcccaagggtcatgctccccttatta

SEQ ID NO: 61641 - DNA, 201 bp, Homo sapiens
ttagataattctaatgctgatgatttatgtctccatttagacgccttttcatggaagctggggaatgtgggggccttggggagactgttcgagaacgtgcrgtggaggagtccagtacacgatgagggaatgtgacaacccagtcccaaagaatggagggaagtactgtgaaggcaaacgagtgcgctacagatcctgtaa

SEQ ID NO: 61642 - DNA, 201 bp, Homo sapiens; identical to SEQ ID NO: 11925

SEQ ID NO: 61643 - DNA, 201 bp, Homo sapiens
ataaagaatgagtaagtgaatggacatggctgtgttctaaaaaaactacttgcaaaaacaaataatgggtcagatttgttctgcagattcagtttgccaaccctggtatataccataaattaaatggaaagagctttcagttctggatgctttttgaatttgtatctcttcctcaattatatcccataagtaaaaatacgt

SEQ ID NO: 61644 - DNA, 201 bp, Homo sapiens
ccggcgagggagaaaagcggtggaagggagagtcttctccctggagcggccccagcagtacaaagtgctggtcacagcgccccttccgcccctagattgasgagcagtggcgtggagccagcgcggaggctgccccctccccctcccgagcccgcagcgcggagcgcggtttagcaccaacggagccgggggcggcgtctt

SEQ ID NO: 61645 - DNA, 201 bp, Homo sapiens
ggaactcctctttataaagccatcagatctgatgagacttatccactatcacaacaacagcacagaaaagacccgcccccatgatgcatttacctcccackgcatcccacaacacacaggaattatgggaactacaattcaagatgagatttggtggggacacagccaaaccatatcacaggtattacaatatagcatgct

SEQ ID NO: 61646 - DNA, 201 bp, Homo sapiens; identical to SEQ ID NO: 11928

SEQ ID NO: 61647 - DNA, 201 bp, Homo sapiens
actccctgcctgctggggtaatgttacagggaggagtatagctgcctctgctgtacaaatgaatccacatggggagtcgggggtagcaggtggcagtaagycccactcagcccccacacacttggcaaggcaggtctcgcatccacagtgttctactagcagcagctagctgggttccagacagcctgcactcagaattcc

SEQ ID NO: 61648 - DNA, 201 bp, Homo sapiens
tgtgttcttgtctccataattcagaaacctgaatttttctttacagccccttctagcagccatattgcctttatgtaagggtaggtttctaaaagtacagttttttttttttgaaatttagcatgttttgttagctagggtagtttctttttatttaggattactattgtcttatgttctgctgctcttaagagaagtaca

SEQ ID NO: 61649 - DNA, 201 bp, Homo sapiens
acatcttgggaaaactacttaacccttttgagtctcatttctgcatcagttacacaaagggagtcgatctggcagatcatactcctctgagttctgtgagkgcatgatgtggagggaatatcaattttgagtctaaatgcaagctacaataatttttctgtctccaatatttgcaatacttctgggtatataacctgttta

SEQ ID NO: 61650 - DNA, 201 bp, Homo sapiens
ttatccttcaagtcaggattgttgtcatctccattttacatatgaggaggctgaggctcagggatgatccatggcttccctgaagccacaaagtaaggatrcagcagtcagaatgccagaattcaaatgtggattacgtggctctccaccactagctcccagggtattaagtgcagggaacaggaagacccccagcctcta

SEQ ID NO: 61651 - DNA, 201 bp, Homo sapiens
ttgtcaagtattaatgtatactaaacatactgtatgtacttaatatctattgaataaatgaatgagtttttaatctgttttagtggattgcaaatgtactyaatcttttcatttgaatgacaagaagttctcaaatgtaatgaataaaagcggtccacagtattattttgtcagaggcagttttctttctttaaagtttaa

SEQ ID NO: 61652 - DNA, 201 bp, Homo sapiens
tactggaaacaacatcattccaaagtctgacaatataattacctcctacacaattagataggttaaaatgtcaaaacagttgattaaaagttatgagtcaragtcatttctaagcccccagtttgactctcgctatgacatcttgggaaaactacttaacccttttgagtctcatttctgcatcagttacacaaagggagt

SEQ ID NO: 61653 - DNA, 201 bp, Homo sapiens
ctcctctgctcctgggagcaaagtggtcgcagcccagtttaggactttctgcaggggttgggtctcagtccggagtggaaggctctgttccaaataatcartcatgcctggaagctggaacttatttcgctggggcagtgggagtggggccagaggctgctgggcagagtgggtggtccttgtgcccggaattggcaagag

SEQ ID NO: 61654 - DNA, 201 bp, Homo sapiens
ttgattattcaacgttcaacgatgagggtgattttaggaaaccaaaattaaatctacgaaaccacccactcctaaatgtgtagggactagaggtcgttacyaagcccttcagaagtaagctgagttgcttctctctgccattcttgctcatttgatttttcctgatgagtggaaagcaatgtttttgtttttgtttttcaa

SEQ ID NO: 61655 - DNA, 201 bp, Homo sapiens
acgttgcgctgagttttgtaaccgctgcctgtgcgtgcatcctgcgctcacgggagggcggatgtggagagggcagaggagcaatggtgacctgggaaggyaccctgagcggctacgctaggatctctgttctgcagacttctgtcccctttcccccttataaggctgacccaggcgggctgaaggcggtggggccccttc

SEQ ID NO: 61656 - DNA, 201 bp, Homo sapiens
caataagaataccctgcaggtagaaacacactaaaggtcaaacttacgttaacatatttttaaaagctaaagtttatgtagagaagttgatagactgaaayacattacatatgtctttaaagatacagattttctgctgtttttgtccctttttgccccaatttaagggaatcacatctaccttcactcatcttcattcag

SEQ ID NO: 61657 - DNA, 201 bp, Homo sapiens
aataaccaagaaaaaaactgacaaacgattttctgcaaactaaagcaaagcatttaggccggggagggagagtttgtaacctgactccttccacctttagsgagttggagcttgtgcgagttctttccactctgtgtatttctttttaatgattttgtgtgcgccttttgtgcgggttgcaacgttgcgctgagttttgta

SEQ ID NO: 61658 - DNA, 201 bp, Homo sapiens
gcctggccctggcctggccctggccttctccagacagccctgtccaccccaaagcccagccaccctgggcctgcagcaggcctgtggagttctcagttgcrtggggaccagagggtgctggagaaacaaaccagacgcagctgaaggcagtcagggcagggcgcaatcagcgataagagctgcataggggccacagcgtaa

SEQ ID NO: 61659 - DNA, 201 bp, Homo sapiens
tcctccttcccagctgtttccaatttcaaagtgaactcgaccttgtggctccaggagatgcagcagggacagtgttaaatcggctttcaccagcccacacrgccaggcatcctcctcggccctcctgggcactgggtggacaccactggctgtggcctggccctggcctggccctggccttctccagacagccctgtccac

SEQ ID NO: 61660 - DNA, 201 bp, Homo sapiens
gcctgagggtttgcgcttatcggcgacatcagcctgcacttttcttttctcgtgatctctctggttctggcctcagggtgacgtgggcctcgtagggtccygtggtggctcctccccagacggtgacatggagtgagcccattctccctcctgggagtgggtcactcaggccaccagagcaccacagggaaagcagccagg

SEQ ID NO: 61661 - DNA, 201 bp, Homo sapiens
cccccacagcttccccgtctcctccaggccccacagacactgatgaatggacagagacccccaaaaccagctgccccttgcatgtctgtctccatatgttkggtgacagcagtgaaaatgttattagttttgagggggtttgggaagcccagcggtacctgaggagtttctggacatttaagccggttcctaggtgtggcc

SEQ ID NO: 61662 - DNA, 201 bp, Homo sapiens
ctctttagcctatcattgtagttgggagttagttagcccgttgagcgtcattgaatttccagtgttgagccagccctgcgtgcccgggataaacccacctsgccgtggtgtgtggccctgtttatgcacgtgggccctgattcgctgatgcctgcctgagggtttgcgcttatcggcgacatcagcctgcacttttctttt

SEQ ID NO: 61663 - DNA, 201 bp, Homo sapiens
ggagaaacaaaccagacgcagctgaaggcagtcagggcagggcgcaatcagcgataagagctgcataggggccacagcgtaacctgagctccagtcggtgkaaagaaaaggcagagacgttgcagaggccaggtctgctcaggggaagacagttctgggtgtagaggactcacatcccagagaggctgaggaagggtttac

SEQ ID NO: 61664 - DNA, 201 bp, Homo sapiens
tagaagatggatgaatggatggattgctggatgagtgggtgggtggatggataagtggatacatgggtgaatgagtagatgtatgggtgagtaggtgggtrggtgggtagatggatgggtgggtgggcgagtgtgtggttagatgatggatggctgaatggatgagtggggggatggatgggtgagtgggtgtatgtatgg

SEQ ID NO: 61665 - DNA, 201 bp, Homo sapiens
gcgaccccaacatagcatcccctccagagtcccctcccccaaaagatgcctccacatagcatccccctcagagttcctacacacagcattccccaagggtyccctccccaatgtcctccccacagttatcccccagaaggtgctctgtgcctccaaatccctagcctggccaagggtttaaccagggctgcaggttggtct

SEQ ID NO: 61666 - DNA, 201 bp, Homo sapiens
gaaggggcttcctcccaggaagtggatgaggtcctacccatgtgtgggtggcctcagggggaccgagagaccccgtgctcagagcggcagctacaggcacygggaaggagctatgggtgaaacaggcgactgttgcaggtcccccgggacagacggggttcttcctcccaggcccccttccccaacccccggccacacccg

SEQ ID NO: 61667 - DNA, 201 bp, Homo sapiens
ccggccaccagctccccttgacatcaggtgaaggggcttcctcccaggaagtggatgaggtcctacccatgtgtgggtggcctcagggggaccgagagacmccgtgctcagagcggcagctacaggcaccgggaaggagctatgggtgaaacaggcgactgttgcaggtcccccgggacagacggggttcttcctcccagg

SEQ ID NO: 61668 - DNA, 201 bp, Homo sapiens
ggggaagcagaccagagcccaccggcaagggtagaacgtcagccccgccctagtgggacagacaagagagaagcctcctcacaccaggaggcagtatagcsggagccttccctccagggctctcaggagagcctgtgctggttcatgaaaaagtgaggcctctgggctttgctgctgcagagtgaggtcagagcccacagg

SEQ ID NO: 61669 - DNA, 201 bp, Homo sapiens; identical to SEQ ID NO: 11980

SEQ ID NO: 61670 - DNA, 201 bp, Homo sapiens
ccacgtgacctcaggggtgatgctgaagggctgtgtggtaaaaccccggccaccagctccccttgacatcaggtgaaggggcttcctcccaggaagtggaygaggtcctacccatgtgtgggtggcctcagggggaccgagagaccccgtgctcagagcggcagctacaggcaccgggaaggagctatgggtgaaacaggc

SEQ ID NO: 61671 - DNA, 201 bp, Homo sapiens
cgcctaggacgcccctggagaagggaccttccctttggggtcggaacccagaaaggaggggcctgcgatccgcggagctccttgttcttgggataacacakctctggcttggaggcccccttgcacttcgactctggtgattatttcaagaaaggccagaccgggcacggtggctcacgcctgtaatcccaacacttgggg

SEQ ID NO: 61672 - DNA, 201 bp, Homo sapiens
ccccaggagcagcagtttctgcaggagctcctgacccggggcctctcgcgggaggcctgagcaagccggacacaggacacggggtaggggaggggtggggsggctgatggggggaaccctgcaccccccagggcagctgctaccaaggggcgagtcccagggcccccgtcggccctgcgtgcggggcgcggtccccaacac

SEQ ID NO: 61673 - DNA, 201 bp, Homo sapiens
ctccccagcatcccagggttcctgatctcctggataaggatacaagtcaccacactggactggggctcagcctgctctagaatacctcacctaagtcacastggaccaggctcagcctgctctaaggtgagcttacccgagacactggaccagagatcagcctatcctgggataagctcacccgagtcacactggaccagg

SEQ ID NO: 61674 - DNA, 201 bp, Homo sapiens
aaggaacagaagcacctcgataacttgatggccgtcccaaaacccagcctccagcccgacccagggctcagcctcctccgcagactgtttgtcgagaacaytagatgccagcggcccaccgagcactcccctcagcctgcagggctggcccttccctgcctgtgtctctgcagagctcctcactaatgcccctctctcctc

SEQ ID NO: 61675 - DNA, 201 bp, Homo sapiens
gtacctcatacccaccctcagccccagccccccatcctgccctgaaggacccaggttgtggagtcaggggcaaggcagtgggcctgaggtcctggatgggycacagggaaaggaggagctgggaccctcaagacagaggtccacggcccccacaggcagcaggaggagctgcggccatgtggcctggtggtcagggctgga

SEQ ID NO: 61676 - DNA, 201 bp, Homo sapiens
ggaaaccgggtaagggccgtttgcacccctccttcagcctcggcccagggggtgtgggtgcctgaccgggtgggagggtagttgctgctgcagtgggagcrtgggttctcccggcagcccagcagccccagcccagcagccccagcccagcattctgccgggtcggagtcatgtgaggaactccccctgggagctcctggc

SEQ ID NO: 61677 - DNA, 201 bp, Homo sapiens
ctggaaacactggtcagtgaggagccaatggccgtgggatgtggtggagggtgccctgcccgttgcttcatcagcttctaaccagggcttgggcggccccrccgctgctcaccgaggcctcagcaacaaacccacctcctcccaggtggagccccagggagccccacccacacctcctggagctccccatgggaacgttgg

SEQ ID NO: 61678 - DNA, 201 bp, Homo sapiens
tgggttctcccggcagcccagcagccccagcccagcagccccagcccagcattctgccgggtcggagtcatgtgaggaactccccctgggagctcctggcrgatccccgtggcctggagacctgatgcatcccaaacttcggtgtcactggacagctccatttccctgagcagcagatccaggcctggcctcttggtcact

SEQ ID NO: 61679 - DNA, 201 bp, Homo sapiens
cggcaaggtaagtggccttgtcagggtacggggcaggcggggtcaccagcttccaggggcctcctggaggcagccccagctgagaagctgagcagagaggrcctttctggaaacactggtcagtgaggagccaatggccgtgggatgtggtggagggtgccctgcccgttgcttcatcagcttctaaccagggcttgggcg

SEQ ID NO: 61680 - DNA, 201 bp, Homo sapiens
gccaccgtctccgccagcgtcagcggcacagagactgcccgcctcagaccctcctgtagggccgccgtgcgcctgaaaggagcaagaggagagcctgagcrcagcggcacacacaggcaggcagtggacacactgcaccccaacagggctgagcaggctgcagaagcgggcgatgggaagtcattcccaaacacccagcac

SEQ ID NO: 61681 - DNA, 201 bp, Homo sapiens
tctcagggccccgacggttacccgggggaagcagggagtccaggggagcgaggagaccaaggcggcaaggtaagtggccttgtcagggtacggggcaggcrgggtcaccagcttccaggggcctcctggaggcagccccagctgagaagctgagcagagagggcctttctggaaacactggtcagtgaggagccaatggcc

SEQ ID NO: 61682 - DNA, 201 bp, Homo sapiens
gggtgatgctgaagggctgtgtggtaaaaccccggccaccagctccccttgacatcaggtgaaggggcttcctcccaggaagtggatgaggtcctacccaygtgtgggtggcctcagggggaccgagagaccccgtgctcagagcggcagctacaggcaccgggaaggagctatgggtgaaacaggcgactgttgcaggtc

SEQ ID NO: 61683 - DNA, 201 bp, Homo sapiens
ccggcccactgaggcaccactcacaccccccggcccccactgaggtaccgctcaccccccagcccccactaggcaccgctcacacccccgctacacctctyacccccagcccactgaggcattgctcacccacgtgacctcaggggtgatgctgaagggctgtgtggtaaaaccccggccaccagctccccttgacatcag

SEQ ID NO: 61684 - DNA, 201 bp, Homo sapiens
ctccactacccacccaggcacaccccgcacagctgtgcaggcaccattcacccccggcccactgaggcaccactcacaccccccggcccccactgaggtaycgctcaccccccagcccccactaggcaccgctcacacccccgctacacctcttacccccagcccactgaggcattgctcacccacgtgacctcaggggtg

SEQ ID NO: 61685 - DNA, 201 bp, Homo sapiens
tccccacaccccattctctgctgaggaagctccactacccacccaggcacaccccgcacagctgtgcaggcaccattcacccccggcccactgaggcaccrctcacaccccccggcccccactgaggtaccgctcaccccccagcccccactaggcaccgctcacacccccgctacacctcttacccccagcccactgagg

SEQ ID NO: 61686 - DNA, 201 bp, Homo sapiens; identical to SEQ ID NO: 11990

SEQ ID NO: 61687 - DNA, 201 bp, Homo sapiens; identical to SEQ ID NO: 11991

SEQ ID NO: 61688 - DNA, 201 bp, Homo sapiens
gagccaatggccgtgggatgtggtggagggtgccctgcccgttgcttcatcagcttctaaccagggcttgggcggccccaccgctgctcaccgaggcctcrgcaacaaacccacctcctcccaggtggagccccagggagccccacccacacctcctggagctccccatgggaacgttggtgccccaggggctctgccctc

SEQ ID NO: 61689 - DNA, 201 bp, Homo sapiens
ctggcttctccagtcctggtggcaatgccgaccctactacagctgggaatgaatttgccacttggggcagccttggctgcacacagcagtgcagtgacccsttctgttgggggggccactggaagctgccacagggatcactgtggttagagtttgaggggtggcaaggtgccaagcggagcccaggacagggcacagctg

SEQ ID NO: 61690 - DNA, 201 bp, Homo sapiens
tgagccgcgggcgggagcaccgtccacgcgccaggggtggccacggtgggctgtccacccactccgggcctcactttacccctctgtgagtgcggaggccraaggaggaagctccgggcagggcctgggccactcaggtgtccctccatccccacccagactcgaggtgcagccgccccaggtctcgaggcacacggctaa

SEQ ID NO: 61691 - DNA, 201 bp, Homo sapiens
tttatatcttacactgggaagattgttgctggctctcagtctgcttccagtctgctcatattgcttttgttgtaatgatggtcatatgtgggagctcagtrtcaagagggcagacttgagcccacactgccaggcttcagacctcagctattagctgagtgccctgggcaagttacctcactgggccttggtttcctcatc

SEQ ID NO: 61692 - DNA, 201 bp, Homo sapiens
caggcggatcctggtccccctggtgagccaggccctcgggggccaagaggagtcccaggacccgaggtaggttggtggccagtccccatgccctccccccracctgccaggccaacacacacccaagcctcgtggttctgcccacggtggacccacgtatcagtgggcagtggcctgggagagactcagccacccagcctt

SEQ ID NO: 61693 - DNA, 201 bp, Homo sapiens
ggccaccatgtcatagcctaagttctcgtgtgttgttatgcccatggttgtgtggagtgttggcctgttccagcaccaaaaccaaaactgtaattttatcrtttcatttgatagcacaagctttctcatcactctattttttattttgctcaactcttcttgctttttctaccaagtaaaacttggattcattttgcaaac

SEQ ID NO: 61694 - DNA, 201 bp, Homo sapiens
aactggttgttagaaaatgtttcttctaactgatagaagaaaatcaataactttttgtatgttgaggactaagctctgatttttttatcttgcctatattsttatctaaggggtctggggagtcatgccctacaaaccataaattctcatcagatggttttatctaaccctatatgctgtgacttactttccatctgactc

SEQ ID NO: 61695 - DNA, 201 bp, Homo sapiens
atgtttcttctaactgatagaagaaaatcaataactttttgtatgttgaggactaagctctgatttttttatcttgcctatattcttatctaaggggtctrgggagtcatgccctacaaaccataaattctcatcagatggttttatctaaccctatatgctgtgacttactttccatctgactctggcatgacactacac

SEQ ID NO: 61696 - DNA, 201 bp, Homo sapiens
taaagaacccgaagaccatgaggtcttagggcagctgcagaaagtgctgagcccatgagagagacgctccttctctgggaccctctgcccagctgtggccygtcagtgtgaggcatctacttccaagagctgccttgtgtgctttctcgtgttttgttgtttttgacccagggtcttgctctgtcaccaaggctggagcgc

SEQ ID NO: 61697 - DNA, 201 bp, Homo sapiens
gctgtccctgccctcccggctccccaccctcaggccccaggagcagcagtttctgcaggagctcctgacccggggcctctcgcgggaggcctgagcaagcsggacacaggacacggggtaggggaggggtggggcggctgatggggggaaccctgcaccccccagggcagctgctaccaaggggcgagtcccagggccccc

SEQ ID NO: 61698 - DNA, 201 bp, Homo sapiens
tcaggagtcaacatgtgaaactggggaaatgcagttcactctggataccctgaaactttgttgtcctttgaaaagactcactcttttcttcatactccacygctctgtcatctgaccacacagcctgcagctccaggggagtacgtcagttattttctcttcctttcctccttttcccatcccacaaaaaaactacgcaaa

SEQ ID NO: 61699 - DNA, 201 bp, Homo sapiens
ctgcccacctaccctccgggccccacacgaacaagctgtgtccccaccgaggtcacagctctgccctctggggatgggcgagggaggggccacagagcccrgagaggcctcccgcaccgtcactcctgccgggtctccaagcagtccagcaccagtgcagcctgggtcttggcttcctgcaggaggctggaaacacgatgg

SEQ ID NO: 61700 - DNA, 201 bp, Homo sapiens
acacgatggtggatctgatggacacagggaaagaggggtctggtagttccagtcttcagcccagcttgctgggcagcaacctccgacccccactgcccacrgccagtcggcaatcaccctgaggctgtgaatccaggcccccacgtggggtccgggcaccacacctgcctcctgctcacctggtccttaaatgcctcgtct

SEQ ID NO: 61701 - DNA, 201 bp, Homo sapiens
ctcactcctctctcagggccccgacggttacccgggggaagcagggagtccaggggagcgaggagaccaaggcggcaaggtaagtggccttgtcagggtayggggcaggcggggtcaccagcttccaggggcctcctggaggcagccccagctgagaagctgagcagagagggcctttctggaaacactggtcagtgagga

SEQ ID NO: 61702 - DNA, 201 bp, Homo sapiens; identical to SEQ ID NO: 12005

SEQ ID NO: 61703 - DNA, 201 bp, Homo sapiens
agcagcccccagccagcatctggcatcccaggtgccccgtggacatcagggaggtgcagtcccaagcccgaccgtgggtcctgcccccgcagcgggcatcstgcaccccccttcccctgccaaaagacgtgaggctgattctgcaaacccttccagggggaccctggccgcccaggacgcagagggcccccgggagaaatc

SEQ ID NO: 61704 - DNA, 201 bp, Homo sapiens
cacggtcagagagcaagatcagtggaggaggtcagagggcaaggtcagagagcaagcttggttggggaaggtcacagggcaaggttggtggggggaggagrgtggcagcgaggttggtagggacaggacccgccagcctccccgcatggctgcctccacacgtgggctggaatgtcccgggacccccaggccaggaccttg

SEQ ID NO: 61705 - DNA, 201 bp, Homo sapiens
agttccagtcttcagcccagcttgctgggcagcaacctccgacccccactgcccacggccagtcggcaatcaccctgaggctgtgaatccaggcccccacrtggggtccgggcaccacacctgcctcctgctcacctggtccttaaatgcctcgtctgtgatgtccctcaggttgatgagcacgttgaaatatgcgccaaa

SEQ ID NO: 61706 - DNA, 201 bp, Homo sapiens
gtgagcccctctgcctcttcgcctgcagctgagctggccacactcacgcccatggcccagatgaacagtcacgctggccaccatctctgctgtcaccatgktgccgcattgggctctggggacacggggagggacaggaagaacaggccatgtgccctgagccaccagcccctctgacctgtgccctcctcacgaggctga

SEQ ID NO: 61707 - DNA, 201 bp, Homo sapiens
ggtccgggcaccacacctgcctcctgctcacctggtccttaaatgcctcgtctgtgatgtccctcaggttgatgagcacgttgaaatatgcgccaaacacrcccatctccagggctttggccgccacctgcaaggaccccagggagcccctacatggatcaaggctgagcaaactgccggaaggagggtctctgcctgacg

SEQ ID NO: 61708 - DNA, 201 bp, Homo sapiens
gcttttttctgggagcttggacttagggcttcccactttctgtccaccttccctcagcccaagcccaagtctggctgagtcctctgtgcagatgcacaggygtcctgcccgtgacacacactctgccctcagctggcacggaggttccagcagcccccagccagcatctggcatcccaggtgccccgtggacatcagggag

SEQ ID NO: 61709 - DNA, 201 bp, Homo sapiens
ctgcctgacgggctctgggacaggccggacttcgtcctcctcctcacaaggagcccagcgcagcccccgctttcgccccacagagggctaagccccaccaytgagcttagaaaacaaaactttctcttatccaagcagggctcagccccacaggaggcctgggagcagtcacactggaggctctccgccactctaggaacc

SEQ ID NO: 61710 - DNA, 201 bp, Homo sapiens
cttttttctgggagcttggacttagggcttcccactttctgtccaccttccctcagcccaagcccaagtctggctgagtcctctgtgcagatgcacaggcrtcctgcccgtgacacacactctgccctcagctggcacggaggttccagcagcccccagccagcatctggcatcccaggtgccccgtggacatcagggagg

SEQ ID NO: 61711 - DNA, 201 bp, Homo sapiens
cagcgcagcccccgctttcgccccacagagggctaagccccaccactgagcttagaaaacaaaactttctcttatccaagcagggctcagccccacaggargcctgggagcagtcacactggaggctctccgccactctaggaaccaggaccacagttctagagacagtcatcccctggagggcccccggaggcagcttca

SEQ ID NO: 61712 - DNA, 201 bp, Homo sapiens
ggtgactgtgctgtcctctccttcttcaggggtatcaaggcaacaatggagccccaggaagtcctggtgtgaaaggagccaagggcgggcctgggccccgyggacccaaaggcgagccggtgagtccctcctgcccctgcctcagggccccgctctgggcatcctccttgcagcttgaggaggaccatgggggaagggcac

SEQ ID NO: 61713 - DNA, 201 bp, Homo sapiens
cacacctgcctcctgctcacctggtccttaaatgcctcgtctgtgatgtccctcaggttgatgagcacgttgaaatatgcgccaaacacgcccatctccarggctttggccgccacctgcaaggaccccagggagcccctacatggatcaaggctgagcaaactgccggaaggagggtctctgcctgacgggctctgggac

SEQ ID NO: 61714 - DNA, 201 bp, Homo sapiens
gccccaggaagtcctggtgtgaaaggagccaagggcgggcctgggccccgcggacccaaaggcgagccggtgagtccctcctgcccctgcctcagggcccygctctgggcatcctccttgcagcttgaggaggaccatgggggaagggcacctgggctgtaggcaggatcccctgctggcaaggcacagccaggcccccat

SEQ ID NO: 61715 - DNA, 201 bp, Homo sapiens
aactcagccccaacagctgcttcctgctttgcggcaggaggcctggggtcccccgggcccccctacctggaggtctgaccggcaggccaggttcccacacygggccagttcctgcagcgccggccacagcgaggccaccgtctccgccagcgtcagcggcacagagactgcccgcctcagaccctcctgtagggccgccgt

SEQ ID NO: 61716 - DNA, 201 bp, Homo sapiens
tgttctctgcaggggcgcaggggagaccccggcaccaagggcagcccaggcagcgatggccccaagggggagaaggtgagtcctcgtgtggaggcagcccrgggtctcactgtggtgcccatgggccctgctgacgagggccccaaccccattcctcccagagaacaacagaaccccagggcctcactctccagagttcac

SEQ ID NO: 61717 - DNA, 201 bp, Homo sapiens
cagcccggggtctcactgtggtgcccatgggccctgctgacgagggccccaaccccattcctcccagagaacaacagaaccccagggcctcactctccagmgttcactctctgcagagtctgggaatgcagccctgagatccccacaccccattctctgctgaggaagctccactacccacccaggcacaccccgcacagc

SEQ ID NO: 61718 - DNA, 201 bp, Homo sapiens; identical to SEQ ID NO: 12007

SEQ ID NO: 61719 - DNA, 201 bp, Homo sapiens
ctacacccagaacccagcctactccactcagtgtgctcagggctgaaggtcaagtggagccacagcctccggggagggtcataggggccggggccagaccygtcttacccccgaggccctgcagtgtccacaggattgatactggggactccagggtgctgctgtcagtcaagagaaccccaaattcctcccctttcttcc

SEQ ID NO: 61720 - DNA, 201 bp, Homo sapiens
caacccaagataggggtgcttaggcaggggctacacccagaacccagcctactccactcagtgtgctcagggctgaaggtcaagtggagccacagcctccsgggagggtcataggggccggggccagacccgtcttacccccgaggccctgcagtgtccacaggattgatactggggactccagggtgctgctgtcagtca

SEQ ID NO: 61721 - DNA, 201 bp, Homo sapiens
atataaaatgtactgtcttaaccatttttaagtgtgcagctagttcagcgacagtaagtacattcatagtgttgtgtagccatcaccaaggtccatctccrgaactcttttcctcttgtcaaactgaagcccatggagcaccaactcgcatcaccccttccctcccctggcagccaccatcctactttatgtttccaggaa

SEQ ID NO: 61722 - DNA, 201 bp, Homo sapiens
ccactgtgcccagctaattttcttttaagagacggggtctcactatgttgcccaggccatggatgtgtttgtttgtttgtttgtttggggtgtttgggggkttttttctttttttattgatttgaaaaagctttattttcccgaattttttattgtggtatacaatataaaatgtactgtcttaaccatttttaagtgtgc

SEQ ID NO: 61723 - DNA, 201 bp, Homo sapiens
tcaatgatatatttttctaagtggctcactaaattttctctccctaatctcccctcctttctctttctttctctctttctctctgtctatatatatatatwtttttttttctcttttttaaaaaaactttgttcagatgattttctgggtagacaatcctatctttaataaggacagttttgtctcttcttttccaacagt

SEQ ID NO: 61724 - DNA, 201 bp, Homo sapiens
gatttttttatcttgcctatattcttatctaaggggtctggggagtcatgccctacaaaccataaattctcatcagatggttttatctaaccctatatgcygtgacttactttccatctgactctggcatgacactacacgaccaagaagaaaataaaaatattttaccccaaaacatgtttctttgccacattttgaaat

SEQ ID NO: 61725 - DNA, 201 bp, Homo sapiens
tgcttcctgctttgcggcaggaggcctggggtcccccgggcccccctacctggaggtctgaccggcaggccaggttcccacaccgggccagttcctgcagsgccggccacagcgaggccaccgtctccgccagcgtcagcggcacagagactgcccgcctcagaccctcctgtagggccgccgtgcgcctgaaaggagcaa

SEQ ID NO: 61726 - DNA, 201 bp, Homo sapiens
tctgtaaggaatctctgttaacatagctagctctttttcttccaggccctcccaattctgaagagattaaccgagagtctagcagcttttaaaggtctcartaggaaacacttgtcattgattgtctctaagggcagccactatgagacttcagaagaaccttggtctccacagtcttttatcttaacctgagcatttcct

SEQ ID NO: 61727 - DNA, 201 bp, Homo sapiens
aggtacacagacaagtggagggtgtgcaagacagagaagctttattgagtgttaggggagctcacaggagacccgcagggggcagcccctctctgtaggcrggttgtcttgtcggcgggttgtcttgtcaaatgttcagctctcagcagagagaaggccctggagtgggtggctcctctctgcaggcaggtcatcccattg

SEQ ID NO: 61728 - DNA, 201 bp, Homo sapiens
acagtgggggtgatacaaggggtcttgggggagtatacacttatacagtggtcagggtgggctctgcagacacatttgggtctccgtctgtggtgccgccrtgagcgagatcttagaaggcagcggacaccccggccctgttggaggaggccaaagccccgggaactgcccgtgaagtgaggtctccctacctggctcagc

SEQ ID NO: 61729 - DNA, 201 bp, Homo sapiens
tctgacggtggccactcatggcctttctagctctggtgccagcatagggaaggaggaggcacagccttgtcttactccttgcacctgttagctccccccccgccaagggaggacccgtggttggggacagcacagggggccctgctgtgtgcagggactgtccctggggccactgaagcgcacctgttcttgttccttctc

SEQ ID NO: 61730 - DNA, 201 bp, Homo sapiens
ttctctcctgccctcagggatctcggggagaccccggtgatgcaggaccccgtggagactcaggacagccaggccccaaggtacgtgcccctcccccagcrggacgtattaggggttcggggcagctgcctgaggagcaggacagggggccggcctgggggaccctgttgccggcagacgtgcctcaggacgggcctgtgc

SEQ ID NO: 61731 - DNA, 201 bp, Homo sapiens
acccaccctcagccccagccccccatcctgccctgaaggacccaggttgtggagtcaggggcaaggcagtgggcctgaggtcctggatgggccacagggaraggaggagctgggaccctcaagacagaggtccacggcccccacaggcagcaggaggagctgcggccatgtggcctggtggtcagggctggacggggcatg

SEQ ID NO: 61732 - DNA, 201 bp, Homo sapiens; identical to SEQ ID NO: 11965

SEQ ID NO: 61733 - DNA, 201 bp, Homo sapiens
tcaggaaggggagcaggcatctgagatctcccccgtgaggcttcctgcaaaaacgtgccctgcctcagaatcgctgctcagtaacagtggtttcattgccrtgtacaaatggtgcctccctcaccagtgccccttgctcttccatccttttgtaaaatttattcttttatatttgtttttttagagacagggtctttctct

SEQ ID NO: 61734 - DNA, 201 bp, Homo sapiens
ctacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcaggggtgatgct

SEQ ID NO: 61735 - DNA, 201 bp, Homo sapiens
caggacagggcacagctgtgatgttccagaagcctctgcccacctcatcccctgccctgagtttcctcccttttcttccttttgacctcttaattcttccyctttcctctgctcctctttgcacttaaattgggagcatatcaataaatagatgaatttatttaataaagttctgtatcataggttaaaattttaattcca

SEQ ID NO: 61736 - DNA, 201 bp, Homo sapiens
actacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcaggggtgatgc

SEQ ID NO: 61737 - DNA, 201 bp, Homo sapiens
cactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcaggggtgatg

SEQ ID NO: 61738 - DNA, 201 bp, Homo sapiens
gctgtgctcaggagcagcaggcaggagccctggactcatggctaccatgtggctgccacactcaggcacacttaggcacatacactcacactcaggcacayttagacacacacatcacactcaacctcagacgcagacacacaccacacactcacagatgcacacacagtctcagacacagacacacaccacacacagata

SEQ ID NO: 61739 - DNA, 201 bp, Homo sapiens
ccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcaggggtgat

SEQ ID NO: 61740 - DNA, 201 bp, Homo sapiens
tccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcaggggtga

SEQ ID NO: 61741 - DNA, 201 bp, Homo sapiens
gggtcccccgggcccccctacctggaggtctgaccggcaggccaggttcccacaccgggccagttcctgcagcgccggccacagcgaggccaccgtctccrccagcgtcagcggcacagagactgcccgcctcagaccctcctgtagggccgccgtgcgcctgaaaggagcaagaggagagcctgagcacagcggcacaca

SEQ ID NO: 61742 - DNA, 201 bp, Homo sapiens
cgagagcctgggtgagattattgagaataatgcggtggctctggcttaaaaaataaaagccggaggatctaccaccagctctgaacacacacccgtgacamaaactgactcatgtgcaattgcccattagtggcaggtcttgccatttttcgtttttttctgagtcgagatcagctgcggctggggagaacattagttctg

SEQ ID NO: 61743 - DNA, 201 bp, Homo sapiens
acaccgggccagttcctgcagcgccggccacagcgaggccaccgtctccgccagcgtcagcggcacagagactgcccgcctcagaccctcctgtagggccrccgtgcgcctgaaaggagcaagaggagagcctgagcacagcggcacacacaggcaggcagtggacacactgcaccccaacagggctgagcaggctgcaga

SEQ ID NO: 61744 - DNA, 201 bp, Homo sapiens
gggtcggggcccatgcaccgggtggagggcgggagtgcagcagggctgggtcatcgctgggtcctgcatgtgcacgtgaccctagggtctgaggtctcccyggtaccccccgatgaccctgccacccccccagactgtgagaagcgctgtggcgccctggacgtggtcttcgtcatcgacagctccgagagcattgggtac

SEQ ID NO: 61745 - DNA, 201 bp, Homo sapiens
caggcgggctcttgaggggtggctggggtcttcctggcgacgggcctgcggcactggaagccctactggagtttggcctgtctccggcacaggtttggacrgagctgttttgtgctgaaaggttttctcggggtccgtggtgtcccccaaaggtgccaccgtgcgggtctcctagctccctgccagcttcctgtccctgtg

SEQ ID NO: 61746 - DNA, 201 bp, Homo sapiens
caccgtctccgccagcgtcagcggcacagagactgcccgcctcagaccctcctgtagggccgccgtgcgcctgaaaggagcaagaggagagcctgagcacrgcggcacacacaggcaggcagtggacacactgcaccccaacagggctgagcaggctgcagaagcgggcgatgggaagtcattcccaaacacccagcacgc

SEQ ID NO: 61747 - DNA, 201 bp, Homo sapiens
aggggacccaggcgggtgctgcaccccaaggtaagggaccaaggcaagggctgcaccccaaagtagggaacccaggtgagggctgcaacccaagatagggktgcttaggcaggggctacacccagaacccagcctactccactcagtgtgctcagggctgaaggtcaagtggagccacagcctccggggagggtcataggg

SEQ ID NO: 61748 - DNA, 201 bp, Homo sapiens
ccacaggaagcatttctctaaaggtgagcagcttcctctgcaggtgacacggcctccacccaaacccagaggctctggctctcccactgcggcttgccgcrgccccacacttgcctgctcccacactgacacctccaacaccacaggggctgctgggtcacgtggcccagatggcagggctgctcagacagtcattttctg

SEQ ID NO: 61749 - DNA, 201 bp, Homo sapiens
tggtggtcagggctggacggggcatgtcaggtgacccctgggcatggccagtccctgcctgtgctgacttctgaatttctctcctgccctcagggatctcrgggagaccccggtgatgcaggaccccgtggagactcaggacagccaggccccaaggtacgtgcccctcccccagcaggacgtattaggggttcggggcag

SEQ ID NO: 61750 - DNA, 201 bp, Homo sapiens
ctctgctcacagccagaactcgacggcacccctagcccacttccaccccagtgtgcaccttgcgccctgttgagcacagccccccagccccaccccgtccyatgaccatgctgaccgactcaacgtcctcctccagggagaccccggcaggcctggattcagctacccaggaccccgaggagcacccgtgagtcacagcct

SEQ ID NO: 61751 - DNA, 201 bp, Homo sapiens
acgcagcacagtggcctcacccagagtgtgaatgagcgagggagggaaacggggctgcagaaagctgcccagagggaggaaggagcactgggatctgaggytgagtcaccctggcttctgtttgcttcacagggagaaaaaggcgagcccggcccacgcggccccgaggtatgtgtgggtcctggccacctgtgcccaccc

SEQ ID NO: 61752 - DNA, 201 bp, Homo sapiens
ttgtcttactccttgcacctgttagctccccccccgccaagggaggacccgtggttggggacagcacagggggccctgctgtgtgcagggactgtccctgkggccactgaagcgcacctgttcttgttccttctcaggcggatcctggtccccctggtgagccaggccctcgggggccaagaggagtcccaggacccgagg

SEQ ID NO: 61753 - DNA, 201 bp, Homo sapiens
tcactgacaggaccacccctgtcttgagatggtcctggctccccaaggcccagccatgtcacctatgctgagctctgggggagctgtcagccactggctgrtcccttttcaaccaaagttcaggctttgccaaaaaaaccacatagatgctcccgtttaaaggaccccaaaatgccagatcgatttttccacataaaaatc

SEQ ID NO: 61754 - DNA, 201 bp, Homo sapiens
ggggcaagagggcgcaagccccccagtccagatgctggtgacggtgtgtgctgggcgcagaccccgcttccttgaagactgagggcagtgcccccaatccygctgacctgctgtgcgtgcgcctgccatgggggagggtgccaggggagaggcactgggggtgtctgagcgacccccacccctgttgcaggacttcagggc

SEQ ID NO: 61755 - DNA, 201 bp, Homo sapiens
aggaccacccctgtcttgagatggtcctggctccccaaggcccagccatgtcacctatgctgagctctgggggagctgtcagccactggctggtccctttycaaccaaagttcaggctttgccaaaaaaaccacatagatgctcccgtttaaaggaccccaaaatgccagatcgatttttccacataaaaatctcactggt

SEQ ID NO: 61756 - DNA, 201 bp, Homo sapiens
gtttaaaggaccccaaaatgccagatcgatttttccacataaaaatctcactggtgtccctggtagagacagctcctctgtcccaggctaacatgtgttcyctgtcacagggaggccgaggcgactttggcttgaaaggagaacctgggaggaaaggagagaaaggagagcctgtgagtgtcgccgtcccgaagcccacag

SEQ ID NO: 61757 - DNA, 201 bp, Homo sapiens
gaacacttgggcagaaaaggacagcacggcttcctcctcctccaggccgggcctacaagcacccacagttccgacagagaaagtctcttcttaatggtacrcatgtgtcttactgtagctcccagttagtcccctaagcgtgaaccaccacccacccatgctgctcccctcccaccatctctccataaacaggacccaacg

SEQ ID NO: 61758 - DNA, 201 bp, Homo sapiens
tggctgccatttctgggacacccagctctgccaggcccctacccctctggtgggccaggctctgacggtggccactcatggcctttctagctctggtgccrgcatagggaaggaggaggcacagccttgtcttactccttgcacctgttagctccccccccgccaagggaggacccgtggttggggacagcacagggggcc

SEQ ID NO: 61759 - DNA, 201 bp, Homo sapiens
gggcagctccgagggtcctaggtcccctgtgaatctccacagaatcctgggacctcagagcctgcatcagttggtcccccatgcagggacttagtgactcygcagccccagtcagggcctgctctgtgccaggcattgctctgcagacccaaagggactccaggccagtcctcatcctcagggcccacagtgtaacacaga

SEQ ID NO: 61760 - DNA, 201 bp, Homo sapiens
agaggagtcccaggacccgaggtaggttggtggccagtccccatgccctccccccaacctgccaggccaacacacacccaagcctcgtggttctgcccacrgtggacccacgtatcagtgggcagtggcctgggagagactcagccacccagccttggccccagagtctcagcctcatccttccttccccagggtgagccc

SEQ ID NO: 61761 - DNA, 201 bp, Homo sapiens
gggagagactcagccacccagccttggccccagagtctcagcctcatccttccttccccagggtgagcccggcccccctggagaccccggtctcacggtargtgtcacatggggcagaaccagtgtccttctcctgccaaaactagacaccaagagcagcaggggtgggggaaggtcagctggcacggtcagagagcaaga

SEQ ID NO: 61762 - DNA, 201 bp, Homo sapiens
tacaaaaaaaaattagccgggcgtggtggcaggcacctgtaatcccagctaatcgggaggctgaggcaggagaaaatcacttgaacctgggaggcggaggytgcagtgagctgagatcgcgccactgcactccagcctgggtgagggagcgagactgtctcaaaaaaaaaaaaaaaaaaaaaaaaaaaggaaagaaaggcc

SEQ ID NO: 61763 - DNA, 201 bp, Homo sapiens
ccccaacctccgcgcccaggctctgctgtccctgccctcccggctccccaccctcaggccccaggagcagcagtttctgcaggagctcctgacccggggcytctcgcgggaggcctgagcaagccggacacaggacacggggtaggggaggggtggggcggctgatggggggaaccctgcaccccccagggcagctgctac

SEQ ID NO: 61764 - DNA, 201 bp, Homo sapiens
ttctgcccagctgcccggctgctgccagccccactctgcggagccagcagcacagtgaggcccgtcctgatggcctccagctccactctgcggagtcagcrgcacagtgaggcccgtcctgatggcctcctggagctggagcttaggccaagccacagggcatcagggaggatggacgttcaagggctggatctgtttgcc

SEQ ID NO: 61765 - DNA, 201 bp, Homo sapiens
acccaggcatcgctggagaatcagagcccagtgttggccacagtcacagctactgggtgcagaagggacccccacgggccaggcacccccaccccaggggkctcttctggctccattttgcaggtggctttgtgggaagcttccctcagagctgggagaaatgggtcaaagcaaacccttgtctgacagaggctggccctt

SEQ ID NO: 61766 - DNA, 201 bp, Homo sapiens
gggctcctggggggtcctgtggccttgagtttggcccaagggctttgccccccagaggcagcagtgcccatgatgctttgaggcaccgagctcactgcgcyggctttcctcctacacagggtgaatttggagccgacggtcgcaaggtaggctggctgggtaggcagagcccctccttcctgctgctcagggcagaaggac

SEQ ID NO: 61767 - DNA, 201 bp, Homo sapiens
gatctcagccaggcatagtggctcatgcttgtaaccccatcactttgggaggccgaggcaggaggataacttgagcccaggagttcaagaccagcctgagyaatatagggagaccctatctctataaaataaaaatatttttaaaaatcgaccaagcatggtggtgcacacctgtggtcccaactactggggaggctgagg

SEQ ID NO: 61768 - DNA, 201 bp, Homo sapiens
ggtgccccaggggctctgccctcctgggccgcctgcagtgtcgccccgcccctggcggccccaggatccccaagggcttttttctgggagcttggacttarggcttcccactttctgtccaccttccctcagcccaagcccaagtctggctgagtcctctgtgcagatgcacaggcgtcctgcccgtgacacacactctgc

SEQ ID NO: 61769 - DNA, 201 bp, Homo sapiens
gctccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcaggggt

SEQ ID NO: 61770 - DNA, 201 bp, Homo sapiens
ggctccacaccacacaccgcacaggcgtgaccatgcctcagggcccctgcctctgggtgactgtgctgtcctctccttcttcaggggtatcaaggcaacartggagccccaggaagtcctggtgtgaaaggagccaagggcgggcctgggccccgcggacccaaaggcgagccggtgagtccctcctgcccctgcctcagg

SEQ ID NO: 61771 - DNA, 201 bp, Homo sapiens
agctccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcagggg

SEQ ID NO: 61772 - DNA, 201 bp, Homo sapiens; identical to SEQ ID NO: 11997

SEQ ID NO: 61773 - DNA, 201 bp, Homo sapiens
gctgaggaagctccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgac

SEQ ID NO: 61774 - DNA, 201 bp, Homo sapiens
tcccaagggccctgaagattcctagtagttccctcaaggcctcctctgtgcagaagaaagtgtgaggtccctcctgcgggacagagtggtgagaaggcttygggtgactcagtgaaggataggtccagcccagcatcaggaaaagagcacagctcagaacgcagcacagtggcctcacccagagtgtgaatgagcgaggga

SEQ ID NO: 61775 - DNA, 201 bp, Homo sapiens
tgctgaggaagctccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtga

SEQ ID NO: 61776 - DNA, 201 bp, Homo sapiens
ccaggctaacatgtgttccctgtcacagggaggccgaggcgactttggcttgaaaggagaacctgggaggaaaggagagaaaggagagcctgtgagtgtcrccgtcccgaagcccacagcagctgggcagaggcagggaggggccctgaggctgagcgtgtgcatctatgagtacaggagaacgccaggcagcttggcccc

SEQ ID NO: 61777 - DNA, 201 bp, Homo sapiens
tgggcgaatgggcgaatgggtggatgggtgggcgtggagttggtgggtacatgataatggggtggaatacccatggattggaatgagctgttttggctgcyatttctgggacacccagctctgccaggcccctacccctctggtgggccaggctctgacggtggccactcatggcctttctagctctggtgccagcatagg

SEQ ID NO: 61778 - DNA, 201 bp, Homo sapiens
attctctgctgaggaagctccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcaccc

SEQ ID NO: 61779 - DNA, 201 bp, Homo sapiens
gggcaagagggcgcaagccccccagtccagatgctggtgacggtgtgtgctgggcgcagaccccgcttccttgaagactgagggcagtgcccccaatcccrctgacctgctgtgcgtgcgcctgccatgggggagggtgccaggggagaggcactgggggtgtctgagcgacccccacccctgttgcaggacttcagggcc

SEQ ID NO: 61780 - DNA, 201 bp, Homo sapiens
ctctgaacacacacccgtgacacaaactgactcatgtgcaattgcccattagtggcaggtcttgccatttttcgtttttttctgagtcgagatcagctgcrgctggggagaacattagttctgtctgtcggctccatgagtaagcagaggaaagtctgactacagaggcatcttctcaaatgtccatgaaaggctgcaagc

SEQ ID NO: 61781 - DNA, 201 bp, Homo sapiens
ttcctcccaggcccccttccccaacccccggccacacccgcctctcacatgggacccaggccggaggcctcagctgagacccgtggggcctcccttccctycccacagggggaccctggccctgaggggccccgcggcctggctggagaggttggcaacaaaggagccaaggtaggggagcagggtgggccgcaccccaag

SEQ ID NO: 61782 - DNA, 201 bp, Homo sapiens
ccacaggggctgctgggtcacgtggcccagatggcagggctgctcagacagtcattttctgctcctggccgcctcgaagctggcagcctccatgtcagccragccgtgggtcagagcagtgcccccaggaattaaatatgttgccttcagaacccaaaaaggcctgtcaggccctgtgcttcctcctttgaagtaggggat

SEQ ID NO: 61783 - DNA, 201 bp, Homo sapiens
caagatgtagcaatttctcttttactttagaggatgtcctggtatgaacctgatcactggtgccctaaaaacttccatgaagttaggtccctgaatcctcrgagttcacctcccacccacagatgcaaatgtgtctcataaggcctctagctcatgaccctcctgttcctcctcctgcccattatgtcgtcactgtaatgg

SEQ ID NO: 61784 - DNA, 201 bp, Homo sapiens
caccacttgtgttaattggggtcttccaagaggcaggtgccatggaagctctgacgtgactggagatttatcagtgcaatgtctgtgaaggatgctggggrggtggccaaagaggacggaagcctcagaccacaggtgagacccctgtgaaggagatacggggagccttggccagcacgtgcccctagacagtgctggcca

SEQ ID NO: 61785 - DNA, 201 bp, Homo sapiens
ccagacagtggtgctccattcccttccatgccgacgcgcccagctacccactccacccagccctggaggacatggaagggcctcaaccatccaaatcccamccaaaactgagcccagaggcacccactaaacatctgtgaccccacccagggtggggcaagagggcgcaagccccccagtccagatgctggtgacggtgtg

SEQ ID NO: 61786 - DNA, 201 bp, Homo sapiens
tggggtcttccaagaggcaggtgccatggaagctctgacgtgactggagatttatcagtgcaatgtctgtgaaggatgctgggggggtggccaaagaggayggaagcctcagaccacaggtgagacccctgtgaaggagatacggggagccttggccagcacgtgcccctagacagtgctggccaggccgagggagaactt

SEQ ID NO: 61787 - DNA, 201 bp, Homo sapiens
tgtctttccaatatatttctcaaaaatttttttgagtttttttcataagtcctgcacatttttattcagttgattccttgggtttatgttgtttttcttamtagtgtaaatagcatttttctgcaacattttctaactggttgttagaaaatgtttcttctaactgatagaagaaaatcaataactttttgtatgttgagg

SEQ ID NO: 61788 - DNA, 201 bp, Homo sapiens
gtctgttctccattttgtttatctttgctctgatctttattttttccttctttctgctagcttgttctttttctagttccttacattgtaaggttaagctsctatttgagacctgtcttttttaatataagcatgtatagccatcagtttcccccttagcactgctttcactgtcgaacaagtttttaaatttgtgttttc

SEQ ID NO: 61789 - DNA, 201 bp, Homo sapiens
tgacctggccacctctgcaatcaatggttccagacaggaaattagctcaagtccaggaatggagtagggaaccacgatattttactggagtccccgccctyggcctctttcttccttcctctgccgtccgccagggcggcttggctcaacatgacccatcgctttctccaggcttctgggagccatcccagaatcatcttt

SEQ ID NO: 61790 - DNA, 201 bp, Homo sapiens
agccccgcccagcggcccttcctggcctgcagtggaggctgtaatgggcaggggtggtgggaatcccagctcacagggcgcctgctcttagaagggcggcrtctgggtccagaggtcagaaacgtcagatgcccatcccagaagtggcggggaacctgtctccacaatggatagcagcactgtcttttttttttttttttt

SEQ ID NO: 61791 - DNA, 201 bp, Homo sapiens
gaaaggccagaccgggcacggtggctcacgcctgtaatcccaacacttggggaggccgaggcgggcagatcacctgaggtcaggagttcgagaccagcctrgccaacagggtgaaaccccgtctctactaaaaatacaaaaaaaaattagccgggcgtggtggcaggcacctgtaatcccagctaatcgggaggctgaggc

SEQ ID NO: 61792 - DNA, 201 bp, Homo sapiens; identical to SEQ ID NO: 11956

SEQ ID NO: 61793 - DNA, 201 bp, Homo sapiens
caggccaacacacacccaagcctcgtggttctgcccacggtggacccacgtatcagtgggcagtggcctgggagagactcagccacccagccttggccccrgagtctcagcctcatccttccttccccagggtgagcccggcccccctggagaccccggtctcacggtaggtgtcacatggggcagaaccagtgtccttct

SEQ ID NO: 61794 - DNA, 201 bp, Homo sapiens
ggtaggttggtggccagtccccatgccctccccccaacctgccaggccaacacacacccaagcctcgtggttctgcccacggtggacccacgtatcagtgrgcagtggcctgggagagactcagccacccagccttggccccagagtctcagcctcatccttccttccccagggtgagcccggcccccctggagaccccgg

SEQ ID NO: 61795 - DNA, 201 bp, Homo sapiens
acccttcagggccctctcctggcagcgcctcccctagtcccggtgcttggacactcctcccatctgcaccgaggagagggcggcactccaatccctgcatyacccctggaactgcacgctctgaaccaggcccggtgccctttctgcccagctgcccggctgctgccagccccactctgcggagccagcagcacagtgagg

SEQ ID NO: 61796 - DNA, 201 bp, Homo sapiens
acctgcgggtgctgcggtgaggcactgcccacggcagggtcggggcccatgcaccgggtggagggcgggagtgcagcagggctgggtcatcgctgggtccygcatgtgcacgtgaccctagggtctgaggtctccccggtaccccccgatgaccctgccacccccccagactgtgagaagcgctgtggcgccctggacgtg

SEQ ID NO: 61797 - DNA, 201 bp, Homo sapiens
taaaagtaagggagaaattaacacattcttagatcaacaaaagctgagaatgttccttaccactagacctgccctataggaaacgccaaagggagtcctgygggttgaaataaagggtgatagacagtaattcaagtgaagaagtaaagatctcagccaggcatagtggctcatgcttgtaaccccatcactttgggaggc

SEQ ID NO: 61798 - DNA, 201 bp, Homo sapiens; identical to SEQ ID NO: 11958

SEQ ID NO: 61799 - DNA, 201 bp, Homo sapiens
tgcacctgttagctccccccccgccaagggaggacccgtggttggggacagcacagggggccctgctgtgtgcagggactgtccctggggccactgaagcscacctgttcttgttccttctcaggcggatcctggtccccctggtgagccaggccctcgggggccaagaggagtcccaggacccgaggtaggttggtggcc

SEQ ID NO: 61800 - DNA, 201 bp, Homo sapiens
ctctgcaagctctgaggggacaggggtctgcagggccatgccctcagggcttccacctggatgtctcagcccatgtttcagggtcccagattttcccaacyggggtccagaccttcacataggccagccgtggccaggcatcaaaacatgcctagagctaggtggtccccacagtcactgtcggctcctcagccatactgg

SEQ ID NO: 61801 - DNA, 201 bp, Homo sapiens
caggatccccaagggcttttttctgggagcttggacttagggcttcccactttctgtccaccttccctcagcccaagcccaagtctggctgagtcctctgwgcagatgcacaggcgtcctgcccgtgacacacactctgccctcagctggcacggaggttccagcagcccccagccagcatctggcatcccaggtgccccg

SEQ ID NO: 61802 - DNA, 201 bp, Homo sapiens; identical to SEQ ID NO: 11959

SEQ ID NO: 61803 - DNA, 201 bp, Homo sapiens
agcctccccgcatggctgcctccacacgtgggctggaatgtcccgggacccccaggccaggaccttgctgtggaaactcttctggggccccggggggactrccctgcctgccgtgtgcattgcaggagtgtgacgtcatgacctacgtgagggagacctgcgggtgctgcggtgaggcactgcccacggcagggtcggggc

SEQ ID NO: 61804 - DNA, 201 bp, Homo sapiens; identical to SEQ ID NO: 11962

SEQ ID NO: 61805 - DNA, 201 bp, Homo sapiens
ctggcaacgacctcacgcgtgcggcttgcagggacgcgtgtgggcgtggtgcagtacagccacgagggcacctttgaggccatccagctggacgacgaacrtatcgactccctgtcgagcttcaaggaggctgtcaagaacctcgagtggattgcaggtggcacctggacaccctcagccctcaagtttgcctacgaccgc

SEQ ID NO: 61806 - DNA, 201 bp, Homo sapiens
gggcgtgggaggcgatgagatgggagaagtccagacgcgtccctccaacgagggcctctgcatggctggggatgccccagaccccgaggcctctggcaacsacctcacgcgtgcggcttgcagggacgcgtgtgggcgtggtgcagtacagccacgagggcacctttgaggccatccagctggacgacgaacatatcgact

SEQ ID NO: 61807 - DNA, 201 bp, Homo sapiens; identical to SEQ ID NO: 11966

SEQ ID NO: 61808 - DNA, 201 bp, Homo sapiens
acctggtcgctgagaagttcatcgatgacatggaggacgtcctctgcccgggtgagcgtgtgggcgcggggcagtcggccgaggagcagcaggccccagcygctgtctagcgtgagccccagggacacccctcacctgagggatgaatgtgcagcccaggatcttgggctgtgggtgggaaggggtcgggccctctcgggg

SEQ ID NO: 61809 - DNA, 201 bp, Homo sapiens; identical to SEQ ID NO: 11968

SEQ ID NO: 61810 - DNA, 201 bp, Homo sapiens
gtcgctgagaagttcatcgatgacatggaggacgtcctctgcccgggtgagcgtgtgggcgcggggcagtcggccgaggagcagcaggccccagccgctgyctagcgtgagccccagggacacccctcacctgagggatgaatgtgcagcccaggatcttgggctgtgggtgggaaggggtcgggccctctcggggctgca

SEQ ID NO: 61811 - DNA, 201 bp, Homo sapiens; identical to SEQ ID NO: 11970

SEQ ID NO: 61812 - DNA, 201 bp, Homo sapiens
ctgcccgggtgagcgtgtgggcgcggggcagtcggccgaggagcagcaggccccagccgctgtctagcgtgagccccagggacacccctcacctgagggaygaatgtgcagcccaggatcttgggctgtgggtgggaaggggtcgggccctctcggggctgcagggcagaggccagctgcaccctgagcctgtctaggcag

SEQ ID NO: 61813 - DNA, 201 bp, Homo sapiens
ggcgcggggcagtcggccgaggagcagcaggccccagccgctgtctagcgtgagccccagggacacccctcacctgagggatgaatgtgcagcccaggatmttgggctgtgggtgggaaggggtcgggccctctcggggctgcagggcagaggccagctgcaccctgagcctgtctaggcagatcagtgaacggccgctga

SEQ ID NO: 61814 - DNA, 201 bp, Homo sapiens
tcttgaaggcccaccatgggccttgcagtctccctcagctgccgcccagctcccatgggctggccgtgcatgtgccactcggaggaagccctggattcagkgagtgaaaccatcccggggtggaagcactgacaccccccagcaccagcaggtcttgctccaaccctggcctgcctcggagctgcagctgcggctctcatc

SEQ ID NO: 61815 - DNA, 201 bp, Homo sapiens
ggagctgggggtgccgtccaggctctgctggacgtggtgctgcccccatggtgcactgctgcaccgtacctgggcccacaggaggtccccgggggcgttakgagctgagtccccctcagtgagccgtcccctccaggagtgtgagggtggggatgccatggagacagggtgggagggtccgacctggaggaccacagggag

SEQ ID NO: 61816 - DNA, 201 bp, Homo sapiens
tggtgcactgctgcaccgtacctgggcccacaggaggtccccgggggcgttaggagctgagtccccctcagtgagccgtcccctccaggagtgtgagggtrgggatgccatggagacagggtgggagggtccgacctggaggaccacagggaggaaacctcagggtctgcggtacgaagtcagcgcttcctcagcacgcgg

SEQ ID NO: 61817 - DNA, 201 bp, Homo sapiens
tggcaacaaaggagccaaggtaggggagcagggtgggccgcaccccaaggtaggggatctgagggggtgcaggggggctgcaccccaaggtagggtggccrggactgcaccccaaggtaggggacccgggtgggtgctgcaccccaaggtaaggggggcccaggtgagggctatacctcaaggtaggggacccaggcgggt

SEQ ID NO: 61818 - DNA, 201 bp, Homo sapiens
ggggggcccaggtgagggctatacctcaaggtaggggacccaggcgggtgctgcaccccaaggtaagggaccaaggcaagggctgcaccccaaagtagggracccaggtgagggctgcaacccaagataggggtgcttaggcaggggctacacccagaacccagcctactccactcagtgtgctcagggctgaaggtcaag

SEQ ID NO: 61819 - DNA, 201 bp, Homo sapiens
ggccaggctctgacggtggccactcatggcctttctagctctggtgccagcatagggaaggaggaggcacagccttgtcttactccttgcacctgttagcyccccccccgccaagggaggacccgtggttggggacagcacagggggccctgctgtgtgcagggactgtccctggggccactgaagcgcacctgttcttgt

SEQ ID NO: 61820 - DNA, 201 bp, Homo sapiens
tgtgaccccacccagggtggggcaagagggcgcaagccccccagtccagatgctggtgacggtgtgtgctgggcgcagaccccgcttccttgaagactgasggcagtgcccccaatcccgctgacctgctgtgcgtgcgcctgccatgggggagggtgccaggggagaggcactgggggtgtctgagcgacccccacccct

SEQ ID NO: 61821 - DNA, 201 bp, Homo sapiens
tctacttccaagagctgccttgtgtgctttctcgtgttttgttgtttttgacccagggtcttgctctgtcaccaaggctggagcgcagtggtgtgatcacrgctcactgcagccttgacctcctgtgctcaagcaattctcctgcctcagcctcccaagtagctgggaccacaggcaccaccgtgcctggctcatatgtat

SEQ ID NO: 61822 - DNA, 201 bp, Homo sapiens
ggtcacatgggactaggggccttctgtccctgccagcgcctccattcccaggcgatgccccgctgcctgcccacctaccctccgggccccacacgaacaarctgtgtccccaccgaggtcacagctctgccctctggggatgggcgagggaggggccacagagcccggagaggcctcccgcaccgtcactcctgccgggtc

SEQ ID NO: 61823 - DNA, 201 bp, Homo sapiens
gagcccagaggcacccactaaacatctgtgaccccacccagggtggggcaagagggcgcaagccccccagtccagatgctggtgacggtgtgtgctgggcrcagaccccgcttccttgaagactgagggcagtgcccccaatcccgctgacctgctgtgcgtgcgcctgccatgggggagggtgccaggggagaggcactg

SEQ ID NO: 61824 - DNA, 201 bp, Homo sapiens
cgtcatgacctacgtgagggagacctgcgggtgctgcggtgaggcactgcccacggcagggtcggggcccatgcaccgggtggagggcgggagtgcagcarggctgggtcatcgctgggtcctgcatgtgcacgtgaccctagggtctgaggtctccccggtaccccccgatgaccctgccacccccccagactgtgagaa

SEQ ID NO: 61825 - DNA, 201 bp, Homo sapiens
tgtgacttactttccatctgactctggcatgacactacacgaccaagaagaaaataaaaatattttaccccaaaacatgtttctttgccacattttgaaayggccctgcaaagctgtcctttactggggaaaatttgcatctgtaaggaatctctgttaacatagctagctctttttcttccaggccctcccaattctgaa

SEQ ID NO: 61826 - DNA, 201 bp, Homo sapiens
ggccttaacagggaggctgcccttcctttcactgaatgagctgcgtcactcataagctcactgagggaaccccatctgccagctcgtgcgtgctcagacgrcgtccatgtctcaagcgttctgtgaaggctgcggtgcagcgtgaggtcaccctgctgtgttcagagctttgctcactgcctgcggggctggaccgttgca

SEQ ID NO: 61827 - DNA, 201 bp, Homo sapiens
agtcaatttttaagtattttattatttttgatactatagtaaatagaattgttttcttaatttcctttggattgttcattgttagtgaatagaaatacaastgatttttatgtgtttactatgtattctgctattttgctgaatttgtttattagttgtaacagtttttgtggaatttttagggttttctacatacaagat

SEQ ID NO: 61828 - DNA, 201 bp, Homo sapiens
ttgccaggtaactaatcctatgtgccaagcaagtgcctccgcctcaatagttcttctgtccccctggataaagcaccctggaaatctaataccgggggtgytccctggctcctgcaggcacatgctggctgcctcgtgcagttcctggacatgcaacctctctactccctggtcaggcctagcaggtccccatccaggtta

SEQ ID NO: 61829 - DNA, 201 bp, Homo sapiens
actgccacacccacaaggcctccccttccaccaggaaaacgtcccagatcactcttggtgaaaacatttaacaattggggccctaactttgtgccaaagaytacccatatccccacatcaaccagaatggtgtcctcggtgttggccgggaaacggccaccgcaccagctgagtctcaggcccctcctgcaccacttgtgt

SEQ ID NO: 61830 - DNA, 201 bp, Homo sapiens
cagatgcacacaccacacacactcagtctcagacacacacacacaccacatttgcaaacctgctcatcagaagagggacctcgcccccagccgctccgccmccttccaggacagctctgaagggagccctgtcccggagcccagggacctctccccaacccggctgcgcctcacctcaaggaggaaccccggccctggctg

SEQ ID NO: 61831 - DNA, 201 bp, Homo sapiens
aaacgcccccgcagagcccagtggtctgtgaggttgcaggcagggtgcgaatggaagggcacaggtgcggggctggcacctgcccggtcctgcccacctcycctccgcccagcccgcacctgcgtctccccacagagctgtccgtggcacagtgcacgcagcggcccgtggacatcgtcttcctgctggacggctccgagc

SEQ ID NO: 61832 - DNA, 201 bp, Homo sapiens
ttaggatttttgcatcaatgttcataaggaagactggattgtagttttcttctcttgcaatatctttgtctggtattggtatcagagtaatgctggcctcrtaagaatgagttaaatagtgttcccttctcttcaagttttttgaaaattttgggagggtttggtgttagttctttatgtgtttggtagaattcaccagtg

SEQ ID NO: 61833 - DNA, 201 bp, Homo sapiens
gtgggaaggggtcgggccctctcggggctgcagggcagaggccagctgcaccctgagcctgtctaggcagatcagtgaacggccgctgagggttcgctagrgactgaccctggcctggcccggcctctctcctctcttccagaccctcagatcgtgtgcccagaccttccctgccaaacaggtaatgcagggcaccctgag

SEQ ID NO: 61834 - DNA, 201 bp, Homo sapiens; identical to SEQ ID NO: 11994

SEQ ID NO: 61835 - DNA, 201 bp, Homo sapiens
aaattataaaaacaagaaaaaccagcaaactctggggaagaaagagattttgatttcacaaggcatacaaagaaactttcctatttcaaaggaaaaaaaaacaacagaaactgtcactgaaaaagacttggtggtagatctactagacaaaggctttgaaagaactatcttaaagatactcaaataactaagggaaaatgt

SEQ ID NO: 61836 - DNA, 201 bp, Homo sapiens; identical to SEQ ID NO: 11996

SEQ ID NO: 61837 - DNA, 201 bp, Homo sapiens
cgggtcgcggtgtgcgttcgggcgttccatggggagctcccggtgggtgagctgggccactgagcacattcacaggccctgaggctgccccaggggaggarccgtggactcagagccgaggttccccatacgtgctgcgacagagaacctagggcttgcacctgggtctggctgcccttcagcaggcgggcagcctctggc

SEQ ID NO: 61838 - DNA, 201 bp, Homo sapiens
cgggcggccgggcccgggacgcgaagtccgagcagcagcgggcaggggctggcgggggagctcggcccgggctgcaggggggtccccaccctctccacctyctccagcctcccgccctcgagggtccccgcttccctcccatccccctcccgtgcccccggccccctcctcccatccgcggggccgcagcgcttcctggcg

SEQ ID NO: 61839 - DNA, 201 bp, Homo sapiens; identical to SEQ ID NO: 11998

SEQ ID NO: 61840 - DNA, 201 bp, Homo sapiens
tcgaggtcccttgagattccatctaaattttaggatttattcactatttctgaaaaaaaaaacaatcactgggatttttatagggattacattaaacctckagatcaatttgggtggtattgacatcttaatatagtaagtcttccaatctatgaacatgaatgtctttttttaaatgtcctcttcaatttctttcagaaa

SEQ ID NO: 61841 - DNA, 201 bp, Homo sapiens
gagtggccgctatggcttcccctccactccaggttctatcgtgagtgggtgggtgctgcgtctgtggatgtcacgtgacctttcctctttagcctatcatygtagttgggagttagttagcccgttgagcgtcattgaatttccagtgttgagccagccctgcgtgcccgggataaacccacctggccgtggtgtgtggcc

SEQ ID NO: 61842 - DNA, 201 bp, Homo sapiens; identical to SEQ ID NO: 11999

SEQ ID NO: 61843 - DNA, 201 bp, Homo sapiens; identical to SEQ ID NO: 11969

SEQ ID NO: 61844 - DNA, 201 bp, Homo sapiens; identical to SEQ ID NO: 12000

SEQ ID NO: 61845 - DNA, 201 bp, Homo sapiens
tccttccaggggctctggggcagctcccagcctcttcccatgctggtggccaccgtgtcccttgctgcggctgcatcttccagtctctcctccgtcttccwgtggccgctctctttataagaaccctggtcattgaatttaaggcccaccccaagtccagaatgacctcgcaagacccttaactcactcccgtctgcagag

SEQ ID NO: 61846 - DNA, 201 bp, Homo sapiens
gaatgagctgttttggctgccatttctgggacacccagctctgccaggcccctacccctctggtgggccaggctctgacggtggccactcatggcctttcyagctctggtgccagcatagggaaggaggaggcacagccttgtcttactccttgcacctgttagctccccccccgccaagggaggacccgtggttggggac

SEQ ID NO: 61847 - DNA, 201 bp, Homo sapiens; identical to SEQ ID NO: 11972

SEQ ID NO: 61848 - DNA, 201 bp, Homo sapiens; identical to SEQ ID NO: 12001

SEQ ID NO: 61849 - DNA, 201 bp, Homo sapiens; identical to SEQ ID NO: 12002

SEQ ID NO: 61850 - DNA, 201 bp, Homo sapiens
tcctgatggggcagggaagtctcgggaccccatgatgggcgacatggcgatggtcactgtgggtgctttgctatcaggtggggggccttcctctccactcygggtccagtgtgagtggccgctatggcttcccctccactccaggttctatcgtgagtgggtgggtgctgcgtctgtggatgtcacgtgacctttcctctt

SEQ ID NO: 61851 - DNA, 201 bp, Homo sapiens; identical to SEQ ID NO: 12003

SEQ ID NO: 61852 - DNA, 201 bp, Homo sapiens; identical to SEQ ID NO: 12004

SEQ ID NO: 61853 - DNA, 201 bp, Homo sapiens
tggtctggcgtcactttctaggatccatcagtctttgcaatgaccaggccagagaattagacacgacagtccaccaccctcgcctccgtgaggcctttaayggtggtgccatcctcccaggatgcaacgtgatttgtgatttactctcttggccatggaaaggggacttccccactatgatgtctgtcaccacacaggcct

SEQ ID NO: 61854 - DNA, 201 bp, Homo sapiens
atcccaggagctgaggtcttggtgaggccacagggccaggtccacgcaaggactgtccgtgtcctgtcctgtggtctctggccccacgtgacacccacacrtgtggtaggcagcctggcctgggttgtggctatggccaggcccccaagctgtccccgatgcccagggctggtgaccacccaggcaggtgggggccccact

SEQ ID NO: 61855 - DNA, 201 bp, Homo sapiens
agacatccaactccacctggagcctccccagatcattcctaaatcctcggcatgggcgggaccgacgcagcagagggacgagggctggcagcagagccacyggcgcaggctgaggctgttgggaaggagcctggggatcgaggtcccaggtcccaaagccagagccctcctgtagagaaggagcatcggccccggcacagc

SEQ ID NO: 61856 - DNA, 201 bp, Homo sapiens
aattgcatcaaattataccaaatttagtttactattaatagtattttgtttaggatttttgcatcaatgttcataaggaagactggattgtagttttcttytcttgcaatatctttgtctggtattggtatcagagtaatgctggcctcgtaagaatgagttaaatagtgttcccttctcttcaagttttttgaaaatttt

SEQ ID NO: 61857 - DNA, 201 bp, Homo sapiens
tctttgcaatgaccaggccagagaattagacacgacagtccaccaccctcgcctccgtgaggcctttaatggtggtgccatcctcccaggatgcaacgtgrtttgtgatttactctcttggccatggaaaggggacttccccactatgatgtctgtcaccacacaggcctgggatccaatatatggctactccagccacca

SEQ ID NO: 61858 - DNA, 201 bp, Homo sapiens
ttaaagggaatggagccaggctggagagagagtgcctagctctgcaggggagccggtctggggaagctgggatctctctcccgccctcccctctgcactgyttccagggcagccccaggcagtggggggcgccagacagtggtgctccattcccttccatgccgacgcgcccagctacccactccacccagccctggagga

SEQ ID NO: 61859 - DNA, 201 bp, Homo sapiens
ggccgggcccgggacgcgaagtccgagcagcagcgggcaggggctggcgggggagctcggcccgggctgcaggggggtccccaccctctccacctcctccwgcctcccgccctcgagggtccccgcttccctcccatccccctcccgtgcccccggccccctcctcccatccgcggggccgcagcgcttcctggcggcggg

SEQ ID NO: 61860 - DNA, 201 bp, Homo sapiens
cagcaggcaggagccctggactcatggctaccatgtggctgccacactcaggcacacttaggcacatacactcacactcaggcacacttagacacacacaycacactcaacctcagacgcagacacacaccacacactcacagatgcacacacagtctcagacacagacacacaccacacacagatacacacaccacagac

SEQ ID NO: 61861 - DNA, 201 bp, Homo sapiens
aggtgagcgcctcccggaccccgcaccctggaagccgctcggcccgcggggggtgaccccgagtcctgggaaggcggcggcggcggctccgtccctcgggyccccgggaagggggactccagccccagggacggcggggggctcggcgggttcggggctcctcctcgcggggctggggccgcgcctgcccctgtggctccg

SEQ ID NO: 61862 - DNA, 201 bp, Homo sapiens
atgggctgccgctgccatcagtaatatttatagtgatatttatctgtagagttacttttagggacttttttttttatcaagctttggtcacaggttatgcmacatttaaaaatgaattgggaaaaagtttatctttttatgttctaaaacaagttaaatagcatgaagtgcttgtccttgaagctgtgaaactcacccaca

SEQ ID NO: 61863 - DNA, 201 bp, Homo sapiens
ttataccaaatttagtttactattaatagtattttgtttaggatttttgcatcaatgttcataaggaagactggattgtagttttcttctcttgcaatatytttgtctggtattggtatcagagtaatgctggcctcgtaagaatgagttaaatagtgttcccttctcttcaagttttttgaaaattttgggagggtttgg

SEQ ID NO: 61864 - DNA, 201 bp, Homo sapiens
tccaccgagatcgaccaggacaccatcaaccgcatcatcaaggtcatggtgagccgcgggcgggagcaccgtccacgcgccaggggtggccacggtgggcygtccacccactccgggcctcactttacccctctgtgagtgcggaggccgaaggaggaagctccgggcagggcctgggccactcaggtgtccctccatccc

SEQ ID NO: 61865 - DNA, 201 bp, Homo sapiens; identical to SEQ ID NO: 11957

SEQ ID NO: 61866 - DNA, 201 bp, Homo sapiens
aggggttgggggccgggggctctggcattcgggggcagtgaggtcaaacccacaaacaggcacggggccaggaaacggggctccaacagcagtccctcctraggctggctcgtgacaggtcctgtgccccacagagaagaccgactgccccatccacgtgtacttcgtgctggacacctcggagagcgtcaccatgcagtc

SEQ ID NO: 61867 - DNA, 201 bp, Homo sapiens; identical to SEQ ID NO: 11961

SEQ ID NO: 61868 - DNA, 201 bp, Homo sapiens
tcgccgtggcccccaaccagaacctgaaggagcagggcctgcgggacatcgccagcacgccgcacgagctctaccgcaacgactacgccaccatgctgccygactccaccgagatcgaccaggacaccatcaaccgcatcatcaaggtcatggtgagccgcgggcgggagcaccgtccacgcgccaggggtggccacggtg

SEQ ID NO: 61869 - DNA, 201 bp, Homo sapiens
ccagaacctgaaggagcagggcctgcgggacatcgccagcacgccgcacgagctctaccgcaacgactacgccaccatgctgcccgactccaccgagatcraccaggacaccatcaaccgcatcatcaaggtcatggtgagccgcgggcgggagcaccgtccacgcgccaggggtggccacggtgggctgtccacccactc

SEQ ID NO: 61870 - DNA, 201 bp, Homo sapiens
tttggtgccaaaactttactggaggtcacatgggactaggggccttctgtccctgccagcgcctccattcccaggcgatgccccgctgcctgcccacctaycctccgggccccacacgaacaagctgtgtccccaccgaggtcacagctctgccctctggggatgggcgagggaggggccacagagcccggagaggcctcc

SEQ ID NO: 61871 - DNA, 201 bp, Homo sapiens
cgcacgagctctaccgcaacgactacgccaccatgctgcccgactccaccgagatcgaccaggacaccatcaaccgcatcatcaaggtcatggtgagccgygggcgggagcaccgtccacgcgccaggggtggccacggtgggctgtccacccactccgggcctcactttacccctctgtgagtgcggaggccgaaggagg

SEQ ID NO: 61872 - DNA, 201 bp, Homo sapiens
tgggcctgcagcaggcctgtggagttctcagttgcgtggggaccagagggtgctggagaaacaaaccagacgcagctgaaggcagtcagggcagggcgcamtcagcgataagagctgcataggggccacagcgtaacctgagctccagtcggtggaaagaaaaggcagagacgttgcagaggccaggtctgctcaggggaa

SEQ ID NO: 61873 - DNA, 201 bp, Homo sapiens
gactacgccaccatgctgcccgactccaccgagatcgaccaggacaccatcaaccgcatcatcaaggtcatggtgagccgcgggcgggagcaccgtccacrcgccaggggtggccacggtgggctgtccacccactccgggcctcactttacccctctgtgagtgcggaggccgaaggaggaagctccgggcagggcctgg

SEQ ID NO: 61874 - DNA, 201 bp, Homo sapiens
ggggtttgggaagcccagcggtacctgaggagtttctggacatttaagccggttcctaggtgtggccttaacagggaggctgcccttcctttcactgaatragctgcgtcactcataagctcactgagggaaccccatctgccagctcgtgcgtgctcagacggcgtccatgtctcaagcgttctgtgaaggctgcggtgc

SEQ ID NO: 61875 - DNA, 201 bp, Homo sapiens
atcgaccaggacaccatcaaccgcatcatcaaggtcatggtgagccgcgggcgggagcaccgtccacgcgccaggggtggccacggtgggctgtccacccrctccgggcctcactttacccctctgtgagtgcggaggccgaaggaggaagctccgggcagggcctgggccactcaggtgtccctccatccccacccagac

SEQ ID NO: 61876 - DNA, 201 bp, Homo sapiens
gttcctaggtgtggccttaacagggaggctgcccttcctttcactgaatgagctgcgtcactcataagctcactgagggaaccccatctgccagctcgtgygtgctcagacggcgtccatgtctcaagcgttctgtgaaggctgcggtgcagcgtgaggtcaccctgctgtgttcagagctttgctcactgcctgcggggc

SEQ ID NO: 61877 - DNA, 201 bp, Homo sapiens
agacttctccacttgggcaggggaatcagtaacctctgctgtgtcacctctcagaggagctgtggcagggtccccagctgcctaccgcccaccctaccctrcctcgatgtactcttttctctgcttttagggtgccaagggcaacatgggtgagccgggagagcctggccagaagggaagacaggtgagtgtccttgcccc

SEQ ID NO: 61878 - DNA, 201 bp, Homo sapiens
tgtggcagggtccccagctgcctaccgcccaccctaccctgcctcgatgtactcttttctctgcttttagggtgccaagggcaacatgggtgagccgggaragcctggccagaagggaagacaggtgagtgtccttgccccacgcccgccccgcctgcagcccagcgccccagggctgggctcacactgctgcgttgtcct

SEQ ID NO: 61879 - DNA, 201 bp, Homo sapiens
tccccccagttaccaaggaacagaagcacctcgataacttgatggccgtcccaaaacccagcctccagcccgacccagggctcagcctcctccgcagactrtttgtcgagaacactagatgccagcggcccaccgagcactcccctcagcctgcagggctggcccttccctgcctgtgtctctgcagagctcctcactaat

SEQ ID NO: 61880 - DNA, 201 bp, Homo sapiens
cattgcaagcccttctccgtctggttgaagtgacttccaggagatttaaagggctggcacccttttctcccttcatttttctctttttcctcttttgagasgtagacattgaagactagcacattcaaaagcaaccatatatgtggagaaaataaaaaagtcattgcacatgctcaggggaagtcacgggcttagaaaaga

SEQ ID NO: 61881 - DNA, 201 bp, Homo sapiens
gagctgaaaagtacaataactgaaatttaaaattcactagagaaatgcaaaggcagatttcagcaggcagaataaagaatcagggaacttgaagatacaamaatggaaattattgagtctgaggagcagaaataaaaagattgaataaaggtgatcagagcctaaggggtctgtgggataccatcaagcaaaccaacataa

SEQ ID NO: 61882 - DNA, 201 bp, Homo sapiens
caccaatgtcccctcaccaatgtcccctcccagccttccctcctgagtcccctccccagtctcccctcccagactcccctcccagcctcccctccccagcrttccctcccagcctcccctccccagcgttccctcccagcctcccctcccagcctcccctccccagcgttccctcccagcctcccctccccagcctcccct

SEQ ID NO: 61883 - DNA, 201 bp, Homo sapiens
tggagggaggcagaggcccctgcaggtgcacaggctccacccacaggagctacacaggagctgcccagggcctctgcagggagagggcgctcccctctctygtgccagctcccacgtgtgcagcctcggaccctgcagggcaggaacgtcagtcccactggaagggacttccagctacctacaggctctacccacagctcc

SEQ ID NO: 61884 - DNA, 201 bp, Homo sapiens
ccagggctcagcctattccgggatgagctcacccgagtcacactggaccagggctcagcctattctaggatgagctcacccgagtcacactggaccagggmtcagcctattccgggatgagctcacccgagtcacactggaccagggctcagcctattccgggatgagctcacccgagtcacactggaccagggctcagcc

SEQ ID NO: 61885 - DNA, 201 bp, Homo sapiens
tgcccgactccaccgagatcgaccaggacaccatcaaccgcatcatcaaggtcatggtgagccgcgggcgggagcaccgtccacgcgccaggggtggccayggtgggctgtccacccactccgggcctcactttacccctctgtgagtgcggaggccgaaggaggaagctccgggcagggcctgggccactcaggtgtccc

SEQ ID NO: 61886 - DNA, 201 bp, Homo sapiens
tatcctgggataagctcacccgagtcacactggaccagggctcagcctattccgggatgagctcacccgagtcacactggaccagggctcagcctattctrggatgagctcacccgagtcacactggaccagggctcagcctattccgggatgagctcacccgagtcacactggaccagggctcagcctattccgggatga

SEQ ID NO: 61887 - DNA, 201 bp, Homo sapiens
ctatcctgggataagctcacccgagtcacactggaccagggctcagcctattccgggatgagctcacccgagtcacactggaccagggctcagcctattcyaggatgagctcacccgagtcacactggaccagggctcagcctattccgggatgagctcacccgagtcacactggaccagggctcagcctattccgggatg

SEQ ID NO: 61888 - DNA, 201 bp, Homo sapiens
ggccctgcgtgcggggcgcggtccccaacacccagggccccggaggcggacacagccccagccaggtcgtccgggaaatggggcgggggcgacgggcggcsgggcccgggacgcgaagtccgagcagcagcgggcaggggctggcgggggagctcggcccgggctgcaggggggtccccaccctctccacctcctccagcc

SEQ ID NO: 61889 - DNA, 201 bp, Homo sapiens
atcccacccaaaactgagcccagaggcacccactaaacatctgtgaccccacccagggtggggcaagagggcgcaagccccccagtccagatgctggtgayggtgtgtgctgggcgcagaccccgcttccttgaagactgagggcagtgcccccaatcccgctgacctgctgtgcgtgcgcctgccatgggggagggtgcc

SEQ ID NO: 61890 - DNA, 201 bp, Homo sapiens
gggcctgtgcctcctgttctcagctctggagtgaggggatgcctccggggtccaggaagcccccctggctctcctcttcagcagtgacccttgggtgtgcrtggcacatccttcctgaggcagggcctgagggcagctacgtggcctgagtagggtcctccccgcgtgtgggcaggcttcgggtctctaggcacgtccagc

SEQ ID NO: 61891 - DNA, 201 bp, Homo sapiens; identical to SEQ ID NO: 11992

SEQ ID NO: 61892 - DNA, 201 bp, Homo sapiens
ctccgcgcccaggctctgctgtccctgccctcccggctccccaccctcaggccccaggagcagcagtttctgcaggagctcctgacccggggcctctcgcrggaggcctgagcaagccggacacaggacacggggtaggggaggggtggggcggctgatggggggaaccctgcaccccccagggcagctgctaccaagggg

SEQ ID NO: 61893 - DNA, 201 bp, Homo sapiens; identical to SEQ ID NO: 11993

SEQ ID NO: 61894 - DNA, 201 bp, Homo sapiens
gcaggggtggctcgccgcatgcccaggctctgccccaacctccgcgcccaggctctgctgtccctgccctcccggctccccaccctcaggccccaggagcrgcagtttctgcaggagctcctgacccggggcctctcgcgggaggcctgagcaagccggacacaggacacggggtaggggaggggtggggcggctgatggg

SEQ ID NO: 61895 - DNA, 201 bp, Homo sapiens
ggccgtcccaaaacccagcctccagcccgacccagggctcagcctcctccgcagactgtttgtcgagaacactagatgccagcggcccaccgagcactccyctcagcctgcagggctggcccttccctgcctgtgtctctgcagagctcctcactaatgcccctctctcctcctgcccccagggcgttcctggcttcaaag

SEQ ID NO: 61896 - DNA, 201 bp, Homo sapiens
ggctgggggactgtgaccagggtggggagtggggaccccagacagagccctaccagggacccctgtcactctgtccccggctgggctcaggtggggacctmacggtggtcccagggcccagcaccaagcccacctgtggtttccagcgggaaaggggtggcaggggtggctcgccgcatgcccaggctctgccccaacctc

SEQ ID NO: 61897 - DNA, 201 bp, Homo sapiens
tgaatgagctgcgtcactcataagctcactgagggaaccccatctgccagctcgtgcgtgctcagacggcgtccatgtctcaagcgttctgtgaaggctgyggtgcagcgtgaggtcaccctgctgtgttcagagctttgctcactgcctgcggggctggaccgttgcacctccagggcccccagaaaccgagtttcgggt

SEQ ID NO: 61898 - DNA, 201 bp, Homo sapiens
agacggcgtccatgtctcaagcgttctgtgaaggctgcggtgcagcgtgaggtcaccctgctgtgttcagagctttgctcactgcctgcggggctggaccrttgcacctccagggcccccagaaaccgagtttcgggtcagggtcctctgtgtgcattcctgggggtccatgtaccagctgtgacgacgtccaggggttgg

SEQ ID NO: 61899 - DNA, 201 bp, Homo sapiens
agcgttctgtgaaggctgcggtgcagcgtgaggtcaccctgctgtgttcagagctttgctcactgcctgcggggctggaccgttgcacctccagggccccsagaaaccgagtttcgggtcagggtcctctgtgtgcattcctgggggtccatgtaccagctgtgacgacgtccaggggttgggctgagaagcagacaccct

SEQ ID NO: 61900 - DNA, 201 bp, Homo sapiens
ggccctgcacgttgagttgctgcctcctgtggcctatttcacgtttatgcaaagtcgggcgcctgatgcggggctcacccgccacaagcaggggtcctggygctgctcatggaaggggccctacccagcccgcggggcactggctgggacggggctgcccaggtccgcccaggatccaaacacccagccccgcccagcggc

SEQ ID NO: 61901 - DNA, 201 bp, Homo sapiens
tactggaggtcacatgggactaggggccttctgtccctgccagcgcctccattcccaggcgatgccccgctgcctgcccacctaccctccgggccccacaygaacaagctgtgtccccaccgaggtcacagctctgccctctggggatgggcgagggaggggccacagagcccggagaggcctcccgcaccgtcactcctg

SEQ ID NO: 61902 - DNA, 201 bp, Homo sapiens
agtgcctagctctgcaggggagccggtctggggaagctgggatctctctcccgccctcccctctgcactgtttccagggcagccccaggcagtggggggcrccagacagtggtgctccattcccttccatgccgacgcgcccagctacccactccacccagccctggaggacatggaagggcctcaaccatccaaatccca

SEQ ID NO: 61903 - DNA, 201 bp, Homo sapiens
cctcccaggagggcagcctgtgcagggatggtgctcagcaggtggacagggcctggggcctgtgtcagggtctcaggcctgggagcaccagcagaggagayggcggctcccagcagtgccgcctgaaagtgtcttgggctaaggacccacacccagggctgccctgcagaaacgcccccgcagagcccagtggtctgtgag

SEQ ID NO: 61904 - DNA, 201 bp, Homo sapiens
gaggccaccgtctccgccagcgtcagcggcacagagactgcccgcctcagaccctcctgtagggccgccgtgcgcctgaaaggagcaagaggagagcctgrgcacagcggcacacacaggcaggcagtggacacactgcaccccaacagggctgagcaggctgcagaagcgggcgatgggaagtcattcccaaacacccag

SEQ ID NO: 61905 - DNA, 201 bp, Homo sapiens
gctcagcaggtggacagggcctggggcctgtgtcagggtctcaggcctgggagcaccagcagaggagatggcggctcccagcagtgccgcctgaaagtgtyttgggctaaggacccacacccagggctgccctgcagaaacgcccccgcagagcccagtggtctgtgaggttgcaggcagggtgcgaatggaagggcacag

SEQ ID NO: 61906 - DNA, 201 bp, Homo sapiens
caggccccaggagcagcagtttctgcaggagctcctgacccggggcctctcgcgggaggcctgagcaagccggacacaggacacggggtaggggaggggtsgggcggctgatggggggaaccctgcaccccccagggcagctgctaccaaggggcgagtcccagggcccccgtcggccctgcgtgcggggcgcggtcccca

SEQ ID NO: 61907 - DNA, 201 bp, Homo sapiens
cacacaaatgcatgctcaaacgcaaatgcacgctcacacatgcgaatgcacactcacacatgaatgtatcctcacatgcacaaatggatgctcacacacgygaatgcatgctcacacacaaaagcacactcaaactcaaatgcacacacacgtgaatgcatgctcacacacgtgaatgtatgctcacacacatgctcaaac

SEQ ID NO: 61908 - DNA, 201 bp, Homo sapiens
acacctcccctccagcagtctacacctcccctccagccatctacacctcttctccagccatctacacctcccctccagcagtctacacctcccctccagcygtctacacctcttctccagccgtctgcacctcccctccagcagtctacacctcccctccagccgtctacacctcttctccagccatctacacctcccctc

SEQ ID NO: 61909 - DNA, 201 bp, Homo sapiens
cctcccctccagcagtctacacctcccctccagccatctacacctcttctccagccatctacacctcccctccagcagtctacacctcccctccagctgtmtacacctcttctccagccgtctgcacctcccctccagcagtctacacctcccctccagccgtctacacctcttctccagccatctacacctcccctccag

SEQ ID NO: 61910 - DNA, 201 bp, Homo sapiens
cagcagtctacacctcccctccagctgtctacacctcttctccagccgtctgcacctcccctccagcagtctacacctcccctccagccgtctacacctcytctccagccatctacacctcccctccagcagtctacacctcccctccagcagtctacacctcccctccaaccgtctacacctcctctccagccatctaca

SEQ ID NO: 61911 - DNA, 201 bp, Homo sapiens
gggaggaaatgctcatcattgcatccgcccaccccacccctgcagtgccacattcaccagcctcgctgggcatcttccccctccccgccctctgcccctgscgcattcaccagcctcactgggcatattctgccctccccgcccctgcggtggcatattcaccagccccgctgggcatgtcccccaccctgcccctgcagt

SEQ ID NO: 61912 - DNA, 201 bp, Homo sapiens
aacgtgcacagcctctgacttccagccttgtgcaacaggcacatcagatgggggatagtaagatgagtgctgagtgagtccccggaatggaggtctgggtccccccatagcaaggtcacggctctgggaagccccacggtccctagcccctccccttcactccctccaccagcctttatttaattaattaattaatttatt

SEQ ID NO: 61913 - DNA, 201 bp, Homo sapiens
aatggaggtctgggtccccccatagcaaggtcacggctctgggaagccccacggtccctagcccctccccttcactccctccaccagcctttatttaattwattaattaatttatttatttattgtatatatattttttgagacggagtctcgctctgttgtccaggctggagtgcagtggcacgatcttggctcactgca

SEQ ID NO: 61914 - DNA, 201 bp, Homo sapiens
gaggtctgggtccccccatagcaaggtcacggctctgggaagccccacggtccctagcccctccccttcactccctccaccagcctttatttaattaattwattaatttatttatttattgtatatatattttttgagacggagtctcgctctgttgtccaggctggagtgcagtggcacgatcttggctcactgcaagct

SEQ ID NO: 61915 - DNA, 201 bp, Homo sapiens
aattccaggcgcagaggaggaggggacagggtgggtcctcagtcctccatggccagtcagcctcctgcaggtcccgcagtgtggccccctcctgacccctkactccccctccccagaacttcacagggccgggggatcctgactccattcgctgcgacacccggccacagctgctcatgaggggctgtgcggctgacgaca

SEQ ID NO: 61916 - DNA, 201 bp, Homo sapiens
tcagctcctctgaaataaacacctttcagtgagatttgtttgtttctgtgtggattacatttaggctttcttttctctcttgctgggatacttgctgatgyacttttatttctggaggacttctttaaaaaattctgtggttccaaaagtcagagccctacaaagaggcaccctggggactgtcgccctcccctcccacct

SEQ ID NO: 61917 - DNA, 201 bp, Homo sapiens
tctgggtccccccatagcaaggtcacggctctgggaagccccacggtccctagcccctccccttcactccctccaccagcctttatttaattaattaattwatttatttatttattgtatatatattttttgagacggagtctcgctctgttgtccaggctggagtgcagtggcacgatcttggctcactgcaagctccgc

SEQ ID NO: 61918 - DNA, 201 bp, Homo sapiens; identical to SEQ ID NO: 12051

SEQ ID NO: 61919 - DNA, 201 bp, Homo sapiens
ctagcagtcagtctggttagggttagaccacaagtccagacctgcctcttgtgggctgtggttctcatgtgagttcagtttttattttttcttttcttttyccttccttccttccttccttccttccttccttccttccttccttccttccttccttccctccctccctcccttccttcttcctttctttctttctgacag

SEQ ID NO: 61920 - DNA, 201 bp, Homo sapiens
acatatgcacttttaattccagactgctctaagtaatcatcctgtttctgtaaagagtcataacggttgtacttcctgtacaatgtgccgtttgggtcatkcctctgagcttgaagctctttgacaattgaatatgtatctttggattccagacatgttaaattacacaatgcctcccatttcctctttttaaatcttgac

SEQ ID NO: 61921 - DNA, 201 bp, Homo sapiens; identical to SEQ ID NO: 12052

SEQ ID NO: 61922 - DNA, 201 bp, Homo sapiens
tgtggttctcatgtgagttcagtttttattttttcttttctttttccttccttccttccttccttccttccttccttccttccttccttccttccttccttccctccctccctcccttccttcttcctttctttctttctgacaggatcttactctgtcacccaggctggagtgcagtggtgtgatcttggctcaccatag

SEQ ID NO: 61923 - DNA, 201 bp, Homo sapiens
gtggttctcatgtgagttcagtttttattttttcttttctttttccttccttccttccttccttccttccttccttccttccttccttccttccttccttccctccctccctcccttccttcttcctttctttctttctgacaggatcttactctgtcacccaggctggagtgcagtggtgtgatcttggctcaccatagc

SEQ ID NO: 61924 - DNA, 201 bp, Homo sapiens
tggttctcatgtgagttcagtttttattttttcttttctttttccttccttccttccttccttccttccttccttccttccttccttccttccttccttccctccctccctcccttccttcttcctttctttctttctgacaggatcttactctgtcacccaggctggagtgcagtggtgtgatcttggctcaccatagcc

SEQ ID NO: 61925 - DNA, 201 bp, Homo sapiens
ggttctcatgtgagttcagtttttattttttcttttctttttccttccttccttccttccttccttccttccttccttccttccttccttccttccttccytccctccctcccttccttcttcctttctttctttctgacaggatcttactctgtcacccaggctggagtgcagtggtgtgatcttggctcaccatagcct

SEQ ID NO: 61926 - DNA, 201 bp, Homo sapiens
tacggaattgtgcaatcatcaccacaatctaatttcagagcatttccaccccctgaaagatccttctgctcatttgcagtcacttcctcctagctcctttaaaaaaaaaaaaaagatataaactattttaagaatacagaacagcatggagagcactagtaccaatccccaaacagctacctctcatcttaccaaatctta

SEQ ID NO: 61927 - DNA, 201 bp, Homo sapiens
cccagggccagtccccgccgggtgccatcctgagcagggccacagaacggatgtcccacatggccaggacccctgtggccacctgaccccgggggggctgyggccctcggtgaagcaggtgaccgggcgggctgtggggtttgtcagctccgcagcgtcactgccgctcagcgtatgagtttccactcccagcactcaatg

SEQ ID NO: 61928 - DNA, 201 bp, Homo sapiens
cgcctgcgccgggtggatgcggcggcacttgggtgcggtgggctcccaacctcactgtccgaccaaaggatcgccccggctgggcggggacctggcgcgcmtaggccgggaggggacagctggtttcgggcggcctctgccccagtgacctgtagactttggctttggttcagggacgtctggggttaaaaatgatcgttt

SEQ ID NO: 61929 - DNA, 201 bp, Homo sapiens
tttttagtaaagaaaactctacaatagaactttgaagccctctgcttccatctcccaggcccgtagccttctctgtcttcaggggtaaccactgtcctgcyctaggggtgtgtgggtctgcagggacgaggtgcatgttattcttcaatgcctccttctacattttgcttttcagaagaatctcagtgttacggatctgtg

SEQ ID NO: 61930 - DNA, 201 bp, Homo sapiens
gggtgaggaaggcagcccacaggcatccagggtgaggaaggctgcccacaggcatccagggtgaggaaggcagcccacaggcatccagggtgaggaaggcwgcccacaggcatccagggtgaggaaggctgcccacaggcatccagggtgaggaaggcagcccacacttttcttggagacacatccccaaagaagtcctca

SEQ ID NO: 61931 - DNA, 201 bp, Homo sapiens
tcctccttggctggttcctccgctccattctctggctcaggaatttgctccccagggtttttcattccgctctgtagcagaatgtgctactgttgctttcyagcatcaaacttttcactcccatggcctctgtgttcttcttcctaatgggtgccctttctgcctggcgctcctggaggccgggcccctctcccaagtgtg

SEQ ID NO: 61932 - DNA, 201 bp, Homo sapiens
gctggaggagagggtgccagtgcacagcccgctcggggccacacgcccccagacaccctgtgtgagatgtgaggtgtggctccttttgttctgtccccacyggcaggccaggcagcagcgttcaacgtgaccttccggcgggccaagggctaccccatcgacctgtactatctgatggacctctcctactccatgcttgat

SEQ ID NO: 61933 - DNA, 201 bp, Homo sapiens
ggtcgtgggagcctgtagtcccagctactcaggaagctgaggcaggagaatggcatgaacctgggaggcggagcttgcagtgagctgagatcgcgccactrcactccaggccggtgacagcgcaactccgtctcaaaaaaataaaaaggaagcctgaccccgctggattcctctcccagcataggctctgccctctctctg

SEQ ID NO: 61934 - DNA, 201 bp, Homo sapiens
gtggacacccgtgtgtggctgcaccccggcctccccaggcagcttgtcctctgggcgtccgccgctgtgggtgagcttggctgccggtgctgggaccctgsgggggctgccccacgtctagctcttcctcaaagtgacggcttccatgcggggagtgtcctcagggagaaagattctgctctgaaaacctcccacactcac

SEQ ID NO: 61935 - DNA, 201 bp, Homo sapiens
aaaaataaaaaggaagcctgaccccgctggattcctctcccagcataggctctgccctctctctgctgtcttgcttaaagtttcctttctttttcttttcttttttttttgagacagggcctcgttctgtcaactaggctggagttcagcagtgccattagggttcactgcagtctctccctcctgggcgcgagtgatcct

SEQ ID NO: 61936 - DNA, 201 bp, Homo sapiens
gcacgctttcctgcagagtcagcaggtttggggccagtgacgggacccaccaaacacagcccttatcagaatccaggggctttgcagggacaaggtggccragaggaaatgtactttgatgtaaatgtattttgatacatgtatatctatatttgataaattcatgtatcagattcaggaaattcagcattggtatctcat

SEQ ID NO: 61937 - DNA, 201 bp, Homo sapiens
gacagaacagaaagttttgcaatgctttttcatacaatgtctggaatttacagataacaccagtagttttggtcaggggttaataataataataataatawtattattagtttaaccaccagggccgggtggtggcgccaaggtcatctggctatttatcttacttctgtttctttccaactttttgctttctctcttttc

SEQ ID NO: 61938 - DNA, 201 bp, Homo sapiens
ccgcagtgtggccccctcctgacccctgactccccctccccagaacttcacagggccgggggatcctgactccattcgctgcgacacccggccacagctgytcatgaggggctgtgcggctgacgacatcatggaccccacaagcctcgctgaaacccaggaagaccacaatgggggccagaagcagctgtccccacaaaa

SEQ ID NO: 61939 - DNA, 201 bp, Homo sapiens
cgcagtgtggccccctcctgacccctgactccccctccccagaacttcacagggccgggggatcctgactccattcgctgcgacacccggccacagctgcycatgaggggctgtgcggctgacgacatcatggaccccacaagcctcgctgaaacccaggaagaccacaatgggggccagaagcagctgtccccacaaaaa

SEQ ID NO: 61940 - DNA, 201 bp, Homo sapiens
gtgtgtcagtcacagcgcatgtcttccccgccggccgtggcttctcacatcggcactctgccaccttccctacatgcggggatgcacacatgcacgataamacacacacacacaagcaaatgcatgctcacacaaatgcacgctcacacacaaatgcacgctcatgcacgtgaatgcacgctcacacacaaatgcatgttc

SEQ ID NO: 61941 - DNA, 201 bp, Homo sapiens
ccccatggaaaccaagtcacaggcatccagggtgaggaaggctgcccacaggcatccagggtgaggaaggctgcccacaggcatccagggtgaggaaggcwgcccacaggcatccagggtgaggaaggctgcccacaggcatccagggtgaggaaggcagcccacaggcatccagggtgaggaaggctgcccacaggcatc

SEQ ID NO: 61942 - DNA, 201 bp, Homo sapiens
gccgtagtgcgacgctcttgcagcctgacgttgtaggctctgggggccgcaaaggactttagagatacaagactcaggtcctccgccgggagccacagacaggggagggacggccctcgggtcccggaactcgggtagggagagccgcacctgacactcacggcctctaccgaaactgagtgtccctcagtgcgaaagcag

SEQ ID NO: 61943 - DNA, 201 bp, Homo sapiens
ccgtagtgcgacgctcttgcagcctgacgttgtaggctctgggggccgcaaaggactttagagatacaagactcaggtcctccgccgggagccacagacaggggagggacggccctcgggtcccggaactcgggtagggagagccgcacctgacactcacggcctctaccgaaactgagtgtccctcagtgcgaaagcagg

SEQ ID NO: 61944 - DNA, 201 bp, Homo sapiens
gcccttaggtttcatttggaaccacagggcctggcctggaatccagcaggggctgggccaggttctcactgacccctggccatggtgatggatggtgagcyggggccctgggaacctccgtctctctaagtgctgtgttgtggggtgacctcggacctgtgggcacacggctcagtgagatggggctggactgacgctcag

SEQ ID NO: 61945 - DNA, 201 bp, Homo sapiens
cttcaatgcctccttctacattttgcttttcagaagaatctcagtgttacggatctgtgggtcacgaggcttcagagcagcacttcaagggctcttattcrttaccccgtagcgtgagtgtggcaccatggatgtatgtgatctaggctatatttgggtccacttttcaggagtgctgttttttttctttcatgccatcct

SEQ ID NO: 61946 - DNA, 201 bp, Homo sapiens
tctcagtgttacggatctgtgggtcacgaggcttcagagcagcacttcaagggctcttattcattaccccgtagcgtgagtgtggcaccatggatgtatgygatctaggctatatttgggtccacttttcaggagtgctgttttttttctttcatgccatcctttggacagcatctaatttcattcaattgtgtccgtgaa

SEQ ID NO: 61947 - DNA, 201 bp, Homo sapiens
gctttagaatatgtggttatttcccttgtggtctagtaattatgtgtttatcattgtcccactttgtaacataattgtgtttaagttggagacgaatggtyacgttcctcaaattctctacctgccaaatttgcatttctatttgattttttcttgtttgtttgttgttgtttttgtttttgagtaagagtttccttctca

SEQ ID NO: 61948 - DNA, 201 bp, Homo sapiens
ccgagggtgagtgtgcagaggccccgctatgtccacggtgatttttggagggaagcactctcctgccccagcctggagtgaccctggtggccctgcttatrgccccggcccaggggtgtctggcaggaaggggtctccagaccgtctgctccagggtcccctttgagacccggcaaggggaagtgcctgccaccaagagca

SEQ ID NO: 61949 - DNA, 201 bp, Homo sapiens
ggggtctccagaccgtctgctccagggtcccctttgagacccggcaaggggaagtgcctgccaccaagagcagagccacatggtgtgctgggagcgcttgyggctgaggatggggccggcatgggaggacaaggggctgtgaggccggcaaggccaggaagaggctgggcccacaagcccctagggggacggctggggggt

SEQ ID NO: 61950 - DNA, 201 bp, Homo sapiens
ggggcccctctcctctgtcagttcctgggtggggagaaggaggggtggcatggctgcaatggggaaggggggggatggccggagagctcagcctgggagcragctgtgggggcataggggacactcgctgtcactcgccttccccgtgacggtggcgcaacgcctgcgggtttgggggctgaggccggattctggaggctt

SEQ ID NO: 61951 - DNA, 201 bp, Homo sapiens
gtggcgcaacgcctgcgggtttgggggctgaggccggattctggaggcttcacagaaatgagctgctagaagctctgggctgtctgccgtcaccccagcgyttcaccatgagtgaagcccagctcactgcagaatccatgcccagctcactgcagaatccccgggggccagcactttaccaagagtggcctccagactcca

SEQ ID NO: 61952 - DNA, 201 bp, Homo sapiens
catgagtgaagcccagctcactgcagaatccatgcccagctcactgcagaatccccgggggccagcactttaccaagagtggcctccagactccacatttyaggaaggaactccttccccatccagctcacagcagaatccccagggtccctgccagcctggcacccagcgtgcccctcagtattctggggatgagtgggg

SEQ ID NO: 61953 - DNA, 201 bp, Homo sapiens
gttttataatacagattttctcaggtaagtttatcatttaatcatgagatacctggctatatcttaaggccttttgtgtgtaactggtgagggcctctacrtgtcaagtaacgccttcaatacccagttatggcagaaagacagaagctaaatgatgataccaatggaatacaggatgaatctgacaagactgtagatgag

SEQ ID NO: 61954 - DNA, 201 bp, Homo sapiens
tagccccttccaaagtgagtccaaagtctgggaccttcaggtgctctccttgttctccccagtgttaagcatctggtggtttaatgggttgccagaagctycactctttttatgcagcctctctggaagtcacccactaaggaatgtactcataatgaccacatacaaaaaaaatccaactgcacagacacttaaccacca

SEQ ID NO: 61955 - DNA, 201 bp, Homo sapiens
ccgtcaccaagaccccttccctccacaggacatgctgggcctgcgccccccactgctcgccctggtggggctgctctccctcgggtgcggtgagttctgtrttccacggaggggactccacgcgtgacattccaatcagggagaacagggcctgccctcactttcccatagacagaagttcccgggaggctggggaaggac

SEQ ID NO: 61956 - DNA, 201 bp, Homo sapiens
gaaggtctttttgacgttccaaccttgttccagagaaatgaggggagctcctgagacatggggaagaagcacggactccaagggtgagcccccagtccacrtccagctctacttcttactggctgcctgacctggaacaagctgtgttttgtcttgtcaaaagtataggtggagggatcactaaagcttggccctgggagg

SEQ ID NO: 61957 - DNA, 201 bp, Homo sapiens
ggaggggagcttcatgggtggtcagccccaggggttgggcctgagaccgtcaccaagaccccttccctccacaggacatgctgggcctgcgccccccactkctcgccctggtggggctgctctccctcgggtgcggtgagttctgtgttccacggaggggactccacgcgtgacattccaatcagggagaacagggcctgc

SEQ ID NO: 61958 - DNA, 201 bp, Homo sapiens
cacccagccaaggctaccggtcagtctgtccctggacagggggtgacaggtgagcctgtctggcagcccttgccaggggctgtgaaatcttcctttgggtsagtcagggaagcaagaatgccacctcctcagctctctccctcaaggaggagccacaccacgcagaggaaggcagaggagggaggaactgtgctcccagtg

SEQ ID NO: 61959 - DNA, 201 bp, Homo sapiens
catcgttgcttaactgttttcctcgttccatctcctttgaacattgagcatcttcccacccccagggggcctggaagacttcccagcataactccccaccyagccaaggctaccggtcagtctgtccctggacagggggtgacaggtgagcctgtctggcagcccttgccaggggctgtgaaatcttcctttgggtgagtc

SEQ ID NO: 61960 - DNA, 201 bp, Homo sapiens
ccaggcaccagctcccagtgtcccctccctgcaggggtgtgggcggcgctccatcctcccagcgatgatgtgtggcctcatgcacagaacatggtccccarggaggctcttgagcctcggtgtctactgggggtcagtcacagcggcgcggctgacaccccatggctgacctcagtctctagccctccagaggtcaagctg

SEQ ID NO: 61961 - DNA, 201 bp, Homo sapiens
cggggcccctgcacgttttgagcacatttagtccgtggcaagtgctcagtaggcctcgaggaaagcaaaatgtgccataggggtgttctccaccaagggcraggggcctggaggacagggcggctgtcccttgtcccacatcactggggggagcctgaccttggggcccctcctgtccccaggtgtgacactggctacatt

SEQ ID NO: 61962 - DNA, 201 bp, Homo sapiens
gccctgcttcttcaggtctcatgttccacaggctcctgagaggcagaggggctggggctggggggccgctggcggactccatcaggcatggccagcagccrgccaggactcttgcagaactgagacctgggagctcctccctcaccaggaagggacccgaggcaggcggcgggggtctctgagcctgtaggtgacatgcct

SEQ ID NO: 61963 - DNA, 201 bp, Homo sapiens
gatggaaacttggggtaggtgttggggaaaagaggtgctgagagtctcagcagagggcagagtccaggagtcctggagtgcagctctcagcccctgcgccrtgcctagaggagaggctggcaagcccctgtcccatggatgggtgaatgggtgagtgacagtggcaacaagcccatgccagcagggaggtcccactgccat

SEQ ID NO: 61964 - DNA, 201 bp, Homo sapiens
gcaggcaggaggactcacacgggcaggcctggacaatgctgcagctcagggctttgctttcttttcttatcctcatgatgcaacagtaattttttttttattttttatttattttattttattttatttatttttttatttcatttcatttcatttcatttcatttcatttcatttcattttattgagacagagttttgct

SEQ ID NO: 61965 - DNA, 201 bp, Homo sapiens
caggcaggaggactcacacgggcaggcctggacaatgctgcagctcagggctttgctttcttttcttatcctcatgatgcaacagtaattttttttttattttttatttattttattttattttatttatttttttatttcatttcatttcatttcatttcatttcatttcatttcattttattgagacagagttttgctc

SEQ ID NO: 61966 - DNA, 201 bp, Homo sapiens
aggcaggaggactcacacgggcaggcctggacaatgctgcagctcagggctttgctttcttttcttatcctcatgatgcaacagtaattttttttttattttttatttattttattttattttatttatttttttatttcatttcatttcatttcatttcatttcatttcatttcattttattgagacagagttttgctct

SEQ ID NO: 61967 - DNA, 201 bp, Homo sapiens
cacctccctgctaggagagaggaaacaggcttgccctcgtgcccctttgaagctggccctcccacctgggcccagcctgccacctccccagcccctccatktgccctgcaggcttcgggtccttcgtggacaagaccgtgctgccgttcgtgaacacgcaccctgataagctgcgaaacccatgccccaacaaggagaaag

SEQ ID NO: 61968 - DNA, 201 bp, Homo sapiens
aggaggactcacacgggcaggcctggacaatgctgcagctcagggctttgctttcttttcttatcctcatgatgcaacagtaattttttttttattttttatttattttattttattttatttatttttttatttcatttcatttcatttcatttcatttcatttcatttcattttattgagacagagttttgctcttgtt

SEQ ID NO: 61969 - DNA, 201 bp, Homo sapiens
tttccctttgacttcaggtatttagcagagtactttagcattccttattaatatgtgtgtgtcgggggggtggggtgtctcattttatttcatttggccasaaattgtggcctttaaaatttgtgctatcaggccgggcgcagtggctcacgcctgtaatcccagcactttgggaggccgaggcaggcggatcacgaggtc

SEQ ID NO: 61970 - DNA, 201 bp, Homo sapiens
atgagatccaaacactgcccaggcagctggacactcctgagcctggagcttctcacctgaaccacagggtggtaacccctgcccctcaggcggcatcgacrtgacctgcctagtgcacagtgagcctgaggcaacacggccaccaccaggagactccctggggaagaggcccccagacagcgaggtgcccatgaaggaagt

SEQ ID NO: 61971 - DNA, 201 bp, Homo sapiens
tgccccccacgccttcttctcaggaggaaatcggctggcgcaacgtcacgcggctgctggtgtttgccactgatgacggcttccatttcgcgggcgacggraagctgggcgccatcctgacccccaacgacggccgctgtcacctggaggacaacttgtacaagaggagcaacgaattcgtaagtccccaccccaggcacc

SEQ ID NO: 61972 - DNA, 201 bp, Homo sapiens
ttatttcatttggccacaaattgtggcctttaaaatttgtgctatcaggccgggcgcagtggctcacgcctgtaatcccagcactttgggaggccgaggcrggcggatcacgaggtcaggagttcgagaccagcctggccaatatggtgaaactccatctctactaaaaatacaaaaattagctgggcctagtggtgtgca

SEQ ID NO: 61973 - DNA, 201 bp, Homo sapiens
ctctagcaagacaaactgtcagatgccctcaatccattttgtgatttttctgacattttcctgccagttttcagaaggtctttttgacgttccaaccttgwtccagagaaatgaggggagctcctgagacatggggaagaagcacggactccaagggtgagcccccagtccacgtccagctctacttcttactggctgcct

SEQ ID NO: 61974 - DNA, 201 bp, Homo sapiens
atctgacctgtttttgtccctggatttcctggagcctctgtgatccaaggacagtgttccagtccccacctgacggcacttctctccagttctttatcacrttcctacaaagcagaaatgagtccatcttgatgctctggcttttggcttaaaaggtggatgcctagtttataatcatcccttgagccttcagttcccagc

SEQ ID NO: 61975 - DNA, 201 bp, Homo sapiens
agccgagattgcgccactgcactccagcctggcaacaaagctagattccatctcaaaaaaaaaaaattgacatcaaggtatggtctacaggggtgtgtgcrgggtggtgatgccctctcaggaaggagggatgggggagggtgacctcaggtgacccaggcaatcagagggcctggcctggagcacgtccggcaaagatca

SEQ ID NO: 61976 - DNA, 201 bp, Homo sapiens
ccttgagccttcagttcccagcgcaggggttggctcccatgtcctcttccttccaaccttgtcccctggcggcatcgtccatcacttcccgcgcacctccragtcactttgatgcgagtgcctctcctctaggacagcgcaaggtgggtttcagcacaggcaggaggaagctctgatgcaaagttccaatgggtctgcggg

SEQ ID NO: 61977 - DNA, 201 bp, Homo sapiens
ggctcccatgtcctcttccttccaaccttgtcccctggcggcatcgtccatcacttcccgcgcacctccgagtcactttgatgcgagtgcctctcctctargacagcgcaaggtgggtttcagcacaggcaggaggaagctctgatgcaaagttccaatgggtctgcggggcctctggttcctcaagcagtctcgtcttag

SEQ ID NO: 61978 - DNA, 201 bp, Homo sapiens
gcctctcctctaggacagcgcaaggtgggtttcagcacaggcaggaggaagctctgatgcaaagttccaatgggtctgcggggcctctggttcctcaagcrgtctcgtcttagggttttacggggttgcaaaaaggaagcctgagactgggcacggtggctcacgcctgtaatcccagcactttgggaggccgaggtgggc

SEQ ID NO: 61979 - DNA, 201 bp, Homo sapiens
ccccctctgcctcccactggggtactcagaggggagggagccagtactgctttagtggaagtgtggaaacagccctgggctgtgccaaagctgctcacggycccagagcagaattcagcaccaagctccacacagatcctgcctgagagctctggacacaagcaggctgctggccgtggttgcagttggtgaacgtctcag

SEQ ID NO: 61980 - DNA, 201 bp, Homo sapiens
tcccagcacactgaggggtcctggggacagccagaaggagccagggtccccatcccagcactctgacgggggcagggaggggcacacaggcatcagaggcwgtctgggagcaggcagcatccactggaaggaccctgtttctttccttcacatcctctctgccgaggccagacgctttccttgtgaagctgatgtcaggaa

SEQ ID NO: 61981 - DNA, 201 bp, Homo sapiens; identical to SEQ ID NO: 12062

SEQ ID NO: 61982 - DNA, 201 bp, Homo sapiens
gctcaggaatgtggtttcttcatcccctatcccgtgacttcaccactcatactcaccaatcagcgatccccacgcctcagaccccatcacctgcccagacmcctgaaaaacaccatccccaagcccctcgggaggtgggtttgaggtttcctcccatctcctcgcttggctgcccacgcgtcttggactttctctgtggca

SEQ ID NO: 61983 - DNA, 201 bp, Homo sapiens
tgccagcggcttgatgccagcttccacatctgtaaaaaccccttgtccctgcattctcccacaacctggcctgtcagtgcacgaacgcaggagggagggcrgggctgtggcaggaggcagtgccgagtccccactggccaccatgtggggcacgcaggagcagacaccagccactcacagagcaccggtatcgcagcacag

SEQ ID NO: 61984 - DNA, 201 bp, Homo sapiens
gagacgggtctaaaccgctgggccaggcagggccaggacaacagaaacactcgcccccaagagtaaccgctctctgcccgcagaaactctcctccagggtmttcctggatcacaacgccctccccgacaccctgaaagtcacctacgactccttctgcagcaatggagtgacgcacaggaaccagcccagaggtgactgtg

SEQ ID NO: 61985 - DNA, 201 bp, Homo sapiens
gaaggccccaccaaggaaccgactcagctcaggaatgtggtttcttcatcccctatcccgtgacttcaccactcatactcaccaatcagcgatccccacgyctcagaccccatcacctgcccagacccctgaaaaacaccatccccaagcccctcgggaggtgggtttgaggtttcctcccatctcctcgcttggctgccc

SEQ ID NO: 61986 - DNA, 201 bp, Homo sapiens
attctgccctgctgtccctgtccatccggggcccctctcctctgtcagttcctgggtggggagaaggaggggtggcatggctgcaatggggaagggggggkatggccggagagctcagcctgggagcgagctgtgggggcataggggacactcgctgtcactcgccttccccgtgacggtggcgcaacgcctgcgggtttg

SEQ ID NO: 61987 - DNA, 201 bp, Homo sapiens
gactcacacgggcaggcctggacaatgctgcagctcagggctttgctttcttttcttatcctcatgatgcaacagtaattttttttttattttttatttattttattttattttatttatttttttatttcatttcatttcatttcatttcatttcatttcatttcattttattgagacagagttttgctcttgttgccca

SEQ ID NO: 61988 - DNA, 201 bp, Homo sapiens
gtgaaataatattcagcaagacacttgctttcattgcattttcttaatatgactttggaattccttcaaacatgtttcttggtaaatgttgcctgtggattttttttttttttttttttttttttttgagatggagtttcgctctgtcgcccaggctggagtgcactggtgcgatcttggctcactacaatccaagtgatt

SEQ ID NO: 61989 - DNA, 201 bp, Homo sapiens
agggtggtgcggaaggaggatctcacctccagtgttgtgggcccagcagggtggatgagccatgcgggatgcccttggcattgcaaggaggccagaggcckgtcccctcacccccagcagcctcccctttccctcccctcctcacctgaccccacatcaagctgggcagcagacggcctgctccctgggggcaccactgct

SEQ ID NO: 61990 - DNA, 201 bp, Homo sapiens
tgaaataatattcagcaagacacttgctttcattgcattttcttaatatgactttggaattccttcaaacatgtttcttggtaaatgttgcctgtggattttttttttttttttttttttttttttgagatggagtttcgctctgtcgcccaggctggagtgcactggtgcgatcttggctcactacaatccaagtgattc

SEQ ID NO: 61991 - DNA, 201 bp, Homo sapiens
gggacaggtggacccagtggggaggttcacatggcactcagccaggcggcctgcccgggggctggatggctgtccccctttccttgcttgcctggccagarctgctaggctgacctcccaggactctgccccctttgctctggtcacctcctcccctgtcctgaccgcagtgccaatccacgtcctggtggcagtgccctt

SEQ ID NO: 61992 - DNA, 201 bp, Homo sapiens
cagtcctgctcactcacgcctggcttcagaacctagcttggtgattcagcagatgagaaaccctgagcagttgtacccagacatgcggccagtttcgcccrcctgactccctcggctcttagggacggactcctcagtcctagcttgggatcaacatctactctttcctgtggctgcttggctggagggccctgggaagca

SEQ ID NO: 61993 - DNA, 201 bp, Homo sapiens
gaaataatattcagcaagacacttgctttcattgcattttcttaatatgactttggaattccttcaaacatgtttcttggtaaatgttgcctgtggattttttttttttttttttttttttttttgagatggagtttcgctctgtcgcccaggctggagtgcactggtgcgatcttggctcactacaatccaagtgattct

SEQ ID NO: 61994 - DNA, 201 bp, Homo sapiens
tattgcagctccccaagcacctctgtgaagtgagcctggaaccaccctctccccactggccctctccatccttagcatctttcttgaccttcaaaccctgstcctatggggtctcctccgtggaaacttccagaatcccacctgtcacagagagacctccttcccaagctctggggttgtgtgttatgggggtggaagctg

SEQ ID NO: 61995 - DNA, 201 bp, Homo sapiens
agcagccgggctcactcggggaccccagtgagcacctctgcaccgcggggttctctgcgggtgcgtctggactgaggggccctccgcggccgccgtgcccctgtgtccctcctccctcctgtgcgcacctgccgcgggccctgggatcaggcttccagttcacccgctgcacccgcatctgccccacttgggccccctcct

SEQ ID NO: 61996 - DNA, 201 bp, Homo sapiens
tctcatcccttatgaacctcactgacctgactcttcccttggtgctgccaaaatattgcagctccccaagcacctctgtgaagtgagcctggaaccacccyctccccactggccctctccatccttagcatctttcttgaccttcaaaccctgctcctatggggtctcctccgtggaaacttccagaatcccacctgtcac

SEQ ID NO: 61997 - DNA, 201 bp, Homo sapiens
gcagccgggctcactcggggaccccagtgagcacctctgcaccgcggggttctctgcgggtgcgtctggactgaggggccctccgcggccgccgtgcccctgtgtccctcctccctcctgtgcgcacctgccgcgggccctgggatcaggcttccagttcacccgctgcacccgcatctgccccacttgggccccctcctt

SEQ ID NO: 61998 - DNA, 201 bp, Homo sapiens
gttggagggtgggcgggagagggaagtgtggtgagtgactgggagggagcagcggttcccgggtggccccagggtcctcgtgggggtgctctccaggcagraagggactttctgccacttggacatctccctgtggggccagaccccaggggtctccagggctggttagactcctttctcatcccttatgaacctcactga

SEQ ID NO: 61999 - DNA, 201 bp, Homo sapiens
cctcacctgctggtctatacagagccccgctctgaggccctgtcccaaatcctaggtgcatttccgtaaacggtggtggccccaccaaagaggtgcctgcrgcggagcctggccagggcagaggcaaagcaggaaagcgggtacctgtctgccctccctccagccatctacacctcccctccagccatctacacctcctct

SEQ ID NO: 62000 - DNA, 201 bp, Homo sapiens
ggggaatttgcaggcaggttggagggtgggcgggagagggaagtgtggtgagtgactgggagggagcagcggttcccgggtggccccagggtcctcgtggrggtgctctccaggcaggaagggactttctgccacttggacatctccctgtggggccagaccccaggggtctccagggctggttagactcctttctcatcc

SEQ ID NO: 62001 - DNA, 201 bp, Homo sapiens
cctggccagggcagaggcaaagcaggaaagcgggtacctgtctgccctccctccagccatctacacctcccctccagccatctacacctcctctccagctytacacctcccctccagccatctacacctcccctccagccatctacacctcccctccagccatctacacctcccctccagcagtctacacctcccctccag

SEQ ID NO: 62002 - DNA, 201 bp, Homo sapiens
ctgggagttgggggttgcagtgagctgtgattgcaccactgcactccagccagggtgacagagaaagaccctatcttaaaaaaaaaaaaaaaaaaaaaaarcaaacaaacaaacaaaccaaaaacgaacttctaactgcgtgataacctcttactgtatatgcctgggagactttacctgggcaggtgggaggagctagaa

SEQ ID NO: 62003 - DNA, 201 bp, Homo sapiens
ttaaattagcattgtgtggttgtattgtttcaggggcatagttctaaactagacttgtgtttattctgtttctgcaaactgattttttttttttttcagaygtagtctcactctgtggcccaggctggagtgcagtggtgcgatctcagctcactgcaacctctgtctcctgggttcaagagattctcctgccttggcctc

SEQ ID NO: 62004 - DNA, 201 bp, Homo sapiens
ctgaggcaggagaatggcttgaacccaggaggcggaagttgtggtgagccgagattgcgccactgcactccagcctggcaacaaagctagattccatctcaaaaaaaaaaaattgacatcaaggtatggtctacaggggtgtgtgcagggtggtgatgccctctcaggaaggagggatgggggagggtgacctcaggtgac

SEQ ID NO: 62005 - DNA, 201 bp, Homo sapiens
tctgagaggcctgtggggctgtggattcctaagcagcctcagctttgggttttgcaccttaggtcttggtaaggggacccgcccgcccttagatgggggawgtccagagctggaggatgaggagggcacccgcccctggtgtggggcagcagggagggccttggaggatgaggagggcacctgcccccagtgtggggcagc

SEQ ID NO: 62006 - DNA, 201 bp, Homo sapiens
gcccacactttctccgtgaaaggaaaacaactatgagtctgccaaacgcatctcagatgcgttttaaaaaattctggtccccgctctctgtcccatcatcygcctcggggacttcctctctccgtggttctcaccccatactctgtcactgccacattttcacctgggcctggcctttgtctccacctgaaactcctgaaa

SEQ ID NO: 62007 - DNA, 201 bp, Homo sapiens
aagggaacccaggggtggaacggccctgctgcccgctaggaggtgctgccggcctccagcaccaggctgaggcctgcttccgtcattttgcctctggggcygagggcctgtgagtgaccactgagccgcccctggctgtggatgcgtgggttaaggacggggtgggtgtgtatctggaaacaaaagggcaggaccccggca

SEQ ID NO: 62008 - DNA, 201 bp, Homo sapiens
tgggttgagaggtcatctccgggacaggactcagaactggaagagggaggggcagcgaggaaaggtccctgcctggcggtgctgccttccatgggggcctkgtggggcagaggctggaacacccacttggggtttctggtgggaactggggagcagggtggggagcctgagtcccctcagaggaggagtcattttgaaact

SEQ ID NO: 62009 - DNA, 201 bp, Homo sapiens
catgcaaagtgtcagccagccaggcccctggaaggcagtcatcacctcttaaggcattgcgggtgtcggtcctgcaactgccaggtgcagcacacgacccrtgtccggtgttcgatagcagggagccatgacctggcaacgattccacgctcaaaggggcacccggggggccctgggtcggggcggatcagctttccctgg

SEQ ID NO: 62010 - DNA, 201 bp, Homo sapiens
tccaggggctttgcagggacaaggtggccaagaggaaatgtactttgatgtaaatgtattttgatacatgtatatctatatttgataaattcatgtatcarattcaggaaattcagcattggtatctcattatcatcaaacctacacaccacgcatattttattggttgtcccaatgatgtcttcgtgagcatattttcct

SEQ ID NO: 62011 - DNA, 201 bp, Homo sapiens
tgtccttacacagaggatgcaggtgacgccactgccctggccattcacccgatgcccctatgaacctgtccctctgcctcctctcaatttccgtctgtctstcagtctttgtctctctttctctgtctctctctgtctgtctctctctgtctctgccccatctctgtctgtctctgtctctgcctctctctgtttctctcc

SEQ ID NO: 62012 - DNA, 201 bp, Homo sapiens
catagcgtagtgtggtgtgtgtgtgtgcatgtatggtgtgcgagtgtgcgcatgtgatgtggggagtctgttgtatgtacatgtatggtgcacatgtgtartgtagtgtggtgtggtgtggcacatgctccatgctcctctgggaccctcgagcttccctgcctcctccgtggggacccctgggtgacgtcttgctgtagg

SEQ ID NO: 62013 - DNA, 201 bp, Homo sapiens
gtaaatgtattttgatacatgtatatctatatttgataaattcatgtatcagattcaggaaattcagcattggtatctcattatcatcaaacctacacacyacgcatattttattggttgtcccaatgatgtcttcgtgagcatattttcctggtggattttgtcacccaggctcaccctgtgctcagctgtctcaggctc

SEQ ID NO: 62014 - DNA, 201 bp, Homo sapiens
gcgattctggtcgagttggttcagctggtgaccctggcctccccacaacaggctcctggaggccattcccaaggtcctggtgggagggggattgaagccaygcccctgggtcccaggcccacctggcccccttcccccaacactgcactcttggggccagccctccccatgcatcctccacccctggcaccaccccttgca

SEQ ID NO: 62015 - DNA, 201 bp, Homo sapiens
gcctgaagccgccatcactgcgatggctgcagattggtgccgtgctggtccccgcctgccactcacggctgccaacctaaggaagggtctctccttctctkcagcctctctctcatcagcgtgacccacagttttattttgttcagtagtgcatgatctgtggctgtcctttcttccccgagatgctcaaatccgctaggt

SEQ ID NO: 62016 - DNA, 201 bp, Homo sapiens
ggctttatttggccaggagtgtcagcagacttgcgtcttaagagccgagctccccgaaaaagaaattcctagcccttttaagggcttacaactctaagggstccacatgaaagggttgtgatagatagagcaagtgtggggaacttgactgggggttacatgcatcagctgacagaacagaaagttttgcaatgctttttc

SEQ ID NO: 62017 - DNA, 201 bp, Homo sapiens
catgcaggtggatgtcaatgcgtgcacgcacccaggttttcttgcctgttcccacctctttatcctccttggctggttcctccgctccattctctggctcrggaatttgctccccagggtttttcattccgctctgtagcagaatgtgctactgttgctttccagcatcaaacttttcactcccatggcctctgtgttctt

SEQ ID NO: 62018 - DNA, 201 bp, Homo sapiens
tctcctcactcaggctcaccctgcactcagccatctcaggccccaaatctcctaacccaggttcacacactgcgctcagccgtctaacgctctgaatctcstcacccaggctcgccctacgctcagccgtctccttgggcttcttgaatctggacaagtcctcagctttctttgtctttcctgtccttgggcgtttctgag

SEQ ID NO: 62019 - DNA, 201 bp, Homo sapiens
acccaggctcgccctacgctcagccgtctccttgggcttcttgaatctggacaagtcctcagctttctttgtctttcctgtccttgggcgtttctgaggargtcaggagagcagctttgtagcatgaccctcgggggtcttgtctggagtttcctctgcctggactcaggtgtgctttggcaggagcccctcagtgacggt

SEQ ID NO: 62020 - DNA, 201 bp, Homo sapiens
ggaggggggagggctgccctccagccttcaggggcttcctgggtggagggggccagacctttctggtcaggtccctctgggttgagaggtcatctccgggmcaggactcagaactggaagagggaggggcagcgaggaaaggtccctgcctggcggtgctgccttccatgggggccttgtggggcagaggctggaacaccc

SEQ ID NO: 62021 - DNA, 201 bp, Homo sapiens; identical to SEQ ID NO: 12048

SEQ ID NO: 62022 - DNA, 201 bp, Homo sapiens
gctgtttgtctgggctcagccactggcattggggggtggggcagggcctggcttctcttgtgcccccagctccaagccccccagggctgctcatggaggascaacagtggggagaaggtggctccccaccagcccccttcctgtggtcaaggttggggtgccgtggtctctgagccaatcctgctggaatcaaggtgcacc

SEQ ID NO: 62023 - DNA, 201 bp, Homo sapiens
agccttggggcacacaagccttcctcagcctttcctggtcaccttcgggggtggtcaaggcaacaggcagcgagtgtggacacacgtgccacgccccctcygagtgtgtttctgcaccaagcgcacagcaggctcagcaggacaggatgtgggagggcccagctctcccaagacagggatggccccagactgggacggatg

SEQ ID NO: 62024 - DNA, 201 bp, Homo sapiens
ctgtgctcttcctcccctcctgccctgcagctctgccggcttagcctcagggcaccagaggtgacagtggccaggcacctgtttgcccgaatgctgccctmcatctgtgccttacccattcccatcccccagggagctggcacaggcccttcgaccacctccaggcacatggaggaaactgaggcagataggcctgatggg

SEQ ID NO: 62025 - DNA, 201 bp, Homo sapiens
ggggcttgtcctcgctggccgtagtgcgacgctcttgcagcctgacgttgtaggctctgggggccgcaaaggactttagagatacaagactcaggtcctcygccgggagccacagacaggggagggacggccctcgggtcccggaactcgggtagggagagccgcacctgacactcacggcctctaccgaaactgagtgtc

SEQ ID NO: 62026 - DNA, 201 bp, Homo sapiens
tcagccgtgggccgagaggcaaccactggtcacaaggggcttgtcctcgctggccgtagtgcgacgctcttgcagcctgacgttgtaggctctgggggccrcaaaggactttagagatacaagactcaggtcctccgccgggagccacagacaggggagggacggccctcgggtcccggaactcgggtagggagagccgca

SEQ ID NO: 62027 - DNA, 201 bp, Homo sapiens
tgaggcaggagaatggcttgaacccaggaggcggaagttgtggtgagccgagattgcgccactgcactccagcctggcaacaaagctagattccatctcaaaaaaaaaaaattgacatcaaggtatggtctacaggggtgtgtgcagggtggtgatgccctctcaggaaggagggatgggggagggtgacctcaggtgacc

SEQ ID NO: 62028 - DNA, 201 bp, Homo sapiens
gtgtggttgtattgtttcaggggcatagttctaaactagacttgtgtttattctgtttctgcaaactgattttttttttttttcagacgtagtctcactcygtggcccaggctggagtgcagtggtgcgatctcagctcactgcaacctctgtctcctgggttcaagagattctcctgccttggcctccaagtagctgaga

SEQ ID NO: 62029 - DNA, 201 bp, Homo sapiens
gcagggctggggccggacatccacagagaccacctgctggtcaggatgtcacagccctgtgtcccatctgtaggtggccatgacggtcccctcctcaccarcagtagcaggtcccaatcctttgccatttgtcatggcagccagactccaggcgatggtgtggcaccagggccaggcactggaggcaggtagagtgcaccc

SEQ ID NO: 62030 - DNA, 201 bp, Homo sapiens
catgacccgtggactccactcaatccctcttctccaggagccatgcaaagtgtcagccagccaggcccctggaaggcagtcatcacctcttaaggcattgygggtgtcggtcctgcaactgccaggtgcagcacacgacccatgtccggtgttcgatagcagggagccatgacctggcaacgattccacgctcaaaggggc

SEQ ID NO: 62031 - DNA, 201 bp, Homo sapiens
aggaaagtgcccgggagggccgctgcttttgtaaagtgaacatttgctgaactacagggatccattgtcaggcccgtatcccagctacaagctcaacctcrtggtgtgttggggccgacagcgagaccagcggttcctgccataggttccccgggctctggagtgggagcaggaccctgcgggagacacgggatgggggca

SEQ ID NO: 62032 - DNA, 201 bp, Homo sapiens
cccaagcccaaggactaggtccagagccacacagcgccaggccacatccgcctcacctgggaccttttgtggggtacagtctccggccccacccagacctsctgaaggagagaccccatggcaaggactcagccacctgcagtttcataagcccccagtgggttcctaggcatgaagaccaccggttagaggctgaactgg

SEQ ID NO: 62033 - DNA, 201 bp, Homo sapiens
gtcacagctgtctcaagcccaggccctgggcgccagcccaagcccaaggactaggtccagagccacacagcgccaggccacatccgcctcacctgggaccytttgtggggtacagtctccggccccacccagacctgctgaaggagagaccccatggcaaggactcagccacctgcagtttcataagcccccagtgggttc

SEQ ID NO: 62034 - DNA, 201 bp, Homo sapiens
cctggctgcctgtgtgttccaagctaggaagatgtaatgtccccacaaacggggtaaatggcttgcctgcgtcacagctgtctcaagcccaggccctgggygccagcccaagcccaaggactaggtccagagccacacagcgccaggccacatccgcctcacctgggaccttttgtggggtacagtctccggccccaccca

SEQ ID NO: 62035 - DNA, 201 bp, Homo sapiens
ctgtttttgtcaataaagttttattggaacacagtcatactcattcactttcagaaggtctatggtcactctgcagccacaatggcagagctgagtagtcrcggcagagaccatttggccagcaaagcctaaaacacatactgtctgcaggggcttcctgggtggagggggggtgaaccttcctggtcagatccctctggg

SEQ ID NO: 62036 - DNA, 201 bp, Homo sapiens
aagggtctctccttctctgcagcctctctctcatcagcgtgacccacagttttattttgttcagtagtgcatgatctgtggctgtcctttcttccccgagwtgctcaaatccgctaggtctggctgcgtgtcctgtccatgcatccccgttctaccgttctgagcactttcttgctttctggagcaacatgatgctgcagg

SEQ ID NO: 62037 - DNA, 201 bp, Homo sapiens
cacaagcctcgctgaaacccaggaagaccacaatgggggccagaagcagctgtccccacaaaaagtgacgctttacctgcgaccaggtaggcttggcctcrgtggtggtgccaggcaccgtctgtgctggttattggctctggctgggagtccggccctgctctggggtgtcagggctgcccagaaggcatgtgtccgggt

SEQ ID NO: 62038 - DNA, 201 bp, Homo sapiens
tctgcagcctctctctcatcagcgtgacccacagttttattttgttcagtagtgcatgatctgtggctgtcctttcttccccgagatgctcaaatccgctrggtctggctgcgtgtcctgtccatgcatccccgttctaccgttctgagcactttcttgctttctggagcaacatgatgctgcaggcccatctccatgtcc

SEQ ID NO: 62039 - DNA, 201 bp, Homo sapiens
ggctgcctcctccatgtcgctgcagacgccgcacggcccccaaagccaaacacatttactgtctggcccttcatagaaagtgattggggtccttggcccaraggccaagtgaagcctctgagggctgcaaggcacagcagggcgagggccagggccaggagtgccgggtgtgaatgtgggtgagtgtgtgtgtgtgtgagc

SEQ ID NO: 62040 - DNA, 201 bp, Homo sapiens
agaaggggagggggtggagaagaaggggagggcagcaggagaagtggtgtctcattccttaccgtcagcagcttcctcatttctcaattttgcgtcccacrgggagcggctttgggtcctccagcccacgccaccgcggcgagcagtccccggaggagaagccgggtggctcccgtctgtcctcggactgagcagggtggc

SEQ ID NO: 62041 - DNA, 201 bp, Homo sapiens
aaacattttgcgagcggccaagggtggaacagggccgctaggcagcaggtcccgtggttcctggggtggaaccaccctcctccctccaggccgggtgggckctggctgcccagtgtgtgtcgctctccacgtcccgcccacccagtttgtgactgtcagcctaacagagcagccacagtccctgggccatgttgaggccac

SEQ ID NO: 62042 - DNA, 201 bp, Homo sapiens
gggagggaagggagggagggaagggagggaagggagggaaggggaagggagggaagaaacgaagctccctccttgctccaggaaggcaggtgtggtggtgsagcagatgggagaaggaggcctggtgtggccaccgacctgtgacctcccaggccacagtgaggccagggaaggaaggggaagccatctcccagggagagg

SEQ ID NO: 62043 - DNA, 201 bp, Homo sapiens
cagcgagaccagcggttcctgccataggttccccgggctctggagtgggagcaggaccctgcgggagacacgggatgggggcaggtgtctgggggaccctscgagtgggcacccagagctggtcaggctgccgggacagtgggtcagcgcagggcagggctggggccggacatccacagagaccacctgctggtcaggatg

SEQ ID NO: 62044 - DNA, 201 bp, Homo sapiens
gggagggtttgggcggggaggtgacccgaccatctgctccgtgttcctggaaggtgaaatgatgccgcaatcttccatgaaagaagctgagcatgtgtgarcatgggggaggctggctgcgcccctgtgcatctggccggccagaaccgatgtcaccgggctgtttaacacccatggaaactcagtagagtgccaagagcc

SEQ ID NO: 62045 - DNA, 201 bp, Homo sapiens
tcctcatttctcaattttgcgtcccacggggagcggctttgggtcctccagcccacgccaccgcggcgagcagtccccggaggagaagccgggtggctccygtctgtcctcggactgagcagggtggccaggccccaggtggaaactaccttggtcaggctgggttttttccctcccctttctggaggttttcagctcctc

SEQ ID NO: 62046 - DNA, 201 bp, Homo sapiens
ttggcctcccaaagtgctgggatcacaggcgtgagccatcatgcctggcctgggttttttttgttttgttttgtttttttgagacaaggtcttgctctgtygcccaggctggagtgcagtggtgcgatctcagctcactgcaacctccacctcctgggtttaagtgatcctcctgcctcagcctcccgagtatctggtact

SEQ ID NO: 62047 - DNA, 201 bp, Homo sapiens
gcaggatcactcacactgcaggcgggatcactcacaccgcaggcgggagcactcacaccgcaggcgggatcactcacaccgcaggcaggaggactcacacrggcaggcctggacaatgctgcagctcagggctttgctttcttttcttatcctcatgatgcaacagtaattttttttttattttttatttattttatttta

SEQ ID NO: 62048 - DNA, 201 bp, Homo sapiens
ctggagtgcagtggtgcgatctcagctcactgcaacctccacctcctgggtttaagtgatcctcctgcctcagcctcccgagtatctggtactacaggcawgtgacgccacaccactctaatatttgtactttttgtagagatggggtcttcttatgttgcccaggctggtcctgaactcctgggctcaggcaatcttccc

SEQ ID NO: 62049 - DNA, 201 bp, Homo sapiens
gtgtgagatgtgaggtgtggctccttttgttctgtccccaccggcaggccaggcagcagcgttcaacgtgaccttccggcgggccaagggctaccccatcracctgtactatctgatggacctctcctactccatgcttgatgacctcaggaatgtcaagaagctaggtggcgacctgctccgggccctcaacgagatcac

SEQ ID NO: 62050 - DNA, 201 bp, Homo sapiens
ttaacacgttaaaatctcaatcctgtctggtgaggactgcagtgaagcccagctggccaccccttccggggcctctgttctccccagggccttgcagcctytctgggcttggcattgctatggctaaagtgtgaaagggtcatgcaaggctgtcagccctgcgtcccccacgtgtgactgcatggggtcccacccaaatcg

SEQ ID NO: 62051 - DNA, 201 bp, Homo sapiens
acaactccatcatctgctcagggctgggggactgtgtctgcgggcagtgcctgtgccacaccagcgacgtccccggcaagctgatatacgggcagtactgmgagtgtgacaccatcaactgtgagcgctacaacggccaggtctgcggcggcccgggtgagcccgtgggtccctgctggacaacggccgtcctgcggcaca

SEQ ID NO: 62052 - DNA, 201 bp, Homo sapiens
gggtgaggaaggctgcccacaggcatccagggtgaggaaggcagcccacaggcatccagggtgaggaaggctgcccacaggcatccagggtgaggaaggcwgcccacaggcatccagggtgaggaaggctgcccacaggcatccagggtgaggaaggctgcccacaggcatccagggtgaggaaggcagcccacacttttc

SEQ ID NO: 62053 - DNA, 201 bp, Homo sapiens
acccacaccagcctccgggccaccccaccagctctgcatcgtctcctctgctccagagggccgggtctgggaaactgaggcaggtaaccctgccccccacrccttcttctcaggaggaaatcggctggcgcaacgtcacgcggctgctggtgtttgccactgatgacggcttccatttcgcgggcgacgggaagctgggcg

SEQ ID NO: 62054 - DNA, 201 bp, Homo sapiens
aggtaaccctgccccccacgccttcttctcaggaggaaatcggctggcgcaacgtcacgcggctgctggtgtttgccactgatgacggcttccatttcgcrggcgacgggaagctgggcgccatcctgacccccaacgacggccgctgtcacctggaggacaacttgtacaagaggagcaacgaattcgtaagtccccacc

SEQ ID NO: 62055 - DNA, 201 bp, Homo sapiens
acatcagccatgaatttagtgatgttatttggtttatctgggatacagacacagcttttagttttacgatagcacaggttaccctcgagctgcggtgagtrtgtctaaagccatatggttttataatacagattttctcaggtaagtttatcatttaatcatgagatacctggctatatcttaaggccttttgtgtgtaac

SEQ ID NO: 62056 - DNA, 201 bp, Homo sapiens
cgcctgcccggtgaggccgctgcccctgcttgggtccccacgttcccccagtgtggggggctctgtcaggcgctgtgtgggggcaggggggtaccctggcyggcaggtcgtctgagggactccagcctgggcctggggagagcagctcctcaccctgctgctgcccatgcaggaaagggcaggaggaagggagggtgacca

SEQ ID NO: 62057 - DNA, 201 bp, Homo sapiens
gtcccagaacttagttatattttaaaatgccattgtgcattgtttaaaatgtggtgatattcaccgagttttggttaatgtttacaaacacctaatgtccwtcaaataccattaaattagcattgtgtggttgtattgtttcaggggcatagttctaaactagacttgtgtttattctgtttctgcaaactgatttttttt

SEQ ID NO: 62058 - DNA, 201 bp, Homo sapiens
tggacgccatgatgcaggtcgccgcctgcccggtgaggccgctgcccctgcttgggtccccacgttcccccagtgtggggggctctgtcaggcgctgtgtkggggcaggggggtaccctggccggcaggtcgtctgagggactccagcctgggcctggggagagcagctcctcaccctgctgctgcccatgcaggaaaggg

SEQ ID NO: 62059 - DNA, 201 bp, Homo sapiens
ggtcgggaagcagctgatttccggaaacctggatgcacccgagggtgggctggacgccatgatgcaggtcgccgcctgcccggtgaggccgctgcccctgyttgggtccccacgttcccccagtgtggggggctctgtcaggcgctgtgtgggggcaggggggtaccctggccggcaggtcgtctgagggactccagcctg

SEQ ID NO: 62060 - DNA, 201 bp, Homo sapiens
ggtgtcagggctgcccagaaggcatgtgtccgggtcggacgggtgtgtgggccagtgaagccccaaggctgctggaaagctgagctcctcagtgcccttcygctctgtccccaggtggagctgccccagcccttaccatcggtgcccagtgtctgcactctctcgcagcccgacgttctgcaccttttttttttaaaggga

SEQ ID NO: 62061 - DNA, 201 bp, Homo sapiens
tccacagggacttctgtcccaaattccaggcgcagaggaggaggggacagggtgggtcctcagtcctccatggccagtcagcctcctgcaggtcccgcagygtggccccctcctgacccctgactccccctccccagaacttcacagggccgggggatcctgactccattcgctgcgacacccggccacagctgctcatga

SEQ ID NO: 62062 - DNA, 201 bp, Homo sapiens
ctctcaggagtgcacgaagttcaaggtcagcagctgccgggaatgcatcgagtcggggcccggctgcacctggtgccagaagctggtaagtgcctcctggrcccctccccacctgcccagctcctgggtgagggccctttcctgcccctgaagccagtggcacccagaggaccaacaactccattttctttttgagggggt

SEQ ID NO: 62063 - DNA, 201 bp, Homo sapiens
cattgtcaggcccgtatcccagctacaagctcaacctcgtggtgtgttggggccgacagcgagaccagcggttcctgccataggttccccgggctctggartgggagcaggaccctgcgggagacacgggatgggggcaggtgtctgggggaccctccgagtgggcacccagagctggtcaggctgccgggacagtgggtc

SEQ ID NO: 62064 - DNA, 201 bp, Homo sapiens
tctgtccccaccggcaggccaggcagcagcgttcaacgtgaccttccggcgggccaagggctaccccatcgacctgtactatctgatggacctctcctacyccatgcttgatgacctcaggaatgtcaagaagctaggtggcgacctgctccgggccctcaacgagatcaccgagtccggccgcattggtgaggcccaggc

SEQ ID NO: 62065 - DNA, 201 bp, Homo sapiens
cagtcctctctcaggagtgcacgaagttcaaggtcagcagctgccgggaatgcatcgagtcggggcccggctgcacctggtgccagaagctggtaagtgcytcctggacccctccccacctgcccagctcctgggtgagggccctttcctgcccctgaagccagtggcacccagaggaccaacaactccattttctttttg

SEQ ID NO: 62066 - DNA, 201 bp, Homo sapiens
aacgtgaccttccggcgggccaagggctaccccatcgacctgtactatctgatggacctctcctactccatgcttgatgacctcaggaatgtcaagaagcyaggtggcgacctgctccgggccctcaacgagatcaccgagtccggccgcattggtgaggcccaggcactgcaggacaaaacccagtcctttcccagaccc

SEQ ID NO: 62067 - DNA, 201 bp, Homo sapiens
ctggaggctgcctccctgtctttttgggcctcctctgaccttcctgctctactcccccttgggtgtgggcagggcggcccagagcacccactcaccagccrgcctcgtccctcagtcctctctcaggagtgcacgaagttcaaggtcagcagctgccgggaatgcatcgagtcggggcccggctgcacctggtgccagaag

SEQ ID NO: 62068 - DNA, 201 bp, Homo sapiens
gagaggaaacaggcttgccctcgtgcccctttgaagctggccctcccacctgggcccagcctgccacctccccagcccctccatgtgccctgcaggcttcrggtccttcgtggacaagaccgtgctgccgttcgtgaacacgcaccctgataagctgcgaaacccatgccccaacaaggagaaagagtgccagcccccgtt

SEQ ID NO: 62069 - DNA, 201 bp, Homo sapiens
ttccaggcgtggcccctgggcagctcagggctttttacccccaagaacctcttaccacacatcactgaccacacactctggggaccaagtgcaaaactgcrttgaggaccgtcccagccattttgcaggtgcagaagcccctggggtgagcccagtgcgtggagatgccgtggcacaggtcctagccgtgccatgtctggt

SEQ ID NO: 62070 - DNA, 201 bp, Homo sapiens
gaggcttggggtccctgagcttaggaagcccccatggaaaccaagtcacaggcatccagggtgaggaaggctgcccacaggcatccagggtgaggaaggcwgcccacaggcatccagggtgaggaaggcagcccacaggcatccagggtgaggaaggctgcccacaggcatccagggtgaggaaggcagcccacaggcatc

SEQ ID NO: 62071 - DNA, 201 bp, Homo sapiens
atgtgccctgcaggcttcgggtccttcgtggacaagaccgtgctgccgttcgtgaacacgcaccctgataagctgcgaaacccatgccccaacaaggagamagagtgccagcccccgtttgccttcaggcacgtgctgaagctgaccaacaactccaaccagtttcagaccgaggtcgggaagcagctgatttccggaaac

SEQ ID NO: 62072 - DNA, 201 bp, Homo sapiens
cctgccccccacgccttcttctcaggaggaaatcggctggcgcaacgtcacgcggctgctggtgtttgccactgatgacggcttccatttcgcgggcgacrggaagctgggcgccatcctgacccccaacgacggccgctgtcacctggaggacaacttgtacaagaggagcaacgaattcgtaagtccccaccccaggca

SEQ ID NO: 62073 - DNA, 201 bp, Homo sapiens
ggctctgtcaggcgctgtgtgggggcaggggggtaccctggccggcaggtcgtctgagggactccagcctgggcctggggagagcagctcctcaccctgcygctgcccatgcaggaaagggcaggaggaagggagggtgaccacgagggctcgaaaatcatgcgctgatttcattgtttgctgtgagttaaatttgtgacc

SEQ ID NO: 62074 - DNA, 201 bp, Homo sapiens
gggtgaggaaggctgcccacaggcatccagggtgaggaaggcagcccacaggcatccagggtgaggaaggctgcccacaggcatccagggtgaggaaggcwgcccacaggcatccagggtgaggaaggcagcccacacttttcttggagacacatccccaaagaagtcctcacgtggctccgtttgggcagaaaccatgaa

SEQ ID NO: 62075 - DNA, 201 bp, Homo sapiens
catctcaaaaaaacaaacaaacaaacaaaactgtgctatcaaacttcacagatagtcaaaccaacagtaggaacacgtctccctgacccttgggaaaataygcttttgcagggtcgcaggttcagaggcgacatgggctgggttttcctgcatcctctctgctccgacttgttcctatttgatctgacctgtttttgtccc

SEQ ID NO: 62076 - DNA, 201 bp, Homo sapiens
cacacactctggggaccaagtgcaaaactgcgttgaggaccgtcccagccattttgcaggtgcagaagcccctggggtgagcccagtgcgtggagatgccrtggcacaggtcctagccgtgccatgtctggtcttcttgcccaacagaaactcaccgagatcatccccaagtcagccgtgggggagctgtctgaggactcc

SEQ ID NO: 62077 - DNA, 201 bp, Homo sapiens
ctgtgtgtacatatgtgtggtgtgatgcatgtatatgtgtggtgtgtgcatgcacgtggtgtgtacatgcagtcaggcacacatctgtatgcacgtacacrtgcatgtgtggtgtgtgtacacgtctgcatgtgtgtgtgtgcctgtgttgtgtgcctctgcaggggcccgctgcagctgtcctgggtgcctggctgagca

SEQ ID NO: 62078 - DNA, 201 bp, Homo sapiens
cctccacaggacatgctgggcctgcgccccccactgctcgccctggtggggctgctctccctcgggtgcggtgagttctgtgttccacggaggggactccwcgcgtgacattccaatcagggagaacagggcctgccctcactttcccatagacagaagttcccgggaggctggggaaggaccttgccactgggggtaggt

SEQ ID NO: 62079 - DNA, 201 bp, Homo sapiens
ccaggccagctggaggggagcttcatgggtggtcagccccaggggttgggcctgagaccgtcaccaagaccccttccctccacaggacatgctgggcctgygccccccactgctcgccctggtggggctgctctccctcgggtgcggtgagttctgtgttccacggaggggactccacgcgtgacattccaatcagggaga

SEQ ID NO: 62080 - DNA, 201 bp, Homo sapiens
ctgaaaacaacatccagcccatcttcgcggtgaccagtaggatggtgaagacctacgaggtgagtgctgttgggtcccgagcatccattgggtgggggcaygtttcagccacaggccagacccagcgccactgcaggtctgagcgccacctctgcatgctgggcacgtgagcaaccagccggcccaggtcctggatccccc

SEQ ID NO: 62081 - DNA, 201 bp, Homo sapiens
ttaggtttcatttggaaccacagggcctggcctggaatccagcaggggctgggccaggttctcactgacccctggccatggtgatggatggtgagccgggrccctgggaacctccgtctctctaagtgctgtgttgtggggtgacctcggacctgtgggcacacggctcagtgagatggggctggactgacgctcaggtgt

SEQ ID NO: 62082 - DNA, 201 bp, Homo sapiens
agagatacaagactcaggtcctccgccgggagccacagacaggggagggacggccctcgggtcccggaactcgggtagggagagccgcacctgacactcayggcctctaccgaaactgagtgtccctcagtgcgaaagcaggtccaccgtgtggggaaggctgggattctgcccccgtggacatccccagtcccacggtga

SEQ ID NO: 62083 - DNA, 201 bp, Homo sapiens
gacctccgggagtacaggcgctttgagaaggagaagctcaagtcccagtggaacaatgtaagtggccgtccttgggggtcccacgcagaggggcacgtgcrtcccacactatgcgacctcctgctgcgggaggccgtggacacccgtgtgtggctgcaccccggcctccccaggcagcttgtcctctgggcgtccgccgct

SEQ ID NO: 62084 - DNA, 201 bp, Homo sapiens
tcatctatgtggatgagagccgaggtgaggccgctggggtgcagcggggaccggctccagagctccggctgcggggtctccgcagaggcgagggtggtgcrgaaggaggatctcacctccagtgttgtgggcccagcagggtggatgagccatgcgggatgcccttggcattgcaaggaggccagaggccggtcccctcac

SEQ ID NO: 62085 - DNA, 201 bp, Homo sapiens
tggtggacacacacccaagcccgagcccccgttgccggagcccccgcacaccctggcaccgatgctcacacctggctccccgcagctcctgcgccgagtgyctgaagttcgaaaagggcccctttgggaagaactgcagcgcggcgtgtccgggcctgcagctgtcgaacaaccccgtgaagggcaggacctgcaaggaga

SEQ ID NO: 62086 - DNA, 201 bp, Homo sapiens
cgcatctgccccacttgggccccctccttggcctgagggcgccccaaccccacctgccccccctggtggacacacacccaagcccgagcccccgttgccgragcccccgcacaccctggcaccgatgctcacacctggctccccgcagctcctgcgccgagtgcctgaagttcgaaaagggcccctttgggaagaactgca

SEQ ID NO: 62087 - DNA, 201 bp, Homo sapiens
ctgcacccgcatctgccccacttgggccccctccttggcctgagggcgccccaaccccacctgccccccctggtggacacacacccaagcccgagcccccrttgccggagcccccgcacaccctggcaccgatgctcacacctggctccccgcagctcctgcgccgagtgcctgaagttcgaaaagggcccctttgggaag

SEQ ID NO: 62088 - DNA, 201 bp, Homo sapiens
ggaacatcccccaggctggaggaggcaggcgggccggagggagcaaccgcagtggggtttcgggcgggtctcggttcccaggccaagcaggagcttagccrtgctgccccgtcttccagggagggggctctgcttctgcgggaagtgccgctgccacccgggctttgagggctcagcgtgccagtgcgagaggaccactga

SEQ ID NO: 62089 - DNA, 201 bp, Homo sapiens
tggcgggggcagaagggcctggctagtggccccatgccttttgctcaggaacatcccccaggctggaggaggcaggcgggccggagggagcaaccgcagtrgggtttcgggcgggtctcggttcccaggccaagcaggagcttagccgtgctgccccgtcttccagggagggggctctgcttctgcgggaagtgccgctgc

SEQ ID NO: 62090 - DNA, 201 bp, Homo sapiens
gctcctcaccctgctgctgcccatgcaggaaagggcaggaggaagggagggtgaccacgagggctcgaaaatcatgcgctgatttcattgtttgctgtgarttaaatttgtgaccctgggcaaaccttatgaagcctaaacattttgcgagcggccaagggtggaacagggccgctaggcagcaggtcccgtggttcctgg

SEQ ID NO: 62091 - DNA, 201 bp, Homo sapiens; identical to SEQ ID NO: 12029

SEQ ID NO: 62092 - DNA, 201 bp, Homo sapiens
ctgtgacctgagtgtctcctcctcgctgtccctgttctgtcccctcccgccctcacatgcaggtggatgtcaatgcgtgcacgcacccaggttttcttgcytgttcccacctctttatcctccttggctggttcctccgctccattctctggctcaggaatttgctccccagggtttttcattccgctctgtagcagaatg

SEQ ID NO: 62093 - DNA, 201 bp, Homo sapiens
ggtttcactatgttgctcaggctggtctcaaactcctgacctcaggtgatccgcctgcctcagcctcccaaagtgctgggattacaggcatgagccaccaygcccggcctccccttagcttttatgctgaggtttccttactcttagatacctattcttctatttcctttattgttttattccctaaaactgaagtcctac

SEQ ID NO: 62094 - DNA, 201 bp, Homo sapiens
gctgggattacaggcgcccgccaccaagcccagctaatttatgtatttttagtagagatggggtttcactatgttgctcaggctggtctcaaactcctgayctcaggtgatccgcctgcctcagcctcccaaagtgctgggattacaggcatgagccaccatgcccggcctccccttagcttttatgctgaggtttcctta

SEQ ID NO: 62095 - DNA, 201 bp, Homo sapiens
cccccttagctttttttttttttttcttttgagacagtttcactcttgttgcccaggctggagtgcagaggtgagatctcagctcactgcaccctctgccwcccgggctcaagtgattctcctgcctcagcctcgcgagtagctgggattacaggcgcccgccaccaagcccagctaatttatgtatttttagtagagatg

SEQ ID NO: 62096 - DNA, 201 bp, Homo sapiens
acgctcacacatgcgaatgcacactcacacatgaatgtatcctcacatgcacaaatggatgctcacacacgcgaatgcatgctcacacacaaaagcacacycaaactcaaatgcacacacacgtgaatgcatgctcacacacgtgaatgtatgctcacacacatgctcaaacacacaaatgcatgctctcacatgtgaatg

SEQ ID NO: 62097 - DNA, 201 bp, Homo sapiens
tcacacacatacatgcaggaacacacatgcatacacttatgctcatccatgtacattgcacactcccaggttcacacacacgcccacatacgttcacatgygtgcttgcacaacgcacatgctcacacacacactccacatgtgccatcttgctttctccacctccctgctaggagagaggaaacaggcttgccctcgtgc

SEQ ID NO: 62098 - DNA, 201 bp, Homo sapiens
actctcctccagggtcttcctggatcacaacgccctccccgacaccctgaaagtcacctacgactccttctgcagcaatggagtgacgcacaggaaccagyccagaggtgactgtgatggcgtgcagatcaatgtcccggtgagcctggccacaagggtccccatcccagcttgctgaggggctctggggacagccagaag

SEQ ID NO: 62099 - DNA, 201 bp, Homo sapiens
aacactcgcccccaagagtaaccgctctctgcccgcagaaactctcctccagggtcttcctggatcacaacgccctccccgacaccctgaaagtcacctaygactccttctgcagcaatggagtgacgcacaggaaccagcccagaggtgactgtgatggcgtgcagatcaatgtcccggtgagcctggccacaagggtcc

SEQ ID NO: 62100 - DNA, 201 bp, Homo sapiens
ggaaggctgcccacaggcatccagggtgaggaaggctgcccacaggcatccagggtgaggaaggcagcccacacttttcttggagacacatccccaaagamgtcctcacgtggctccgtttgggcagaaaccatgaattgaacgggaaaagaaatatgtcaagtatcagaaagaagagtggcatgctttgacagcaagtgg

SEQ ID NO: 62101 - DNA, 201 bp, Homo sapiens
ttccatcttctacttcctttatttatttcttggtatgtttaaaagacaaaattctgacagtgccaattattaaacattaaagaccacaacacatatagacrgcacagcgacggcagcactgaagaaaccacacagcaagctctgctgggccaagggctccgctctacaccagcactgccttgccacagagcaggtctccag

SEQ ID NO: 62102 - DNA, 201 bp, Homo sapiens
gcaggtgcagaagcccctggggtgagcccagtgcgtggagatgccgtggcacaggtcctagccgtgccatgtctggtcttcttgcccaacagaaactcacygagatcatccccaagtcagccgtgggggagctgtctgaggactccagcaatgtggtccatctcattaagaatgcttacaatgtgagtctcccgcaccact

SEQ ID NO: 62103 - DNA, 201 bp, Homo sapiens
gggtgaggaaggctgcccacaggcatccagggtgaggaaggctgcccacaggcatccagggtgaggaaggcagcccacaggcatccagggtgaggaaggcwgcccacaggcatccagggtgaggaaggcagcccacaggcatccagggtgaggaaggctgcccacaggcatccagggtgaggaaggctgcccacaggcatc

SEQ ID NO: 62104 - DNA, 201 bp, Homo sapiens
cgcaggagggagggcggggctgtggcaggaggcagtgccgagtccccactggccaccatgtggggcacgcaggagcagacaccagccactcacagagcacyggtatcgcagcacaggccatgtgcatggctgcaacacagctccacagtgagcctgccgagccactgcatgcgcaggccaaggccaggtgtctgctttccc

SEQ ID NO: 62105 - DNA, 201 bp, Homo sapiens
tgtggctgctgatgagggcgcccgtgggactgcaggcatggggccgggttaggtgtgagcccaggtgagccgctgccactctcaatgaaaggcgtccccartgtcgctggcgtcaactctaagcaccccaggcgggtttcagtgtcactgcgaggcacatgcctgcgtccgggagtcatgtccttcctctgaaactccagc

SEQ ID NO: 62106 - DNA, 201 bp, Homo sapiens
gcagtgaagcccagctggccaccccttccggggcctctgttctccccagggccttgcagcctctctgggcttggcattgctatggctaaagtgtgaaaggktcatgcaaggctgtcagccctgcgtcccccacgtgtgactgcatggggtcccacccaaatcggagtaatatacccactcagcctcacccctgctctgctg

SEQ ID NO: 62107 - DNA, 201 bp, Homo sapiens
atacataagtgaaagtgactgcaaatggaatttctgggctgactggagggaaaagattgttcccagaatcctgctccagtcctgctcactcacgcctggcytcagaacctagcttggtgattcagcagatgagaaaccctgagcagttgtacccagacatgcggccagtttcgcccacctgactccctcggctcttaggga

SEQ ID NO: 62108 - DNA, 201 bp, Homo sapiens
gccttggggcagagtggcccagggtgcaggcggccaggtgacagccagcagcagccgggagggaggcagctgggagacagtgagggatggggccgagccaytggggaggtcctgcaggagcagggcccaggtgtccctgggggcagcaggggacaaaaccccaccctggtggtagggtcaggcctgcccctcgctgccccg

SEQ ID NO: 62109 - DNA, 201 bp, Homo sapiens
agctccttgtcccaggccagctggaggggagcttcatgggtggtcagccccaggggttgggcctgagaccgtcaccaagaccccttccctccacaggacawgctgggcctgcgccccccactgctcgccctggtggggctgctctccctcgggtgcggtgagttctgtgttccacggaggggactccacgcgtgacattcc

SEQ ID NO: 62110 - DNA, 201 bp, Homo sapiens
gctgtgcagccagggtggacacccgctggccttgagcctcagttccccaaggctggccttggcagcagaacaagcctcacctagaaacctgtcagaggcgsattcttggcttggccccggaccagctagtcggcagcactccgggtgggctcagcaatctgggctttgcaggtcctccagggatactgatgcacgctgtag

SEQ ID NO: 62111 - DNA, 201 bp, Homo sapiens
ctgctgtagagcggagaggggcaggggtgaagggccacggtggtgcaacccaccacttcctccaaggaggagctgagaggaacaggaagtgtcaggacttyacgacccgcgcctccagctgaggtttctagacgtgacccagggcagactggtagcaaagcccccacgcccagccaggagcaccgccgaggactccagcac

SEQ ID NO: 62112 - DNA, 201 bp, Homo sapiens
ccatgttgaggccacatgcactgtcctcccctcacaacccaccttagctctcctgcttccctgcagtcccagcgcagacacactgctcacgagtgtgaggycacagcctaggacacgcacggcccccacatgcgcctgccaggggctgtcaatggtggactcaaggcctgctgggcccctcaggctcgttttcctccatgt

SEQ ID NO: 62113 - DNA, 201 bp, Homo sapiens
agccaccaggctggcctcttcctttcctgtgtttgctcctgttctcctgtcctcgacttctgtgaaagggtgtgtgtgatttggcccggatctgctgcagrtctcttctgacgccgctttcgtgtctcagagcctgaatgttcagagctttgctcaccgtgaagtgtggttcttgttagctgtgtccatttggtgcccggg

SEQ ID NO: 62114 - DNA, 201 bp, Homo sapiens
tgctgctgtttctatcagaaagaaaaactaacagggggagggaggggggagggctgccctccagccttcaggggcttcctgggtggagggggccagacctktctggtcaggtccctctgggttgagaggtcatctccgggacaggactcagaactggaagagggaggggcagcgaggaaaggtccctgcctggcggtgctg

SEQ ID NO: 62115 - DNA, 201 bp, Homo sapiens
gcataattcgtcggccaccatgaaattccatttttaaaatgtcctttattcatttatcacaaaaagggtggaaaatacaaacaggaataatgaaaattgaraatactcatagtgccaccacccagagaaatgcagaatattttggaactgtgtctctctttttttccccataaattcacttttaccacgaagccaagctgc

SEQ ID NO: 62116 - DNA, 201 bp, Homo sapiens
aggctccacactgtctagccccttccaaagtgagtccaaagtctgggaccttcaggtgctctccttgttctccccagtgttaagcatctggtggtttaatsggttgccagaagcttcactctttttatgcagcctctctggaagtcacccactaaggaatgtactcataatgaccacatacaaaaaaaatccaactgcaca

SEQ ID NO: 62117 - DNA, 201 bp, Homo sapiens
ctggcacaggaagtgctttgagaatcataactgcttgcaagggatgggcaaccggaactctctgtgccttggtcaaggacaaactcctgagcacaagagayctcgcgtggcacagaccagctctgaagccatgaagctgccaaccgtgtgcagccccacaggagtcctcccacataccaggggtgcaggttccacaccgct

SEQ ID NO: 62118 - DNA, 201 bp, Homo sapiens
cactgcactccagcctggcaacaaagctagattccatctcaaaaaaaaaaaattgacatcaaggtatggtctacaggggtgtgtgcagggtggtgatgccytctcaggaaggagggatgggggagggtgacctcaggtgacccaggcaatcagagggcctggcctggagcacgtccggcaaagatcagatgccagccctga

SEQ ID NO: 62119 - DNA, 201 bp, Homo sapiens
gcgaggaaaggtccctgcctggcggtgctgccttccatgggggccttgtggggcagaggctggaacacccacttggggtttctggtgggaactggggagcwgggtggggagcctgagtcccctcagaggaggagtcattttgaaactggagggagaggctaaaagaggaggctgtggagagacctagtgttgaccagggtc

SEQ ID NO: 62120 - DNA, 201 bp, Homo sapiens
ctgcactccagccagggtgacagagaaagaccctatcttaaaaaaaaaaaaaaaaaaaaaaagcaaacaaacaaacaaaccaaaaacgaacttctaactgygtgataacctcttactgtatatgcctgggagactttacctgggcaggtgggaggagctagaaatggccagatgctccaacaccgctcacttcccagctca

SEQ ID NO: 62121 - DNA, 201 bp, Homo sapiens
agcggttgctgctgtttctatcagaaagaaaaactaacagggggagggaggggggagggctgccctccagccttcaggggcttcctgggtggagggggccrgacctttctggtcaggtccctctgggttgagaggtcatctccgggacaggactcagaactggaagagggaggggcagcgaggaaaggtccctgcctggcg

SEQ ID NO: 62122 - DNA, 201 bp, Homo sapiens
ctccaactgtgtctacacctcccctctggctgtctacagagccccctctgcctcccactggggtactcagaggggagggagccagtactgctttagtggamgtgtggaaacagccctgggctgtgccaaagctgctcacggccccagagcagaattcagcaccaagctccacacagatcctgcctgagagctctggacaca

SEQ ID NO: 62123 - DNA, 201 bp, Homo sapiens
cagcctctgacttccagccttgtgcaacaggcacatcagatgggggatagtaagatgagtgctgagtgagtccccggaatggaggtctgggtccccccatwgcaaggtcacggctctgggaagccccacggtccctagcccctccccttcactccctccaccagcctttatttaattaattaattaatttatttatttatt

SEQ ID NO: 62124 - DNA, 201 bp, Homo sapiens
ccatgcaaagtgtcagccagccaggcccctggaaggcagtcatcacctcttaaggcattgcgggtgtcggtcctgcaactgccaggtgcagcacacgaccyatgtccggtgttcgatagcagggagccatgacctggcaacgattccacgctcaaaggggcacccggggggccctgggtcggggcggatcagctttccctg

SEQ ID NO: 62125 - DNA, 201 bp, Homo sapiens
gcaccctgtctggaaggggcatggggtgagcaggctatttggtcccccgtgactcagtttccccatctgtgaaacaggaggggtggtctggccaattgtgygcactccagctgtctctatagtcaaccgtgtaacttgaactcacttccccagggctcctgccaggcccaggtctgtccactctggcccaggccgggcccc

SEQ ID NO: 62126 - DNA, 201 bp, Homo sapiens
caggtcccgcagtgtggccccctcctgacccctgactccccctccccagaacttcacagggccgggggatcctgactccattcgctgcgacacccggccayagctgctcatgaggggctgtgcggctgacgacatcatggaccccacaagcctcgctgaaacccaggaagaccacaatgggggccagaagcagctgtcccc

SEQ ID NO: 62127 - DNA, 201 bp, Homo sapiens
caccagctctgcatcgtctcctctgctccagagggccgggtctgggaaactgaggcaggtaaccctgccccccacgccttcttctcaggaggaaatcggcyggcgcaacgtcacgcggctgctggtgtttgccactgatgacggcttccatttcgcgggcgacgggaagctgggcgccatcctgacccccaacgacggccg

SEQ ID NO: 62128 - DNA, 201 bp, Homo sapiens
caggtaaccctgccccccacgccttcttctcaggaggaaatcggctggcgcaacgtcacgcggctgctggtgtttgccactgatgacggcttccatttcgygggcgacgggaagctgggcgccatcctgacccccaacgacggccgctgtcacctggaggacaacttgtacaagaggagcaacgaattcgtaagtccccac

SEQ ID NO: 62129 - DNA, 201 bp, Homo sapiens
gtgtctgcgggcagtgcctgtgccacaccagcgacgtccccggcaagctgatatacgggcagtactgcgagtgtgacaccatcaactgtgagcgctacaayggccaggtctgcggcggcccgggtgagcccgtgggtccctgctggacaacggccgtcctgcggcacagacttggtgttggggggtgcgttctggaccatt

SEQ ID NO: 62130 - DNA, 201 bp, Homo sapiens
gcctcacctgctgagctctggtctctggtcttgtccttgacgaccacaaatcactttcacagtatggggagtgaactccagcagggaccctgagcctggtyctgaactctgctgtaggagagcggggtccctcgcactgtgtcctaccccccagtattagcactctgtcctggctgcccggtaccctggccctgccttctt

SEQ ID NO: 62131 - DNA, 201 bp, Homo sapiens
ggaaggcaggtcccccaggaaaggcaggatggcaggagggggcacggggagtgagagtgcaggtcaggatggcaggagggggcacagggagtgagggtgcrgatcaggatggcaggagcaaccacagggagtgagggtgcaggtcaggatggcaggaggggtacagggagtgaggatgccagaccaggccagggactgcac

SEQ ID NO: 62132 - DNA, 201 bp, Homo sapiens
ggaggcgcgaggtccttctgggggctcctccgacgcctgagggcgctgcttccccgcggccgccccgggtttctgcggagccggggcctccgctctcgggwgacccggtgagacccccggggaggccgctggggaggcgcgggctctgctcccgggtcccaaatgcaccggctgcccctcaggagggacggcgacctccac

SEQ ID NO: 62133 - DNA, 201 bp, Homo sapiens
tcacgtctggtttgtgcaatcctggccaagtcacttcacctttgaggacaggtgaaggaaggcaggtcccccaggaaaggcaggatggcaggagggggcayggggagtgagagtgcaggtcaggatggcaggagggggcacagggagtgagggtgcggatcaggatggcaggagcaaccacagggagtgagggtgcaggtc

SEQ ID NO: 62134 - DNA, 201 bp, Homo sapiens
cccgggtttctgcggagccggggcctccgctctcgggagacccggtgagacccccggggaggccgctggggaggcgcgggctctgctcccgggtcccaaaygcaccggctgcccctcaggagggacggcgacctccacccacggcgctggcgcccgcacggccgctcctcccgctcccgcagcctggacgcctcccgaggc

SEQ ID NO: 62135 - DNA, 201 bp, Homo sapiens
acacggcccgggccatctcccgctggatgcctcatggggcaaggcttgcagttgcaggtccccaggggtggcccgcggtcaggttgctgcgtgaggctccyttgaggggattgggagatcctggtgctcggctctcagccctggaggggcccagggccaccaggcaccaccgtccccatcactcgttcggctccagtccag

SEQ ID NO: 62136 - DNA, 201 bp, Homo sapiens
gagaggggcaggggtgaagggccacggtggtgcaacccaccacttcctccaaggaggagctgagaggaacaggaagtgtcaggactttacgacccgcgccyccagctgaggtttctagacgtgacccagggcagactggtagcaaagcccccacgcccagccaggagcaccgccgaggactccagcacaccgagggtgagt

SEQ ID NO: 62137 - DNA, 201 bp, Homo sapiens
tgggtcactttctctgcccgaccttccttgaccctaggagctggcttctctctgaccttggggacccaaggccatcaggctggcagccctggggcatgggyggctagagagcctcctgggacaggtgatggcttctgggagcctgggccccataggccacctcttgggcgtgcacaccccctgccaggcgtgggcacccca

SEQ ID NO: 62138 - DNA, 201 bp, Homo sapiens
gctgagcaactgcaggtgcctccgagtgctgggagaggggaatgctcagctccgagtgctgggagaggggacgctcagctccgagtgctgggagaggggaygcttagccacccaagggcctttgcctcaagggagtaaataggggcatttcctggtgggcgtgggctgggctggagaagcagggcctcctggcaggggctg

SEQ ID NO: 62139 - DNA, 201 bp, Homo sapiens
agatcaccttccaggtgaaggtcacggccacagagtgcatccaggagcagtcgtttgtcatccgggcgctgggcttcacggacatagtgaccgtgcaggtycttccccagtgtgagtgccggtgccgggaccagagcagagaccgcagcctctgccatggcaagggcttcttggagtgcggcatctgcaggtgaggcgggc

SEQ ID NO: 62140 - DNA, 201 bp, Homo sapiens
agcaactgcaggtgcctccgagtgctgggagaggggaatgctcagctccgagtgctgggagaggggacgctcagctccgagtgctgggagaggggacgctyagccacccaagggcctttgcctcaagggagtaaataggggcatttcctggtgggcgtgggctgggctggagaagcagggcctcctggcaggggctggcat

SEQ ID NO: 62141 - DNA, 201 bp, Homo sapiens
tggtctgagtgggagtgtgctcagcttctcctgatttgctgtctgcgtgtcacatgtctctgctgatgtgtggccggggagatcctggtgccggccagtgmgggagtgcgggcagagcacctccttgccggctgactttggctctcggatctgagcatcagctcttcctgctcctggtcaccccttcctccccacgctgaa

SEQ ID NO: 62142 - DNA, 201 bp, Homo sapiens
tcctccccctcccggcctccactgtacgttccctgctgcccctgagtccgcctcctccagtgtggcccctccctgcccccattgcctgagctgggtgagcrgctgcggggaccatgaggaacatgcagggagggacagaggcgagaaggagcccaggatgcacgggttaggatgagcctctctgcggaggcatctcaatgg

SEQ ID NO: 62143 - DNA, 201 bp, Homo sapiens
ctgacttccagccttgtgcaacaggcacatcagatgggggatagtaagatgagtgctgagtgagtccccggaatggaggtctgggtccccccatagcaagktcacggctctgggaagccccacggtccctagcccctccccttcactccctccaccagcctttatttaattaattaattaatttatttatttattgtatat

SEQ ID NO: 62144 - DNA, 201 bp, Homo sapiens
tgtcccctccctgcaggggtgtgggcggcgctccatcctcccagcgatgatgtgtggcctcatgcacagaacatggtccccagggaggctcttgagcctcrgtgtctactgggggtcagtcacagcggcgcggctgacaccccatggctgacctcagtctctagccctccagaggtcaagctgaaaactgtccagggcccc

SEQ ID NO: 62145 - DNA, 201 bp, Homo sapiens
acagcaggctcagcaggacaggatgtgggagggcccagctctcccaagacagggatggccccagactgggacggatggaagtgggcggtgggcggagggckcagaggagggtggtggccaggctgtgaccggccccaggagctccatggaagggactgggcccatgcagggcagtcatgggagggtttgggcggggaggtg

SEQ ID NO: 62146 - DNA, 201 bp, Homo sapiens
ccagtgagggagtgcgggcagagcacctccttgccggctgactttggctctcggatctgagcatcagctcttcctgctcctggtcaccccttcctccccaygctgaaccccccaggacccctgcagaggccaggaggtgagggttgggagctgggctgccaccctggccaccgagggtccccacctgagcccagcactgcc

SEQ ID NO: 62147 - DNA, 201 bp, Homo sapiens
ggatgctcacacacgcgaatgcatgctcacacacaaaagcacactcaaactcaaatgcacacacacgtgaatgcatgctcacacacgtgaatgtatgctcwcacacatgctcaaacacacaaatgcatgctctcacatgtgaatgtatgctcacacatgaatgtatgctcacacgcaaatgcatgctcacacacgcgaatg

SEQ ID NO: 62148 - DNA, 201 bp, Homo sapiens
cggcctatgagctggacccttcaggatgggaaatgcgtgggccgggttgcagagggggttggtgaggggctcggggacaacacaggtgtgttcagagacarggcgggtcattagatttgatggaggcttggggtccctgagcttaggaagcccccatggaaaccaagtcacaggcatccagggtgaggaaggctgcccaca

SEQ ID NO: 62149 - DNA, 201 bp, Homo sapiens
agcttcatgggtggtcagccccaggggttgggcctgagaccgtcaccaagaccccttccctccacaggacatgctgggcctgcgccccccactgctcgccytggtggggctgctctccctcgggtgcggtgagttctgtgttccacggaggggactccacgcgtgacattccaatcagggagaacagggcctgccctcact

SEQ ID NO: 62150 - DNA, 201 bp, Homo sapiens
gtgccatcttgctttctccacctccctgctaggagagaggaaacaggcttgccctcgtgcccctttgaagctggccctcccacctgggcccagcctgccayctccccagcccctccatgtgccctgcaggcttcgggtccttcgtggacaagaccgtgctgccgttcgtgaacacgcaccctgataagctgcgaaacccat

SEQ ID NO: 62151 - DNA, 201 bp, Homo sapiens
atatagacggcacagcgacggcagcactgaagaaaccacacagcaagctctgctgggccaagggctccgctctacaccagcactgccttgccacagagcargtctccagcacacgtgtgtgtcagtcacagcgcatgtcttccccgccggccgtggcttctcacatcggcactctgccaccttccctacatgcggggatgc

SEQ ID NO: 62152 - DNA, 201 bp, Homo sapiens
catcgccgccatcgtcgggggcaccgtggcaggcatcgtgctgatcggcattctcctgctggtcatctggaaggctctgatccacctgagcgacctccggkagtacaggcgctttgagaaggagaagctcaagtcccagtggaacaatgtaagtggccgtccttgggggtcccacgcagaggggcacgtgcgtcccacact

SEQ ID NO: 62153 - DNA, 201 bp, Homo sapiens
ccatttcctgccccgagccctccccactcgcctccagggagtgtgtgtcacctcctcccctctgccagccctgcctgcagccctcttctccgcccccgccyctgcccccagcctgcaaaaggtctcacccgccttcaaagggagctgaatcaacactgcagaaggaagtcactggggggaagaagtgaaaaagaaaaaaaa

SEQ ID NO: 62154 - DNA, 201 bp, Homo sapiens
ctggggagcaggagagcccgtggcagtgccgtctctgaggatgcctcagggtgtgtgtggctcctgcctgccagcggcttgatgccagcttccacatctgwaaaaaccccttgtccctgcattctcccacaacctggcctgtcagtgcacgaacgcaggagggagggcggggctgtggcaggaggcagtgccgagtcccca

SEQ ID NO: 62155 - DNA, 201 bp, Homo sapiens; identical to SEQ ID NO: 12053

SEQ ID NO: 62156 - DNA, 201 bp, Homo sapiens
agggagggggctctgcttctgcgggaagtgccgctgccacccgggctttgagggctcagcgtgccagtgcgagaggaccactgagggctgcctgaacccgyggcgtgttgagtgtagtggtcgtggccggtgccgctgcaacgtatgcgagtgccattcaggctaccagctgcctctgtgccaggagtgccccggctgccc

SEQ ID NO: 62157 - DNA, 201 bp, Homo sapiens
aaacccccacagtggacttgggccctgggaagacaccctggggggtggaattcctcttgctctgttcacctgtcctgggcaagctccagagaagcccttamcccctgaatttctccctggtgcacggcccatcgagctgcaccctgggctgctcccctggggagcccatggccctggtgggcataggtaggcataggtgcg

SEQ ID NO: 62158 - DNA, 201 bp, Homo sapiens
cttcagaataaagggcgcccgcggtcccccagcacctgcccaagccacacccctagcttccctccctatccctgcagcctgagggtcccttcagccacccytaagtccccacctgggctcctgccccgcccctggctagcagcgccttctccaccggggcccctctgctcacagagccccctcacctccctggggatgagg

SEQ ID NO: 62159 - DNA, 201 bp, Homo sapiens
gccgtgccatgtctggtcttcttgcccaacagaaactcaccgagatcatccccaagtcagccgtgggggagctgtctgaggactccagcaatgtggtccawctcattaagaatgcttacaatgtgagtctcccgcaccactcagctgggacccatggggtggccagcaatctccccactgcaggtcagctcctgctgcagg

SEQ ID NO: 62160 - DNA, 201 bp, Homo sapiens
tgaaactcctgaaaatcttgaaatggatttctaggtcactggggactccggcagcacattcggcttcagaataaagggcgcccgcggtcccccagcacctscccaagccacacccctagcttccctccctatccctgcagcctgagggtcccttcagccacccctaagtccccacctgggctcctgccccgcccctggcta

SEQ ID NO: 62161 - DNA, 201 bp, Homo sapiens
agaggtccctggctacgtccctgcagggcggcggctgagcccatgcctcggccccagggccagtccccgccgggtgccatcctgagcagggccacagaacrgatgtcccacatggccaggacccctgtggccacctgaccccgggggggctgtggccctcggtgaagcaggtgaccgggcgggctgtggggtttgtcagct

SEQ ID NO: 62162 - DNA, 201 bp, Homo sapiens
gggccgtcccgcaccgaacccaggcggtcggagcccggcggggaggcgcgaggtccttctgggggctcctccgacgcctgagggcgctgcttccccgcggscgccccgggtttctgcggagccggggcctccgctctcgggagacccggtgagacccccggggaggccgctggggaggcgcgggctctgctcccgggtccc

SEQ ID NO: 62163 - DNA, 201 bp, Homo sapiens
acagcgggtgagggaaggcggcttcctcctgcttcgagacccatcctcgtgcccaggggagcgcctcagggaaggaggagccacgttccagggcacctggmtgggacctgccgcagcctctgcgcgcagcgggctccatcccccgggccacggattgggagactgaggcaggcgcgaagcccgccgcccagcctccgctag

SEQ ID NO: 62164 - DNA, 201 bp, Homo sapiens
aatccccagggaccattgagaggaagtggtgagggcgggggaggcgcgggaggaagaggctgggggctgaggtgtgctggggtgggtaggagaccggctgmgcccagcacggagccgcttcctggtagccctggcggcatcacccttgggtcgggttccagagcccgggggtcctttcagctttccgttccttttccttat

SEQ ID NO: 62165 - DNA, 201 bp, Homo sapiens
gctgccttccatgggggccttgtggggcagaggctggaacacccacttggggtttctggtgggaactggggagcagggtggggagcctgagtcccctcagrggaggagtcattttgaaactggagggagaggctaaaagaggaggctgtggagagacctagtgttgaccagggtccagcgtcagtgtttaggttctctagc

SEQ ID NO: 62166 - DNA, 201 bp, Homo sapiens
ctgccttccatgggggccttgtggggcagaggctggaacacccacttggggtttctggtgggaactggggagcagggtggggagcctgagtcccctcagargaggagtcattttgaaactggagggagaggctaaaagaggaggctgtggagagacctagtgttgaccagggtccagcgtcagtgtttaggttctctagct

SEQ ID NO: 62167 - DNA, 201 bp, Homo sapiens
cactgtccccactccccatgccccattcctctccagagaatcactggtctagaatagagacctacaaacttgggcccttaggctggccctccacctgtttytgtcaataaagttttattggaacacagtcatactcattcactttcagaaggtctatggtcactctgcagccacaatggcagagctgagtagtcgcggcag

SEQ ID NO: 62168 - DNA, 201 bp, Homo sapiens
gagggtgagtgtgcagaggccccgctatgtccacggtgatttttggagggaagcactctcctgccccagcctggagtgaccctggtggccctgcttatagycccggcccaggggtgtctggcaggaaggggtctccagaccgtctgctccagggtcccctttgagacccggcaaggggaagtgcctgccaccaagagcaga

SEQ ID NO: 62169 - DNA, 201 bp, Homo sapiens
cccgtggactccactcaatccctcttctccaggagccatgcaaagtgtcagccagccaggcccctggaaggcagtcatcacctcttaaggcattgcgggtrtcggtcctgcaactgccaggtgcagcacacgacccatgtccggtgttcgatagcagggagccatgacctggcaacgattccacgctcaaaggggcacccg

SEQ ID NO: 62170 - DNA, 201 bp, Homo sapiens
cgacgtccccggcaagctgatatacgggcagtactgcgagtgtgacaccatcaactgtgagcgctacaacggccaggtctgcggcggcccgggtgagcccrtgggtccctgctggacaacggccgtcctgcggcacagacttggtgttggggggtgcgttctggaccattcaacgagtggaacagaaaggggggatcctga

SEQ ID NO: 62171 - DNA, 201 bp, Homo sapiens
tcacctccctggggatgaggggccaggccatgaccctgaaagcctagccctggccttgacctcccaggagcgccctccccgccctctcccggccccggccycgtcctctgctgctggcctctgggtcgtgccccgcagactgagctgcgcttgggggtcctggcggcctgggccgtcccgcaccgaacccaggcggtcgga

SEQ ID NO: 62172 - DNA, 201 bp, Homo sapiens
acacagcaactcccttggacaaaggttctgctgatgaagggcttgaagcccctgggccagctgctagaggacgctgaggcctctcctcttgggtcagcctygggctggagagtaggtcctgagtcctttctgccgctagaggcagaggaggaggcgataccctgccccccaggggtctgctgtggccgggagccttcaggg

SEQ ID NO: 62173 - DNA, 201 bp, Homo sapiens
acaggcgctttgagaaggagaagctcaagtcccagtggaacaatgtaagtggccgtccttgggggtcccacgcagaggggcacgtgcgtcccacactatgygacctcctgctgcgggaggccgtggacacccgtgtgtggctgcaccccggcctccccaggcagcttgtcctctgggcgtccgccgctgtgggtgagcttg

SEQ ID NO: 62174 - DNA, 201 bp, Homo sapiens; identical to SEQ ID NO: 12040

SEQ ID NO: 62175 - DNA, 201 bp, Homo sapiens
tctcgttgatgttgtgggcgatgctccctgaaacctgagctccggactcttcattccagactcttctctgcgggtctctatggagaagggaggtggacagstctggtggcaaacagtgcagctggggcaggaggaggccacaggaaacccccacagtggacttgggccctgggaagacaccctggggggtggaattcctct

SEQ ID NO: 62176 - DNA, 201 bp, Homo sapiens
tcccaatgttttattgtttggtttttatttacctttcttgtttgttctattttcccttacttttttcttttaaaggatttgcctttttttttttttttttytctcagttacccagactggagtgcagtggtgtaagcatggttcaccgtagcctcaacctcttgggctcaagcaattctcccacctcagcctcccaagtag

SEQ ID NO: 62177 - DNA, 201 bp, Homo sapiens
cggctggcgcaacgtcacgcggctgctggtgtttgccactgatgacggcttccatttcgcgggcgacgggaagctgggcgccatcctgacccccaacgacrgccgctgtcacctggaggacaacttgtacaagaggagcaacgaattcgtaagtccccaccccaggcacccaggcaccgcctggcaggacaccactgacgg

SEQ ID NO: 62178 - DNA, 201 bp, Homo sapiens
tatggtgaaactccatctctactaaaaatacaaaaattagctgggcctagtggtgtgcacctatagtcccagctactcaggaggctgaggcagaagaattkcttgaacatgggaggcggaggttgcagtgagccgagatctagccattgcactccagcctggatgacagagtgagactccatctcaaaaaaacaaacaaac

SEQ ID NO: 62179 - DNA, 201 bp, Homo sapiens
tggtagccctggcggcatcacccttgggtcgggttccagagcccgggggtcctttcagctttccgttccttttccttatacttcgtccctctctccagctrgagaggggcaggctctggggtctgggtacttttgttttggagccatttaacttgagttataataacatgcttttctgattataaaattaatgcatggcta

SEQ ID NO: 62180 - DNA, 201 bp, Homo sapiens
tggaccctgcaccctgggggagtcctgaagccggctggaccctgcaccctgggggagtcctgaagctggctggaccctgcaccctggggtagctccagcaygcacagggcctccgatcagctgaggggctggtgggcactcgtggcaccgaggtcagtccaggcgcaggactttgagggggcccagatggagagctggaac

SEQ ID NO: 62181 - DNA, 201 bp, Homo sapiens
gaaacattaaggcatgggccacacaggtggttaggaatggacactgagttccttctctaatctttcaggtttaagtttattatccaatcatttgttgtttytttttgttttttgttttttgtttttttttttgctagctgtgaaataatattcagcaagacacttgctttcattgcattttcttaatatgactttggaatt

SEQ ID NO: 62182 - DNA, 201 bp, Homo sapiens
gacacccgctggccttgagcctcagttccccaaggctggccttggcagcagaacaagcctcacctagaaacctgtcagaggcgcattcttggcttggcccyggaccagctagtcggcagcactccgggtgggctcagcaatctgggctttgcaggtcctccagggatactgatgcacgctgtagtttgagaaccactagac

SEQ ID NO: 62183 - DNA, 201 bp, Homo sapiens
agcgcatgtgtgtgtggtgtgtgtgtatgcatggtgtgtgtggtatgtatgtgtttagcattgtgtggggtgtgtgtatatgtgtggcacgtgtgtgtatrggtgtgaatgcatgtgtgtggcatgtgtatatgtgtgtggcatgcatgtgtatgtgagtgcatgtgtgtggtgtatgtgcgtgagtgcatgtgtgtgtgt

SEQ ID NO: 62184 - DNA, 201 bp, Homo sapiens
gcgcatgtgtgtgtggtgtgtgtgtatgcatggtgtgtgtggtatgtatgtgtttagcattgtgtggggtgtgtgtatatgtgtggcacgtgtgtgtatgkgtgtgaatgcatgtgtgtggcatgtgtatatgtgtgtggcatgcatgtgtatgtgagtgcatgtgtgtggtgtatgtgcgtgagtgcatgtgtgtgtgtt

SEQ ID NO: 62185 - DNA, 201 bp, Homo sapiens
caaacacacaaatgcatgctctcacatgtgaatgtatgctcacacatgaatgtatgctcacacgcaaatgcatgctcacacacgcgaatgtatgctcacaygcacaaatgcacgctcacacacgtgaatgcacgctcacacacaaatgcatgctcacacacatgaatgcatgctcacacttgcatgtgcacacacatgcac

SEQ ID NO: 62186 - DNA, 201 bp, Homo sapiens
gtgttgaccagggtccagcgtcagtgtttaggttctctagctcttccccacctccaatgtcctccatgtccgcaccattcccacgtgcctgtgtcccaccycttctcccacacactgtccccactccccatgccccattcctctccagagaatcactggtctagaatagagacctacaaacttgggcccttaggctggccc

SEQ ID NO: 62187 - DNA, 201 bp, Homo sapiens
tggtaaggggacccgcccgcccttagatgggggatgtccagagctggaggatgaggagggcacccgcccctggtgtggggcagcagggagggccttggagratgaggagggcacctgcccccagtgtggggcagcagggagggcctcagggtgatcaggctccaggccagagctctggggccagctcaggggctggggtgg

SEQ ID NO: 62188 - DNA, 201 bp, Homo sapiens
cccctcctgtccccaggtgtgacactggctacattgggaaaaactgtgagtgccagacacagggccggagcagccaggagctggaaggaagctgccggaargacaacaactccatcatctgctcagggctgggggactgtgtctgcgggcagtgcctgtgccacaccagcgacgtccccggcaagctgatatacgggcagt

SEQ ID NO: 62189 - DNA, 201 bp, Homo sapiens
cccactgacaagcatctatattcctccccagataggatggaacggcaatgtgctccctggcccctcccaacccagtcctctaggcgttttgtttcacagcrttaatattcttaccactattttttaaatcaacaggttatgacatcataatttttacttatttctttgcccaactttgtatcatctgctcttgtatttctc

SEQ ID NO: 62190 - DNA, 201 bp, Homo sapiens
caggccaggggagggtagggttggtgggggcagccaggctgaggcccggcctcgcccttgtgggacacccaggctctgttggtctccagccccactgcccscctacctgggctgacagctgctgtggaggtatagtaaccgctcccaggctacggctgcaccctgccgtccccgcctctggccagggtcccatccccaagc

SEQ ID NO: 62191 - DNA, 201 bp, Homo sapiens
ggcccggcctcgcccttgtgggacacccaggctctgttggtctccagccccactgcccgcctacctgggctgacagctgctgtggaggtatagtaaccgcycccaggctacggctgcaccctgccgtccccgcctctggccagggtcccatccccaagcatccgcctcctccccctcccggcctccactgtacgttccctg

SEQ ID NO: 62192 - DNA, 201 bp, Homo sapiens
caggatcactcacaccacaggcaggagtactcacaccacaggcgggagcagtcacaccgcaggcaggatcactcacactgcaggcgggatcactcacaccrcaggcgggagcactcacaccgcaggcgggatcactcacaccgcaggcaggaggactcacacgggcaggcctggacaatgctgcagctcagggctttgctt

SEQ ID NO: 62193 - DNA, 201 bp, Homo sapiens
tgctgcagctcagggctttgctttcttttcttatcctcatgatgcaacagtaattttttttttattttttatttattttattttattttatttattttttyatttcatttcatttcatttcatttcatttcatttcatttcattttattgagacagagttttgctcttgttgcccaggctggagtgccatggtgtgatctc

SEQ ID NO: 62194 - DNA, 201 bp, Homo sapiens
tgatgcaacagtaattttttttttattttttatttattttattttattttatttatttttttatttcatttcatttcatttcatttcatttcatttcattycattttattgagacagagttttgctcttgttgcccaggctggagtgccatggtgtgatctcagctcattgcgacctccgcctcctgggttctcctgcctc

SEQ ID NO: 62195 - DNA, 201 bp, Homo sapiens
tgcgtgtgtgttctgggcattccaatttggatttccctttccctcccccaatgcactttactgtgtgcccaatccaggagctgccccgggagcagcctctrccccctggccccattggcacagaacgatcacagcgtacagaccgaggcacagagcctggccccattcggccatcccatcgacctggtcccccagtccagt

SEQ ID NO: 62196 - DNA, 201 bp, Homo sapiens
ggagctagtactgctagctactcaggaggctgaggtgggagaactgtttgagcccaggagttcaaggttacagtgagctttaactcactggattgcaccaytgcactccagtctgggtgacagagcaagactctgtaacttaaaaaaaaaagaaaaaagctggccgggcacgatggctcaagcctgtaatcccagcacttt

SEQ ID NO: 62197 - DNA, 201 bp, Homo sapiens
gggctagggagcgccaagacttgggagtagggattctgtatttcaaggtaggcagctcatgatttttttcccctcagctgcatccagtggaactaaagccrttccaggattatcaaaaactgagcagcaaccttgggggacctggatcatcacggactcccccaactggaaggtgaaacggaatagggatgtggactttcc

SEQ ID NO: 62198 - DNA, 201 bp, Homo sapiens
ccccatcactttcagctgtgttcacttgtcctccaatcattgatacctctctctaccttttccaaaatacagattctacaacttggagggacggaggtggkcgtggccctgatgagctggagggcccggactccaaacttcatcatggtcatgatccccggggtgggctacagccttcaggcccaccccagttccctccct

SEQ ID NO: 62199 - DNA, 201 bp, Homo sapiens
ccctttccaaacacaagatgataccagtttatttaccagactctcctgtgatttccaagattaaaaaatggcaaagaagatggggtctggtatcaggttamtgaagaaagactaagaagataagaaagcaaaaaaggtcccagcacagtggctcacacctgtaatcccagcactttgggaggccgaggcaggtggatcacc

SEQ ID NO: 62200 - DNA, 201 bp, Homo sapiens
gacagagagggactccatctcaaaaaattaaataaataaacttaatgaagctcaggttatagatccaggaaaaataacacggatgaaaaacaaaaaaaaamcacatggacattatattatctgtctggcatccaagggagtatgtgtctagagacatcagtgacccctttccaaacacaagatgataccagtttatttacc

SEQ ID NO: 62201 - DNA, 201 bp, Homo sapiens
aaacagaaaaatagtaaaagagagtctgcatcataataaagtgttcttttcccacctagttctggttttcctgagatacttatttccattctttctgtctktctcttcaggagcgagactcctccagtacctcccccaccaccctatctggccagttatccaggctttcctgagaatggagcccctgggcccccaatctct

SEQ ID NO: 62202 - DNA, 201 bp, Homo sapiens
ttatttccattctttctgtctgtctcttcaggagcgagactcctccagtacctcccccaccaccctatctggccagttatccaggctttcctgagaatggrgcccctgggcccccaatctctcgctttcctctggaggaaccagggccccgtccactcccctggcccccaggcagtgatgaagtggccaagatacaaactc

SEQ ID NO: 62203 - DNA, 201 bp, Homo sapiens
tatttccattctttctgtctgtctcttcaggagcgagactcctccagtacctcccccaccaccctatctggccagttatccaggctttcctgagaatggarcccctgggcccccaatctctcgctttcctctggaggaaccagggccccgtccactcccctggcccccaggcagtgatgaagtggccaagatacaaactcc

SEQ ID NO: 62204 - DNA, 201 bp, Homo sapiens
tcttccgcacccagcgcgtcgacctttaccagcaggtgaaggagaaacccttgtggccccaactctaaattcgagttgccacctgatttcctgtccttccrtctcatcgctgacctctcactgtgactcactctttaacacatgcctgtcccctaggcctccccaccagatgccctgcgctggatacctaagccttgggag

SEQ ID NO: 62205 - DNA, 201 bp, Homo sapiens
aagctcaagagactcaagctatgccataaaaattagtaatttcactcaacagtctatcaaggacctatctccattatgggttctgatttctaccctttaaraacacagcatagacctgaccaatgtctatcagtaagacacacttgcttagggttcctgtgctgtttcccttcccaaaggccagagccatgcctgtccctt

SEQ ID NO: 62206 - DNA, 201 bp, Homo sapiens
tttttagtagagacggggttttgccatgttggccaggatggtctccatttcttgaccttgtgatctgcccgcctcagcctcccaaagtgccaggactacargcataagccaccacgcccggcctcatatctcttaataagagtttttctagaaacatttctcaatcaccccaggcataatcatattttatttctctacttc

SEQ ID NO: 62207 - DNA, 201 bp, Homo sapiens
gaatggactgagagacctgtcgtccggcttgcttagggagctggaggtatcgagtaaagaaacactggtgatggacatttttaatgaggataggaaaacgragatggctctggccttggccctctgttttctggcccatggttacagggtgctaaggtggctccataatgctttttctcagttcttcatatggtaaaacag

SEQ ID NO: 62208 - DNA, 201 bp, Homo sapiens
gcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggatttaaaaaaaaaaa

SEQ ID NO: 62209 - DNA, 201 bp, Homo sapiens
taccacaacctccacctcctgggtttaagcgattatcctgcctcagcctcctgagtagctgggattacaggcatgcgccaccacacccggctaattttgtrtttttagtagagacagggtttctccattttggtcaagctggtcttgaactcctgacctcaggtgatccgcctgcctcggcctgccaaagtgctgggattg

SEQ ID NO: 62210 - DNA, 201 bp, Homo sapiens
atggcaagccagccactcacctgcaagaagtcagtcatgccttggagaaaggcagggacaccaggcatcgccacagtgatggtgggagaagccacaccagrccctccagcccctggccctgcaggccctagcaggttccccagaagctgagagaactgaagatcagccatggagggttgaggggtgggtggaggctgggca

SEQ ID NO: 62211 - DNA, 201 bp, Homo sapiens
gaaaaagtttcctcattaaacgaggggaggggagactgaataacaagagctcccaccatctctacatagtttgattccaggcatgacggggaaacctggayagagagagaggcttagggaagaggaaaaccaaccttgcgtctcttggcaggcataccactgaggtaggcatcactcagagggggctgcggtttcaccttc

SEQ ID NO: 62212 - DNA, 201 bp, Homo sapiens
ccggccggggagaagggagaagagaatcattttggaagtttgaaaacagaagtcatcttaaatcttactgagcctctgactaaaattctcatctgatttcygcaaacttttctgccttcacttttcataatgaataagccgcctcctttatttagccatatcagcctaggcacaggcccccaaactcatgcctccactaat

SEQ ID NO: 62213 - DNA, 201 bp, Homo sapiens
agaaaaccagagctgctacaggaggtaagggatgggtttgagattgtgcttcactgcactcttactcgtgaaaattcttctgggttatgttttctctgttytctttcctgtttctttcactgtgtttttactccagaattctcagtattagtctcccatgtgtctcccttgttgtccccacaccctgtgtcaccccactct

SEQ ID NO: 62214 - DNA, 201 bp, Homo sapiens
tatctccagcgccttcaaatcatagtcattgaatgatctgttgaatgggtataactctgatgggagcagagagttctagaatcgggtagtaagagacaaasgagggtaacagtactgcatttcacaaaatgaaacccattgttaagaaattacaaattcccaataatttcaaatataaaaatttattcatgaaaattatag

SEQ ID NO: 62215 - DNA, 201 bp, Homo sapiens
tactctgtctcaaaaaaaaaaaaaaacaaacatcaaaactggcttgtacaatttagcgtgctgagtagaacacaacagtgttccaaggaagtattaatttwaaaaagttcacacaagattaagggacacactacctaatggagacaatgtagagagaaagcagccagaaaaatccgacttttatttcttaaatactgtgaa

SEQ ID NO: 62216 - DNA, 201 bp, Homo sapiens
cacgggccgtgtgtcgttgccttccacttttggcgtcccaacgtctctccgctcccatctttctactaacgtccgacgcacgctccgcctctttctcccamattcgtcgtgtaaattctgcgtcccaaccgcccagccgacctgcaccgcattcccgccccctcaacacggctcaacggccgacgctgggggcccgcctcc

SEQ ID NO: 62217 - DNA, 201 bp, Homo sapiens
ctgtcgctaggctggagtgcagtggcgtgatctcagctcactgcaacctccgtctcccaggttcaagcgattctcctgcctcagcctcccaagtagctgaractacaggcacgcgccaccagtccagctaatttttgtatttttagtagagacggggttttgccatgttggccaggatggtctccatttcttgaccttgtg

SEQ ID NO: 62218 - DNA, 201 bp, Homo sapiens
caggtgaaggagaaacccttgtggccccaactctaaattcgagttgccacctgatttcctgtccttccgtctcatcgctgacctctcactgtgactcactstttaacacatgcctgtcccctaggcctccccaccagatgccctgcgctggatacctaagccttgggagcggacagggccgccacctcgagaagggccctc

SEQ ID NO: 62219 - DNA, 201 bp, Homo sapiens
tcgtgtcgagccactcccactctagaatcctgcttttatcccagcatctttgctttctatgttgctcagtcgccctatgtctgctttttcatttttcctgktcctcgtctcctttctcccccaaccccgtttttcttcttgggcctctgcccccttacttcgttgtctacatcctttttttttttgccattcctgtttcca

SEQ ID NO: 62220 - DNA, 201 bp, Homo sapiens
cccaaatttcttgttacagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccag

SEQ ID NO: 62221 - DNA, 201 bp, Homo sapiens
tagctgggattacaggtgtgcaccactacatccagctaatgtttatattttcagtagagatggggttgcaccatgttggccaggctggtctcaaactcccratctcagatgatccgcccaccttggcctcccaaagtgctgggattacaggcgtgagccactgcacctggccctgttgcaatgtttttccagggagggaaa

SEQ ID NO: 62222 - DNA, 201 bp, Homo sapiens
ccgtactacgcctgcgtgcgtcgcactacggatgcgtggacacttaagcatcgccccaccccctcccccctctggcggcgttcacgtctgtgcgcgcgctkgagcgctagaagattgaggtggctaccgtaaatgcctgaaaaacagtcaccagctgggactctaccactgcctcgagaggggctatggacggtcgtatgg

SEQ ID NO: 62223 - DNA, 201 bp, Homo sapiens
tcctaagacggcctgggcagaaacctctcggcctccagagacagagccgggacctcctgccccaaagcctcccctacccccacctcaccggggccccgccrggaactggggcccccctggggactacccagtgagtgtctccaataagggattgagagggtcagctgtgggaaattggtgtcagctgagtaattgaagcgg

SEQ ID NO: 62224 - DNA, 201 bp, Homo sapiens
ggtctcaaagaagaccaggataatgagtttgtcaccacccagagagatcaaccccaaagcctgggtcgttgcatcctgcaagtagcgacagttgatttgtygtaaaagagatgatagaaagcatagtaactgattcccctggccctgctgggtcttgccaattgacaggatcgtgggggtcctccctgcaagcccccagca

SEQ ID NO: 62225 - DNA, 201 bp, Homo sapiens
cataatcatattttatttctctacttctttcttttttttttttttttgagatagagtttcgctcttgttgcccaggctggagtgcaatggcacgatcttgsctcaccacaacctccgcctcccaggttcaagcgattctcccgactcagcctcccgagtagctgggatcataggcatgcgccaccacgcctgggtaattgt

SEQ ID NO: 62226 - DNA, 201 bp, Homo sapiens
tactgttgttctaatggtttcatagaaagttaatgccaccaccataggctcatgagaggccatgaagtgctttaatgggtcttaaatgggaggggcttcartagaatagatgttgaatagaatattttagtcttaagggagctagagatgagacgtgagattcctggggtgttcatggagtgtctattgttggactagatc

SEQ ID NO: 62227 - DNA, 201 bp, Homo sapiens
cagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggtgagtcttgg

SEQ ID NO: 62228 - DNA, 201 bp, Homo sapiens; identical to SEQ ID NO: 12185

SEQ ID NO: 62229 - DNA, 201 bp, Homo sapiens; identical to SEQ ID NO: 12186

SEQ ID NO: 62230 - DNA, 201 bp, Homo sapiens; identical to SEQ ID NO: 12187

SEQ ID NO: 62231 - DNA, 201 bp, Homo sapiens
tctgtctagccacctcatttgcatgacgtaatataataactggaaggccccgcccctctggtgcatttccccgctccaaccacctcctcaaactcacggcraagggatgcgagagctggaactcttaccaggcctgcggaaactcagccctccggcagctaatcccgcccgccagcccccgtcctctctctctttctccct

SEQ ID NO: 62232 - DNA, 201 bp, Homo sapiens
caggcattgtggctcacgcctgtaatcccagcacttagggaggccgaggtgggcagatcaactgagttcaggagttcgagaccaccatggctaacgtggtraaaccccatttctactaaaaatacaaaaaagtagccggcgtggtggcgctcgcctgtagtcccagctactcgggagactgaggcaggagaaacgcttgaa

SEQ ID NO: 62233 - DNA, 201 bp, Homo sapiens
tgtccgatcgctcggggccgactgccaagggaaaggatggaaagaagtattcctcgctcaacctgtttgatacgtataagggcaagtccttagagatccaraaacccgctggtgagagtcctgcaaagatgcttctgatggttgaaagctaggcatgcatggggcatacgttttagagctctttaaagggaagtggctgta

SEQ ID NO: 62234 - DNA, 201 bp, Homo sapiens
agaggcctccagcttggtctgtctccccacctctaccagcatctgctgagctatgagccaaaccagggatttacagggtagggagggtgggataggcagcrgcattagatcggaggaatgagatggacagacctgggctgtgggctaggagggcagtcagctggcctagggtagcccgggctggtgtcagggtaaggagag

SEQ ID NO: 62235 - DNA, 201 bp, Homo sapiens
tcataggcatgcgccaccacgcctgggtaattgtatttttagtagagacggggtttctccatgttggtcaggctggtctcgaactcgtgacctcaggtgayccgcccgcctgagcctcccaaagtgctgggattacaggcgtgagccaccgcgcccatccttctttttttttttttttttttttttttgagacgtagtctt

SEQ ID NO: 62236 - DNA, 201 bp, Homo sapiens
gcctctgtgaggcttttttctaaaaatggggataaagtgacctatgctattgtgcctgacatatcataagccctcaataatgtttaaaacttgaatgagcyggggccgatggcttatgcctgtaatcccagcactttgggaggatggggtgggcagatcacctgaggtcaggagttcgagaccagcctgacgaacatgaag

SEQ ID NO: 62237 - DNA, 201 bp, Homo sapiens; identical to SEQ ID NO: 12151

SEQ ID NO: 62238 - DNA, 201 bp, Homo sapiens
acggagcttctcaagtcagcggccaggcatggaacggcagaatcggcgccctggcccagggggcaaggctggcagcagtggcagcagcagtggaggaggcrgtgggggtcctggaggaaggaccgggccaggacgaggcgacaagaggagctggccctctcccaagaaccgaaggtgggtaggaacaaacaaatttattgt

SEQ ID NO: 62239 - DNA, 201 bp, Homo sapiens
agccagagagccaaggatttgagtaaacggagcttctcaagtcagcggccaggcatggaacggcagaatcggcgccctggcccagggggcaaggctggcarcagtggcagcagcagtggaggaggcggtgggggtcctggaggaaggaccgggccaggacgaggcgacaagaggagctggccctctcccaagaaccgaagg

SEQ ID NO: 62240 - DNA, 201 bp, Homo sapiens; identical to SEQ ID NO: 12155

SEQ ID NO: 62241 - DNA, 201 bp, Homo sapiens; identical to SEQ ID NO: 12156

SEQ ID NO: 62242 - DNA, 201 bp, Homo sapiens
atggagtggctcatgcctgtaatcccagcattttgggaggctgaggcaagaagattgcttgagcccagcagttcgagactagcctcggcaactggatgccrtctctgccaaaacaaacagaaaaatagtaaaagagagtctgcatcataataaagtgttcttttcccacctagttctggttttcctgagatacttatttcc

SEQ ID NO: 62243 - DNA, 201 bp, Homo sapiens; identical to SEQ ID NO: 12158

SEQ ID NO: 62244 - DNA, 201 bp, Homo sapiens; identical to SEQ ID NO: 12161

SEQ ID NO: 62245 - DNA, 201 bp, Homo sapiens
atgcataggaacccttagaaggactcaaaaacacctggactttaatagggaagagaataggttgtaagcagaagttgggaaacataacttgtgggaaaaartaacgatttagtggatactggagctaatgctctgttttctccagtcgtcctccagaggagcgtcccccggggcttcccctgcctcccccacctcccagca

SEQ ID NO: 62246 - DNA, 201 bp, Homo sapiens
ctatgggtgggatggtgatcttttttcttgaccacagatactaaagctgtttcaaccgtgctcctctcctgcagatctctgggggagccatggactctcarttacatccaaacagtggaggcttccgccctgggacaccctcactgcacccttacaggtaagactcgatgcctgtggatcacagaagtacttggagatgtg

SEQ ID NO: 62247 - DNA, 201 bp, Homo sapiens
gttttctatggcagtgctgggccttccagttctcaggtaggccccgcttcccattgcatgaccccttcagtgaataataatttttttctgcctggtatgtrtttataatcaagcctttctacgttgcagagttgtgagataccactttgtcacatcatttttctccctactttttgcttctatgggtgggatggtgatctt

SEQ ID NO: 62248 - DNA, 201 bp, Homo sapiens
tatgtattcattgctggttctttgctttccagtctgtgcatctgtatgcataggaacccttagaaggactcaaaaacacctggactttaatagggaagagrataggttgtaagcagaagttgggaaacataacttgtgggaaaaagtaacgatttagtggatactggagctaatgctctgttttctccagtcgtcctccag

SEQ ID NO: 62249 - DNA, 201 bp, Homo sapiens
ctagaagctagtggacttaaggcattgctaggactctggcttcctaacagcttttctccccacaatttattttcagatcacagcccctatacctacccccsggcccagcccctccctcagcactgctctctggggtagctctcaagggccagtttctggatttctccacaatgcaagctacagagctggggaagttgccgg

SEQ ID NO: 62250 - DNA, 201 bp, Homo sapiens
cctttccctcccccaatgcactttactgtgtgcccaatccaggagctgccccgggagcagcctctgccccctggccccattggcacagaacgatcacagcrtacagaccgaggcacagagcctggccccattcggccatcccatcgacctggtcccccagtccagtttggcactagtgacaaggtctgtgtgggctggatc

SEQ ID NO: 62251 - DNA, 201 bp, Homo sapiens
gacccccactttgaggagccggggccaatggtgagaggggtgggtgggactcctcgggactctgccggggttagtccctttccccctaaacgtcgggagcrgcctcccagaaaaccagagctgctacaggaggtaagggatgggtttgagattgtgcttcactgcactcttactcgtgaaaattcttctgggttatgtttt

SEQ ID NO: 62252 - DNA, 201 bp, Homo sapiens
gacctctcactgtgactcactctttaacacatgcctgtcccctaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgc

SEQ ID NO: 62253 - DNA, 201 bp, Homo sapiens
actggaaagcggttggtagggtgttagagtcaagaacacccacctatgtattcattgctggttctttgctttccagtctgtgcatctgtatgcataggaayccttagaaggactcaaaaacacctggactttaatagggaagagaataggttgtaagcagaagttgggaaacataacttgtgggaaaaagtaacgatttag

SEQ ID NO: 62254 - DNA, 201 bp, Homo sapiens
ggctaaggcaactggaaagcggttggtagggtgttagagtcaagaacacccacctatgtattcattgctggttctttgctttccagtctgtgcatctgtaygcataggaacccttagaaggactcaaaaacacctggactttaatagggaagagaataggttgtaagcagaagttgggaaacataacttgtgggaaaaagt

SEQ ID NO: 62255 - DNA, 201 bp, Homo sapiens
cgcgtctactgccttcccacggtgttccagcagaacggcacaactaacccacagccaaacacacacacacacacacacacacacacacacacacacacacmcaccaccccgcggctccgcccccgacttccccacggaccgtcacttccggtctcccccaaacctgccaccgacggccacttccgtttccccgatagtatt

SEQ ID NO: 62256 - DNA, 201 bp, Homo sapiens
cctatgtctgctttttcatttttcctgttcctcgtctcctttctcccccaaccccgtttttcttcttgggcctctgcccccttacttcgttgtctacatcstttttttttttgccattcctgtttccatatattttccacctgctttcgtattcattattttctgttagttttggtctattcgctacatgactcttgtatt

SEQ ID NO: 62257 - DNA, 201 bp, Homo sapiens
ttacacaactccagcaaccgggccccaaatccactatctgtgggcaaaatacaaggagggaatgctggcacgtggcagccctgcacatgcaacaggccccvcttgcccccgcctggccagcccctgacctgtgcaatgcagcacatgcgcagcaatgctattaaactgctcttggagaaattccaggtttgtccggatgat

SEQ ID NO: 62258 - DNA, 201 bp, Homo sapiens
ttatttcttaaatactgtgaaggaagaggggggaaacggtcccctgatgaggaagggccatagagcaaagagctaaggatcatcagcaaaggcccgctggscattggggaagcgctggggactgtagttggggtcttcctgcagtcgtttttgtatatcagaccggagctaaagagaaaaagtaagcaggttggagaaacg

SEQ ID NO: 62259 - DNA, 201 bp, Homo sapiens
gagaccagcctggccaacatggtgaaaccccatctctactaaaatacaaaaaattagctgggcatggtggcaggtgcctgtaatcccagctactcgggagrctgaggcaggagaatcgcttgaacccgggaggtggaggttgcggtgagccgagatcacgccatggcactccagcctgggtgacaagagtgagactctgtc

SEQ ID NO: 62260 - DNA, 201 bp, Homo sapiens
ccaacatggtgaaaccccatctctactaaaatacaaaaaattagctgggcatggtggcaggtgcctgtaatcccagctactcgggagactgaggcaggagratcgcttgaacccgggaggtggaggttgcggtgagccgagatcacgccatggcactccagcctgggtgacaagagtgagactctgtctcaaaaaaaaaaa

SEQ ID NO: 62261 - DNA, 201 bp, Homo sapiens
gcttggtctgtctccccacctctaccagcatctgctgagctatgagccaaaccagggatttacagggtagggagggtgggataggcagcggcattagatcrgaggaatgagatggacagacctgggctgtgggctaggagggcagtcagctggcctagggtagcccgggctggtgtcagggtaaggagaggaagggaggga

SEQ ID NO: 62262 - DNA, 201 bp, Homo sapiens
aaaaaattagctgggcatggtggcaggtgcctgtaatcccagctactcgggagactgaggcaggagaatcgcttgaacccgggaggtggaggttgcggtgmgccgagatcacgccatggcactccagcctgggtgacaagagtgagactctgtctcaaaaaaaaaaaaaaaaaaaaaaaaagactggaaggagaaactcat

SEQ ID NO: 62263 - DNA, 201 bp, Homo sapiens
ccccacttcctctgcctgcccctcctcctccttccacgttgtctcctccacctagcagttggttggcaaccccttcctcagtcccctgctgaaaaccctcsagtcagcgcttatcccttctgctctctcccctcacccagagaaatacatggagtttgaccttaatggaaatggcgatattggtgagaaacgggtgatttg

SEQ ID NO: 62264 - DNA, 201 bp, Homo sapiens
ggtctccaactcctgacctcaggtgacccacccaccttggcctctcaaagtgctgggattacaggcgtgagccactgctcccgctcccggccctttttttyttctttttcttttttttttttttttgagacgtagtctcactctgtcgctaggctggagtgcagtggcgtgatctcagctcactgcaacctccgtctccca

SEQ ID NO: 62265 - DNA, 201 bp, Homo sapiens
aagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcagcttagtttttatttgggtgattttttt

SEQ ID NO: 62266 - DNA, 201 bp, Homo sapiens
gatgccgcctttcgtgagtcttggtgtcttgtcttggaacgattacactggaagctggagagctaggaatcaggacttagtctttgacctatgagatagargggagggtgggaggatgattgatagcaggcttaaggagctagaagggtatatgactgtccctctgagcagctactgttggacccttttacagatgtatcc

SEQ ID NO: 62267 - DNA, 201 bp, Homo sapiens
aaagttgccattgcccggcgtatgccacctccagccaaccttccaagcctgaaagccgagaacaaaggcaatgaccccaatgtctcactagtgccaaaagwcggaacaggatgggcaagcaaacaggagcagtccgaccccaagaggtagacagaggcttgggggacctagagtgatgggtattttaacttgaacttcagg

SEQ ID NO: 62268 - DNA, 201 bp, Homo sapiens
agccaccacgcccggcctcatatctcttaataagagtttttctagaaacatttctcaatcaccccaggcataatcatattttatttctctacttctttcttttttttttttttttgagatagagtttcgctcttgttgcccaggctggagtgcaatggcacgatcttggctcaccacaacctccgcctcccaggttcaagc

SEQ ID NO: 62269 - DNA, 201 bp, Homo sapiens
caagaggtagacagaggcttgggggacctagagtgatgggtattttaacttgaacttcagggagcattggggcttggtttagtccagccacgtctgagccrgagacgaagaggtccctttcttacctattgcaggttccttgttaaatgactaaggaatggtactaaactttagctttttgtcttggagagagagcatgaa

SEQ ID NO: 62270 - DNA, 201 bp, Homo sapiens
ttggtcaggctggtctcgaactcgtgacctcaggtgatccgcccgcctgagcctcccaaagtgctgggattacaggcgtgagccaccgcgcccatccttctttttttttttttttttttttttttgagacgtagtcttgctctgtcacccaggctggagtgcaacctccgcctccctggttcaaggaattctctgcctcag

SEQ ID NO: 62271 - DNA, 201 bp, Homo sapiens
ctagagtgatgggtattttaacttgaacttcagggagcattggggcttggtttagtccagccacgtctgagccagagacgaagaggtccctttcttacctrttgcaggttccttgttaaatgactaaggaatggtactaaactttagctttttgtcttggagagagagcatgaaaaaatagacaacagcctacaaaggatg

SEQ ID NO: 62272 - DNA, 201 bp, Homo sapiens
tccaaccacctcctcaaactcacggcaaagggatgcgagagctggaactcttaccaggcctgcggaaactcagccctccggcagctaatcccgcccgccascccccgtcctctctctctttctccctagctgaaggcgccacgggccgtgtgtcgttgccttccacttttggcgtcccaacgtctctccgctcccatcttt

SEQ ID NO: 62273 - DNA, 201 bp, Homo sapiens
ccccgcgcacccggccaggtgagtctgggtgaaccgtgcgctgacgcccttttccggcgcgggagaggtggtggcggtggcggtggcggcggcggcggcgktggtgggccggggggaggagaagctgccattagccgccgccattttgtcctcctgctgccgggcctgcttgcccctccccctccggtacctctactccgg

SEQ ID NO: 62274 - DNA, 201 bp, Homo sapiens
tccattcctcatgatttgggagggggcccacctaccacagtgggaggaaggagaatggggatgcggaagtgggagaggagagagagggtctccccaccttytccccatccccatcctctgcccccagatatcatgtccctgaaacgaatgctggagaaacttggagtccccaagactcacctagagctaaagaaattaatt

SEQ ID NO: 62275 - DNA, 201 bp, Homo sapiens
ttcgtgtcgagccactcccactctagaatcctgcttttatcccagcatctttgctttctatgttgctcagtcgccctatgtctgctttttcatttttcctkttcctcgtctcctttctcccccaaccccgtttttcttcttgggcctctgcccccttacttcgttgtctacatcctttttttttttgccattcctgtttcc

SEQ ID NO: 62276 - DNA, 201 bp, Homo sapiens
caaacaaaaaacacttgaatgggtagatgaatgaaagaactggtgctattaaataaagcaaagaatttacagctgggcgtggtggctcacgcctgtaatcycagcacttcaggaggccgaagcgggcagattacctgaaatcaggagttggagaccagcctggccaacatggtgaaaccccatctctactaaaatacaaaa

SEQ ID NO: 62277 - DNA, 201 bp, Homo sapiens
ccctcctggtgtgcatccctctggtaagggggcatgggaggagtgagaaacaggaaagtcccctcagtcttaggcattggatattagggtcttactgtgaytctggtacgataggttttgcccatcatagtgatgagggaagggcatatgcttggcactgctgagatagctctgttgcaaaaatgggcttagttaagaaat

SEQ ID NO: 62278 - DNA, 201 bp, Homo sapiens
acagctgggcgtggtggctcacgcctgtaatcccagcacttcaggaggccgaagcgggcagattacctgaaatcaggagttggagaccagcctggccaacrtggtgaaaccccatctctactaaaatacaaaaaattagctgggcatggtggcaggtgcctgtaatcccagctactcgggagactgaggcaggagaatcgc

SEQ ID NO: 62279 - DNA, 201 bp, Homo sapiens
tttcctgagatggagtctcatgttggccaggctggtctccaactcctgacctcaggtgacccacccaccttggcctctcaaagtgctgggattacaggcgwgagccactgctcccgctcccggccctttttttcttctttttcttttttttttttttttgagacgtagtctcactctgtcgctaggctggagtgcagtggc

SEQ ID NO: 62280 - DNA, 201 bp, Homo sapiens
tttgccatgttggccaggatggtctccatttcttgaccttgtgatctgcccgcctcagcctcccaaagtgccaggactacaggcataagccaccacgcccrgcctcatatctcttaataagagtttttctagaaacatttctcaatcaccccaggcataatcatattttatttctctacttctttcttttttttttttttt

SEQ ID NO: 62281 - DNA, 201 bp, Homo sapiens
cctctcccaagaaccgaaggtgggtaggaacaaacaaatttattgtggtttaaaaattggaggagggggaaaaagcctgagggaaagataagtttgggtgkagtggagattgtggcctgaggggccatgggctctagaatgtcagtaggatttccatgtctggctaaggcaactggaaagcggttggtagggtgttagagt

SEQ ID NO: 62282 - DNA, 201 bp, Homo sapiens
gggccaggacgaggcgacaagaggagctggccctctcccaagaaccgaaggtgggtaggaacaaacaaatttattgtggtttaaaaattggaggagggggraaaagcctgagggaaagataagtttgggtggagtggagattgtggcctgaggggccatgggctctagaatgtcagtaggatttccatgtctggctaaggc

SEQ ID NO: 62283 - DNA, 201 bp, Homo sapiens; identical to SEQ ID NO: 12184

SEQ ID NO: 62284 - DNA, 201 bp, Homo sapiens
gagaaacgcttgaacccaggaggtggaggttgtagtgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttg

SEQ ID NO: 62285 - DNA, 201 bp, Homo sapiens
tacaaaaaagtagccggcgtggtggcgctcgcctgtagtcccagctactcgggagactgaggcaggagaaacgcttgaacccaggaggtggaggttgtagwgagccgagattgtgccatcgcactccagcttaggcaacgagcgaaactccgtctcaaaaatgaatgaatgaatagcacaactccatctcaaaaatgaatg

SEQ ID NO: 62286 - DNA, 201 bp, Homo sapiens
tgcaaaaatgggcttagttaagaaataagcagtggttggccaggcattgtggctcacgcctgtaatcccagcacttagggaggccgaggtgggcagatcarctgagttcaggagttcgagaccaccatggctaacgtggtgaaaccccatttctactaaaaatacaaaaaagtagccggcgtggtggcgctcgcctgtagt

SEQ ID NO: 62287 - DNA, 201 bp, Homo sapiens
gaaagtcccctcagtcttaggcattggatattagggtcttactgtgactctggtacgataggttttgcccatcatagtgatgagggaagggcatatgcttrgcactgctgagatagctctgttgcaaaaatgggcttagttaagaaataagcagtggttggccaggcattgtggctcacgcctgtaatcccagcacttagg

SEQ ID NO: 62288 - DNA, 201 bp, Homo sapiens
aactgtttgagcccaggagttcaaggttacagtgagctttaactcactggattgcaccactgcactccagtctgggtgacagagcaagactctgtaacttaaaaaaaaaagaaaaaagctggccgggcacgatggctcaagcctgtaatcccagcactttgggaggccaaggtgggtggatcacaaggtcaagagttcgag

SEQ ID NO: 62289 - DNA, 201 bp, Homo sapiens
ttgcactccagcctgggtgacagagcaagactctgtctcaaaaaaaaatcctgtctcacaagaaatacataaataaaaatgaaaactatttcctataggcyaagactgaagaaagtactgttgttctaatggtttcatagaaagttaatgccaccaccataggctcatgagaggccatgaagtgctttaatgggtcttaaa

SEQ ID NO: 62290 - DNA, 201 bp, Homo sapiens
gaggcgggcagaacatgaggtcaggagttcaagatcagcctggccaacatagtgaaacccgtctctactaaaaatacaaaaattagccaagtgtggtggcwtgtgcttgtagtcccagctgcttgggaggctgaggtagtagaatcgctttaacccgggaggcagagatttctgtgagccaagaccatgccattgcactcc

SEQ ID NO: 62291 - DNA, 201 bp, Homo sapiens
agaggattggcagaaatgagagagcctcacaaagatactttttctgcccaaaagaatgaatactgcagagaagactagattatgaaggccaaaccctgtgratgtggccagtgaagccctaactcccaggctgagagaaaagggagagggagggtggagagagaccctagccagccttgcccacttacctccatccgggat

SEQ ID NO: 62292 - DNA, 201 bp, Homo sapiens
accaggataatgagtttgtcaccacccagagagatcaaccccaaagcctgggtcgttgcatcctgcaagtagcgacagttgatttgttgtaaaagagatgrtagaaagcatagtaactgattcccctggccctgctgggtcttgccaattgacaggatcgtgggggtcctccctgcaagcccccagcacctgaagatgagg

SEQ ID NO: 62293 - DNA, 201 bp, Homo sapiens
agaaatatttttcctaactacaaactgactcttgggaagtaccagagtatttatatacatctaatcacaagtctatatatggctttcttatatccaggtartatcacattttagaaaaccatggaccaccccacatgcaatttgtctccaagtattacaggagtaaagacacagatagctatgtccaaggctttaagctca

SEQ ID NO: 62294 - DNA, 201 bp, Homo sapiens
ttgagagctctatgctagtgtgcacctggaatatgctcccaactcaaaatacaggttttttatttatatataaagtgctttcgcacaaaaaatacaaacaycaggctgggcgcggtggcccacgcctgtaattccagcactttgggaggccaaggcgggtggatcacaaggtcaggagttcgagaccagcctggccaatat

SEQ ID NO: 62295 - DNA, 201 bp, Homo sapiens
agtgtgcacctggaatatgctcccaactcaaaatacaggttttttatttatatataaagtgctttcgcacaaaaaatacaaacatcaggctgggcgcggtrgcccacgcctgtaattccagcactttgggaggccaaggcgggtggatcacaaggtcaggagttcgagaccagcctggccaatatggtgaaaccctgtctc

SEQ ID NO: 62296 - DNA, 201 bp, Homo sapiens
gaaaagttagggtcagtggcagagccaggcagatgctgaccctttttctctttcccagacccccactttgaggagccggggccaatggtgagaggggtggrtgggactcctcgggactctgccggggttagtccctttccccctaaacgtcgggagcggcctcccagaaaaccagagctgctacaggaggtaagggatggg

SEQ ID NO: 62297 - DNA, 201 bp, Homo sapiens
ttttagtagaaatggggtttcatcatgttggccaggctggtcttgaactcctgatctcgtgatccacctgcctaggcctcccaaagtgctgggattacagscgtgagccaccgcgccaggccttatttctctacttctataatatcctgtgcattatctccagcgccttcaaatcatagtcattgaatgatctgttgaatg

SEQ ID NO: 62298 - DNA, 201 bp, Homo sapiens
ccccctaaacgtcgggagcggcctcccagaaaaccagagctgctacaggaggtaagggatgggtttgagattgtgcttcactgcactcttactcgtgaaawttcttctgggttatgttttctctgttttctttcctgtttctttcactgtgtttttactccagaattctcagtattagtctcccatgtgtctcccttgttg

SEQ ID NO: 62299 - DNA, 201 bp, Homo sapiens
tggactgagagacctgtcgtccggcttgcttagggagctggaggtatcgagtaaagaaacactggtgatggacatttttaatgaggataggaaaacgaagrtggctctggccttggccctctgttttctggcccatggttacagggtgctaaggtggctccataatgctttttctcagttcttcatatggtaaaacagtat

SEQ ID NO: 62300 - DNA, 201 bp, Homo sapiens
ggccaggagtgagctccgggttctgggctggggcacgctcctccacttcttctgcctccatgggctcccggggaggtgcttcactttcaactggttctgaygtttgagagctcaaggctactggctccggggtcacagccggtggctgcgggggcggctgactgtgctgcggttggggccctcctcgacactgaaggtagg

SEQ ID NO: 62301 - DNA, 201 bp, Homo sapiens
ggcacagaagtgagtgagggtgggagggtgtgtctgagctgggacttttttgagcactggtcataccccccacctgctctgggttgagtctggagctgttytctcacttggctgtcccctttctgcagtttgtatgtgtgcatcagtcaggtattggggtgctttctaccctgacttaactagctccttctccactcctct

SEQ ID NO: 62302 - DNA, 201 bp, Homo sapiens
cacagcaaccctgctggcatccaacaggctctggcccagcttagtagccgtcaagggagtgtaactgcaccagggggtcatccaaggcacaagcctgggcytccccaagcccctcagggcccctctcctaggcccccaacccgatacgagccccagagggtcaacagcggcctcagttctggtaagctggaggggttatgg

SEQ ID NO: 62303 - DNA, 201 bp, Homo sapiens
attattacttgtagggaattactctttgtagacaggcacaaagggcagagtgtttatactaggaggatgctggatttttacttagatttccttgacaaagktgtctgggggaaaggagggaacatggcatttgagctatgagggagctaagtagatcatggttgcttaagaagagtgggcagtttacatagactggaggaa

SEQ ID NO: 62304 - DNA, 201 bp, Homo sapiens
cgggatagtaaggtctgtatatccctgatcatgtgctgagccatcaccagccgtacccggggctcactctacaatgagagaaggtttatcagggtaggttrcagatgaagccatgagttctaccacctactaaatcaggtcccagccatctctcagccaggtccaccccacctcccagcctccttctcccagatccccttc

SEQ ID NO: 62305 - DNA, 201 bp, Homo sapiens
attggcacagaacgatcacagcgtacagaccgaggcacagagcctggccccattcggccatcccatcgacctggtcccccagtccagtttggcactagtgrcaaggtctgtgtgggctggatctgggtatcctgagttgggtggagagaagggaaggactaaaggtgggacatagaggacacatgtctgtcacgggacaat

SEQ ID NO: 62306 - DNA, 201 bp, Homo sapiens
tggtcaggctggtctcgaactcgtgacctcaggtgatccgcccgcctgagcctcccaaagtgctgggattacaggcgtgagccaccgcgcccatccttctytttttttttttttttttttttttgagacgtagtcttgctctgtcacccaggctggagtgcaacctccgcctccctggttcaaggaattctctgcctcagc

SEQ ID NO: 62307 - DNA, 201 bp, Homo sapiens
aggccaaggcgggtggatcacaaggtcaggagttcgagaccagcctggccaatatggtgaaaccctgtctctactaaaaatacaaaaattagccgggcgtsgtggcggacgcctgtagtcccagctactcaggaggctgaggcatgagtgagaatcacttgaacccgggaggtggaggttgtagtgagccgagctcgagat

SEQ ID NO: 62308 - DNA, 201 bp, Homo sapiens
agggcaagtccttagagatccagaaacccgctggtgagagtcctgcaaagatgcttctgatggttgaaagctaggcatgcatggggcatacgttttagagytctttaaagggaagtggctgtagtagaaataccaaaagactagaggagatttcccaactttacactgggtcctttaaagggggtgtgggctctgggtgaa

SEQ ID NO: 62309 - DNA, 201 bp, Homo sapiens
ccctgatgaggaagggccatagagcaaagagctaaggatcatcagcaaaggcccgctgggcattggggaagcgctggggactgtagttggggtcttcctgyagtcgtttttgtatatcagaccggagctaaagagaaaaagtaagcaggttggagaaacgctggccaagtccctatgatcccagcaagcacacaaggccat

SEQ ID NO: 62310 - DNA, 201 bp, Homo sapiens
agagaagggaaggactaaaggtgggacatagaggacacatgtctgtcacgggacaatgtctcctgccttcttgtgatcacaggactcagacttacgcctartggtaggagacagcttgaaagcagagaaggagctaacagcatcagtcactgaggtaagtgggagtaagagtttggtggaaaggcccaagatttctgggga

SEQ ID NO: 62311 - DNA, 201 bp, Homo sapiens
tccgcctccctggttcaaggaattctctgcctcagcttcccgagtagttgggattacaggcgcccgccaccacgtagggcaaatttttgtatttttagtaraaatggggtttcatcatgttggccaggctggtcttgaactcctgatctcgtgatccacctgcctaggcctcccaaagtgctgggattacaggcgtgagcc

SEQ ID NO: 62312 - DNA, 201 bp, Homo sapiens
tcagcaaaggcccgctgggcattggggaagcgctggggactgtagttggggtcttcctgcagtcgtttttgtatatcagaccggagctaaagagaaaaagyaagcaggttggagaaacgctggccaagtccctatgatcccagcaagcacacaaggccatccctcagaagctaacatttccccccccaagcacactgtcaa

SEQ ID NO: 62313 - DNA, 201 bp, Homo sapiens
gtgctttgggagtgttaggtgagaggatcgcttgaagccaggagttcaagaccagcctgggcaacacagcaagaccccccacctctacaaaaaaaaaaaawttttttagttgggtgtggactgtgcatctgtggtcccagctactctggaggttgtggtgggaggatcagttgagcccaggagttggaggtcacagtgagc

SEQ ID NO: 62314 - DNA, 201 bp, Homo sapiens
ggcattggggaagcgctggggactgtagttggggtcttcctgcagtcgtttttgtatatcagaccggagctaaagagaaaaagtaagcaggttggagaaasgctggccaagtccctatgatcccagcaagcacacaaggccatccctcagaagctaacatttccccccccaagcacactgtcaaatagcccggggtggcac

SEQ ID NO: 62315 - DNA, 201 bp, Homo sapiens
aatgtctcctgccttcttgtgatcacaggactcagacttacgcctagtggtaggagacagcttgaaagcagagaaggagctaacagcatcagtcactgagrtaagtgggagtaagagtttggtggaaaggcccaagatttctggggaagattgctgggagtgaccagggcgtccaggatgccagacatccctctccacgag

SEQ ID NO: 62316 - DNA, 201 bp, Homo sapiens
cagttgagcccaggagttggaggtcacagtgagctatgatcgtgccactgaactccatcctgggcaacagagcgagacttttaaaaggaaaaaaaaaaaaragtaggggaggatggatggggaataccaagtccttgcaaagtggtgagaggagtaagaatgacaagacttcattggtggatctagacttcggagggaagg

SEQ ID NO: 62317 - DNA, 201 bp, Homo sapiens
tctggcttcctaacagcttttctccccacaatttattttcagatcacagcccctatacctaccccccggcccagcccctccctcagcactgctctctgggktagctctcaagggccagtttctggatttctccacaatgcaagctacagagctggggaagttgccggctggaggagttctctaccctccaccttccttcct

SEQ ID NO: 62318 - DNA, 201 bp, Homo sapiens
ggctcatgatcaaccaatctcacataaaagtattgaatgttacatatctcagccttcttgatagggatttcatagattttttttttttttttttttttttkagaccaagtttagctcctgttgcccaggctggagtgcaatggtgtgatcttgacttaccacaacctccacctcctgggtttaagcgattatcctgcctca

SEQ ID NO: 62319 - DNA, 201 bp, Homo sapiens
acatgaggtcaggagttcaagatcagcctggccaacatagtgaaacccgtctctactaaaaatacaaaaattagccaagtgtggtggcatgtgcttgtagycccagctgcttgggaggctgaggtagtagaatcgctttaacccgggaggcagagatttctgtgagccaagaccatgccattgcactccagcctgggtgac

SEQ ID NO: 62320 - DNA, 201 bp, Homo sapiens
caacatagtgaaacccgtctctactaaaaatacaaaaattagccaagtgtggtggcatgtgcttgtagtcccagctgcttgggaggctgaggtagtagaaycgctttaacccgggaggcagagatttctgtgagccaagaccatgccattgcactccagcctgggtgacagagcaagactctgtctcaaaaaaaaatcctg

SEQ ID NO: 62321 - DNA, 201 bp, Homo sapiens
acatagtgaaacccgtctctactaaaaatacaaaaattagccaagtgtggtggcatgtgcttgtagtcccagctgcttgggaggctgaggtagtagaatcsctttaacccgggaggcagagatttctgtgagccaagaccatgccattgcactccagcctgggtgacagagcaagactctgtctcaaaaaaaaatcctgtc

SEQ ID NO: 62322 - DNA, 201 bp, Homo sapiens
gcaaggcccggacctactgggaacaagagatggaagagctgacttgaccgcgaggggagatgctttttgggctggagggcttgtgacatgaataggattawttttctttttctttggtttcttcaggcctagttccccgagagcgttcagacagtgggggctcaagctcagagccatttgaccgtcatgcacctgctatgt

SEQ ID NO: 62323 - DNA, 201 bp, Homo sapiens
gccggcccccacccatgcccccaatgaactttgatccccgatggatgatgattcctccttatgtggacccccggctcctccagggtcgtccccctctagasttctaccctcctggtgtgcatccctctggtaagggggcatgggaggagtgagaaacaggaaagtcccctcagtcttaggcattggatattagggtcttac

SEQ ID NO: 62324 - DNA, 201 bp, Homo sapiens
aatactcatatttcccctcaggggcccatgaagaggttgactacactgaaaagctcaagttcagcgatgaggaagatgggcgagactctgatgaggagggwgctgagggccagtgagttagggccatcaggggagaagaggagggggtcttggtttgtattttggtaatatactcttagaggagtatattagttgcagctg

SEQ ID NO: 62325 - DNA, 201 bp, Homo sapiens
agacaccagagggcctcatatctgagtccctaatgataatgcaatggagtttttaagtttctgttatggtctgtacaggggacagagactgagacacttgmtgtctggcccacaggctctggcacgttttgggggaggtgcctgcaggacccaacatactcaatgagcttccagcgcaatgtccgatcgctcggggccgac

SEQ ID NO: 62326 - DNA, 201 bp, Homo sapiens
tctcgcatgtggttatacaacatgccatatttcattttcttttttgtgtacagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggtaag

SEQ ID NO: 62327 - DNA, 201 bp, Homo sapiens
acacgccaacacacccagctaattttttgtgtgtttttagtagagatggggtttcacatgttggccaggatggtctcgatctcttgacctcgtgatccgcycgcctcagcctcccagagtgctgggattacaggcgtgagccaccgcgcccagccagagtcttccacttttatagcatgtcctcaggaaatgtcttctgtc

SEQ ID NO: 62328 - DNA, 201 bp, Homo sapiens
gaaggcgggaaacctgatggtctggtacctgtcagagccttccactttttttttttttgagacggagtctcattctgtcacccaggctggagtgcagtggygcaatctcggctcactgcaacctctgcctcctgggttcaagcgattttcctgcctcagcctccagagtagcgggactacaggcacacgccaacacaccca

SEQ ID NO: 62329 - DNA, 201 bp, Homo sapiens
tgcccgcgtctactgccttcccacggtgttccagcagaacggcacaactaacccacagccaaacacacacacacacacacacacacacacacacacacacmcacccaccaccccgcggctccgcccccgacttccccacggaccgtcacttccggtctcccccaaacctgccaccgacggccacttccgtttccccgatag

SEQ ID NO: 62330 - DNA, 201 bp, Homo sapiens
cttcctctgtatttccctctgcattaagttctatccatgtggaggacagaacaaaatcagcctcactcacaaaacatcagaaaacgttctactggaatacraacaaagggatcaataaaaagaaaatctgaggccaggtgcggtggctcatgcctgtaataccagcactttgggaggccgaggagggcacatcacctgagg

SEQ ID NO: 62331 - DNA, 201 bp, Homo sapiens
ttcatggaggcacatgagcaagtttaagtctcagtcttatatgatggagtgtagtggtgccagaactgacctccttggggaataagcagttattctgtagsggggtgagtttgaaggcgggaaacctgatggtctggtacctgtcagagccttccactttttttttttttgagacggagtctcattctgtcacccaggctg

SEQ ID NO: 62332 - DNA, 201 bp, Homo sapiens
aactagactccctgaaggcatggctctgcaattttatctccgactcgctagcaactagcataagactgacacaaattagatgcataataagcatctgtaatttttttttttttttttgagacagagtctcgctctgttgcccaggctggagtgcagtggcatgatctcagctcactgtaacctccgcctcccaggttcaag

SEQ ID NO: 62333 - DNA, 201 bp, Homo sapiens
ctctaaagaagaacgaaggaaggaaggcccgctgttgcccagaccagagtgtacccgaaagactccctagcattaatccctgccccaatacctaaaaagtwtctcctgcacacacacacattcacacctgtccccatcccccttctgattccggggcacagggagagaaacacaaagggcaggagatcgacggcttaggga

SEQ ID NO: 62334 - DNA, 201 bp, Homo sapiens
ccttgttaaatgactaaggaatggtactaaactttagctttttgtcttggagagagagcatgaaaaaatagacaacagcctacaaaggatgacaaaattawtttgtccttatatttgtaaatggtagcaatgggcatgatttcagtcctgagtctccaccagttggagaagtcagggaggcatctcaggtgtgaataacct

SEQ ID NO: 62335 - DNA, 201 bp, Homo sapiens
ctaccagatgtcagatcactgcttcaaggtgcttaaaggtgcagggtggtaaggctggggataaatgaagtagaaggcagttgttttggtttattggactrtcagtgatagtgttctatcatttgtatatctgaaggagggaaggttttgtctggaatcttaggttgtagtctaataccatttcttggcagagtactgtag

SEQ ID NO: 62336 - DNA, 201 bp, Homo sapiens
cgccccacactctgcggagaaagtggtttcgcgcacgcgcgccacgcccatcgaaccctcctaactcactatagacccgaaacggcactcacggggcgacrgacctgctagctgactgcccgcgtctactgccttcccacggtgttccagcagaacggcacaactaacccacagccaaacacacacacacacacacacaca

SEQ ID NO: 62337 - DNA, 201 bp, Homo sapiens
taaagggggtgtgggctctgggtgaacaccagttatcctcctacaaaggcgtgtctgtggttccctgtctttggacacgtaagaattggaggaaaataaakgtggatttgggaaactttgaggccagcttgcttcttgcaggctcatgatcaaccaatctcacataaaagtattgaatgttacatatctcagccttcttga

SEQ ID NO: 62338 - DNA, 201 bp, Homo sapiens
tgctggatttttacttagatttccttgacaaaggtgtctgggggaaaggagggaacatggcatttgagctatgagggagctaagtagatcatggttgcttragaagagtgggcagtttacatagactggaggaaaagacaccagagggcctcatatctgagtccctaatgataatgcaatggagtttttaagtttctgtta

SEQ ID NO: 62339 - DNA, 201 bp, Homo sapiens
aaagaatgcaggcaggacaaaaacacatgtccaaacaaggtactcaggcccatgacagatttcatgaagagcaaggaataccatgaaccaacattctccaycactataagctttgtcactttgacaaatcactcagcctctgtgaggcttttttctaaaaatggggataaagtgacctatgctattgtgcctgacatatca

SEQ ID NO: 62340 - DNA, 201 bp, Homo sapiens
gctgatcctgctcttctcgccagcaactattctcaccttgaatgttcatgtgcatcatgaccacgggttccacactctggtgggaaatccggatgaccctygggtggctggtggctggcgggggagctggacctggcgggggagccccctcagctgaggactcgacattggtagaagacggagccacggatgaggcctgcc

SEQ ID NO: 62341 - DNA, 201 bp, Homo sapiens
cctcctctttatgcaaataacctccgcatgctccgcgcgcccggcccttttttttttttttttaaactaaagacagccctggaagtagagggttagggtakaaagtgccccgccctttatgcaaattaaggggcgtgtctaggcgcggagggaggtgggaggtgggagggggtgctcccgggggcggcggttgcccggatg

SEQ ID NO: 62342 - DNA, 201 bp, Homo sapiens
ctccacattatctggcccctcaacctccccctctctagagtacctgaggctcaggggaagctctttctgctccctgaacttccattggctcctcaggaagyggctgtgaaattaaagaacaccatacttcctctcagatctctccagttctctcaagtaccctgaccccatcgcccaacaggtcccttacctgggggggat

SEQ ID NO: 62343 - DNA, 201 bp, Homo sapiens
tagaactgcccgaagaatgcctacgctgcgtggtgcggacgaaacgcttcccggggcctttggattggtctgtctagccacctcatttgcatgacgtaatwtaataactggaaggccccgcccctctggtgcatttccccgctccaaccacctcctcaaactcacggcaaagggatgcgagagctggaactcttaccaggc

SEQ ID NO: 62344 - DNA, 201 bp, Homo sapiens
ccacacctggctgaacctgcaccaaggactgagagacaagataacacaaagatcccaaaatcaagaatcataagactgggagtggaggaggcagctgcctygaccagacccaggagaggaaaggaatagagaagggttactcacaaaactctcccgcacatactcttctagccccgtgatcaatgtgtgggttgccatctg

SEQ ID NO: 62345 - DNA, 201 bp, Homo sapiens
aaaatacaaaaattagccaagtgtggtggcatgtgcttgtagtcccagctgcttgggaggctgaggtagtagaatcgctttaacccgggaggcagagattyctgtgagccaagaccatgccattgcactccagcctgggtgacagagcaagactctgtctcaaaaaaaaatcctgtctcacaagaaatacataaataaaaa

SEQ ID NO: 62346 - DNA, 201 bp, Homo sapiens; identical to SEQ ID NO: 12172

SEQ ID NO: 62347 - DNA, 201 bp, Homo sapiens; identical to SEQ ID NO: 12173

SEQ ID NO: 62348 - DNA, 201 bp, Homo sapiens
gcacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgag

SEQ ID NO: 62349 - DNA, 201 bp, Homo sapiens
aaagataagtttgggtggagtggagattgtggcctgaggggccatgggctctagaatgtcagtaggatttccatgtctggctaaggcaactggaaagcggytggtagggtgttagagtcaagaacacccacctatgtattcattgctggttctttgctttccagtctgtgcatctgtatgcataggaacccttagaaggac

SEQ ID NO: 62350 - DNA, 201 bp, Homo sapiens
cacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgaga

SEQ ID NO: 62351 - DNA, 201 bp, Homo sapiens
acttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgagat

SEQ ID NO: 62352 - DNA, 201 bp, Homo sapiens; identical to SEQ ID NO: 12175

SEQ ID NO: 62353 - DNA, 201 bp, Homo sapiens
cccccaccccgctgagggagttcctcttgccccctacccccggggcttgtatatagattataaatatataagggggaaaggggtgggcggggaggggttgyggggctggggcctcacttcccctcctcccccttcccctggtcccctgtccctggggctgtttgttaaaaaagagtaataaaaggatttaaaaaaaaaaac

SEQ ID NO: 62354 - DNA, 201 bp, Homo sapiens
cttttttgtgccagtgagcgaggtcaactggttatcagtctgcagctgacacctgggctggtcccaatatggcttcctttgcatatctagggccttggtgrgacatctgtaacattactgggttatcaaccagtgtcttcacatggactctccagcaggcctgttaaatgtccgtgagctcatgttccaagaggtctagct

SEQ ID NO: 62355 - DNA, 201 bp, Homo sapiens
gaggctgaggcaggagaatcacttgaacccgggaggcagaggttgcagtgagccaagattgtacactgcactccagcctagcaacagagtgagactccatytcaaaaaaaaaaaaaaaaaaaaaaaaaaaagctgaaacctgaagacacaagacactacagcagccccattccaggaaagcaggaaccaagaaaatatgga

SEQ ID NO: 62356 - DNA, 201 bp, Homo sapiens
aaacggagcttctcaagtcagcggccaggcatggaacggcagaatcggcgccctggcccagggggcaaggctggcagcagtggcagcagcagtggaggagscggtgggggtcctggaggaaggaccgggccaggacgaggcgacaagaggagctggccctctcccaagaaccgaaggtgggtaggaacaaacaaatttatt

SEQ ID NO: 62357 - DNA, 201 bp, Homo sapiens
gagactccatctcaaaaaaaaaaaaaaaaaaaaaaaaaaaagctgaaacctgaagacacaagacactacagcagccccattccaggaaagcaggaaccaasaaaatatggaaagaactggaaagtgccagtgagcagactaggaaaggagtttaaactctgagtggggaagaatgaaaactcacccacaaggactggctgc

SEQ ID NO: 62358 - DNA, 201 bp, Homo sapiens
cctcaactccccaaccccacttcctctgcctgcccctcctcctccttccacgttgtctcctccacctagcagttggttggcaaccccttcctcagtcccckgctgaaaaccctccagtcagcgcttatcccttctgctctctcccctcacccagagaaatacatggagtttgaccttaatggaaatggcgatattggtgag

SEQ ID NO: 62359 - DNA, 201 bp, Homo sapiens
ccaatcagaaagcctgcctttccctccatctaaacagggagaggtactcccttcaccacacaaacacacctccaaagacaaaccaacccccacaccccccwcatctgtctacttaagcttctgctctggtccccaggctaccaccaccagcatgtgcctctcccttccccaccctgttccctcacacctcagcatgaacct

SEQ ID NO: 62360 - DNA, 201 bp, Homo sapiens
tctcttcaacctccgcctcccaggttcaaacgattctcctgcctctgcctcccaagtagctgggattaagttgcctgccaccacacccggctaatttttgktttttttttttttttttttttttgagacagagtctcgctctatcacccaggctggagtgcagtggtgcgacctcagctcactgcaagctccgtctcctgg

SEQ ID NO: 62361 - DNA, 201 bp, Homo sapiens
acctcattttcttcatctttaaaatgaaaggttcagagtcaatgaattcccagggccccttcccctaacatgtcactaggggctcttacccagtggttatrtaatggcaagaaggtaccactgcctggctgggccgggggacaggaagatgaggtgaatggcaagccagccactcacctgcaagaagtcagtcatgccttg

SEQ ID NO: 62362 - DNA, 201 bp, Homo sapiens
tggctgcataagaagctgccccacaaggccgctcaccatctgggccaacgaggcattggtacccagaccggcgccctgctggatagagagcaagggagaayttcagacctgcccttccatgcaccaccacaggagtctctccctagactgttacgcactagaactccccgacccttgctcaccagtgtcccagagactggg

SEQ ID NO: 62363 - DNA, 201 bp, Homo sapiens
ggaggccaaggcatgagaactgcttgagcccaggagtctaggccacatagcaagaccccatctctaccagaaaaaaaaaaagacaattactagccaggagmtagtactgctagctactcaggaggctgaggtgggagaactgtttgagcccaggagttcaaggttacagtgagctttaactcactggattgcaccactgca

SEQ ID NO: 62364 - DNA, 201 bp, Homo sapiens
cactggtgatggacatttttaatgaggataggaaaacgaagatggctctggccttggccctctgttttctggcccatggttacagggtgctaaggtggctycataatgctttttctcagttcttcatatggtaaaacagtatttcatctggaggcgattttttccaggagccaatacaggagcaagtttaggaaaagatgg

SEQ ID NO: 62365 - DNA, 201 bp, Homo sapiens
ccacatgaggcattttcgaccctctctccgtcttgttctccagttgcccctcgccatggcctgcagagtctcgggaaagttgccattgcccggcgtatgcsacctccagccaaccttccaagcctgaaagccgagaacaaaggcaatgaccccaatgtctcactagtgccaaaagacggaacaggatgggcaagcaaacag

SEQ ID NO: 62366 - DNA, 201 bp, Homo sapiens
acaggagtaaagacacagatagctatgtccaaggctttaagctcaagagactcaagctatgccataaaaattagtaatttcactcaacagtctatcaaggmcctatctccattatgggttctgatttctaccctttaaaaacacagcatagacctgaccaatgtctatcagtaagacacacttgcttagggttcctgtgct

SEQ ID NO: 62367 - DNA, 201 bp, Homo sapiens
tcccaactttacactgggtcctttaaagggggtgtgggctctgggtgaacaccagttatcctcctacaaaggcgtgtctgtggttccctgtctttggacaygtaagaattggaggaaaataaatgtggatttgggaaactttgaggccagcttgcttcttgcaggctcatgatcaaccaatctcacataaaagtattgaat

SEQ ID NO: 62368 - DNA, 201 bp, Homo sapiens
tgactaaggaatggtactaaactttagctttttgtcttggagagagagcatgaaaaaatagacaacagcctacaaaggatgacaaaattaatttgtccttrtatttgtaaatggtagcaatgggcatgatttcagtcctgagtctccaccagttggagaagtcagggaggcatctcaggtgtgaataaccttcccattctg

SEQ ID NO: 62369 - DNA, 201 bp, Homo sapiens
tagaaggcagttgttttggtttattggactatcagtgatagtgttctatcatttgtatatctgaaggagggaaggttttgtctggaatcttaggttgtagyctaataccatttcttggcagagtactgtagctcacgcctataatcccaacacttagggaggcttggggtggaggatcgcttgagcctagggagtttgaga

SEQ ID NO: 62370 - DNA, 201 bp, Homo sapiens
cattaagttctatccatgtggaggacagaacaaaatcagcctcactcacaaaacatcagaaaacgttctactggaatacgaacaaagggatcaataaaaakaaaatctgaggccaggtgcggtggctcatgcctgtaataccagcactttgggaggccgaggagggcacatcacctgaggtaaggagttcgagaccagcct

SEQ ID NO: 62371 - DNA, 201 bp, Homo sapiens
cctccgcctcccaggttcaaacgattctcctgcctctgcctcccaagtagctgggattaagttgcctgccaccacacccggctaatttttgtttttttttkttttttttttttttgagacagagtctcgctctatcacccaggctggagtgcagtggtgcgacctcagctcactgcaagctccgtctcctgggttcacacc

SEQ ID NO: 62372 - DNA, 201 bp, Homo sapiens
actttttttttttttgagacggagtctcattctgtcacccaggctggagtgcagtggcgcaatctcggctcactgcaacctctgcctcctgggttcaagcrattttcctgcctcagcctccagagtagcgggactacaggcacacgccaacacacccagctaattttttgtgtgtttttagtagagatggggtttcacatg

SEQ ID NO: 62373 - DNA, 201 bp, Homo sapiens
tagaagctagtggacttaaggcattgctaggactctggcttcctaacagcttttctccccacaatttattttcagatcacagcccctatacctaccccccrgcccagcccctccctcagcactgctctctggggtagctctcaagggccagtttctggatttctccacaatgcaagctacagagctggggaagttgccggc

SEQ ID NO: 62374 - DNA, 201 bp, Homo sapiens
ccttttgaggatgtggctggcacagaagtgagtgagggtgggagggtgtgtctgagctgggacttttttgagcactggtcataccccccacctgctctggkttgagtctggagctgttctctcacttggctgtcccctttctgcagtttgtatgtgtgcatcagtcaggtattggggtgctttctaccctgacttaactag

SEQ ID NO: 62375 - DNA, 201 bp, Homo sapiens
ttttttttgagacagagtctcgctctatcacccaggctggagtgcagtggtgcgacctcagctcactgcaagctccgtctcctgggttcacaccattctcstgactcagcctcccgagtagctgggactacaggtgcccgccaccatgcccagctaattttttgtatttttagtagagacggggtttcatcatgttagcca

SEQ ID NO: 62376 - DNA, 201 bp, Homo sapiens
ccaatgcactttactgtgtgcccaatccaggagctgccccgggagcagcctctgccccctggccccattggcacagaacgatcacagcgtacagaccgagscacagagcctggccccattcggccatcccatcgacctggtcccccagtccagtttggcactagtgacaaggtctgtgtgggctggatctgggtatcctga

SEQ ID NO: 62377 - DNA, 201 bp, Homo sapiens
aaaaatcagctgggtatagtggcacacgcctataatcccagctactcaggaggctgagataggaaaatcgcttgaacccaagaggtggaagtttcagtgartcgagatcgcgccactgcactccagcctggaagacagggcgtgactccatctcaaaaaaaagaaaaaaaaagaaaatctggtgaccagaaaatcaagctc

SEQ ID NO: 62378 - DNA, 201 bp, Homo sapiens
gggttgatatatttctccctgtttcccgacaggtacgccaggatctgccatccccttcggatttttattctactcctctgcagcctggtggccaaagtggmtttctcccttcaggggctcctgcccagcaggtatattgtatcttcacacttccccttcatttgatttctctgtccagttgctggctttgattttccctgg

SEQ ID NO: 62379 - DNA, 201 bp, Homo sapiens
cacctggaatatgctcccaactcaaaatacaggttttttatttatatataaagtgctttcgcacaaaaaatacaaacatcaggctgggcgcggtggcccasgcctgtaattccagcactttgggaggccaaggcgggtggatcacaaggtcaggagttcgagaccagcctggccaatatggtgaaaccctgtctctactaa

SEQ ID NO: 62380 - DNA, 201 bp, Homo sapiens
gccattgcactccagcctgggtgacagagcaagactctgtctcaaaaaaaaatcctgtctcacaagaaatacataaataaaaatgaaaactatttcctatrggccaagactgaagaaagtactgttgttctaatggtttcatagaaagttaatgccaccaccataggctcatgagaggccatgaagtgctttaatgggtct

SEQ ID NO: 62381 - DNA, 201 bp, Homo sapiens
gcctcagttctggtaagctggaggggttatgggtgggaatatctccatccccagagaaggtcaagtgctggagggagcgggtggagaacctggcctagggrccctgctgctgggtgcgtttctgcagggagcaagggtagaagaattgggaggtggagtagagaggaaaagttagggtcagtggcagagccaggcagatgc

SEQ ID NO: 62382 - DNA, 201 bp, Homo sapiens
tggggagttacattctgatcttcactgcttaaagcagaagtatggtaggtatttaacagagtcaggcagcacaacttacctacctcttcctctgaacaggytgtcagaaagcagtgacactaattactatactttctttttctaaacctcattttcttcatctttaaaatgaaaggttcagagtcaatgaattcccagggc

SEQ ID NO: 62383 - DNA, 201 bp, Homo sapiens
tttgtccagttgtctccattgtcacgccaatttcccctagtccaagttttttctttgctgattcctttgtccatgtgtgctttgagcctctctcatcttgyctttcctcctttcctaggagcagctcctgaagcagcagcagcagcaccagtggcagcagcatcaacagggctctgcccctcctaccccagtgcccccatc

SEQ ID NO: 62384 - DNA, 201 bp, Homo sapiens
ccaaagaatcctgggggacaagggcagatgttagcaatggcctttaccacctggcctgcccacccacaaccagatcatcaacctcatcccaccttggcaayacccctaaaccaaggccatctacattcctctggctgccccttcctggagcaagccaaagcatcctttttgctcaccaagggccccatcagctccaggctc

SEQ ID NO: 62385 - DNA, 201 bp, Homo sapiens
gtgtgcatccctctggtaagggggcatgggaggagtgagaaacaggaaagtcccctcagtcttaggcattggatattagggtcttactgtgactctggtaygataggttttgcccatcatagtgatgagggaagggcatatgcttggcactgctgagatagctctgttgcaaaaatgggcttagttaagaaataagcagtg

SEQ ID NO: 62386 - DNA, 201 bp, Homo sapiens
ttctggtaagctggaggggttatgggtgggaatatctccatccccagagaaggtcaagtgctggagggagcgggtggagaacctggcctaggggccctgcygctgggtgcgtttctgcagggagcaagggtagaagaattgggaggtggagtagagaggaaaagttagggtcagtggcagagccaggcagatgctgaccct

SEQ ID NO: 62387 - DNA, 201 bp, Homo sapiens; identical to SEQ ID NO: 12170

SEQ ID NO: 62388 - DNA, 201 bp, Homo sapiens
gaaaaagtaagcaggttggagaaacgctggccaagtccctatgatcccagcaagcacacaaggccatccctcagaagctaacatttccccccccaagcacrctgtcaaatagcccggggtggcactgtcaagccttcccagatgccaaaggggaaaacaaatggtagcaccaggctgaccagttcatcgctgaagggatcc

SEQ ID NO: 62389 - DNA, 201 bp, Homo sapiens
gattctcttgtagggaatctgagtggataaccttgttatataagagcaggcaaggcccggacctactgggaacaagagatggaagagctgacttgaccgcraggggagatgctttttgggctggagggcttgtgacatgaataggattatttttctttttctttggtttcttcaggcctagttccccgagagcgttcagac

SEQ ID NO: 62390 - DNA, 201 bp, Homo sapiens
taccccccacctgctctgggttgagtctggagctgttctctcacttggctgtcccctttctgcagtttgtatgtgtgcatcagtcaggtattggggtgctytctaccctgacttaactagctccttctccactcctctcagatgagtcagtctgacagtggggtggacctgagtggggattctcaggtgtcatcaggtccc

SEQ ID NO: 62391 - DNA, 201 bp, Homo sapiens
tctactaaaaatacaaaaaagtagccggcgtggtggcgctcgcctgtagtcccagctactcgggagactgaggcaggagaaacgcttgaacccaggaggtkgaggttgtagtgagccgagattgtgccatcgcactccagcttaggcaacgagcgaaactccgtctcaaaaatgaatgaatgaatagcacaactccatctc

SEQ ID NO: 62392 - DNA, 201 bp, Homo sapiens
ctggggactgtagttggggtcttcctgcagtcgtttttgtatatcagaccggagctaaagagaaaaagtaagcaggttggagaaacgctggccaagtcccyatgatcccagcaagcacacaaggccatccctcagaagctaacatttccccccccaagcacactgtcaaatagcccggggtggcactgtcaagccttccca

SEQ ID NO: 62393 - DNA, 201 bp, Homo sapiens
ggccaggacgaggcgacaagaggagctggccctctcccaagaaccgaaggtgggtaggaacaaacaaatttattgtggtttaaaaattggaggagggggaraaagcctgagggaaagataagtttgggtggagtggagattgtggcctgaggggccatgggctctagaatgtcagtaggatttccatgtctggctaaggca

SEQ ID NO: 62394 - DNA, 201 bp, Homo sapiens
tctgccatccccttcggatttttattctactcctctgcagcctggtggccaaagtggctttctcccttcaggggctcctgcccagcaggtatattgtatcktcacacttccccttcatttgatttctctgtccagttgctggctttgattttccctggttttctgacattcctccctgcccccaacatgcacacccaaatt

SEQ ID NO: 62395 - DNA, 201 bp, Homo sapiens
cagctcatgatttttttcccctcagctgcatccagtggaactaaagccgttccaggattatcaaaaactgagcagcaaccttgggggacctggatcatcayggactcccccaactggaaggtgaaacggaatagggatgtggactttccaagtgcttccttactttggaaccagggtctggatcctaggcttgccttagac

SEQ ID NO: 62396 - DNA, 201 bp, Homo sapiens
acaggctgtcagaaagcagtgacactaattactatactttctttttctaaacctcattttcttcatctttaaaatgaaaggttcagagtcaatgaattccyagggccccttcccctaacatgtcactaggggctcttacccagtggttatgtaatggcaagaaggtaccactgcctggctgggccgggggacaggaagatg

SEQ ID NO: 62397 - DNA, 201 bp, Homo sapiens
tacttcacttaggattccccacccactaaagattccctccatctctcacttgggtgcatttgtttccggggcaggtgttgggcccgctggggctgggccakgagtgagctccgggttctgggctggggcacgctcctccacttcttctgcctccatgggctcccggggaggtgcttcactttcaactggttctgatgtttg

SEQ ID NO: 62398 - DNA, 201 bp, Homo sapiens
tttccaagtgcttccttactttggaaccagggtctggatcctaggcttgccttagacgcccttcttcccttaggtccttctctggcctcaattcccgtctsaaggccacgccttccacctacagtggagtcttccgcacccagcgcgtcgacctttaccagcaggtgaaggagaaacccttgtggccccaactctaaattc

SEQ ID NO: 62399 - DNA, 201 bp, Homo sapiens
tgagataggaaaatcgcttgaacccaagaggtggaagtttcagtgagtcgagatcgcgccactgcactccagcctggaagacagggcgtgactccatctcaaaaaaaagaaaaaaaaagaaaatctggtgaccagaaaatcaagctcatctctcaggctaaggggcctaaacgaggaaaagctaaaggtgtcttccagaac

SEQ ID NO: 62400 - DNA, 201 bp, Homo sapiens
gactgcccgcgtctactgccttcccacggtgttccagcagaacggcacaactaacccacagccaaacacacacacacacacacacacacacacacacacacacacacccaccaccccgcggctccgcccccgacttccccacggaccgtcacttccggtctcccccaaacctgccaccgacggccacttccgtttccccga

SEQ ID NO: 62401 - DNA, 201 bp, Homo sapiens
actgcccgcgtctactgccttcccacggtgttccagcagaacggcacaactaacccacagccaaacacacacacacacacacacacacacacacacacacmcacacccaccaccccgcggctccgcccccgacttccccacggaccgtcacttccggtctcccccaaacctgccaccgacggccacttccgtttccccgat

SEQ ID NO: 62402 - DNA, 201 bp, Homo sapiens
ccccccaggtccccaagctttacttttgtggggcacgacgagaaagtccgcagccccaaacagtgagtttctgagggcgagtcgggccggggccggcctakgtgggagggagccgagcaccccgaggagccgccaccgctgtcgcccgggggaccgtactacgcctgcgtgcgtcgcactacggatgcgtggacacttaag

SEQ ID NO: 62403 - DNA, 201 bp, Homo sapiens
caccccgaggagccgccaccgctgtcgcccgggggaccgtactacgcctgcgtgcgtcgcactacggatgcgtggacacttaagcatcgccccaccccctyccccctctggcggcgttcacgtctgtgcgcgcgcttgagcgctagaagattgaggtggctaccgtaaatgcctgaaaaacagtcaccagctgggactcta

SEQ ID NO: 62404 - DNA, 201 bp, Homo sapiens; identical to SEQ ID NO: 12180

SEQ ID NO: 62405 - DNA, 201 bp, Homo sapiens
tctaataccatttcttggcagagtactgtagctcacgcctataatcccaacacttagggaggcttggggtggaggatcgcttgagcctagggagtttgagmccagcctgggcaacaaagcaagaccctgtcggccaggcatggtggctcacacttgtaatcccagcactctgggaggccgaggcgggcagaacatgaggtc

SEQ ID NO: 62406 - DNA, 201 bp, Homo sapiens
cttccacctacagtggagtcttccgcacccagcgcgtcgacctttaccagcaggtgaaggagaaacccttgtggccccaactctaaattcgagttgccacytgatttcctgtccttccgtctcatcgctgacctctcactgtgactcactctttaacacatgcctgtcccctaggcctccccaccagatgccctgcgctgg

SEQ ID NO: 62407 - DNA, 201 bp, Homo sapiens
ggagatgctttttgggctggagggcttgtgacatgaataggattatttttctttttctttggtttcttcaggcctagttccccgagagcgttcagacagtsggggctcaagctcagagccatttgaccgtcatgcacctgctatgttacgggaacggggcactccaccggtggatccaaagttggcctgggtaggagatgt

SEQ ID NO: 62408 - DNA, 201 bp, Homo sapiens
aaaaagctgaaacctgaagacacaagacactacagcagccccattccaggaaagcaggaaccaagaaaatatggaaagaactggaaagtgccagtgagcaractaggaaaggagtttaaactctgagtggggaagaatgaaaactcacccacaaggactggctgcataagaagctgccccacaaggccgctcaccatctgg

SEQ ID NO: 62409 - DNA, 201 bp, Homo sapiens
cttatttccattctttctgtctgtctcttcaggagcgagactcctccagtacctcccccaccaccctatctggccagttatccaggctttcctgagaatgragcccctgggcccccaatctctcgctttcctctggaggaaccagggccccgtccactcccctggcccccaggcagtgatgaagtggccaagatacaaact

SEQ ID NO: 62410 - DNA, 201 bp, Homo sapiens
cgaacccggcgccatccgccgccatcctcccccgccccaccgccatcccgtcccggggagcccctaggcccgggtcccggatccccgcgcacccggccagktgagtctgggtgaaccgtgcgctgacgcccttttccggcgcgggagaggtggtggcggtggcggtggcggcggcggcggcggtggtgggccggggggagg

SEQ ID NO: 62411 - DNA, 201 bp, Homo sapiens
cgccatcctcccccgccccaccgccatcccgtcccggggagcccctaggcccgggtcccggatccccgcgcacccggccaggtgagtctgggtgaaccgtkcgctgacgcccttttccggcgcgggagaggtggtggcggtggcggtggcggcggcggcggcggtggtgggccggggggaggagaagctgccattagccgc

SEQ ID NO: 62412 - DNA, 201 bp, Homo sapiens
ccatcctcccccgccccaccgccatcccgtcccggggagcccctaggcccgggtcccggatccccgcgcacccggccaggtgagtctgggtgaaccgtgcsctgacgcccttttccggcgcgggagaggtggtggcggtggcggtggcggcggcggcggcggtggtgggccggggggaggagaagctgccattagccgccg

SEQ ID NO: 62413 - DNA, 201 bp, Homo sapiens
gaaaaccctccagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccac

SEQ ID NO: 62414 - DNA, 201 bp, Homo sapiens
tcaacaacgctatagtgtgtccactacagcagatggtttcacgcaccaagggggattccagctgtgtaagacagccttaacctcaaagaatgcaggcaggwcaaaaacacatgtccaaacaaggtactcaggcccatgacagatttcatgaagagcaaggaataccatgaaccaacattctccaccactataagctttgtc

SEQ ID NO: 62415 - DNA, 201 bp, Homo sapiens
ttcaccaacacctccaagctgtcaggctcctccacagcggtactggtactatcattaggctccatggccgacaggtctctaaagaagaacgaaggaaggarggcccgctgttgcccagaccagagtgtacccgaaagactccctagcattaatccctgccccaatacctaaaaagtttctcctgcacacacacacattcac

SEQ ID NO: 62416 - DNA, 201 bp, Homo sapiens
acaatggtgaaagactaattctaagaaagagagcaggccttcgtgaactcagaggagaattccgatcaggctcaggagataccatttggatttccttgccrtagggagagcagcagttcttctcagctgcctgtcctagcgtcatttacctataccgagagagcccctcctcgcccctcaatgctaacccttcaactaaga

SEQ ID NO: 62417 - DNA, 201 bp, Homo sapiens
aagccaccacgcccggcctcatatctcttaataagagtttttctagaaacatttctcaatcaccccaggcataatcatattttatttctctacttctttcttttttttttttttttgagatagagtttcgctcttgttgcccaggctggagtgcaatggcacgatcttggctcaccacaacctccgcctcccaggttcaag

SEQ ID NO: 62418 - DNA, 201 bp, Homo sapiens
atccgcccaccttggcctcccaaagtgctgggattacaggcgtgagccactgcacctggccctgttgcaatgtttttccagggagggaaagagttatctgyatttcagcctgttctgttttgggagtactggggctgaggagaaagggcagggccatcaaagggctcacattgttattgtagtccgtggtggcagcagcac

SEQ ID NO: 62419 - DNA, 201 bp, Homo sapiens
cagctggcctagggtagcccgggctggtgtcagggtaaggagaggaagggagggatgagggctgattaatttttttcaccccacaggaggaaaagctttcrgactgctgaaggcccagcaggaagagaggctggatgagatcaacaaggtagaaggaagaactaagggggcagagccagggggatggggcgtggatgggga

SEQ ID NO: 62420 - DNA, 201 bp, Homo sapiens
tcaggggcacaaggggtacgatacgaggacagtgcttacagcaaagattatcaccttctctgtaagggaggacaaaatcacttacaggtttagagagaaaytgttttgttgcaatgtgtgtttttttgttttgttttgttttttgagacagtctcgctctgtcacccaggctagagtgcagtagtgcaatctcggctcact

SEQ ID NO: 62421 - DNA, 201 bp, Homo sapiens
cctgagtctccaccagttggagaagtcagggaggcatctcaggtgtgaataaccttcccattctgtcccctcagttccgatgcctcaaccgctcagccgcyggaatcgcagccactgccggcttcacagacgcctgcctccaaccagccgaaacgacccccagcagcccccgaggtacctggagaactggaggggtgggga

SEQ ID NO: 62422 - DNA, 201 bp, Homo sapiens
ttgtggtagcaaaaggggaacctgcctttattgccctcctgccacactgcggtccctttcccgggcctgcctctctcagcatcccctctagctccttacamcctagcggggcccctcaactccccaaccccacttcctctgcctgcccctcctcctccttccacgttgtctcctccacctagcagttggttggcaacccct

SEQ ID NO: 62423 - DNA, 201 bp, Homo sapiens
gtgcatgaactcagggggcagggagggcagctggatgagggtggagcctggggggcgggtctgatgtaaccttgaacctggaccccttcaacccacccacwcagcccttccctttctctacccagagctcagcctgccctgatgccctcactcttacccagggtttggccatgaccagggggtcccagggggccagtggga

SEQ ID NO: 62424 - DNA, 201 bp, Homo sapiens
cagaccggcgccctgctggatagagagcaagggagaacttcagacctgcccttccatgcaccaccacaggagtctctccctagactgttacgcactagaamtccccgacccttgctcaccagtgtcccagagactgggggccctccaggatgggaaggccgagcctgtggaggagtgggccgggcaatcaccacccgggtt

SEQ ID NO: 62425 - DNA, 201 bp, Homo sapiens
tggggaagaatgaaaactcacccacaaggactggctgcataagaagctgccccacaaggccgctcaccatctgggccaacgaggcattggtacccagaccrgcgccctgctggatagagagcaagggagaacttcagacctgcccttccatgcaccaccacaggagtctctccctagactgttacgcactagaactccccg

SEQ ID NO: 62426 - DNA, 201 bp, Homo sapiens
gaaacggaatagggatgtggactttccaagtgcttccttactttggaaccagggtctggatcctaggcttgccttagacgcccttcttcccttaggtcctyctctggcctcaattcccgtctcaaggccacgccttccacctacagtggagtcttccgcacccagcgcgtcgacctttaccagcaggtgaaggagaaaccc

SEQ ID NO: 62427 - DNA, 201 bp, Homo sapiens
cactgcactccagtctgggtgacagagcaagactctgtaacttaaaaaaaaaagaaaaaagctggccgggcacgatggctcaagcctgtaatcccagcacyttgggaggccaaggtgggtggatcacaaggtcaagagttcgagaccatcctggccaacatggtgaaacccccttctctactaaaaacataaaaaattagc

SEQ ID NO: 62428 - DNA, 201 bp, Homo sapiens
caaggccacgccttccacctacagtggagtcttccgcacccagcgcgtcgacctttaccagcaggtgaaggagaaacccttgtggccccaactctaaattygagttgccacctgatttcctgtccttccgtctcatcgctgacctctcactgtgactcactctttaacacatgcctgtcccctaggcctccccaccagatg

SEQ ID NO: 62429 - DNA, 201 bp, Homo sapiens
ttctgagattatttttcttgtttttgaagaacatcctttagaattcccttaggtgagagtctgttagctataaatgctctcaattttcatctgaaaatgtrtcttttaaaccttatacttgaaagatagtcaaggttgacagttatttttttattagtactttgagatgttgttccatcgccttctggctttagttattgg

SEQ ID NO: 62430 - DNA, 201 bp, Homo sapiens
tagccagctgccgtcccatagctaccaagggccaaacgagagaaaagggatgaaagcctcaggttggaggataataacaacaacagctaccatataccgcrtcctaagcgttttacgaagatcacccacccgtgcactcttcttctgtttggctcatttatcatgcccagtgccaggttaaagatgaaacctagctgggct

SEQ ID NO: 62431 - DNA, 201 bp, Homo sapiens
aagagcttggtttgctgttgttgttaaggctgttggcatctgtgtttgcaaacactttctgttgatttttttttttaactatacttctagcaggtgacacrtgcacctggctgcaccacttgtagattccacctccatgtttccatcgtccctttccaccctgcctctggctctgtacagcatctcttcatccatcatcca

SEQ ID NO: 62432 - DNA, 201 bp, Homo sapiens
tccatcgtccctttccaccctgcctctggctctgtacagcatctcttcatccatcatccactcaacgagcattcaggatgcaaccgtgttttcctcagcayctctgacagtgccggaggacagaaagtaacctcaggtgtagctggtgttgacctgacactggtcactgggcacggccagggcggcattctggggagtgcc

SEQ ID NO: 62433 - DNA, 201 bp, Homo sapiens
caatgttttgtcattccttctgattctatcagatagtctgatgatgatgtgtctttttttttttttttttttgagacggagtcttgctctgtcgcccaggmtagagcgtagtagtggcgtgatctcagctcactgcaacctctgcctcctgggttcaagcgattctctgcctcagcctcccgagtagctggaactacaggc

SEQ ID NO: 62434 - DNA, 201 bp, Homo sapiens
tttaaaatttttatagatatgagggtagaagtgcagttttgttacacggatatattacgtagtggtgaagtctgggattgtagtgtacccagcactggagygttgtacattgtacccaataagtaattttcattcctcactcccctcccatcttcccaccttttggaatctctgatgtctgttactccattctgtatgtcc

SEQ ID NO: 62435 - DNA, 201 bp, Homo sapiens
agctaaataatgacagtgctgggacttaaatacagcctagcttcagagtctgagtgttaatcatggctcttccagtgtccctgtgccaccacagccacacrgctgggcattattaccagagccccagcctagaatctggagacaccggcctatctgcccaccaacagcacaggcaccggctgcattctgggatacggggtt

SEQ ID NO: 62436 - DNA, 201 bp, Homo sapiens
ttgtcattccttctgattctatcagatagtctgatgatgatgtgtctttttttttttttttttttgagacggagtcttgctctgtcgcccaggctagagcrtagtagtggcgtgatctcagctcactgcaacctctgcctcctgggttcaagcgattctctgcctcagcctcccgagtagctggaactacaggcacctgcc

SEQ ID NO: 62437 - DNA, 201 bp, Homo sapiens
aattgcatctctgcatggccccagggtggtttctttgcctgcatgctagagataaaaatccccaactcaccaaagtgtacaagttaatgtagatgatgcayctgaaaatagccgaacaaaatgcagtgctcagaaatgttagcttataaatgctctacagcaagaccaaagataatcccttgcctatgtgaatacaggact

SEQ ID NO: 62438 - DNA, 201 bp, Homo sapiens
gtgtgtcgggcactgttctgagcacactgcaggtactgactcatgtatgctctcaacagccccatgaagaaccagcatcatccccatcttatgactgaggraacaggctcaagaatgttcagtttttcccagggctatcagctgaacatggtgtggctgggccctggctgccactgcccctgccctcctcctttccatgtg

SEQ ID NO: 62439 - DNA, 201 bp, Homo sapiens
ttagtagagacagggtttcaccatattggccaggctggtctcgaactctggaccttgtgatccacccaccttggcctcccaaagtgctgggattacaggcrtgagccaccgtgcctggccgatgatgtgtcttttaacatctctaacatggctttatttttagtatgcttgtttttacaattaccttctattttaagcaag

SEQ ID NO: 62440 - DNA, 201 bp, Homo sapiens
ccgaacaaaatgcagtgctcagaaatgttagcttataaatgctctacagcaagaccaaagataatcccttgcctatgtgaatacaggactcggtggttaayatagtgctgtttgcacaatgagctccatcacccacatggtgacctcattttatagatgaggaaactgaggtttagcgaggctaagagacttgtcaggacc

SEQ ID NO: 62441 - DNA, 201 bp, Homo sapiens
cacaggaaagggtaaaagtttgctcttactctgttttgtgttgctataacaaagtaccacagagtgagtaatttaaaaccaaacagaaactttattgtctyatagttctgcaggcgtggaaagcccatagatctaggggccacatctgatgagggccttctctctgcatcataacacaatggaaggcgtcacatggccaga

SEQ ID NO: 62442 - DNA, 201 bp, Homo sapiens
aaatagaccaaaaacataaacacatttttaaaatagtatcatttcagagagggatatgtgcaccaagggaaatcaggcaaagtaaggggactgagagcggytgcactggagacacaggcagaacctcggaggggatatagacctgagtgatgagatgagctgggaatgctgagatcagggagaggacattcccgtcagggg

SEQ ID NO: 62443 - DNA, 201 bp, Homo sapiens
atctcagctcactgcaacctccacctcccaggctcaagcaattctcctgcctcagcctccggagtagctgggattacaggcatgtgccaccacacccgacyaatttttgtatttgtagtagagacagggtttcaccatgttggccaggctggtctcggactcctgacctcaggtaatccacatgccttggcctcccaaagt

SEQ ID NO: 62444 - DNA, 201 bp, Homo sapiens
tcttgggataggggatgggagaatgcttgacacaaaaataaagccctcgaggttatccgctttcaaccagctgccttggagctggcagctgctgctcactyattcattcagtcaatcaacaaacattgccttggacactgtgggggacacagggctgacccagccatgggccctgccctctagggttttctgatctaggag

SEQ ID NO: 62445 - DNA, 201 bp, Homo sapiens
ttagcaaaaagtgaaaagatcgtgaagacccagagctcatcccctctgtgaaaggggtgatgaggaggggagaggagatggcctcctagctctagcaggtwttttcttcttgactttgcagaaggactgaaaacaccgtgggcagggaataatttcctcactctgcgatttcagagcattaaacgcggcttctgtaaactc

SEQ ID NO: 62446 - DNA, 201 bp, Homo sapiens
ggggatgggagaatgcttgacacaaaaataaagccctcgaggttatccgctttcaaccagctgccttggagctggcagctgctgctcactcattcattcaktcaatcaacaaacattgccttggacactgtgggggacacagggctgacccagccatgggccctgccctctagggttttctgatctaggagaacacatttt

SEQ ID NO: 62447 - DNA, 201 bp, Homo sapiens
ggacaactgatttttgcttttggagcctccttttcctaatctgtaaaataagaatgctaacacctgcctcattgcattgttgaaagtaaatggaataggcyggatgcagtggctcatgcctgtaatcccggcactttgggaggctgaggcaggcagatcacctgaggtcaggagttcgagaccagcctgaccaacatggag

SEQ ID NO: 62448 - DNA, 201 bp, Homo sapiens
atacggacattttcttacataaccacagtgtacttatcaaaaccagataattaatgctgatacaattctattggataatcgacagaatttattcagatttkgccaatggttccaataatatcttctaagacaaaagaaattttgttcagtatgctgcatttaattctcgtctctctattctccttgaatctggaatgattt

SEQ ID NO: 62449 - DNA, 201 bp, Homo sapiens
tgagaaaattggaaaaaggaagcaaggaggaagataacataaaaagggaagcaggtcagctttacagagaatggaaaggcaagaagaagggtgagtgcccrttcctctttcttcctgaattggaattcttgtttccagaatcttctgtgacagtgaaaatagagaacaaggaatctcgggagctaatgctcctcatcccct

SEQ ID NO: 62450 - DNA, 201 bp, Homo sapiens
gaaaataagaagttaagggggaaaaaaggatttcagccctttctggtggctcacacctgtaattcagcacgttgggaggccgaagtccaagagttccagascagcataggcaacatagtgtgaccccccacgtttacaaaaaattaaaaagttagccggatgtgagattcatgcctgtagtcccagctactcgggaggctg

SEQ ID NO: 62451 - DNA, 201 bp, Homo sapiens
acacagccctgtgttcataaccggccagacactgggcctagggctttatagccattatttcccaaccctttaatcctcttggtagccaaatgggagaggtyttattataacccttacatcaagaaaggagctgaggctccgaggctgaagtcacagctagagattgctggccagaactgacaaccaaggctctgaattcca

SEQ ID NO: 62452 - DNA, 201 bp, Homo sapiens
caagatgggctacccaggttgggcacactggtggatgcctgtagtccccgcattttgggaggccgagggggatggatcgcttgagcccaggagtttgagamcagcctgggcaacatggtgaaaacctgtctctacaaaaaattcaaaaattagctgggcgtgatggtgcatgcctgtggtcccagctactcgggaggctga

SEQ ID NO: 62453 - DNA, 201 bp, Homo sapiens
ctgatttttgcttttggagcctccttttcctaatctgtaaaataagaatgctaacacctgcctcattgcattgttgaaagtaaatggaataggccggatgyagtggctcatgcctgtaatcccggcactttgggaggctgaggcaggcagatcacctgaggtcaggagttcgagaccagcctgaccaacatggagaaaccc

SEQ ID NO: 62454 - DNA, 201 bp, Homo sapiens
gaatcgcttgaatccgggaggtggaggttgcggtgagccgagatcaagccattgcactccagcctgggcaacaagagcgaaactctgtctcaaaaaaaaaraaagaaagaaagaaagaaagtaaatggaacaatatatgcaaatatgcaaatacctgtccttcatgaatgctagtttcttagtgtctgaaggcactttgca

SEQ ID NO: 62455 - DNA, 201 bp, Homo sapiens
cgcacccggccaccctctccttttataaacttaagtttatttgaacttagaaatctgtcactatcatgtatctcaaaccaatactacttaagtaaatagaatatatatatatataaacaaagaaaacactgaaaccaaaagtgtcattaaatagcctgccgtccaagcatgagctgtctctccattcattaagaagtgtta

SEQ ID NO: 62456 - DNA, 201 bp, Homo sapiens; identical to SEQ ID NO: 12363

SEQ ID NO: 62457 - DNA, 201 bp, Homo sapiens
gcacccggccaccctctccttttataaacttaagtttatttgaacttagaaatctgtcactatcatgtatctcaaaccaatactacttaagtaaatagaatatatatatatataaacaaagaaaacactgaaaccaaaagtgtcattaaatagcctgccgtccaagcatgagctgtctctccattcattaagaagtgttag

SEQ ID NO: 62458 - DNA, 201 bp, Homo sapiens
ggccacctgcattcaagcagcaaggggagactgaagggagggaggcctctgaggaggctgttggtctgtccaggtggggccagaaggttctggaccagccrgtgcctctctttgataagcaggagatgggggaggtgggggtgttaaaatgtagattctgattcagtaggtctgaggcagagctccagagtctgcgtttct

SEQ ID NO: 62459 - DNA, 201 bp, Homo sapiens
tacaaaggtttttcatatatgcttttattttaaaatttttttgtttttattttgttttattttattttactaaaattttatttagtaaaaatagtacagawtttagaaaatacaaaaacagaaaaatttaaaaatttatcaatagctaccttcaaagataactgttgttactagcctcttgtagaatcttccagacatttc

SEQ ID NO: 62460 - DNA, 201 bp, Homo sapiens
caggtggggccagaaggttctggaccagccagtgcctctctttgataagcaggagatgggggaggtgggggtgttaaaatgtagattctgattcagtaggyctgaggcagagctccagagtctgcgtttctaacaagatcccaggcaatgccgatgctgctgctccacagaccacacttatcacagcagggttggccagag

SEQ ID NO: 62461 - DNA, 201 bp, Homo sapiens
ccatagatcactgagtcctgatacttcctggacagaagtccattcccccactttcctgtgagctgctggagggcagaaggaaagagctggagagagctgayaccacctcaagcaggggtcagggtcggggcagcagggggagggtgatcttggcccagctgggtagcgggaatgccggcacacagccctgtgttcataacc

SEQ ID NO: 62462 - DNA, 201 bp, Homo sapiens
caaacgagagaaaagggatgaaagcctcaggttggaggataataacaacaacagctaccatataccgcgtcctaagcgttttacgaagatcacccacccgtgcactcttcttctgtttggctcatttatcatgcccagtgccaggttaaagatgaaacctagctgggctcagtgactttccctaggtcacacagccagtaa

SEQ ID NO: 62463 - DNA, 201 bp, Homo sapiens
ttggagtggggatccacgccatcctggaagggcaaagagtgaagcacaaagagagatccagggaccacaccccggcccttggtccatcagcccctccctcrgccaaggccctctgtacccacattcacgggtctccccatggccgcaacacccagcctcactctcacatctgcttcctgctgccagatccagctcccatcc

SEQ ID NO: 62464 - DNA, 201 bp, Homo sapiens
catggaaggtatcacgcaggtgaacatcatctgtcctgtgacataggggcaaaagaaaggtaaaaaggctgaatttctggccgggcgcggtggctcatgcytgtaatcccagcactttgggaggctgaggcagggggattgcttgagcttaggagtttgcgaccagcctgggcaacacggtgaaaccctgtctctagtaaa

SEQ ID NO: 62465 - DNA, 201 bp, Homo sapiens
catccactcaacgagcattcaggatgcaaccgtgttttcctcagcacctctgacagtgccggaggacagaaagtaacctcaggtgtagctggtgttgaccwgacactggtcactgggcacggccagggcggcattctggggagtgccttgtttccccaccaggcttgctctgacactgggctggccagcgggaggctcagc

SEQ ID NO: 62466 - DNA, 201 bp, Homo sapiens
agatccagctcccatcctggcccaaacttccccatttgcagacagagaggggagaggagaaaatgaagacggggagaggagaaaatgaagacagggagagrgttctctcccaggggaagcagactctgcccccagcaaagaggtctggatgatctcatctccctccccgttgctgtcactactagtcatctagccctgtgg

SEQ ID NO: 62467 - DNA, 201 bp, Homo sapiens
cattttgattatctgctgtgtgttctcccacacttatcttcatgttcctgcaatcataccagttcacagagggggttttttggccttgcttcacaaaaaaygtatcatattatattctcttctctgcatcttgcttttcctactcaacacagcttggaaatcctgccaacccatctgggtctatttcattctttataaagg

SEQ ID NO: 62468 - DNA, 201 bp, Homo sapiens
cctcttgagaattaaaggaaaatatggtaagtgcaaggttctgggagccatggccatcccagggggatgtgagccttggcagaaccccagcagcagtggcrtggtccagcaatgaccacccggccctggccctggggagatccccaaggtggaaaggattttcccagcatgcccagcagtcatggacgcaccagcggggag

SEQ ID NO: 62469 - DNA, 201 bp, Homo sapiens
aattagccaggcgtggtggcgcatgcctgtaatcccagctactcaggaggctgagacaggagaatcgcttgaatccgggaggtggaggttgcggtgagccragatcaagccattgcactccagcctgggcaacaagagcgaaactctgtctcaaaaaaaaaaaaagaaagaaagaaagaaagtaaatggaacaatatatgc

SEQ ID NO: 62470 - DNA, 201 bp, Homo sapiens
gtctagcctggcccaccagcttctgtcccacctccaggtgtttgctcgagctgtgccctctccctagaatgccttcttaactcttgctacttgttgagggygcctgaagagtagaaagagtgaatctggggaacaaattcaaatttggatttgaattctggctctatcaatgccaggctatgtgaccgtgggctaggaact

SEQ ID NO: 62471 - DNA, 201 bp, Homo sapiens
aaaggaaaatatggtaagtgcaaggttctgggagccatggccatcccagggggatgtgagccttggcagaaccccagcagcagtggcgtggtccagcaatraccacccggccctggccctggggagatccccaaggtggaaaggattttcccagcatgcccagcagtcatggacgcaccagcggggagaaccagactgtgc

SEQ ID NO: 62472 - DNA, 201 bp, Homo sapiens
gtatggaatgtagaatcaatagccagctgccgtcccatagctaccaagggccaaacgagagaaaagggatgaaagcctcaggttggaggataataacaacmacagctaccatataccgcgtcctaagcgttttacgaagatcacccacccgtgcactcttcttctgtttggctcatttatcatgcccagtgccaggttaaa

SEQ ID NO: 62473 - DNA, 201 bp, Homo sapiens
ggaatgaggagggtggtgtgtcgatgagaacagaacggaaccaggtagactgggagagggcaaaaaaatgacttgtagaatttctgcctcccctccctcarccctccccgtaatggtgaaccaccagcacctacccaccaccatcccggcagggagcaatagctatcaaccggtccccatcaccatccccaaagaaggtag

SEQ ID NO: 62474 - DNA, 201 bp, Homo sapiens
ttttacagaggcgagtaggaaacgttgtcttttacttccccttggatttggtgacagagaggaggggagatgaaacctgggcatgcatggaaggtatcacrcaggtgaacatcatctgtcctgtgacataggggcaaaagaaaggtaaaaaggctgaatttctggccgggcgcggtggctcatgcctgtaatcccagcact

SEQ ID NO: 62475 - DNA, 201 bp, Homo sapiens
gcccagcctacactcccacctgctctggagaggctgtgtttccttccaaggatggatgctgatgatgtctgatggcttctggatgtctgatctcaaggggrccttctcttagggggctttaggccaccctggaaaggtctcagcatcaccccttggagcggggaggattttcaccccttgcccacacacaagctaaaactg

SEQ ID NO: 62476 - DNA, 201 bp, Homo sapiens
tctttttctaaatcactcccactttcgagctttttctatatgtcaagtatttcataggctgtctcatttcagtctcacaatattttcctaagaatcatagytgaaaaattgggactggcacagaaagattaagtcacccattcatggtcacgaagccactttgtgtgtctggccccagtgcccactgcctttcctccctgt

SEQ ID NO: 62477 - DNA, 201 bp, Homo sapiens
cttctttcttgctgctgtgcagtccctaagatgttgccttcatctacatggtccagaatggctcacctccatgtccacattccaggcaagggcaagggaaygatgggatgctggagatggccacagattcccgctcacaacccagcacccagaacgaaaacccactagctgcaagagaggcagggaaacgaaggctctgtc

SEQ ID NO: 62478 - DNA, 201 bp, Homo sapiens
acatcagtgctggtgcaatgggtggtaggaatggagaccacacatggacagatagttatgagaaccatttcagaagtctgagatcgagtactagttgtccrtagtgtggccaaatcaatgaggcatccttttattgactttccttcttttcctatttctcttctctttgttcctcaacctgttccctcggatcgcattccc

SEQ ID NO: 62479 - DNA, 201 bp, Homo sapiens
actcctcaccaatttgttattgttttatggttctttagttttatctcattttttttttcttttttaatttttttttctttttttttttgagacagagtctygctctgtcgcccaggctggagtgcagtggtgcagtcttggctcgctgcaacctccacctcccagtttcaagtgattctcctgcctcagcctcctgcatag

SEQ ID NO: 62480 - DNA, 201 bp, Homo sapiens
tcctgggctaaaaggggcaggtggttcccatagaaggggttctggggaagtgaggaccaccatcagctgaagcagcccatcatcaaccccatggccagccscttcacaatcctccaaggttccctagtcactgtgacagcctctaggacagtaccctcagaggagcagaggggccttcaggggaagcatgcgcccactgga

SEQ ID NO: 62481 - DNA, 201 bp, Homo sapiens
tcagccatttttctctgcacaatatccataaggctatgatcatcctgaatatgttgtttttcatctgttttttccatctacgatacatatatgcacacatrttcatctttcacgtatttgcaggtatagtcattgattccacaagatcttgggcatttgccatgggccaggtattgggggtttttatggtaatctttcctt

SEQ ID NO: 62482 - DNA, 201 bp, Homo sapiens
atcatcaaccccatggccagccgcttcacaatcctccaaggttccctagtcactgtgacagcctctaggacagtaccctcagaggagcagaggggccttcrggggaagcatgcgcccactggaccagggcccctgaactcacaactctgcctttctttcacaaacgggtgcccctggagacaggagcaagtgaggagggtt

SEQ ID NO: 62483 - DNA, 201 bp, Homo sapiens
cccacatgtccccccaggaaaaaagccctgtgtatttatttggggacttttaatttttatttgatatagaacatttgaaaaaattagaacaacacaaggcmgaaaaaaaaaaaaaaaaaaggaaaacaggccaggcacagtggcttatgcctgtaatcccagcattttgggaggccaaggcaggcggatcacctgaggtca

SEQ ID NO: 62484 - DNA, 201 bp, Homo sapiens
gggctttatagccattatttcccaaccctttaatcctcttggtagccaaatgggagaggtcttattataacccttacatcaagaaaggagctgaggctccraggctgaagtcacagctagagattgctggccagaactgacaaccaaggctctgaattccagatccattcttggtctacccaccagctgcgtgtagcttgg

SEQ ID NO: 62485 - DNA, 201 bp, Homo sapiens
gcgctcccagggacaacagagggaggcagagggaagcccaggttcccaccctccattttgtaggctcctgcagcccgaacgccttctgcctgaaaatggcrgctgagagaggccaggaggcaggatgcagggctgaggaggaagctccggggctgggtctctggtccctgggagatgctgagagatagggagatggccctg

SEQ ID NO: 62486 - DNA, 201 bp, Homo sapiens
caagactctgtctcaaaaaaaaaaaaaaagaaaagggtcagtcattcatcctttatgatatatggatttatacctcttgcagaggaatttgagcttaatcmccttgcattatgaatgtattcaatcacctttatcggaaagagttcaatgacataaaaaccaatacaaaactcagccaaatattataaatatcctttgcac

SEQ ID NO: 62487 - DNA, 201 bp, Homo sapiens
tgcctcagttccctccaaggcaaaatggggataataatgtacccacttcacagagttatcatgagggttaaatgaggtaatacttgtaagtgttagaatartgcctcacatatagtaagtgctgtgttaagcgtttgctaaataaatgtttagttctccatattggaaatgaacgaaggcagcctagaaacttcagactgg

SEQ ID NO: 62488 - DNA, 201 bp, Homo sapiens
ttccgcccaccactttgccatgccctcgactctgttctctccccagttttcatgctgcccatccaggtccaggccccgccccctgaggactcagactctgrctcggactcagactatgagcactatgacttcagcgcccagcctcctgtggccctgaccaccttctacagtgagtgcctggccgggctcccgagggcccac

SEQ ID NO: 62489 - DNA, 201 bp, Homo sapiens
aggcagggaaacgaaggctctgtcctgggcagctgtgtccagataaaagccagaatggatattggggaacagacagccgtccctgccccgcctgctaaccyagggcttctgggggtgggacacggatgattccacttcttctggcctgtggaccagtgtttgggcgccacagggatgaagtgtctgtcgaacctgagattc

SEQ ID NO: 62490 - DNA, 201 bp, Homo sapiens
gtggctcagcaccataaaaaacactggggaggccgggcaccgtggctcacgcctgtaatctcagcattttgggaggccaaggcaggaggatcactttagcycagaagttcaagaccagcctggacaacatagtgagaccctgtctctaccgaaaaaaaaaattgaaaatcatccagtatggtggtgcacacctgtagtccc

SEQ ID NO: 62491 - DNA, 201 bp, Homo sapiens
gtacaagcctgttgtcccagctactcggaaggctgaggtaggaggatggtttgagcccgggagtttgaggctgcaatgaatgagccattattgtgccactkcactccagtctgggcgatgaaggagaccctgtctcaataaaaaagtagggggagggttgtcctggaatatttaaaattacatgcgtaacttgcatcatat

SEQ ID NO: 62492 - DNA, 201 bp, Homo sapiens
acacagtaggagggctgatcccagctggcccctgtctctatgtctcccagggactcagacctgggacctgcaccttattgagccgacatgggccaggcctstgctgagactgggaaagctgagatgaatgacagccaggctctgacctgaaggagcaccagcctggcagggaagtcacaaacataagcaggtggcttcccc

SEQ ID NO: 62493 - DNA, 201 bp, Homo sapiens
tcaagtgatcgtcctgcctcagcctccgaaagtgctgggattataggcatgagccactgggcccagccctttctttttttaaaatgggaaataccttaacmgtattaaaactccaacaacatgaattcataccattaaaatcttgccccctccaccctgccccttcctccccacccggcccacccaaggtaaacacaattg

SEQ ID NO: 62494 - DNA, 201 bp, Homo sapiens
caagtgatcgtcctgcctcagcctccgaaagtgctgggattataggcatgagccactgggcccagccctttctttttttaaaatgggaaataccttaaccktattaaaactccaacaacatgaattcataccattaaaatcttgccccctccaccctgccccttcctccccacccggcccacccaaggtaaacacaattgt

SEQ ID NO: 62495 - DNA, 201 bp, Homo sapiens
caaggtttggctgtagctggtttggagactgtggtcaggactgagaaatttcgggattcaagagactaaggagtgggtttggcttggcccaggagcagggytggtccaaaatttagagtctcgtagaaccagagcctttcctgcccgtggtgccatgtttcagccaaagcctttatgcttgtaccacaacccacccctgtg

SEQ ID NO: 62496 - DNA, 201 bp, Homo sapiens
tgagggttaaggttccatataaagtgtctggcacaataggaagtgctcactaagtacccgtcagcattaaactttcccacgtgccacatggtgagggtggyggcctttcagttctaggtcctctcttccttctggtgggagagtcgggcttccctcagtaatgttgcttattccaatttgttgggtgaaggtcagaagaga

SEQ ID NO: 62497 - DNA, 201 bp, Homo sapiens
aaagcatgtctcaatttggacactcaagtttcaccagaaacattcaatctgtatttagatttcatactagttacaattgaaaaaggagaatcacatatctmacttactctggccatttgaaaaggttttccaatgattgaattgattatgcctttaaaattaaatggaaaacattttgtaaattaaatagaaatgaattga

SEQ ID NO: 62498 - DNA, 201 bp, Homo sapiens
tgaagtgaatattaagttatttttaaaatttttatagatatgagggtagaagtgcagttttgttacacggatatattacgtagtggtgaagtctgggattrtagtgtacccagcactggagtgttgtacattgtacccaataagtaattttcattcctcactcccctcccatcttcccaccttttggaatctctgatgtct

SEQ ID NO: 62499 - DNA, 201 bp, Homo sapiens
cgagtctgtgaaacatgggctgcctggggtgtatcatgtcaatccagccccagcaacactcacatcatgctgtcttgcctctacttaccctgtgccctgtmaagagcacccttcccgccaccctacacctgagctacctgctgaaacctaccaacgcttctgtttgtcctattctccctttcatttctttcttttcgtttc

SEQ ID NO: 62500 - DNA, 201 bp, Homo sapiens
gctccagtggatggaaaagggaatctagaaccatctagttccaaagcatggactttagtctccaggcagtatggtacttgagatagttttatttaggatargttcccagatgtggaattactggattgaaagagcttggtttgctgttgttgttaaggctgttggcatctgtgtttgcaaacactttctgttgattttttt

SEQ ID NO: 62501 - DNA, 201 bp, Homo sapiens
tgtttctgagttattaaagcgaatatcaagttctcttaaatattctaatgtttacagatattgtcaaattctcttaaattttctacttcaaaattgaacckaagtcaattacctgctcacattcatgaggaactcaatggccaaatgtttttaaatatcacaaatataggactttatgcaactcacggagcttgacccaac

SEQ ID NO: 62502 - DNA, 201 bp, Homo sapiens
agtgattctcctgcctcagcctcctgcatagctgggactacagatgcgagccaccacgcctggctaatttttgtatttttagtagagatggggtttagccrttttggccaagctgttctcaaactcatgacctcaagtgatccaaccacctcagcctcccaaagtgctgggattacaggcatgagccaccatgtccagcct

SEQ ID NO: 62503 - DNA, 201 bp, Homo sapiens
caaccgtgttttcctcagcacctctgacagtgccggaggacagaaagtaacctcaggtgtagctggtgttgacctgacactggtcactgggcacggccagrgcggcattctggggagtgccttgtttccccaccaggcttgctctgacactgggctggccagcgggaggctcagctttccctcgatgtctatgcctccttt

SEQ ID NO: 62504 - DNA, 201 bp, Homo sapiens
gaactcccccatttcctatttcttgccaactcttaagaaggaaccgttcaccttccagagaggcgggaccactgatggtggtactttcaacgccaaagctraggcttggggtccagcaggcgtaggccaatcacaggagagcaccgcccgaaacaggactcagggaagccagggagagttctggacaaccaggcgctgatg

SEQ ID NO: 62505 - DNA, 201 bp, Homo sapiens
tttcattctttataaaggctgcataagatgccatgctgtaaatggaccgtaattgattcagccgtttcccctgtgaatgggcattcactctgtttctaacwttttgccattcaaaaatctgcagtggactgggtgcggtggctcacacctgtatgcccagcagtttgggaggctgaggcaggcagatcacttgaggtcagg

SEQ ID NO: 62506 - DNA, 201 bp, Homo sapiens
tcttcatagccttcatcctcttgagaattaaaggaaaatatggtaagtgcaaggttctgggagccatggccatcccagggggatgtgagccttggcagaaycccagcagcagtggcgtggtccagcaatgaccacccggccctggccctggggagatccccaaggtggaaaggattttcccagcatgcccagcagtcatgg

SEQ ID NO: 62507 - DNA, 201 bp, Homo sapiens
tctgaaatcctaacttgtgggcatctgaattcttgcgctgaacattctaatacatcagccacagagtttatgctctgaatttggagtcatttctcctccargggctcaggctgggcagacagccagggagttagcgaggacggcaattagagggctgaagactttctgcctgatgatgaagaggcccacacggtttcctgg

SEQ ID NO: 62508 - DNA, 201 bp, Homo sapiens
caccattttggcaaggctggtcttgaattcctgacctcaggtgatccacccgcccgcctcagcctcccaaagtgctgggattacaggtgtgagccactgtrcctggcctaggctccatattttcatattcattcagtacctgctgagtaccaggccctgtgctggcactgccataggacatgaaggtttgcccttgaacag

SEQ ID NO: 62509 - DNA, 201 bp, Homo sapiens
cgagggacctcacagggggggccagaggaataagtgtcacatcttcgctctcctcacttctgcctagctctgctaaggctccccattggctgaatctgacmgaagccataaggcccaggaagacaggggttaatccaaacagatcagcctcccagggcagaatggatagtagctctggtggaataaatggaccctatctgg

SEQ ID NO: 62510 - DNA, 201 bp, Homo sapiens
ggtagggtttgggccggggacccctccccactcaagactcctgcaggaaaggtccgcccttcccccagggacttttcacctcacccaccatcagctgggcygtcatggaactttatggagcctgagctctcctccttcaggctgagtggccatgcccagccttcgtttccccggctgtaaagcagggccaacgggagctca

SEQ ID NO: 62511 - DNA, 201 bp, Homo sapiens
tgcttggagaaatgccaggctccttagggtgttaggagagacctgtggccacagctgctgctccgactgggaccgggcaggcgctcccagggacaacagasggaggcagagggaagcccaggttcccaccctccattttgtaggctcctgcagcccgaacgccttctgcctgaaaatggcggctgagagaggccaggaggc

SEQ ID NO: 62512 - DNA, 201 bp, Homo sapiens
tgttcacctctttcaggaggggtgcctgggagcaggcgggcgcggggagacagagctgaggaagccccccaggcctggaggaggcccgttccccactccayttggtgtgctctcgttttgcctccctccctccttcaaccaaactaaaggatgcacagttgccaaatggattcagctccttggagaaatatgttgctttgc

SEQ ID NO: 62513 - DNA, 201 bp, Homo sapiens
acaggttgctttgataagaagtgagctccctgtcagtggaggcattcaagcagaagcagctggttggctccttgggggagactgtggtagcagaggggctyccaacattcaatcgtccaccgtgtcgtgcagtgtgccattgtggagaccatagccctgaaccagacagacgaggctattccctcagtgctgatgttctag

SEQ ID NO: 62514 - DNA, 201 bp, Homo sapiens
ttgctttgccgggatgggattctagaagtatgacaatgtctgagctggaagaaaccccagcgagctgccagccatctcctgtttgtcagaggaggaaagcraggtgcgaagtggggaacgacatgccccagggtcttggagcagggctgagaagcccagtctttccagggcctcttcccacgctgcccagcagggcatggc

SEQ ID NO: 62515 - DNA, 201 bp, Homo sapiens
tgtccctgatgggagcacaaccctagttctgggtcacttgtctgtcccattcagtttctaacccaaggcctggcacacagtaggtgctcagtaacatgcaytgagtgactgggcggtgctttctgacagcttcccggagtttgcacaatctgtccactcccgaagtccctgcaagtgttcagacagtcactataggtaagt

SEQ ID NO: 62516 - DNA, 201 bp, Homo sapiens
tgatacaattctattggataatcgacagaatttattcagattttgccaatggttccaataatatcttctaagacaaaagaaattttgttcagtatgctgcrtttaattctcgtctctctattctccttgaatctggaatgatttctcagattttctttctctttcatgtcattgatctttttgaagcatagagcagttatt

SEQ ID NO: 62517 - DNA, 201 bp, Homo sapiens
tgggcaagttcccaaagctctctgaggtaaaatgggtgtggccatgtcactcttcagcttttgcgctctaggtagatgctaaagccttccctgaagatctstatggaacttttagtcacctgcatctgtgggggctgcctcagccctaaccatgtcaacatagtgttgaaattcagttccgagaaacacttgtgggtttgt

SEQ ID NO: 62518 - DNA, 201 bp, Homo sapiens
tggaaagctgagacccctagccaggcagggcgttgtcaaagttcacgcacagagtcagtggcagagcctgggcaaccctctgcccaggccccaccggtctyagctctctggtctgacacttccaggggagcggcttccggtccgtctgacaaacgggagcagcagctgcagcgggacggtggaggtgcggctcgaggcgtc

SEQ ID NO: 62519 - DNA, 201 bp, Homo sapiens
ggtggggtaggggagggaggtaagtttccttagccacgtgtccctgatgggagcacaaccctagttctgggtcacttgtctgtcccattcagtttctaacycaaggcctggcacacagtaggtgctcagtaacatgcattgagtgactgggcggtgctttctgacagcttcccggagtttgcacaatctgtccactcccga

SEQ ID NO: 62520 - DNA, 201 bp, Homo sapiens
gtgtcacaggctcttcaagtccaagtcccctcaaaggttgaacacatttatcccctcccaattgaattatattatttgtatgagccagcgcatgcgtcttyttttttttctttttctttctttctttttttttttgaaatgaagtcttgctctgtcacccagcctagaatgcagtgctgcaatctcagcacactgcaacct

SEQ ID NO: 62521 - DNA, 201 bp, Homo sapiens
ttccaacccgggggagtggtgtggttacgaatgtggcctctgcaagcagacagcctgggttcaattcccagcttggccattttctagccgtgtaatcttargcaagatactaaaccgctctgtgcctcagtttccccatctcgtggtcttgctttgacaattaaatcatactgaataaatgtcagccattactgctgagct

SEQ ID NO: 62522 - DNA, 201 bp, Homo sapiens
cccttctccagactcagagcatggtaagttatccagcatagctcttcccggagcactttattccagcccaccttcccagtgttggccaaggtgtcatccasctgacaatttacttaacgtaatttccctcctttttctttctttcttttctttttttttagatggagtctcgctctgtcgcccaggctagaatgcagtggt

SEQ ID NO: 62523 - DNA, 201 bp, Homo sapiens
ccttgcagccagagagccaagtgctttcattttgtgatggaggagacccaggaagacccagtcaggagggggcatcgagctggtttggaggactgggtacwtgtcgcgagactctgggcagggagtgctctcctctctgccttgatctccaggcatgtgttccgagcctgtggcctcatactggttcagggaaagccattc

SEQ ID NO: 62524 - DNA, 201 bp, Homo sapiens
tgagctgaaacagactgtccgagagtggccccctttcctcttccccatgaagcccagccacaggctcaggagtaaagtcgggtccaaaagattttccccarcccagggcttcagaccagctccttctcagcttcccagaaggaatgagggccaggggctgagctaggcattggtgcccttggcgtccgagccttggcagct

SEQ ID NO: 62525 - DNA, 201 bp, Homo sapiens
aattgagatgtgtaaagtgtaaaatatgcaacaggttttgaagatgagtttcaagaaagaatgtaaaatatttcaacaaattttatgtgatttatatgtcraacttataatatttttgatatgatgggctaaatgaattctattatcacaattaagtttacatattcctttttactttttaaaaatggggtttctggtctg

SEQ ID NO: 62526 - DNA, 201 bp, Homo sapiens
ttttttttttttttgacggagtctcactcttgttgcccaggttggagtgcagtgttgtgatctcggctcactgcaacctccacctcccaggttcaagcgaktctcgtgcctcagcctcccgagtagctgggactacagtcccgcaccaccacgctagtttttgtatttttagtagagacggggtttcaccatgttggtcag

SEQ ID NO: 62527 - DNA, 201 bp, Homo sapiens
tgatccagagaaaggacaaagggggtgggcatggtgtcccctgacaagactgagcctggggacgctgactgctctgcagcctggggttacgtcctacacaygagacccccatttcaggggctccccagtaccctgagaagtccctggattttcccagtgagccctgaggttggggggcacccgagttcacctcccttgatt

SEQ ID NO: 62528 - DNA, 201 bp, Homo sapiens
atctaggaacagccctgagggacctctgaggtcctagggaccctggaagtcttcttagcaacagatggggtcaagtgtggctgcctccctcatcatggcaygccctcatggggtttgcctgggggttgccctgcaccttggggccagcaggaaggcaaaattaaagaggcaccatgagccaggggagagcttgctgggcag

SEQ ID NO: 62529 - DNA, 201 bp, Homo sapiens
gagtgagaccctgtcccagaaaagaaagaaaaaaaaagggggctacttggtgctcccctgctactctgcctctcacctctgctgttcatactctaccatcyctccctacgcctttccgcccaccactttgccatgccctcgactctgttctctccccagttttcatgctgcccatccaggtccaggccccgccccctgagg

SEQ ID NO: 62530 - DNA, 201 bp, Homo sapiens
agtcttcttagcaacagatggggtcaagtgtggctgcctccctcatcatggcacgccctcatggggtttgcctgggggttgccctgcaccttggggccagsaggaaggcaaaattaaagaggcaccatgagccaggggagagcttgctgggcagcaggctccatattttgttttgttttcttttttttttttttctttttg

SEQ ID NO: 62531 - DNA, 201 bp, Homo sapiens
cctgtcccagaaaagaaagaaaaaaaaagggggctacttggtgctcccctgctactctgcctctcacctctgctgttcatactctaccatctctccctacrcctttccgcccaccactttgccatgccctcgactctgttctctccccagttttcatgctgcccatccaggtccaggccccgccccctgaggactcagact

SEQ ID NO: 62532 - DNA, 201 bp, Homo sapiens
gcctccctcatcatggcacgccctcatggggtttgcctgggggttgccctgcaccttggggccagcaggaaggcaaaattaaagaggcaccatgagccagrggagagcttgctgggcagcaggctccatattttgttttgttttcttttttttttttttctttttgagacggagtctcagtctgttacccaagctggagtg

SEQ ID NO: 62533 - DNA, 201 bp, Homo sapiens
ccgaagcttacctgtgggactgcccggggctgccaggacagcactactgcggccacaaagaggacgcgggcgcggtgtgctcaggtcagtgggcggagtcrctgaagcccggtcactaccaacactcaccataggcctactgggcgccaagcctggagttagtgccggagaggtggtccctgcccttgagatgtcacagtt

SEQ ID NO: 62534 - DNA, 201 bp, Homo sapiens
catgatctcaccactgcactccagcctggacaacggagcaagaccttgtctcaaaaaagaaaaaaaaaagtatttcagaaagaaggacccatttgaaggcmgggtgcagtggctcacgcctgtaatcccaacactttgggaggtcaagtagggcggatcacttgaggtcaggagtccgagaccagcctggccaatatggcg

SEQ ID NO: 62535 - DNA, 201 bp, Homo sapiens
tgcccccaacaatgctgacattgccgagaagagacaccctgacctgccagccacatgagctcttcaattcttccctgggaatgagtatggctttagctggygtggccacactgtctgcccaggtgctctctgcaggctcattggagcagggtgactgggtagtcagtatgaaagctcactgtattagtacttcaagctagc

SEQ ID NO: 62536 - DNA, 201 bp, Homo sapiens
cctcagtagctagaattacaagcatgtgtccagctaatttacttatttatttattcatatatatctatatatatgtatatatatatgtatatatatctatrgagagagacaaaggatctcactctgttgcccaggctggagtgcagtggcaccatcttggctcactgcagcctcaaactcctcggcccaagtgatccaacc

SEQ ID NO: 62537 - DNA, 201 bp, Homo sapiens
ggcaagaagtcacccctgagtggggctgcagaggtgggagaccctgaatcccagaccccactcccgtcctcatggaggggatgtctggtgggaaggagggrggactcaggcacagctcttctgatggtctgttcactgccagaggtggctcagagtcactgtctctgggaagtcagcgttggtcttccctcacagagaatg

SEQ ID NO: 62538 - DNA, 201 bp, Homo sapiens
tgacaaagtaaactcagcccaaccgggtgtcacaggctcttcaagtccaagtcccctcaaaggttgaacacatttatcccctcccaattgaattatattayttgtatgagccagcgcatgcgtctttttttttttctttttctttctttctttttttttttgaaatgaagtcttgctctgtcacccagcctagaatgcagt

SEQ ID NO: 62539 - DNA, 201 bp, Homo sapiens
acccagcctagaatgcagtgctgcaatctcagcacactgcaacctccccctcccggattcaagcgattctcctacctcagcctcctgagtagctgggactrcaggcatgcactaccacatccagctaatttttgtatttttagtagaggctggatttcgccatgttggccaggctgatctcgaactcccgaccttagctag

SEQ ID NO: 62540 - DNA, 201 bp, Homo sapiens
gggactacaggcatgcactaccacatccagctaatttttgtatttttagtagaggctggatttcgccatgttggccaggctgatctcgaactcccgacctyagctagtccacccacctcagcctctcaaagtgctgggattacagatgtgagccaccaggcccagcccgcatctttctaattttaatggaattacaggcgt

SEQ ID NO: 62541 - DNA, 201 bp, Homo sapiens
ttggggcctcccctttccctatcagagcagtgggaagcatcacaacatccttcccttatccccctgcactctggaccccagatgcccgagataagtagctrctcccatcagtgtgggttgggagtagaaaactaggagtccatctggctgcttcccaaacctgcaaaccaggaatcccagtccagcttcccggccactggg

SEQ ID NO: 62542 - DNA, 201 bp, Homo sapiens
ctgggcaaggggcaggtgagtgtttccggacagctccctgaaccagtcctgctccacttgaatacctggagtctgagccagggcctcgggaggcgggcccrccagggttcacgtagcatttgtcatcactgctcgggacaaaaggccagtcttcatacacaagatgcacggtggtctgcaggttagcagggagcacgcctc

SEQ ID NO: 62543 - DNA, 201 bp, Homo sapiens
acaccacacacttaaaagcaatgagaaaattggaaaaaggaagcaaggaggaagataacataaaaagggaagcaggtcagctttacagagaatggaaaggyaagaagaagggtgagtgcccattcctctttcttcctgaattggaattcttgtttccagaatcttctgtgacagtgaaaatagagaacaaggaatctcggg

SEQ ID NO: 62544 - DNA, 201 bp, Homo sapiens
aaccccgtctctactaaaaatacaaaattagccaggcgtggtggcgcatgcctgtaatcccagctactcaggaggctgagacaggagaatcgcttgaatcygggaggtggaggttgcggtgagccgagatcaagccattgcactccagcctgggcaacaagagcgaaactctgtctcaaaaaaaaaaaaagaaagaaagaa

SEQ ID NO: 62545 - DNA, 201 bp, Homo sapiens
ttaaataataaatacccttacaaatgtagctaatcaaactcccttggttctgtgctattccatagggtagcccctacaatcacgcatttaaaatgtgatgrtagtccaaattgagatgtgtaaagtgtaaaatatgcaacaggttttgaagatgagtttcaagaaagaatgtaaaatatttcaacaaattttatgtgattt

SEQ ID NO: 62546 - DNA, 201 bp, Homo sapiens
ctgcaatagtcccaaaagcaagctgcctccatggaacccccaggtgttttcttcagagaggagttccttcctggagcagcccccaaacttggagctggccrgcacccagccagccttttcaggtaagctgtgcctcccccaaacccccatcccatagccagcctggctggaggaggcataaagctgggagccctgagtcag

SEQ ID NO: 62547 - DNA, 201 bp, Homo sapiens
attagccaagggtagcacgtgcctatagtcccagctcctcaggaggctgaggtgggaggatcgtgtgagcccaggagatccaggctgcagtgagctatgakcgtatcactgtgtatcatgcccctgcagggtcagagcaagaccctctttctacaagaaaacaaacacaagcacaacaagaatatgaagaggtggggaaaa

SEQ ID NO: 62548 - DNA, 201 bp, Homo sapiens
acctgtaatcccagctacccgcaaggctgagggaagagaatcgcttgaaaccgggaggcggaagttacagtgacccaagatcgcaccactgcacttcagcstatgcaacagagtgagactctgtttcaaaataattaattaattaattaaattgaaagaaagacccatttgagcagaaacctggaggtgggacagcctacg

SEQ ID NO: 62549 - DNA, 201 bp, Homo sapiens
gagctgggctgaggtctccgggaggtgccagcagatgccagggtggcggggggggggttctgtgcatggggctggggacagcagatgcccgggtggggggsggtctgtgcatggggctggggacagcagatgcccgagttggcgggggggggggtctgtgcatggggctggggaccagggtcatgtggggacacaggctgt

SEQ ID NO: 62550 - DNA, 201 bp, Homo sapiens
acccagtctctactaatatatataaattaggcgggcatggtggcacatgcctgtagtcccagctattcaggaggctgaggcaggagaattgcttgaactcrggaggcggaggttgcagtgagttgagatggcaccactgcactccagcctgggtgacagagcaagatagaaaggaaagaaagaaagagcaagaaggaagga

SEQ ID NO: 62551 - DNA, 201 bp, Homo sapiens
gctgggctgaggtctccgggaggtgccagcagatgccagggtggcggggggggggttctgtgcatggggctggggacagcagatgcccgggtggggggcgktctgtgcatggggctggggacagcagatgcccgagttggcgggggggggggtctgtgcatggggctggggaccagggtcatgtggggacacaggctgtaa

SEQ ID NO: 62552 - DNA, 201 bp, Homo sapiens
atcagcatggccaacatagtgaaaccccatctctactaaaaatataaataaaaaaattagccaggcatggtggcaggcgcctgtaaccccagctactcagkagctgcggcaggagaatcgcttgaatcaggagggtggaggtggcagtgaaccgagatcgcatcactgcactccagcctgggcaacagagggagagtgaga

SEQ ID NO: 62553 - DNA, 201 bp, Homo sapiens
caaactaaaggatgcacagttgccaaatggattcagctccttggagaaatatgttgctttgccgggatgggattctagaagtatgacaatgtctgagctgsaagaaaccccagcgagctgccagccatctcctgtttgtcagaggaggaaagcaaggtgcgaagtggggaacgacatgccccagggtcttggagcagggct

SEQ ID NO: 62554 - DNA, 201 bp, Homo sapiens
cagtgcatggcaggctggtactaatgaggccaaggtttgagctccctttccactgtgcctctggtggctgctgtcttgccccgcctcggatattggagtcygggtcagcacctctccaccttagggctagttctccctccatctttacaattttgccattcatttgttgagctactagtatgtgttaggcactttttttca

SEQ ID NO: 62555 - DNA, 201 bp, Homo sapiens
agtagctgggactacagtcccgcaccaccacgctagtttttgtatttttagtagagacggggtttcaccatgttggtcaggctggtctttaactcctgacmtcaagcgatcctcctgcctcagcttcccaaagtgctgggattacagacgcgagccactgcacctggcctgttttttcacttaacttttaatttcaggcta

SEQ ID NO: 62556 - DNA, 201 bp, Homo sapiens
ccactgtgcctctggtggctgctgtcttgccccgcctcggatattggagtctgggtcagcacctctccaccttagggctagttctccctccatctttacarttttgccattcatttgttgagctactagtatgtgttaggcactttttttcagccactgaggatacgggacaaagtcccggtcttcaagaagcttctattc

SEQ ID NO: 62557 - DNA, 201 bp, Homo sapiens
tttgtccttcccagtgaatcatatcaggaggcacatgggctctccatgtcccctctccggtggtctaacttgcttggctaaggtgttgtctgctagatttmtctgctgtaaagataatttcctcctttgtaattaacatgtatcttgtgggtagattctttgagaatatgtaaatatcttactcttcctcaaacctttgcc

SEQ ID NO: 62558 - DNA, 201 bp, Homo sapiens
gggcatctgaattcttgcgctgaacattctaatacatcagccacagagtttatgctctgaatttggagtcatttctcctccaggggctcaggctgggcagmcagccagggagttagcgaggacggcaattagagggctgaagactttctgcctgatgatgaagaggcccacacggtttcctggagagggctgtctgccagg

SEQ ID NO: 62559 - DNA, 201 bp, Homo sapiens
ggcagatcacttgagctcaggaatttgagaccagcctgggcaacatgggaaaaccccgtctctacaaaaaatatacaaaaattagccagcatcgtggcaarcgcctgtagtcctagctactcgggaaactgaggcacgagaatcgcttgaacccaggaggtggaggttgcagtgagccgagattgtgccactgcactccag

SEQ ID NO: 62560 - DNA, 201 bp, Homo sapiens
gaggcctggatggaaagacggttccaggtaatttctgcttttgttcctgtagcacagaagtcagagaacagagaagccaggttcccttcttgggatagggratgggagaatgcttgacacaaaaataaagccctcgaggttatccgctttcaaccagctgccttggagctggcagctgctgctcactcattcattcagtca

SEQ ID NO: 62561 - DNA, 201 bp, Homo sapiens
ttggctaaggtgttgtctgctagatttctctgctgtaaagataatttcctcctttgtaattaacatgtatcttgtgggtagattctttgagaatatgtaartatcttactcttcctcaaacctttgcccactagttgtaacattattgttgattcttgccggaatcagttattataaggatggttacctggtggtgatatt

SEQ ID NO: 62562 - DNA, 201 bp, Homo sapiens
ttctgcctgatgatgaagaggcccacacggtttcctggagagggctgtctgccagggtgtgcacgcgcacatgcacaagctcaggctcagggggtatgtcygtggaatctgctcaggtgaagctccaggaatgtgtagtggtcatgtccgagtcttcaggctctgtatcggtcaggccggactaggcaaggctgtagcaac

SEQ ID NO: 62563 - DNA, 201 bp, Homo sapiens
cctgggaggcggaggttgcagtgagccgagatcacgccactgcactccagcctgggcgacagagcaagactctgtctcaaaaaaaaaaaaaaagaaaaggktcagtcattcatcctttatgatatatggatttatacctcttgcagaggaatttgagcttaatcaccttgcattatgaatgtattcaatcacctttatcgg

SEQ ID NO: 62564 - DNA, 201 bp, Homo sapiens
ctagatttctctgctgtaaagataatttcctcctttgtaattaacatgtatcttgtgggtagattctttgagaatatgtaaatatcttactcttcctcaarcctttgcccactagttgtaacattattgttgattcttgccggaatcagttattataaggatggttacctggtggtgatattataattccaccattccttc

SEQ ID NO: 62565 - DNA, 201 bp, Homo sapiens
acagtcaaggagaggtcaccttgaataagcaatgtccttcacatgagggacacagcctacccgagggacctcacagggggggccagaggaataagtgtcayatcttcgctctcctcacttctgcctagctctgctaaggctccccattggctgaatctgacagaagccataaggcccaggaagacaggggttaatccaaac

SEQ ID NO: 62566 - DNA, 201 bp, Homo sapiens
cctcggatattggagtctgggtcagcacctctccaccttagggctagttctccctccatctttacaattttgccattcatttgttgagctactagtatgtrttaggcactttttttcagccactgaggatacgggacaaagtcccggtcttcaagaagcttctattctaatagggaaaatagaccaaaaacataaacacat

SEQ ID NO: 62567 - DNA, 201 bp, Homo sapiens
cacaccggaggacgacctcgagtcatttccagatctgagcgtttccttggatctggcctccagactccacccccacacttggttcctagtcccacccctgkgttcccaaagctaacccggtctctaaccccacttactgggcccgccgcttccctgtccccgcccgctctgggtctctcctcccctttcgccatatacata

SEQ ID NO: 62568 - DNA, 201 bp, Homo sapiens
tacacaggatttctcttcactattttggcaacttcttatgagtccatagtttgaaaataagaagttaagggggaaaaaaggatttcagccctttctggtgrctcacacctgtaattcagcacgttgggaggccgaagtccaagagttccagagcagcataggcaacatagtgtgaccccccacgtttacaaaaaattaaaa

SEQ ID NO: 62569 - DNA, 201 bp, Homo sapiens
aaggaaagagctggagagagctgataccacctcaagcaggggtcagggtcggggcagcagggggagggtgatcttggcccagctgggtagcgggaatgccrgcacacagccctgtgttcataaccggccagacactgggcctagggctttatagccattatttcccaaccctttaatcctcttggtagccaaatgggagag

SEQ ID NO: 62570 - DNA, 201 bp, Homo sapiens
aactcccagctgtgcctcttgctagctgtgccctgttgggcaactcggaacctctctgagcctcagacacctcaattataaaatgggggtgataagcatayagtactttctcctagcattgctgtgaggctccagtgaattaatttttgtaaagcacttagaacagagcctcaaagacagtaagaactgtccgaaagtctg

SEQ ID NO: 62571 - DNA, 201 bp, Homo sapiens
tctccaaaagtgcatcaagaccacaccctccttcccaaccaccattgcacctaaggttaagataaaactcaggatttaatccaagagagccaaattacacrgaccgggacaggcaatgggtcattcactccctcttccaatatgtactgattgagcagctactacattatcaattttttcttctgggccaccagaaatgag

SEQ ID NO: 62572 - DNA, 201 bp, Homo sapiens
cactgcaacctctgcctcccgggttcaagtgattctcctgcctcagcctcccaagtagctgggattacaggcatgcaccaccattgcctggctaatttttktatttttagtagagacggggtttcgccatgttagccaggctggtctcaaactcctggcctcaggtgatctgcccgtctcagcctcccagagtgctgggat

SEQ ID NO: 62573 - DNA, 201 bp, Homo sapiens
gggtctgggctggcgggaatttctgcccaaaggattctgacctgactctgtcccctgccccttccctgcagagcaccagtcctggcgcctgacagggggcrctgaccgctgcgaggggcaggtggaggtacacttccgaggggtctggaacacagtgtgtgacagtgagtggtacccatcggaggccaaggtgctctgcca

SEQ ID NO: 62574 - DNA, 201 bp, Homo sapiens
ctctgtattgttccagttttcgtatatgtaccgccgaagcttgcacccactcctttttttttttttttttttttttttgagactgagtttcgctcttgtcrctcaggctggagtgcaatggtgccatcttggctcactgcaacctctgcctcccgggttcaagtgattctcctgcctcagcctcccaagtagctgggatta

SEQ ID NO: 62575 - DNA, 201 bp, Homo sapiens
cctcacattatgtgtgtcctaccttggcctgtggtttggtcacttgtgtgtgtgtgaacttcatcctccttgagggcaggaatatggtttcctctctttcrcttccacagagtcctgtccagagttctgcacaccaagactgtgtaaatgaatggaattgcatctgggagctcgaggcacccatgcaaacctgtgctgcca

SEQ ID NO: 62576 - DNA, 201 bp, Homo sapiens
caaactcctggcctcaggtgatctgcccgtctcagcctcccagagtgctgggattacaggtataagccaccgcacccggccaccctctccttttataaacytaagtttatttgaacttagaaatctgtcactatcatgtatctcaaaccaatactacttaagtaaatagaatatatatatatataaacaaagaaaacactg

SEQ ID NO: 62577 - DNA, 201 bp, Homo sapiens
tgaggagggaggtgcctctcccatccttaagctcaggaactcccccatttcctatttcttgccaactcttaagaaggaaccgttcaccttccagagaggcrggaccactgatggtggtactttcaacgccaaagctgaggcttggggtccagcaggcgtaggccaatcacaggagagcaccgcccgaaacaggactcaggg

SEQ ID NO: 62578 - DNA, 201 bp, Homo sapiens; identical to SEQ ID NO: 12367

SEQ ID NO: 62579 - DNA, 201 bp, Homo sapiens
tgtcactatcatgtatctcaaaccaatactacttaagtaaatagaatatatatatatataaacaaagaaaacactgaaaccaaaagtgtcattaaatagcytgccgtccaagcatgagctgtctctccattcattaagaagtgttaggtggccaggcacagtggctgatgcctgtcatgccagcactttgggaggccaaga

SEQ ID NO: 62580 - DNA, 201 bp, Homo sapiens
gttcaccttccagagaggcgggaccactgatggtggtactttcaacgccaaagctgaggcttggggtccagcaggcgtaggccaatcacaggagagcacckcccgaaacaggactcagggaagccagggagagttctggacaaccaggcgctgatggcctcagcacaaccagctggggtagtctagggcataagcgagcat

SEQ ID NO: 62581 - DNA, 201 bp, Homo sapiens
caccgggaccaggtgaactgctcgggggccgaagcttacctgtgggactgcccggggctgccaggacagcactactgcggccacaaagaggacgcgggcgyggtgtgctcaggtcagtgggcggagtcgctgaagcccggtcactaccaacactcaccataggcctactgggcgccaagcctggagttagtgccggagagg

SEQ ID NO: 62582 - DNA, 201 bp, Homo sapiens
ctcaaaccaatactacttaagtaaatagaatatatatatatataaacaaagaaaacactgaaaccaaaagtgtcattaaatagcctgccgtccaagcatgmgctgtctctccattcattaagaagtgttaggtggccaggcacagtggctgatgcctgtcatgccagcactttgggaggccaagacaggcaggttgcttga

SEQ ID NO: 62583 - DNA, 201 bp, Homo sapiens
taggcctactgggcgccaagcctggagttagtgccggagaggtggtccctgcccttgagatgtcacagttcaggaggggagatgagactgagacaaacatrattcaggagagaaagtggcaaatgcccccaagaaaggcagtcaggtggagtctagaggcagcagaccatgcggagctgtaggctaaggctgaccacctcc

SEQ ID NO: 62584 - DNA, 201 bp, Homo sapiens
tatctcaggttatttggcaaaggcctggaaagaggtatctttccatcgatttcttacccctgagaactcctactcatcctctaaaacccttcccaattgtyccctgtttcttggagtcagttattccctcctaactctgttttttttccagagtacttagttccaagcccaaggatagcatttataactgatcgtaatcaa

SEQ ID NO: 62585 - DNA, 201 bp, Homo sapiens
gcctggagttagtgccggagaggtggtccctgcccttgagatgtcacagttcaggaggggagatgagactgagacaaacataattcaggagagaaagtggyaaatgcccccaagaaaggcagtcaggtggagtctagaggcagcagaccatgcggagctgtaggctaaggctgaccacctcccggaagaggtgacattaaa

SEQ ID NO: 62586 - DNA, 201 bp, Homo sapiens
gaatgaatgagtggcatctccctgaccaagggttaagatagatgggaactcagaaggactttgagccgcctcagaagcatcctgtaagtgacttgtgaagrggagtaggggacagccgtgtgggctgagagctgagagtgtgagatcagattagagagactggaagtctggctccgcctcttagtaactgtggccttgggc

SEQ ID NO: 62587 - DNA, 201 bp, Homo sapiens
gtggggatccacgccatcctggaagggcaaagagtgaagcacaaagagagatccagggaccacaccccggcccttggtccatcagcccctccctcggccamggccctctgtacccacattcacgggtctccccatggccgcaacacccagcctcactctcacatctgcttcctgctgccagatccagctcccatcctggcc

SEQ ID NO: 62588 - DNA, 201 bp, Homo sapiens
acacgctttctcttcctgaggttggagtggggatccacgccatcctggaagggcaaagagtgaagcacaaagagagatccagggaccacaccccggccctyggtccatcagcccctccctcggccaaggccctctgtacccacattcacgggtctccccatggccgcaacacccagcctcactctcacatctgcttcctgc

SEQ ID NO: 62589 - DNA, 201 bp, Homo sapiens
ccacacacaagctaaaactgcttctgctgcagctctgggagacctagaaccagggcccctcctgagagccagtgggtgggggcaggccccctggaaaatckctgagagctcagcagtttcagccttcactcccctcctcactcccctcctccagcctgcagaaacctagcccagcctttgcacagagggtcttgctctggg

SEQ ID NO: 62590 - DNA, 201 bp, Homo sapiens
gtcagtcattcatcctttatgatatatggatttatacctcttgcagaggaatttgagcttaatcaccttgcattatgaatgtattcaatcacctttatcgsaaagagttcaatgacataaaaaccaatacaaaactcagccaaatattataaatatcctttgcacagagagtccatatatatgaaaagagaatgtgaatac

SEQ ID NO: 62591 - DNA, 201 bp, Homo sapiens
tagtacagaatttagaaaatacaaaaacagaaaaatttaaaaatttatcaatagctaccttcaaagataactgttgttactagcctcttgtagaatcttcyagacatttcgttagagaggaatattgcaaacatacagaaatgcattgagaatgacatttgtttatttgtttatttgcttttgagatggtgtctcgcactg

SEQ ID NO: 62592 - DNA, 201 bp, Homo sapiens
actccagcctggacaacagagtgagaccctgtcccagaaaagaaagaaaaaaaaagggggctacttggtgctcccctgctactctgcctctcacctctgcygttcatactctaccatctctccctacgcctttccgcccaccactttgccatgccctcgactctgttctctccccagttttcatgctgcccatccaggtcc

SEQ ID NO: 62593 - DNA, 201 bp, Homo sapiens
tgcaatctcggctcactgcaacctttgcctcctgggttcaagtgattctcctgtctcagcctcccaagtagctgggactacaggcacacaccaccacaccyggctaatttttgtatttcagtagagatggggtttcaccatgttggtcacactggtcttgaactcctgatctcaagtgatccacttgcctcggccttccaa

SEQ ID NO: 62594 - DNA, 201 bp, Homo sapiens
caggcctttgacattcacctgaagatggctctctgtgtgagagcgggggagtgcggatgagagacacagttggcaggggttctcgcatgccatatccctcygtgtcccatcctgccctgtctgaccccatcagccccactcacttcctcacctccacgctcttgccagcttgtgcctcatagccagctcttttcattgcct

SEQ ID NO: 62595 - DNA, 201 bp, Homo sapiens
catcagccccactcacttcctcacctccacgctcttgccagcttgtgcctcatagccagctcttttcattgccttctggggataggaagaggaaagataaygctgaaggcagttccctggcaatgctgggaggttggaatagaccagagcgtcccacaccttattgtggaatcacttgggagcttgtcaaaaattcctgag

SEQ ID NO: 62596 - DNA, 201 bp, Homo sapiens
atatataatttatatataaatttatataaattggaccctattgttctgaaacttattatacttttctccttgttttcaaaatctaaccaagtggatagatrtgcatctagttcattcctgcaatggaataatccagcctatgatacaatacagtctgtttatttccagctgatggatggttagagtacttctaattttctt

SEQ ID NO: 62597 - DNA, 201 bp, Homo sapiens
agctgcaagagaggcagggaaacgaaggctctgtcctgggcagctgtgtccagataaaagccagaatggatattggggaacagacagccgtccctgccccrcctgctaacccagggcttctgggggtgggacacggatgattccacttcttctggcctgtggaccagtgtttgggcgccacagggatgaagtgtctgtcga

SEQ ID NO: 62598 - DNA, 201 bp, Homo sapiens
gcaggtgccggcgctggggcaggactgggaggagtctcactctgggggcgcctggttccccgtggctctaatacttgccgcatcaaatgcatacacccacmtttaggaccgaacccaatggaggaggaccgctcctcattccacatgttggggaaatgaagacaagcaaggatgcaggaagtggagggccaggagaggtgg

SEQ ID NO: 62599 - DNA, 201 bp, Homo sapiens
tggaggaggaccgctcctcattccacatgttggggaaatgaagacaagcaaggatgcaggaagtggagggccaggagaggtggacctgggatgggaccaaytgaggcagggccaggatttggaaccaaaccccttctggatttgaccacttccagggccctgcttggacaaccaaattatctattccttttctcattcaat

SEQ ID NO: 62600 - DNA, 201 bp, Homo sapiens
tctgcatggatgcgtgtgcatgcgtgtgtctggctccgtgactcttggggtgcagcctggatgggtgggctcccagcacaggcagctggggctctccccamcagcccctgtaacagcagcccagcttcctgcagaccaaaaccacaagcagaacaagcaggcgtgagacactcacaggttgggtttgatcgcatgcgtgtc

SEQ ID NO: 62601 - DNA, 201 bp, Homo sapiens
ccggccactgggcaaggggcaggtgagtgtttccggacagctccctgaaccagtcctgctccacttgaatacctggagtctgagccagggcctcgggaggygggcccaccagggttcacgtagcatttgtcatcactgctcgggacaaaaggccagtcttcatacacaagatgcacggtggtctgcaggttagcagggagc

SEQ ID NO: 62602 - DNA, 201 bp, Homo sapiens
tgccagtgtttctggcctgctgtgctctcttggagccaaatccctactcttatcccttgggattttactgagctgcttgcaaccctccatgggaccttctyattttaccacctggtagctggaaagaaggcacggtctggcacgggagcctgagccagccttggagccaggaccccaggagacttttcttttagaggaact

SEQ ID NO: 62603 - DNA, 201 bp, Homo sapiens
gcagaaaagaaggctaaggagctgtcagagtcatctttctgcctggtatggaatgtagaatcaatagccagctgccgtcccatagctaccaagggccaaaygagagaaaagggatgaaagcctcaggttggaggataataacaacaacagctaccatataccgcgtcctaagcgttttacgaagatcacccacccgtgcac

SEQ ID NO: 62604 - DNA, 201 bp, Homo sapiens
agttgtcctcccaccctattcagcctacccaggccccgggaaatccagcctcttctccaggctcctaaatgatgaggttgagccttcacccctccccaccrccgcctctgcttgcagattcccagcggcatcgggtcacagatgaggaggtccagcaaagcaggttccagatgccacccttggaggaaggtgagtcaggat

SEQ ID NO: 62605 - DNA, 201 bp, Homo sapiens
ctcctgctccctcgatcatcccgctcacactcatctccctcatatcatacctgccccagttcccagcatatgcaacaagttcagcagatgttcatggaacygaatgcaggctggcaacagactcatttctcagctttcaggagaacatggctcacgccctctcactttcttgggagaggagggggagtcccagcaattgaa

SEQ ID NO: 62606 - DNA, 201 bp, Homo sapiens
tcttccccatgaagcccagccacaggctcaggagtaaagtcgggtccaaaagattttccccaacccagggcttcagaccagctccttctcagcttcccagmaggaatgagggccaggggctgagctaggcattggtgcccttggcgtccgagccttggcagctggcccagcagccagccaggagaactggctttgaatggt

SEQ ID NO: 62607 - DNA, 201 bp, Homo sapiens
cctctgcttgcagattcccagcggcatcgggtcacagatgaggaggtccagcaaagcaggttccagatgccacccttggaggaaggtgagtcaggatgggraggggtgtgaatggcagtcccacctccagagagtagctcagctcagcttgagaccttccagcaggaacctccctcaatgagtctttcctgactttcacaa

SEQ ID NO: 62608 - DNA, 201 bp, Homo sapiens
aacagagtgagactcatcccctccccaacacccccgccaaaaaaaaaaaaaaaaaaaaaaagctgaatttctttgacctgagtgactgcagtcctctgggrctgggactctttgagccttaacttccatccgtctctgtcaattgagtaaattgttttatttgtgtccccaagccctgctgtggtataactggggagtgtg

SEQ ID NO: 62609 - DNA, 201 bp, Homo sapiens; identical to SEQ ID NO: 12361

SEQ ID NO: 62610 - DNA, 201 bp, Homo sapiens
ctgccccactccttgtccggcaggatgtactactcatgcaatggggaggagctcaccctctccaactgctcctggcggttcaacaactccaacctctgcarccagtcgctggcagccagggtcctctgctcaggtaccccatcctactccacccccccagatttgagccagaattctacctgaatccatgtcctaaaaact

SEQ ID NO: 62611 - DNA, 201 bp, Homo sapiens
cctcaaaggttgaacacatttatcccctcccaattgaattatattatttgtatgagccagcgcatgcgtctttttttttttctttttctttctttcttttyttttttgaaatgaagtcttgctctgtcacccagcctagaatgcagtgctgcaatctcagcacactgcaacctccccctcccggattcaagcgattctcct

SEQ ID NO: 62612 - DNA, 201 bp, Homo sapiens
actgcaatagtcccaaaagcaagctgcctccatggaacccccaggtgttttcttcagagaggagttccttcctggagcagcccccaaacttggagctggcyggcacccagccagccttttcaggtaagctgtgcctcccccaaacccccatcccatagccagcctggctggaggaggcataaagctgggagccctgagtca

SEQ ID NO: 62613 - DNA, 201 bp, Homo sapiens
ccagcaccctctcactcagagcttcctcccctaaattcattggccctcctcttccaattggccgatgcatcctcaggccctagacagtgctggagtgagcmccatatttgagagcaagtggggaaggggtgggggcagtgcgaggtgagactattaagtctcatcttttccctgctgtgaggtctgtgggatgacacatgc

SEQ ID NO: 62614 - DNA, 201 bp, Homo sapiens
ttggctgggcatggtggctcatgcctgtaatcccagcactttgggaggccaaagcaggtggatcacctgaggtcagaagttcaagaccagcctggccaacrtggtgaaaccccatctctactaaaagtataaaaaaagtagccaggcatggtggtgcgtgcctatagtcccagctactcagggcgctgaggcaggagaatc

SEQ ID NO: 62615 - DNA, 201 bp, Homo sapiens
cctgcgtttatacagatgagtgctttgtgtaccatgggcccacttccgtgatgataaatggacggtgtaggacagatttcccatctatattgacagcataytgaaaacagtatgctgtagtagttaaaagggtgatttctagagccagactgtccaggttcaaattttgctttgattactgaccagctgggtggccttggg

SEQ ID NO: 62616 - DNA, 201 bp, Homo sapiens
catggtgtggctgggccctggctgccactgcccctgccctcctcctttccatgtgaaggtacaatccacaccaaaggctcacttctgtgcctcccaatgcycagctggagccacacacagctcttcaggccccacaattaattggcatcctccagacatctgagagagcccaaggggaccaggtcaggagcacgctctggc

SEQ ID NO: 62617 - DNA, 201 bp, Homo sapiens
tgtcccctggaaacctcacctccgacgtacacctgtccatcccccacccctccctatcgccccatctgcggtttccacttccgcccctctcaaagaccctyttcatggttctggtgaacggacagagcggctggagcccgtgtggccacctggcgtggacctctcttggccgccgtccccggccccccgtcctcgcttcgt

SEQ ID NO: 62618 - DNA, 201 bp, Homo sapiens
atctcatcaatctgtcattatgcaagtgacaaaacggggccagaaagtgaaagaactcattcaaggtcatgtagcaagttaatgatagaaatcaactgtcrgctcctgacgcccaacccagtgaccctctccactgtgcccccaacaatgctgacattgccgagaagagacaccctgacctgccagccacatgagctcttc

SEQ ID NO: 62619 - DNA, 201 bp, Homo sapiens
cccctggaaacctcacctccgacgtacacctgtccatcccccacccctccctatcgccccatctgcggtttccacttccgcccctctcaaagaccctcttsatggttctggtgaacggacagagcggctggagcccgtgtggccacctggcgtggacctctcttggccgccgtccccggccccccgtcctcgcttcgtgag

SEQ ID NO: 62620 - DNA, 201 bp, Homo sapiens
cgtggccacactgtctgcccaggtgctctctgcaggctcattggagcagggtgactgggtagtcagtatgaaagctcactgtattagtacttcaagctagmccacatgtccccccaggaaaaaagccctgtgtatttatttggggacttttaatttttatttgatatagaacatttgaaaaaattagaacaacacaaggca

SEQ ID NO: 62621 - DNA, 201 bp, Homo sapiens
ccacttccgcccctctcaaagaccctcttcatggttctggtgaacggacagagcggctggagcccgtgtggccacctggcgtggacctctcttggccgccrtccccggccccccgtcctcgcttcgtgaggatgggatggagtctccagagtggggaggtgcaggggagccccagggaagggatgggttgaaagaagcttc

SEQ ID NO: 62622 - DNA, 201 bp, Homo sapiens
gcacaaggcaggaggattgcttgaggccaggaatttacgactagccccgggaacatagcaagaccagtctctacaaaactaaaaactaaatattagccaagggtagcacgtgcctatagtcccagctcctcaggaggctgaggtgggaggatcgtgtgagcccaggagatccaggctgcagtgagctatgatcgtatcact

SEQ ID NO: 62623 - DNA, 201 bp, Homo sapiens
gtgagcaggtctgggagtcaggccttgctcaggccctgttcttctcccttgcagcttctgtctggccccaaagagacccctgctgcccagagccccaccaraggcccctctgacaccaagagagcaggtgagggtcccagcaggggtagtcacaggcatctttcttcccctccccctgcctccctttccctgcctagaaaa

SEQ ID NO: 62624 - DNA, 201 bp, Homo sapiens
gaactggctgcagtgagtagcggggggtggaacatgcgggtgagaaggtgagtgtgagccctggctcagctcatgtgtgcaggcaggcgtgagcacaagtktatctgtggattgcatgtgctaatggcagtacgtccacacacgcttctggaaaaacagagatgtttgtgggcatggagcatgtactgattgtggcgtcgc

SEQ ID NO: 62625 - DNA, 201 bp, Homo sapiens
agctaggggccagcgagatggcggacgaggccttagctgggctggatgagggagcccttcggaagctggtaagtggccccatcacccactgtggggacagraaagccaagccagagaggcagggtcaatccagggtacctctcagctgacaggaagaagtgatgggggaaaggtcaggaggagggggacatgggaacaggg

SEQ ID NO: 62626 - DNA, 201 bp, Homo sapiens
ttgaacccgggaggcagaggttgcagtgagctgagatcacatcactgcactgcagcctgggcaatgagtgagaccctatctcaaaaaaaaaattaattaarttaaatttaaaaatgtaaataaataagtaaataaataaataaaagctgtgggttcaaatcctgctcaacaaccaatagctgtgtgcctggcctacatatc

SEQ ID NO: 62627 - DNA, 201 bp, Homo sapiens
aaatggcggtaaaaacaagcaccattactgagttggttatgtacaagcctctgctaagcaccttacctgcattatcttatttaattgtcatcacaataaayaagtattattattgtcctcctgaaacaaagtacatgagaacggtgtctctcatccatgctgccgtaatttctaacccaagccgctgctcatgcagtccca

SEQ ID NO: 62628 - DNA, 201 bp, Homo sapiens
gagccatccaccccgctgtctacaggtcttcatgcctccagtgaggcttactggatctgctgagggggaagggcctatatacctgggttcaaatcccttcsctaccaccaacatgcagtgtcaacttggacaaatgacttcccctctctgagcctcagtttctttgcccataaaagggacagaacattagcatctgcttta

SEQ ID NO: 62629 - DNA, 201 bp, Homo sapiens
acccaagccgctgctcatgcagtcccatctacctggagtgtatctcttttttttttgagacggagtcttgctctgtctccagctggagtgcagtggtgcartctttgctcactgcagcctctgcctcccgggttccagagattctcctgcctcaacctcccgagtagctgggattacaggcaagtgccaccacacctggct

SEQ ID NO: 62630 - DNA, 201 bp, Homo sapiens
tgggttcaaatcccttcgctaccaccaacatgcagtgtcaacttggacaaatgacttcccctctctgagcctcagtttctttgcccataaaagggacagamcattagcatctgctttatagggctgtggtgatggttacatgagtgcatggtatgccataggcactcaatatgtgtcagttatttcatgcttaagtgtgcc

SEQ ID NO: 62631 - DNA, 201 bp, Homo sapiens
accacacctggctaatttttgtatttttaatagagtcggggtttcgccatgttggccaggctggtctcaaactcctgtcttcagatgagccacctacttcrgcctcccaaagtgctaggattacaggcatgagccactgcacccagcctgtaaccaactcttatgcaaccttcagtgttcagtgtaaggtatccaaaaagt

SEQ ID NO: 62632 - DNA, 201 bp, Homo sapiens
tggaagaagcttcagagagaggctgcctttgcatcatggtacagctcgggaaacaagcccagtctgggatagggatgaccctaggggcacgtggcacatcrgcagcagacccagaaccctctcactcatcctaaattcttgtaaggtctcaaatgagatagagaataactgtcctgttctaaagagggggaaacagtcata

SEQ ID NO: 62633 - DNA, 201 bp, Homo sapiens
gggttcaaatcccttcgctaccaccaacatgcagtgtcaacttggacaaatgacttcccctctctgagcctcagtttctttgcccataaaagggacagaayattagcatctgctttatagggctgtggtgatggttacatgagtgcatggtatgccataggcactcaatatgtgtcagttatttcatgcttaagtgtgcca

SEQ ID NO: 62634 - DNA, 201 bp, Homo sapiens
gctatgttcagaagtagagagaagggtttgctgggatcccacactgacaggttggtaaaatattcattctcggactggactctggagccaaaataccctcrgcccctgagctgctccagatactccctactctgccagtccagagctgaacctggaagaatctagacccttcttgttacagttttttgccctaggagggcc

SEQ ID NO: 62635 - DNA, 201 bp, Homo sapiens
gaaagatgatccctggtaatggagaagatagcatccgaaagaattaaatatgaatgtctcactttgtcaagatttcataggttttttatttttacagatgktgtgtctcgctctccctcccagactggagtgcagtgcgatcatagctcattgcagccttgaactcctgggctcaagcggccctccagccccagcctccag

SEQ ID NO: 62636 - DNA, 201 bp, Homo sapiens
ctgacaggttggtaaaatattcattctcggactggactctggagccaaaataccctcagcccctgagctgctccagatactccctactctgccagtccagrgctgaacctggaagaatctagacccttcttgttacagttttttgccctaggagggcctgaaggaggcgagtcaaaccccctcattttacagatgggcaga

SEQ ID NO: 62637 - DNA, 201 bp, Homo sapiens
ctcctgacctcaggtgattcgcccacctcggcctcccaaagtgttgggattacagacgtgagccaccgcgcctggcctacatttttttttttaagtgctgkcaaatgcatgccgtctacttttcttcagtaaatgtcaactctttacccattatgtgccagtccctgtggggtgtgccaagcagaaaaagcactgatctaa

SEQ ID NO: 62638 - DNA, 201 bp, Homo sapiens
cagacatggtggtgtgtgcctgtagtcccagctactttggtggctgaggcaggaggattgcttgcgcccaggagttcaaggcttcagtgagccatgattgygccactgcactcctacctgtgcaacagagctacaccctgtctcaaaaaaaaaaaaaaaagcaataatggaggcatttcaggcatgtgtcagcagccatag

SEQ ID NO: 62639 - DNA, 201 bp, Homo sapiens
agctgctccagatactccctactctgccagtccagagctgaacctggaagaatctagacccttcttgttacagttttttgccctaggagggcctgaaggargcgagtcaaaccccctcattttacagatgggcagactgaggcccaggtctccccagtgctcaggcgtcatccaagtggagcttccaaatggtggatggta

SEQ ID NO: 62640 - DNA, 201 bp, Homo sapiens
aaacatcaggttggggctagttgtaaggtttagggcaaaacacccctcctactccctgttgttagaagaccggaggcggggtttgcccccacctggccccrctccagaaggaggggttattatacgtctgattgaatcaacttccaggatccttattggtccttggtggtaactagggcgctctcttccaggatccttatt

SEQ ID NO: 62641 - DNA, 201 bp, Homo sapiens
tgctccagatactccctactctgccagtccagagctgaacctggaagaatctagacccttcttgttacagttttttgccctaggagggcctgaaggaggcsagtcaaaccccctcattttacagatgggcagactgaggcccaggtctccccagtgctcaggcgtcatccaagtggagcttccaaatggtggatggtagaa

SEQ ID NO: 62642 - DNA, 201 bp, Homo sapiens
ccttacccttcatacttcactcacgttggtcttccatcagtttctggagattgttcctgcctcgggacatttgcgtagtctgttccccttgcctggaacayccccacccccacgtcgagaccaacttagatttttgttcaacaatttcttatcttccagacttgagcataattatctcctgagagataactcctctgacct

SEQ ID NO: 62643 - DNA, 201 bp, Homo sapiens
acacaggccacacattgtgccctaggcagagccgtgggcagctggtgccagccctccgcccctggcagccaaaatgacctgcctctcgcacccactgcagstggaggtcacagcagatctggcagagcggcggcgcatccgctcagccatccgggaactgcagcggcaggagctggagcgcgaggaggaggccctggcatc

SEQ ID NO: 62644 - DNA, 201 bp, Homo sapiens
atagggagacccttgtctctacaaaaaataaaaaaattagccaggcatggtggcacgtgtctgtagtcccactgtgagcctgggaggtcaaggctgcagtragccatggttgtgccactccactccagcctgggcgacagagtgagactctgtctcaaaaacaaaacaaaacaaaaaaaaaacaacaaaagaacgagggtt

SEQ ID NO: 62645 - DNA, 201 bp, Homo sapiens
cccttgccctaggaaggcttgaagcagaccagtctaatcacctcattttacagggggcaggctgaggcccaggcctctctggtgcccacaagatacattcrtcctgctcatctggcattcagaatccttggcaaagagaaccacccacatttcctgctccgcccacagcctatcctcctccttttcccagactattggtct

SEQ ID NO: 62646 - DNA, 201 bp, Homo sapiens; identical to SEQ ID NO: 12410

SEQ ID NO: 62647 - DNA, 201 bp, Homo sapiens
ccctagcactgtaccggactgccctttgatctctagatcacccccactcccttgcagagaggaagacagaggcaggcgggtatgtctggaggtggacccargcactaagggcttgaaggggcaggacccacacatcccttccatagggccaagggctagtgagcgcatgtgccagacagtaaatccaagcatggaggaact

SEQ ID NO: 62648 - DNA, 201 bp, Homo sapiens
tcgggacacacagaggagacactgtggtccaacctttgcctccaggcccaaagggaagggtcgtgccagagggtgaccagtggaatgaggttgtcagtctscagccttgcccacccactttgggggatcagagggaggctcccattttccagatggggacactgaagctccgggggttgtgctgtagaggtggccaagttc

SEQ ID NO: 62649 - DNA, 201 bp, Homo sapiens
tagttggcccggcagaggcgggaagaccgcgcggctagatctgtggtgcaaaggcccgaaggtcatggaaggcggggcctgggatccactgggtgggcccwccgaggcatgccccttatagtcgtgtgacctggtcctgacaccgcccctacagcagccctggcggaccccgcgcagccgtgcagcgatccaccagcttcg

SEQ ID NO: 62650 - DNA, 201 bp, Homo sapiens
gagttcgagaccagcctgaccaacatggtgaaaccccatctctactaaaaatacaaaaattagccaggcgtgtggcgcacacctgtaatcctagcgactcrggaggctgaggtaggagaatcacttgaacccaggaggcgaaggttgcaatgagctgaaatcatgccactgcactccagcctgggtgacagagcgagactc

SEQ ID NO: 62651 - DNA, 201 bp, Homo sapiens
agcatgcctgattcatgtctgtcccctgcagaattctctgagctggtgacaggtgccacaggcactggggatctcaccagaaaggaaccgacggagctagrggccagcgagatggcggacgaggccttagctgggctggatgagggagcccttcggaagctggtaagtggccccatcacccactgtggggacaggaaagcc

SEQ ID NO: 62652 - DNA, 201 bp, Homo sapiens
agttggttatgtacaagcctctgctaagcaccttacctgcattatcttatttaattgtcatcacaataaacaagtattattattgtcctcctgaaacaaartacatgagaacggtgtctctcatccatgctgccgtaatttctaacccaagccgctgctcatgcagtcccatctacctggagtgtatctcttttttttttg

SEQ ID NO: 62653 - DNA, 201 bp, Homo sapiens
tgccttcctggaaggcttttccctgtctggagtttatgaaagaccagcaggcaatgcggcaataaaaaagaccttggggtagaggggcgccacgagaggcrggtctggcgctgacatccaaccccgtgccccctccctgcaggatgctggtggactgtgtgcccctggtggaggtggacgacatgatgatcatgggcaaga

SEQ ID NO: 62654 - DNA, 201 bp, Homo sapiens
agcaaccctaggatctgcttccctatccattggagacatgatgagtttcacccatacccctgcttaaagtccatgccctctccccaccctgcagatggaascagagccagcagagcctctcgctgcagcagtggaagcggccaatggggctgagcagacccgagtgaacaaagcaccagaagggcggagccctctgagcgc

SEQ ID NO: 62655 - DNA, 201 bp, Homo sapiens
agacttgagcataattatctcctgagagataactcctctgacctcccagaactacctgttcaaaacaaaactttaaaaattatttaagccagccgggcacratggctcatgcctgtaatcccggcactttgggaggcccaggtggtcagatcacttgaggtcaggggttcaagaccagcctggccaacatcatgaaacccc

SEQ ID NO: 62656 - DNA, 201 bp, Homo sapiens
cagaactacctgttcaaaacaaaactttaaaaattatttaagccagccgggcacaatggctcatgcctgtaatcccggcactttgggaggcccaggtggtyagatcacttgaggtcaggggttcaagaccagcctggccaacatcatgaaaccccgtctctactaaaaatacaaaaattaaccgggtgtggtggcaggagc

SEQ ID NO: 62657 - DNA, 201 bp, Homo sapiens
caagtccctggcttctcagagctcacagtctagcaggagacaaacaacaaaaaaattaatcatttccgatcgtcagtgctgtgatggggagtaattacagkacagagtaattttggggagcttcagatacgtgctctgggaagacctttctaaggaggtgatgtgtgagttaagatctgaatggtaatctggagccagcca

SEQ ID NO: 62658 - DNA, 201 bp, Homo sapiens
agaactacctgttcaaaacaaaactttaaaaattatttaagccagccgggcacaatggctcatgcctgtaatcccggcactttgggaggcccaggtggtcrgatcacttgaggtcaggggttcaagaccagcctggccaacatcatgaaaccccgtctctactaaaaatacaaaaattaaccgggtgtggtggcaggagcc

SEQ ID NO: 62659 - DNA, 201 bp, Homo sapiens
acagcaagatcccatctgtacaaaaaataagaaaattagccagacatggtggtgtgtgcctgtagtcccagctactttggtggctgaggcaggaggattgyttgcgcccaggagttcaaggcttcagtgagccatgattgcgccactgcactcctacctgtgcaacagagctacaccctgtctcaaaaaaaaaaaaaaaag

SEQ ID NO: 62660 - DNA, 201 bp, Homo sapiens
aatcacttgaacctgggaggcggaggttgcagtgaactgagatcactccactgcactccagtctgggcaacagagcgagactcagtctcaaaaataaatarataaataaataaataaataaataaataaataaataaaacagaggggtagactgggatgctgggaggtaataggtctatagccagggaggggcaaagtgag

SEQ ID NO: 62661 - DNA, 201 bp, Homo sapiens
agtcccagctactttggtggctgaggcaggaggattgcttgcgcccaggagttcaaggcttcagtgagccatgattgcgccactgcactcctacctgtgcracagagctacaccctgtctcaaaaaaaaaaaaaaaagcaataatggaggcatttcaggcatgtgtcagcagccataggtgttcaggggctttgtgcttat

SEQ ID NO: 62662 - DNA, 201 bp, Homo sapiens
actttggtggctgaggcaggaggattgcttgcgcccaggagttcaaggcttcagtgagccatgattgcgccactgcactcctacctgtgcaacagagctasaccctgtctcaaaaaaaaaaaaaaaagcaataatggaggcatttcaggcatgtgtcagcagccataggtgttcaggggctttgtgcttatgaaggtttgt

SEQ ID NO: 62663 - DNA, 201 bp, Homo sapiens
agtgagccatgattgcgccactgcactcctacctgtgcaacagagctacaccctgtctcaaaaaaaaaaaaaaaagcaataatggaggcatttcaggcatstgtcagcagccataggtgttcaggggctttgtgcttatgaaggtttgttcagtaacaaatattcagctggagcgggcatcatggctcacacctgtaatcc

SEQ ID NO: 62664 - DNA, 201 bp, Homo sapiens
cagagtgagaccctgtctcaaaaaattaaaaacttaattaattaaaaaaaattcaactggggaaatagttctagctctctctttctctctctctctctctyttttttttttttttggaggcagagtttcactctgatacccaatctggagtgcagtggcatgatctcggctcactgcaacctccaccttccaggctcaagg

SEQ ID NO: 62665 - DNA, 201 bp, Homo sapiens
ataaaaccatttacaccacaagagatagagggaagggataggatttgtccaaaacataataaatccccttggccaaattcatggaccctggcagggtaagrtcagagatagcatcatttctgcctatgtggctgacattcattatgtaagtcccatgtaccaggatccccatcccatgcaagctccgtgaatgatcactcc

SEQ ID NO: 62666 - DNA, 201 bp, Homo sapiens
tcttaggcaggatagcccaggcttgttcacataacagctgcgagagttccaagagaataagtggaatctcttaaggcccaatctcttaacacccaggcttygaactggcaatgccacttccgtatattctattggccaaaaatagtcacatgcctgcctgggcatggtggctcacacctgtgtaattccagcactttggga

SEQ ID NO: 62667 - DNA, 201 bp, Homo sapiens
cgcacctagatctgtccaactccagatctccctgagcccttcactactgcaaaatagctactcaactggcttgctgtatgatttggggcaagttcctcaamctttctgagtctcagattctttttttctttttctttttttgagatggaatttccctcttgtcacccaggctggagggcaatgcacgatctcagttcactg

SEQ ID NO: 62668 - DNA, 201 bp, Homo sapiens
gggtcagctgccccatagaagaacagacatggggggaatcagaatgtccgcagaacctaaggctggtgaccactggacagtcttgaagaggtttaacccakacagagtaactaggtaagaggcaaggatcctaacaggcagagattgggaggttgacacctctgagcctaccaggatgggagggggaacaagcagtgactt

SEQ ID NO: 62669 - DNA, 201 bp, Homo sapiens
acgagacactgaagcccagtgaggtcataaagcaagtcaggtgcaggctagactctcagcctaggctagactctcagcctagggatccttcccccctcccygccccagtcattgggaccatgttgcccactccccaagaggctcagggggaacagagctagggacctcttccttcaaactcacctcctttaggcggttcag

SEQ ID NO: 62670 - DNA, 201 bp, Homo sapiens
gtgatggttacatgagtgcatggtatgccataggcactcaatatgtgtcagttatttcatgcttaagtgtgccaggccctgaggaggaaacaaagttttgrgaggttgagaatctgggatgcagaatggctctgctcctgatttgctacactacctgaagcctgtcccttgtcctctctgggactcagttacctatttgaa

SEQ ID NO: 62671 - DNA, 201 bp, Homo sapiens
tgattaagaacaaatgttctggccgggcgcagtggctcacgcctgtaatcctagcactttggaaggtcaaggcaggcggatttcttgaacccaggagttcragactagccccggcaacatagggagacccttgtctctacaaaaaataaaaaaattagccaggcatggtggcacgtgtctgtagtcccactgtgagcctgg

SEQ ID NO: 62672 - DNA, 201 bp, Homo sapiens
tgagtctcagattctttttttctttttctttttttgagatggaatttccctcttgtcacccaggctggagggcaatgcacgatctcagttcactgcaacgyccgccttccgggttcaaaccattttcctgcctcagcctcccaagtagctgggattacaggtgcccgccaccacgcctggctaatttttgtatttttagta

SEQ ID NO: 62673 - DNA, 201 bp, Homo sapiens
gtgcggcaccaggaccagttaagctgagcctcaaattctttacctataacttgtcccttatttaagctaacacatggtaggtgctgaagttgattctctckctctctctttttttttttttttttttttgagacagggtcttgctctgtcacccaggctagagtgcaatggcatgatctcggttcagtgtagcctcaacct

SEQ ID NO: 62674 - DNA, 201 bp, Homo sapiens
aggcatgcaccactgttgattctttatagatgttaattctctgcttaacacacatgcccctccaactcccaccacacatacagacacagacacacatacasacgcacgcacgcatgcacgcatgcacgccagccccacaacaggaggaatgtaacggaagcaatgctttgtgttctgtaacctgtttccttttcctggaca

SEQ ID NO: 62675 - DNA, 201 bp, Homo sapiens
caccactgttgattctttatagatgttaattctctgcttaacacacatgcccctccaactcccaccacacatacagacacagacacacatacacacgcacrcacgcatgcacgcatgcacgccagccccacaacaggaggaatgtaacggaagcaatgctttgtgttctgtaacctgtttccttttcctggacacacagga

SEQ ID NO: 62676 - DNA, 201 bp, Homo sapiens
tttatagatgttaattctctgcttaacacacatgcccctccaactcccaccacacatacagacacagacacacatacacacgcacgcacgcatgcacgcaygcacgccagccccacaacaggaggaatgtaacggaagcaatgctttgtgttctgtaacctgtttccttttcctggacacacaggaaggtcatgttctcat

SEQ ID NO: 62677 - DNA, 201 bp, Homo sapiens
tttccacatgcagaggattcaggaatagattccagggaaagcctggggtggaggcaggattcgggggcaaggtcactgcttggaaaagagctccctgggaragccccaacctgtatcagactttgcaggggtgagaaataaactctgattgggttaaaccactgagatatttggtttgttacagcagtcagcattaattac

SEQ ID NO: 62678 - DNA, 201 bp, Homo sapiens
cacatccccaaagccatacttccttatccctgagttgggtcgggctgtgagttatccccggatcagcagttcccaaggtctgaaggaaatgctggaccctygtgggcagaagggggaactgtgtatacaggtggggagactcaggcctagagacaccaggggaaaagagcaaggccagagacccacagtgtgcctgccagc

SEQ ID NO: 62679 - DNA, 201 bp, Homo sapiens
gcttgggtgacagagatcctgtcttaaaaaataaaaaagagctcagcctctagaatcacagccctgggcttaagtcctgactcacttgctattgattttgrgcaaatgccttcccctccctgagactgacatttcccttctataaaacaggtgctggggctgggcatggtggctcacacctgtaatcccagcactttggga

SEQ ID NO: 62680 - DNA, 201 bp, Homo sapiens
tatgccataggcactcaatatgtgtcagttatttcatgcttaagtgtgccaggccctgaggaggaaacaaagttttgagaggttgagaatctgggatgcasaatggctctgctcctgatttgctacactacctgaagcctgtcccttgtcctctctgggactcagttacctatttgaaccataaggtgggtatctaggact

SEQ ID NO: 62681 - DNA, 201 bp, Homo sapiens
aaggaggaaggtcataccccttggatccagccaaccccaacaagaaccatccacctctaggggctccattctccagcctcacctgcctgtctgttgcccarcaaggtcgtcacaatcctacttccgttcctttgctaatgctgttcccgtctccagaatgacagtgctgtcctggggagagaggcttagagagcccaaggc

SEQ ID NO: 62682 - DNA, 201 bp, Homo sapiens
aggggcttcagcatcaggcagaattccactttagtctgaatgcctttactaggccaaggtgccttcacctccctgagcttcagcttcctctgtcgaatcaragtgtacctatcttgcacagtggtcacctggcagtagtgggagccccacgtctgacatgcaacaggtgttcagcaaatgctggggccctcgtcacgggat

SEQ ID NO: 62683 - DNA, 201 bp, Homo sapiens
cagaggccccacagtggggtaacttgaacacagtggttcagagcctggtctctgtcaagaagatatggtgctgggaacagtggtgtgtccctgtggttcgygctcctcggaaggctgaggcaggaggataagcctagggattcttgagcccaagagttctaggctgtagtgtactatattgatcgagtgtctgtgctaagt

SEQ ID NO: 62684 - DNA, 201 bp, Homo sapiens
ggtcttgccaggccctggcttctcaatccaggtccctgccctccctgttttgaggtttagacaggatgagagtccatcccaggccacacagcagactggcrgccaagctggcagggctggaaccagagaccccctaccctgggtttggtgagttttccagcaaaccaccctagggcagagggcagcttccagccaggagcc

SEQ ID NO: 62685 - DNA, 201 bp, Homo sapiens
aaccagagcatcagagaccatgacctcagtctactcgaggtacagacgagacactgaagcccagtgaggtcataaagcaagtcaggtgcaggctagactcycagcctaggctagactctcagcctagggatccttcccccctccccgccccagtcattgggaccatgttgcccactccccaagaggctcagggggaacaga

SEQ ID NO: 62686 - DNA, 201 bp, Homo sapiens
gtggatggtagaatatggtgattaagaacaaatgttctggccgggcgcagtggctcacgcctgtaatcctagcactttggaaggtcaaggcaggcggattkcttgaacccaggagttcgagactagccccggcaacatagggagacccttgtctctacaaaaaataaaaaaattagccaggcatggtggcacgtgtctgta

SEQ ID NO: 62687 - DNA, 201 bp, Homo sapiens
cgccctgtgcctgcctgcctgtccgcccacctcctccggctcttccttgagctctctctccgtgtcttcaactgtgccgtcactttctcttctctgcctgyggctatcaccacccctccatacagcctcccatcccatctcctgatgtccagcccaggccctcacctggtgccccttccccttttttgcagatggcagtgg

SEQ ID NO: 62688 - DNA, 201 bp, Homo sapiens
agtgggaggtacccaatcgagggttggctggcgcgtcggggcagggcggggccagccgggctgctggcgcggctggacgggcagctctccgcagaatccargggacggttgctgagcgggcctgggacagcgggtcgcggcacctccggcctgcgcgtgtctaatccgtctgtcgggtcccgaaagagctaagccgagcct

SEQ ID NO: 62689 - DNA, 201 bp, Homo sapiens
tccaagtcccagtgggggtcgtagaggcagcacagtccaaaaagagggaatgccaggcctggttcccgcacatcctcatctcaaggtatccacaggcaggstcagggttcttcagccgccacctccctctcttaagcgaggctcgggcggcgctggaaaagagttttggagagaagctggagcagtggttgaatctctggg

SEQ ID NO: 62690 - DNA, 201 bp, Homo sapiens
catagtgagactctgtctctaaaagtaaataaataggctgtgcgcagtgggctcacgcctgtaatcccagcactttaggaggccaaggcaggcggatcacytgaggtcaggagttcaagaccagcctggccgatatggcgaaaccctgtctttactaagaatataaaaattagctggtcatgatgtcatgtgcctgtggtc

SEQ ID NO: 62691 - DNA, 201 bp, Homo sapiens
tgcctcggggtatcctgcccttcccatttgcccccttgtctctctccctcctcctgactggctagaaccaagtatgggggtgatgcttattgcaactgcarctatgtacaggagaggccaagtcactgttcccaaccccacccactggcaaatgaaaaaaccaagacacagagagtttaagggatatgctcttgatcaccc

SEQ ID NO: 62692 - DNA, 201 bp, Homo sapiens
cactgcacccagcctgtaaccaactcttatgcaaccttcagtgttcagtgtaaggtatccaaaaagttacttcctgactgtgagacctggatttccaaatraggaagctgagtcacacagggtgagatcacattcaagtaagagacagagctagagaccgggtgcagtggctcacacctgtaatcccagcactttgggagg

SEQ ID NO: 62693 - DNA, 201 bp, Homo sapiens; identical to SEQ ID NO: 12404

SEQ ID NO: 62694 - DNA, 201 bp, Homo sapiens
gctcaagcggccctccagccccagcctccagagtagctgggactacaggtgcacaccaccacacctagctatagttttcaaaatttagatataattcatawataaattatattttatagttattttggtgtttaattttgaaataattttagacttacagaaacgttgcaaaaatagttcagagttatcctaaactcttca

SEQ ID NO: 62695 - DNA, 201 bp, Homo sapiens
agctgccacctcagctctccttacccttatagcagacggagaggccctgccaggagaggaagggccataatagttggcttggggccttgtcttcaaggggytagggagatgccctgggagggctgcagggctagagactccttagaggatggtttccagcaggggcgaggcagggggaggtggtacagaggagagcttcat

SEQ ID NO: 62696 - DNA, 201 bp, Homo sapiens
agaaataagtgggagaagtagggattgccttcctccaataataatgctttggccctaaaaaggaaactcttgaaccccatagaatattttattttattttwttttttttttgagacagagtctcgctctgtcgcccaggctggagtacagttgcacgatcttggctcacgcaacctctacctcccagattcaagcaattct

SEQ ID NO: 62697 - DNA, 201 bp, Homo sapiens
accagagccagcagagcctctcgctgcagcagtggaagcggccaatggggctgagcagacccgagtgaacaaagcaccagaagggcggagccctctgagcrctgaggagctgatgactattgaggatgaaggagtcttggacaagatggtatagccagatccggtgggctgggggttggcagaggccagcaggcaccaggt

SEQ ID NO: 62698 - DNA, 201 bp, Homo sapiens
taagtgggagaagtagggattgccttcctccaataataatgctttggccctaaaaaggaaactcttgaaccccatagaatattttattttattttattttwtttttgagacagagtctcgctctgtcgcccaggctggagtacagttgcacgatcttggctcacgcaacctctacctcccagattcaagcaattcttgtgc

SEQ ID NO: 62699 - DNA, 201 bp, Homo sapiens
acctaactgcaaacccgttttacagaggggtgggctgggcacagtggctcttgcctgtaatcccagcactttgggaggccgaggcgggcggatcacttgargtcaggagttcaagaccagcctggccaacatggtaaaacctcatctctactaaaaatacaaaaattagccgggcgtggtggcaggcacctgtaatcccaa

SEQ ID NO: 62700 - DNA, 201 bp, Homo sapiens
atgttggccaggatgatcttgatctcttgacctcgtgatcctcccccttaggcctcccaaagtgctgggattacaggcataagccaccacgcccggcgcamctgcttcttcttctttttttttttttttttttgagacgagtccccctctgttgcccaggctggagtgcagtggcacgatcttggctcactgcaagctctg

SEQ ID NO: 62701 - DNA, 201 bp, Homo sapiens
aaaaattagccgggcgtggtggcaggcacctgtaatcccaactactggggaggccgaggcacaagaatcacttgaacctgggaggcggaggttgcagtgarctgagatcactccactgcactccagtctgggcaacagagcgagactcagtctcaaaaataaatagataaataaataaataaataaataaataaataaata

SEQ ID NO: 62702 - DNA, 201 bp, Homo sapiens
gaaggaggggttattatacgtctgattgaatcaacttccaggatccttattggtccttggtggtaactagggcgctctcttccaggatccttattggtccttggtggtaattaggccactctcgcttcaaagtcccaaattcaggcgccccgctggggactagagcgaccgttccccacctcacccaccccaagctcagag

SEQ ID NO: 62703 - DNA, 201 bp, Homo sapiens
attccagaatcagtgatgaagtaacagggcctcttgggtggtgggcagggttcaaggccggatcccactcttggagtcccctccttgttgctctgtaggargccctgagtcaatttctctaaatgagggaaggagtgatgaggcatgaccatagccttagctgggtggcgctgggcctctcagtagctctgtcccttgaaa

SEQ ID NO: 62704 - DNA, 201 bp, Homo sapiens
tgggcctttcccctctccccatccaaaccccacttctcccttacccttcatacttcactcacgttggtcttccatcagtttctggagattgttcctgcctygggacatttgcgtagtctgttccccttgcctggaacacccccacccccacgtcgagaccaacttagatttttgttcaacaatttcttatcttccagactt

SEQ ID NO: 62705 - DNA, 201 bp, Homo sapiens
aggaaatgctggacccttgtgggcagaagggggaactgtgtatacaggtggggagactcaggcctagagacaccaggggaaaagagcaaggccagagaccmacagtgtgcctgccagccttggggcctgtacatcctactggctgtggactgactcccaatgcccaggggaaatgatcaccctgctcctcttaagcagtag

SEQ ID NO: 62706 - DNA, 201 bp, Homo sapiens
tgagagataactcctctgacctcccagaactacctgttcaaaacaaaactttaaaaattatttaagccagccgggcacaatggctcatgcctgtaatcccrgcactttgggaggcccaggtggtcagatcacttgaggtcaggggttcaagaccagcctggccaacatcatgaaaccccgtctctactaaaaatacaaaaa

SEQ ID NO: 62707 - DNA, 201 bp, Homo sapiens
ccagaactacctgttcaaaacaaaactttaaaaattatttaagccagccgggcacaatggctcatgcctgtaatcccggcactttgggaggcccaggtggkcagatcacttgaggtcaggggttcaagaccagcctggccaacatcatgaaaccccgtctctactaaaaatacaaaaattaaccgggtgtggtggcaggag

SEQ ID NO: 62708 - DNA, 201 bp, Homo sapiens
gttacagttttttgccctaggagggcctgaaggaggcgagtcaaaccccctcattttacagatgggcagactgaggcccaggtctccccagtgctcaggcktcatccaagtggagcttccaaatggtggatggtagaatatggtgattaagaacaaatgttctggccgggcgcagtggctcacgcctgtaatcctagcact

SEQ ID NO: 62709 - DNA, 201 bp, Homo sapiens
caaatggtggatggtagaatatggtgattaagaacaaatgttctggccgggcgcagtggctcacgcctgtaatcctagcactttggaaggtcaaggcaggmggatttcttgaacccaggagttcgagactagccccggcaacatagggagacccttgtctctacaaaaaataaaaaaattagccaggcatggtggcacgtg

SEQ ID NO: 62710 - DNA, 102 bp, Homo sapiens
trtgactgtgggcagtacagaggcctcaattctcccatctgaaccatggggaaggtccccccgccctgaatcccctacagggctgagaggagggctctggaa

SEQ ID NO: 62711 - DNA, 201 bp, Homo sapiens
ttcataccacacctacaggaaatatctagcagccagttccatgctcagtttcttgaagcatgagattccaggcccctaatatggcatgtgactgtgggcartacagaggcctcaattctcccatctgaaccatggggaaggtccccccgccctgaatcccctacagggctgagaggagggctctggaaaccttgaaaagga

SEQ ID NO: 62712 - DNA, 201 bp, Homo sapiens
atccaagtggagcttccaaatggtggatggtagaatatggtgattaagaacaaatgttctggccgggcgcagtggctcacgcctgtaatcctagcactttrgaaggtcaaggcaggcggatttcttgaacccaggagttcgagactagccccggcaacatagggagacccttgtctctacaaaaaataaaaaaattagcca

SEQ ID NO: 62713 - DNA, 201 bp, Homo sapiens
ttgcagcatggataagaggcattcattttatgttctcttttagtatttttcccaacaagatcctgagaaggaggatctggatggaggttctgccagagccycctggagcagagccaggaagttgagtagggagtagcgccccacagcccatatgagcaggcaggagcaggccaagcctgagggtcgggcctcagaggcctg

SEQ ID NO: 62714 - DNA, 201 bp, Homo sapiens
catccaagtggagcttccaaatggtggatggtagaatatggtgattaagaacaaatgttctggccgggcgcagtggctcacgcctgtaatcctagcacttyggaaggtcaaggcaggcggatttcttgaacccaggagttcgagactagccccggcaacatagggagacccttgtctctacaaaaaataaaaaaattagcc

SEQ ID NO: 62715 - DNA, 201 bp, Homo sapiens
ggtctgtaacaacatggcagctcccatgagaacggcatggttggagtcagaagaggaagaagcagaactgggcaggtgagctgggaagagaataccatagwtgtccactatggagatgataaatgccctaatagatgcgcacaaaaaatgtcatgggcatttaggggatgaagacacaatttctagctgtgcaactgtggt

SEQ ID NO: 62716 - DNA, 201 bp, Homo sapiens
cggccgggtgagctgcagaagtgggctgggcagtggggggcggggcttgataggcagtggggggcggggcttgatagttggcccggcagaggcgggaagaycgcgcggctagatctgtggtgcaaaggcccgaaggtcatggaaggcggggcctgggatccactgggtgggcccaccgaggcatgccccttatagtcgtgt

SEQ ID NO: 62717 - DNA, 201 bp, Homo sapiens
cgttgcaaaaatagttcagagttatcctaaactcttcatttcctacaccttcacctagctttccctgataggaacatcttacctcaccttagtacaattaycagaaccaggaaattaacactggtacagtaacctacataccttatttgaattttagctgttttccttttgatctaatccaaggtccaacattgcatttag

SEQ ID NO: 62718 - DNA, 201 bp, Homo sapiens
  misc_feature (1)...(201): n = A,T,C or G, or insertion/deletion polymorphism (see Tables 1-2)
tccagaactctctccttcctgttccagccccttgcctctcctttgtctgtgaggctgggtctcctggaattcactgctgcccagtgggcatctgaggcccnttctcctcctgcagggccagaagtttgcctggcactgttgcccagagaacacagcggctggatgacatcctggagatgatggccttgccaaactggtttc

SEQ ID NO: 62719 - DNA, 201 bp, Homo sapiens
gataaaggcagaccgtacttgtgaacgtgttctgtaatacaaactagggttgttcattctccttctgcagtgctcagctctggcctctcctctcctgtttrcatttcccttttccttcctgcctgtgttcaggcctgcagacttctgtctgtcctccctggtctaactcccttatcctacttgccaagccttactgtgatg

SEQ ID NO: 62720 - DNA, 201 bp, Homo sapiens
cctctcctgtttgcatttcccttttccttcctgcctgtgttcaggcctgcagacttctgtctgtcctccctggtctaactcccttatcctacttgccaagycttactgtgatgtcatttaataaattttggagacacaaggagcgcctcatagagatggacaatttccttcagtagtctcctgctgtttttagagttgcct

SEQ ID NO: 62721 - DNA, 201 bp, Homo sapiens
tggcccttttgcgcatgcatggggcatcccctgcccagaccagcgggacaaggagcgggaacggcggctgcaggaggcacggggccggccaggggaggggygcggcaacacagccactgagaccaccacgaggcacagccagcgggcagctgatggctctgctgtcagcactgttaccaagactgagcggctcgtccactc

SEQ ID NO: 62722 - DNA, 201 bp, Homo sapiens
tttgccctaggagggcctgaaggaggcgagtcaaaccccctcattttacagatgggcagactgaggcccaggtctccccagtgctcaggcgtcatccaagyggagcttccaaatggtggatggtagaatatggtgattaagaacaaatgttctggccgggcgcagtggctcacgcctgtaatcctagcactttggaaggtc

SEQ ID NO: 62723 - DNA, 201 bp, Homo sapiens
agtaattacagtacagagtaattttggggagcttcagatacgtgctctgggaagacctttctaaggaggtgatgtgtgagttaagatctgaatggtaatcyggagccagccagagtgaagatgtggttgaagagcacagtcccaggggagaagaaagcaaaggcagaggccaggggagagaaagcagcatggcctctctca

SEQ ID NO: 62724 - DNA, 201 bp, Homo sapiens
acagagcgagactctgtcttaaaaaaaaaaaaaaaaaggaatagtcttagccagtgggggtagggtgaggaataagtaagttactgtgggctaagctttarcccagtgcccagcacatattataaacttcataagcagttgctattttaaagggtttttgttttgttttgttttgtttttgtttttgtttttgagacaagg

SEQ ID NO: 62725 - DNA, 201 bp, Homo sapiens
gttattaattgctccctaattgcaaattggctgcctccttactggctcccacccatgctggctggctgaccaaggggtcacatgcatccttcagggaaagstgttttgtgaatccagtggttcatttgttccacacgtgtgttgagccccttcgttgacgccagatcctttctaggtcctggggaccgtgttgagcgagac

SEQ ID NO: 62726 - DNA, 201 bp, Homo sapiens
atttccgatcgtcagtgctgtgatggggagtaattacagtacagagtaattttggggagcttcagatacgtgctctgggaagacctttctaaggaggtgaygtgtgagttaagatctgaatggtaatctggagccagccagagtgaagatgtggttgaagagcacagtcccaggggagaagaaagcaaaggcagaggccag

SEQ ID NO: 62727 - DNA, 201 bp, Homo sapiens
gggagatgtgtttgcacacaagctctaggtcctagagttggcatggggacagaatgaggcatggacccagatctcaggtggaggaaagatgagcccactcyatcccctttcttgttcctcttcctgagagccctgtctacctccatgcacagaggccgtagggcaacccagtggggcagggctccttccccaaccccaaag

SEQ ID NO: 62728 - DNA, 201 bp, Homo sapiens
cgtgttgagcgagacaaacccaagtccctggcttctcagagctcacagtctagcaggagacaaacaacaaaaaaattaatcatttccgatcgtcagtgctrtgatggggagtaattacagtacagagtaattttggggagcttcagatacgtgctctgggaagacctttctaaggaggtgatgtgtgagttaagatctgaa

SEQ ID NO: 62729 - DNA, 201 bp, Homo sapiens
tggctggctgaccaaggggtcacatgcatccttcagggaaaggtgttttgtgaatccagtggttcatttgttccacacgtgtgttgagccccttcgttgaygccagatcctttctaggtcctggggaccgtgttgagcgagacaaacccaagtccctggcttctcagagctcacagtctagcaggagacaaacaacaaaaa

SEQ ID NO: 62730 - DNA, 201 bp, Homo sapiens
aacaaaaaaattaatcatttccgatcgtcagtgctgtgatggggagtaattacagtacagagtaattttggggagcttcagatacgtgctctgggaagacytttctaaggaggtgatgtgtgagttaagatctgaatggtaatctggagccagccagagtgaagatgtggttgaagagcacagtcccaggggagaagaaag

SEQ ID NO: 62731 - DNA, 201 bp, Homo sapiens
ctcaggcgtcatccaagtggagcttccaaatggtggatggtagaatatggtgattaagaacaaatgttctggccgggcgcagtggctcacgcctgtaatcytagcactttggaaggtcaaggcaggcggatttcttgaacccaggagttcgagactagccccggcaacatagggagacccttgtctctacaaaaaataaaa

SEQ ID NO: 62732 - DNA, 201 bp, Homo sapiens
tgctgtgatggggagtaattacagtacagagtaattttggggagcttcagatacgtgctctgggaagacctttctaaggaggtgatgtgtgagttaagatmtgaatggtaatctggagccagccagagtgaagatgtggttgaagagcacagtcccaggggagaagaaagcaaaggcagaggccaggggagagaaagcagc

SEQ ID NO: 62733 - DNA, 201 bp, Homo sapiens
ggaaggatgctaactgcatcctggattctgggacacccatgccctggcagagatgtgccctaagaggaacgaactcacggccacaggcacagattgagcayctaactgtgtgcatggctctgtgctaggatgggggacacaaaacacttcataggactgcaccctcgctcagggctgggtgggccgacctcaggaaacctg

SEQ ID NO: 62734 - DNA, 201 bp, Homo sapiens
aactgcatcctggattctgggacacccatgccctggcagagatgtgccctaagaggaacgaactcacggccacaggcacagattgagcacctaactgtgtkcatggctctgtgctaggatgggggacacaaaacacttcataggactgcaccctcgctcagggctgggtgggccgacctcaggaaacctgggttccagccc

SEQ ID NO: 62735 - DNA, 201 bp, Homo sapiens; identical to SEQ ID NO: 12418

SEQ ID NO: 62736 - DNA, 201 bp, Homo sapiens
cgagaagggcgggtagggcagggcctggctggcggaaggctgggaacacggcttggaggctgggtttgggtttgggccccaccctgcctgccttcccttgyttgcagctggtccagccgccacgtctacacttggctctgaggttgttgcagagcactccctcccaccgtggccgcctcctctgggaagatgcagagccct

SEQ ID NO: 62737 - DNA, 201 bp, Homo sapiens
cccctgccgatgcccacccgactcgctaaagccaccgaggcagacgaccccaagactcccaatttccgacctccctggcccgcgaggggcggggccttccyctcggggcgtggccgtcaaattgaattttcccaatggggcacgagagtgggaggtacccaatcgagggttggctggcgcgtcggggcagggcggggccag

SEQ ID NO: 62738 - DNA, 201 bp, Homo sapiens
gctgctaggccccttgaaaacagagcaggggggcctgtggcacgttcagaggagcctggtgccccgctgcccgtggccgtcggcactgccgagccaggggrcagtatgaagaccacattcaccatcgagatcaaggacggccgtggccaggcctccacaggccgggtgctgctgcccacaggcaaccagagggcaggtagg

SEQ ID NO: 62739 - DNA, 201 bp, Homo sapiens
gcactccctcccaccgtggccgcctcctctgggaagatgcagagcccttctgcagcctcagcacttttctccctgccctagagaggccaggcctgcgtggraactctgaattggacactgcgtgccttcagaaccggcaaaggagccatccaccccgctgtctacaggtcttcatgcctccagtgaggcttactggatctg

SEQ ID NO: 62740 - DNA, 201 bp, Homo sapiens
tgtcttgactatacttggcctttcacacttccaggtacaatttagggccagctcgtcaacctccacagaaaaaccttccaaatttctatcaggatttcagrttcccactggggaaatcaatgtggggagactctacagctttacattattgtgacttttcttccacgaacatagtaagtccctccatttctataggtcttc

SEQ ID NO: 62741 - DNA, 201 bp, Homo sapiens
gatgcagagcccttctgcagcctcagcacttttctccctgccctagagaggccaggcctgcgtggaaactctgaattggacactgcgtgccttcagaaccrgcaaaggagccatccaccccgctgtctacaggtcttcatgcctccagtgaggcttactggatctgctgagggggaagggcctatatacctgggttcaaat

SEQ ID NO: 62742 - DNA, 201 bp, Homo sapiens
ctgggaggtcaaggctgcagtgagccatggttgtgccactccactccagcctgggcgacagagtgagactctgtctcaaaaacaaaacaaaacaaaaaaamaacaacaaaagaacgagggttctgagcctgtctccttatctgtataatggtggtcctacctcacaggactcaagctgtgaaggtcatagtggtaacaaaa

SEQ ID NO: 62743 - DNA, 201 bp, Homo sapiens
ttccctgactgacgctgacatggccatctttgggcaggcaggctggcaggctagtggttatttccaaggcgtgccagcaaccctaggatctgcttccctayccattggagacatgatgagtttcacccatacccctgcttaaagtccatgccctctccccaccctgcagatggaaccagagccagcagagcctctcgctgc

SEQ ID NO: 62744 - DNA, 201 bp, Homo sapiens
cgaagtttcctctgggggcttcgcgggcgcccacacgtactcggggggcacctgcgcgtcgggcgccgccttgcggtagaagccgagctcctgcactagckcattgatctcttcgcgggtcatttcactgagtgggatgcgctgaggcggaggaggggcggggtcagcaggctgggcctcgcctctggcctcgcccccagc

SEQ ID NO: 62745 - DNA, 201 bp, Homo sapiens
gcattctgaaggatggccagaagggtggtccccccgagcatggcatagatggtccattggtattggctgggatcctcatctgcctcctctgctctacccawggcaggtgataagggttagagaacccctctgctgcccacacgttccctggcctccatctccagcagcagggttatccccaccccctgtcaaagaataggg

SEQ ID NO: 62746 - DNA, 201 bp, Homo sapiens
tcagagtagctcattgcaacttgggatgagaaccacataaaactcttctaattacttaatttaaaaaaaaagatttattggaagagggttttaccagaagrttttttggattctgagggttatgtagtgactagggatcaaccaaacaaccactcttggcaaggacagaaaacttcaagaacaggtggaatcagcccattt

SEQ ID NO: 62747 - DNA, 201 bp, Homo sapiens
gccccacgtctgacatgcaacaggtgttcagcaaatgctggggccctcgtcacgggatgtttactctttcctcggctgtagctgtaaacttccctagcacygtaccggactgccctttgatctctagatcacccccactcccttgcagagaggaagacagaggcaggcgggtatgtctggaggtggacccaggcactaagg

SEQ ID NO: 62748 - DNA, 201 bp, Homo sapiens
cctcagctgtcttttgtaccaattaggtagttattaattgctccctaattgcaaattggctgcctccttactggctcccacccatgctggctggctgaccmaggggtcacatgcatccttcagggaaaggtgttttgtgaatccagtggttcatttgttccacacgtgtgttgagccccttcgttgacgccagatcctttc

SEQ ID NO: 62749 - DNA, 201 bp, Homo sapiens
aaagtgctgggattacaggcatgaaccaccacacccggcccctagcagcttctataaaacaacactgggcacctgtcccatcccctgctgcctccttcagytccaaattgccaccaaagccttattcaaccctttgcaacagccctgtgcaaaaggtaggctagatatcatccccatgtcacagacggggaaactgaggct

SEQ ID NO: 62750 - DNA, 201 bp, Homo sapiens
atgctacaagaaggcaatgtctgttcaaaggtgtgtgggctgggggaggcgtgctgtgtgattgattctgctccacctgagatggtcccggcactccaacrcagggtcaaggtgctgccagtcactcagtccctgctctgaggtggctcagaccaggtgtcccgaaagcagcctagggacggcggccaagcttaaacactg

SEQ ID NO: 62751 - DNA, 201 bp, Homo sapiens
aaccccacccactggcaaatgaaaaaaccaagacacagagagtttaagggatatgctcttgatcacccagccaggattggactagggctggaaccaactargggctctggcctgagtttcagggggtcttctcataattcctcaggaatgtggagcctggagggctcttcccccaagactctccctgctctcttcagacta

SEQ ID NO: 62752 - DNA, 201 bp, Homo sapiens
gtgaattttgaagtattcagaattggtcttagagggcgcctgaccctcgttctggataataacatggcatctcgcccaggtagagaaagcctaggaccttsaaatatgtcctccgaagtgagctctgtttgcctctcctgctgtgtagcattgacaagtcgctttcttctgtgccttgattttcttttttctttttttgag

SEQ ID NO: 62753 - DNA, 201 bp, Homo sapiens
tagaggtggccaagttcctacatcaggcttttgtcagagacaagcaccccatctccgagcccagagcactgagaatggggacctaggagacaaaaggctascccttgcccctctgggcctctttaccctctgtacagaaggggctggaccctctgtcccctccagcccccagcctccaaatgtaccacagaaggctctagg

SEQ ID NO: 62754 - DNA, 201 bp, Homo sapiens
acacccctcctactccctgttgttagaagaccggaggcggggtttgcccccacctggccccgctccagaaggaggggttattatacgtctgattgaatcarcttccaggatccttattggtccttggtggtaactagggcgctctcttccaggatccttattggtccttggtggtaattaggccactctcgcttcaaagtc

SEQ ID NO: 62755 - DNA, 201 bp, Homo sapiens
tggctcacacctgtgtaattccagcactttgggaggctgaggtggacggattacttgaaaccaggagtttgagaccagcctggacaacatggggaaactcyatctctataaaaattagtcaggtgtggtggtgagtgcctgtagtcccagctactcgggaggctgaggtgagaggatcacctgagcccagacaggtcaagg

SEQ ID NO: 62756 - DNA, 201 bp, Homo sapiens
gggctctggaaaccttgaaaaggactttgtagactctgagctgggcaccctcaaaggcttggttaggagggagacaagagaaagaattaatccacttcccrccaaggaagccaagagctgaaggagaaatggtccgtgtcctcctccagggcctgcccctcagcatggttcctccctttgttaggagggttaagaacttgg

SEQ ID NO: 62757 - DNA, 201 bp, Homo sapiens
acacccccacccccacgtcgagaccaacttagatttttgttcaacaatttcttatcttccagacttgagcataattatctcctgagagataactcctctgrcctcccagaactacctgttcaaaacaaaactttaaaaattatttaagccagccgggcacaatggctcatgcctgtaatcccggcactttgggaggcccag

SEQ ID NO: 62758 - DNA, 201 bp, Homo sapiens
gcggctggatgacatcctggagatgatggccttgccaaactggtttcccagcaggtcctcagtcccactccgagggctgctggccatgacctaggacgcayccagttctgcacataaggaggaaggtcataccccttggatccagccaaccccaacaagaaccatccacctctaggggctccattctccagcctcacctgc

SEQ ID NO: 62759 - DNA, 201 bp, Homo sapiens
cagacagcttggtaaaatagtcattctcagacttgagctctggagcaaaatattacccctagcctctgagctgctccagccacttcccattctgcctttcyagggttgaacctggaagaacctagagtagaccctttctgtgacagccccttgccctaggaaggcttgaagcagaccagtctaatcacctcattttacagg

SEQ ID NO: 62760 - DNA, 201 bp, Homo sapiens
ggagtgtgccagtgagggtgagcagaaggtggtctccagggagaacatgggcagggtttggagccagcacctccccagggttggaggaagcagacccaggmcctgcctgactgggatggggctctcttctgccatctccgcctccacctgcctagctctgctcccccgccccgagagatgcctccaggcttgggtagatga

SEQ ID NO: 62761 - DNA, 201 bp, Homo sapiens
gacagagtgagactctgtctcaaaaacaaaacaaaacaaaaaaaaaacaacaaaagaacgagggttctgagcctgtctccttatctgtataatggtggtcytacctcacaggactcaagctgtgaaggtcatagtggtaacaaaattgccacacatgtagtataagcatgatcaggagccagtgtccaacccatcaggtag

SEQ ID NO: 62762 - DNA, 201 bp, Homo sapiens
caagaatcacttgaacctgggaggcggaggttgcagtgaactgagatcactccactgcactccagtctgggcaacagagcgagactcagtctcaaaaataratagataaataaataaataaataaataaataaataaataaaacagaggggtagactgggatgctgggaggtaataggtctatagccagggaggggcaaag

SEQ ID NO: 62763 - DNA, 201 bp, Homo sapiens
ttgccacacatgtagtataagcatgatcaggagccagtgtccaacccatcaggtagcaattacatagtgtcccaccatgagcctagacccccactccctgmgcccaggcatcagggactcccagaagtctaaagaggtccaggctggcacatccagaactctctccttcctgttccagccccttgcctctcctttgtctgt

SEQ ID NO: 62764 - DNA, 201 bp, Homo sapiens
ctgagcctcagtttccccttctggttttttttttttttttccggtcttgttttctttgcaacagggtcttactctcttgcccagactggagtgcagctgcrtgatcatagctctctgcagcctctaactcctgggctcaagtaatcctcctacctcagctttctgagtaggtgggactacaggtgcacaccaccatgccta

SEQ ID NO: 62765 - DNA, 201 bp, Homo sapiens
gctctgggaagacctttctaaggaggtgatgtgtgagttaagatctgaatggtaatctggagccagccagagtgaagatgtggttgaagagcacagtcccrggggagaagaaagcaaaggcagaggccaggggagagaaagcagcatggcctctctcaggggcattcatcttatctatgaagccctaagcgattcagaagt

SEQ ID NO: 62766 - DNA, 201 bp, Homo sapiens
tagcatctgctttatagggctgtggtgatggttacatgagtgcatggtatgccataggcactcaatatgtgtcagttatttcatgcttaagtgtgccaggmcctgaggaggaaacaaagttttgagaggttgagaatctgggatgcagaatggctctgctcctgatttgctacactacctgaagcctgtcccttgtcctct

SEQ ID NO: 62767 - DNA, 201 bp, Homo sapiens
ccccatagtgggccacgggggaccagagtcctgggaaagtcaaggctggacgaggccataagagagagacaggttttgtgggcccttatggattctgtggyttctcatctcatttttctactcttgagtctcagttcctctacctgtaaaatgaagggagggagggagatgtgtttgcacacaagctctaggtcctagagt

SEQ ID NO: 62768 - DNA, 201 bp, Homo sapiens
acttagatttttgttcaacaatttcttatcttccagacttgagcataattatctcctgagagataactcctctgacctcccagaactacctgttcaaaacmaaactttaaaaattatttaagccagccgggcacaatggctcatgcctgtaatcccggcactttgggaggcccaggtggtcagatcacttgaggtcagggg

SEQ ID NO: 62769 - DNA, 201 bp, Homo sapiens
ataaaatgggataggtcaggagtccttcacgtttattccagtcacatccccaaagccatacttccttatccctgagttgggtcgggctgtgagttatcccyggatcagcagttcccaaggtctgaaggaaatgctggacccttgtgggcagaagggggaactgtgtatacaggtggggagactcaggcctagagacaccag

SEQ ID NO: 62770 - DNA, 201 bp, Homo sapiens
ggaacagagctagggacctcttccttcaaactcacctcctttaggcggttcagctgtcatcccccgcaggtctggagggggataaaatgggataggtcagragtccttcacgtttattccagtcacatccccaaagccatacttccttatccctgagttgggtcgggctgtgagttatccccggatcagcagttcccaagg

SEQ ID NO: 62771 - DNA, 201 bp, Homo sapiens
gcggcaagaatgtctagcctgcccgcccgcatggccagccagtggcaagctgccgcccccactctccgggcaccgtctcctgcctgtgcgtccgcccaccrctgccctgtctgttgcgacaccctcccccccacatacacacgcagcgttttgataaattattggttttcaacgatcctgactcctctctgcgtctcctgg

SEQ ID NO: 62772 - DNA, 201 bp, Homo sapiens
ataggcacaacccactcactccagagtggggaaaaggctttgccaacacccagaactgggggcctgggtcccatgcggcctagcctgcacttactaagccrtggggcttgaaacaaatggctcctctgctctgtgactcagtttccttatctgtgaagggcagctagcattctgaaggatggccagaagggtggtcccccc

SEQ ID NO: 62773 - DNA, 201 bp, Homo sapiens
aaaaaaaaaaaaaaagtttgaccttcctcctgaggacaacaggagttataaagggtttccaaacagagaagggatggatatagcattctaggaccttcctyggatgaggcttggatgagagatgggatggactagatgactggaatagcttaagagctagagagacaggcttcccaatagatctggtttggagagggagag

SEQ ID NO: 62774 - DNA, 201 bp, Homo sapiens
tcctaacccctgctcggggccccacggtgagaaacgccgcctctcccacctgccccgtttcaccagaatctgctcagcaaggccagagagggtccagggakgcgggtgggggaagtaaggggggcatttagtcaagccagaggagccagacatagccctgtcttctggcagttcagggcccagcaggtgagaccattctaa

SEQ ID NO: 62775 - DNA, 201 bp, Homo sapiens
tagattccagaatcagtgatgaagtaacagggcctcttgggtggtgggcagggttcaaggccggatcccactcttggagtcccctccttgttgctctgtakgaggccctgagtcaatttctctaaatgagggaaggagtgatgaggcatgaccatagccttagctgggtggcgctgggcctctcagtagctctgtcccttg

SEQ ID NO: 62776 - DNA, 201 bp, Homo sapiens
acaggatcagaatccaggatgagaaccaaaggggtccagagactctgaatcagagagaccttgttcaagttctagttccgcccatcacgtcctctgaaatsttaggcaagttactgccagaggtctcagtttcctcacctttagtggaattggtaaggcccctccctgctcttgtgaagtttaaaatggcacacaggaaag

SEQ ID NO: 62777 - DNA, 201 bp, Homo sapiens
agtttcgtgaggcgctcggagagtaaggccacctggtgtcgccctgtgcctgcctgcctgtccgcccacctcctccggctcttccttgagctctctctccrtgtcttcaactgtgccgtcactttctcttctctgcctgcggctatcaccacccctccatacagcctcccatcccatctcctgatgtccagcccaggccct

SEQ ID NO: 62778 - DNA, 201 bp, Homo sapiens
ctgttaccaagactgagcggctcgtccactccagtaaggggccaaatggggccggcccagggctcagggtgggaacacatcctcccccagccccctgtgcmtttcacatccttctcatcccctgcccctgcagatgatggcacacggacggcccgcaccaccacagtggagtcgagtttcgtgaggcgctcggagagtaag

SEQ ID NO: 62779 - DNA, 201 bp, Homo sapiens
acatccaggaattctaccgctgtctggtccagaaggggctggtaaaaaccaaaaagtcctaacccctgctcggggccccacggtgagaaacgccgcctctmccacctgccccgtttcaccagaatctgctcagcaaggccagagagggtccagggaggcgggtgggggaagtaaggggggcatttagtcaagccagaggag

SEQ ID NO: 62780 - DNA, 201 bp, Homo sapiens
caacatgcagtgtcaacttggacaaatgacttcccctctctgagcctcagtttctttgcccataaaagggacagaacattagcatctgctttatagggctrtggtgatggttacatgagtgcatggtatgccataggcactcaatatgtgtcagttatttcatgcttaagtgtgccaggccctgaggaggaaacaaagttt

SEQ ID NO: 62781 - DNA, 201 bp, Homo sapiens
ctgggctttctctgaaggaccctgactgggtggagggttagccagggtgacttagggatgcaacacagacagcttggtaaaatagtcattctcagacttgrgctctggagcaaaatattacccctagcctctgagctgctccagccacttcccattctgcctttccagggttgaacctggaagaacctagagtagaccctt

SEQ ID NO: 62782 - DNA, 201 bp, Homo sapiens
ctggagtgcagtggctcaatcacagcctgaacctcccaggctcaagcaatcctcccacctcagcctcctgagtagctgggactacaggcatgcaccatcaygcccagctgattttttttttttttttttgagacggagtttcactctcattgtccaggctggacactctcatgtccagtggcatgatccggactcactgca

SEQ ID NO: 62783 - DNA, 201 bp, Homo sapiens
gactgacatttcccttctataaaacaggtgctggggctgggcatggtggctcacacctgtaatcccagcactttgggaggccaagaagggcggatcacctraggtcaggagttcaagactagcctggacaacatggtgaaatcctgtctctactaaaaatatgtaacttagccaggcgtggtggtgcacaccagtaatcct

SEQ ID NO: 62784 - DNA, 201 bp, Homo sapiens
aacctggaagaacctagagtagaccctttctgtgacagccccttgccctaggaaggcttgaagcagaccagtctaatcacctcattttacagggggcaggstgaggcccaggcctctctggtgcccacaagatacattcatcctgctcatctggcattcagaatccttggcaaagagaaccacccacatttcctgctccgc

SEQ ID NO: 62785 - DNA, 201 bp, Homo sapiens
gactcagctaccccctcactagatctagatacccctcctgacttagctactcatgcctatagaaaccctttttggatccatacccctttgagtttagctaytccgtattctctagtttctgcctgagtccatcaaacccttcccacactccattccctgtcaagttatggctgtcccctcaccccagctgctcctagagag

SEQ ID NO: 62786 - DNA, 201 bp, Homo sapiens
tagggagtagcgccccacagcccatatgagcaggcaggagcaggccaagcctgagggtcgggcctcagaggcctggcctggccgtatttagttttcaaggmactggaaggcttctcacctcctctgctgtccaggcacagaagcaaggccacccacagttgctgagtcagggaggcccctagggcaggaacagaggcccca

SEQ ID NO: 62787 - DNA, 201 bp, Homo sapiens
tccctgctgctcctctctccctgaagtccattgatggccatcttagcctctgccccatccagcttcccttttcctggacacaactacttcctcccccagayagttcttccctggacacatctattcattcccttagattctgggttcaattgcttctcctctcaaacactctcaattactcctctgaatctagctgcttct

SEQ ID NO: 62788 - DNA, 201 bp, Homo sapiens
gtcagtgccacaggggacctaactgcaaacccgttttacagaggggtgggctgggcacagtggctcttgcctgtaatcccagcactttgggaggccgaggygggcggatcacttgaggtcaggagttcaagaccagcctggccaacatggtaaaacctcatctctactaaaaatacaaaaattagccgggcgtggtggcag

SEQ ID NO: 62789 - DNA, 201 bp, Homo sapiens
  misc_feature (1)...(201): n = A,T,C or G, or insertion/deletion polymorphism (see Tables 1-2)
atgatgagtttcacccatacccctgcttaaagtccatgccctctccccaccctgcagatggaaccagagccagcagagcctctcgctgcagcagtggaagnggccaatggggctgagcagacccgagtgaacaaagcaccagaagggcggagccctctgagcgctgaggagctgatgactattgaggatgaaggagtcttg

SEQ ID NO: 62790 - DNA, 201 bp, Homo sapiens
gtcttctcactctagttacagacagggttcctccatgtggcagagaacatggtggctaatgttaccagaaaaactctgaactaggtacggtggcacgagcytgtagtcccagctacttgggaggctgaggtgggaggatcgcttgagcccaggagtttgagtccagtctgggcaacatagcgagtccctacctctaattgg

SEQ ID NO: 62791 - DNA, 201 bp, Homo sapiens
tgtattaatacaattcggggtacgtgggaagccctacaacaaaactgtcagtgcctcttccctgactgacgctgacatggccatctttgggcaggcaggckggcaggctagtggttatttccaaggcgtgccagcaaccctaggatctgcttccctatccattggagacatgatgagtttcacccatacccctgcttaaag

SEQ ID NO: 62792 - DNA, 201 bp, Homo sapiens
gagttaggctgccttcagctcagatcccaggctgcatcacacttagagagagactgtgggcaagtcagttagctgccctgagcctcagtttccccttctgkttttttttttttttttccggtcttgttttctttgcaacagggtcttactctcttgcccagactggagtgcagctgcgtgatcatagctctctgcagcctc

SEQ ID NO: 62793 - DNA, 201 bp, Homo sapiens
ccctgccaacgctccctgtcggtgctcagcccccgccaaccagcccagaaccgaggtactacctattctcaccctgcctaggatctgtgcagaccctgtcscacccagttgctgacagccctcctgttccttctagagtccaccccccttgccagcggaccttcctcattccagcgggctggctctgtgcgggatcgtgtc

SEQ ID NO: 62794 - DNA, 201 bp, Homo sapiens
agctgaggttccaggcagcccagagccaccccccagcccacccaagaccaccagccctgagcctcaggagtctccaacgctccccagcactgagggccagktggtcaacaaggtgagtctggatgaggggcagggatgccaggcaagtgagcaggtctgggagtcaggccttgctcaggccctgttcttctcccttgcagc

SEQ ID NO: 62795 - DNA, 201 bp, Homo sapiens
caccctggcttcttccatggtggctaggtccaggccagtgcagtggggacaatagccctcagccaggcaggactcctgagcacctgtcctcagtttccccrtctgtggatgaagcagtcaacccccagctgggctgtggtgtttggtgactagaccagggagcctcccttgctcagagggtggacttcatctgtcaccttt

SEQ ID NO: 62796 - DNA, 201 bp, Homo sapiens
gccgggcacaatggctcatgcctgtaatcccggcactttgggaggcccaggtggtcagatcacttgaggtcaggggttcaagaccagcctggccaacatcwtgaaaccccgtctctactaaaaatacaaaaattaaccgggtgtggtggcaggagcctgtaatcccagctacttgggaggctgaggcaggaggattgcttg

SEQ ID NO: 62797 - DNA, 201 bp, Homo sapiens
acaggcatctttcttcccctccccctgcctccctttccctgcctagaaaatgggctcttgtgcctggcagctctagcttcctcaggtccatgcagtccctsatactgcaccccacccctgaagtgtccccgcccccagctaggccagcctccccctccacccccatggctagaggcctcccctgcagccttgaaaggcaac

SEQ ID NO: 62798 - DNA, 201 bp, Homo sapiens
cagacccacactggaggcttatctctgccactatcttccaggggaaccctgggccagtcctctctcccttgagccacggaggatctgtatgtagcaggtgrctctacatggtggaggtgtgggggaggcaacaggattggctgactcactccagagaaggtgttctttcctgaacctggttagaccagtcacccccaattt

SEQ ID NO: 62799 - DNA, 201 bp, Homo sapiens
taatcccagctacttgggaggctgaggcaggaggattgcttgaacccgggaagcagaggttgcagtgagctgagatcacgccattgcactccagcctgggygacagagtgaaactctgtctcaaaaaaaaaaaaaaaaagaaaagaaaacgatttaagcctgagtgcagtggctcactcctgtaatcccaatactttggga

SEQ ID NO: 62800 - DNA, 201 bp, Homo sapiens
gggggtggggacagaggaaatcaccccgcctttactggctcccgtctggttatcagacccacactggaggcttatctctgccactatcttccaggggaacmctgggccagtcctctctcccttgagccacggaggatctgtatgtagcaggtggctctacatggtggaggtgtgggggaggcaacaggattggctgactca

SEQ ID NO: 62801 - DNA, 201 bp, Homo sapiens
cccaggctagagtgcaatggcatgatctcggttcagtgtagcctcaacctcctgagctcaagcgatcctcctgcctcagcttcccagagtagtgggattayaggcatgcaccactgttgattctttatagatgttaattctctgcttaacacacatgcccctccaactcccaccacacatacagacacagacacacataca

SEQ ID NO: 62802 - DNA, 201 bp, Homo sapiens
gctcaagcgatcctcctgcctcagcttcccagagtagtgggattacaggcatgcaccactgttgattctttatagatgttaattctctgcttaacacacaygcccctccaactcccaccacacatacagacacagacacacatacacacgcacgcacgcatgcacgcatgcacgccagccccacaacaggaggaatgtaac

SEQ ID NO: 62803 - DNA, 201 bp, Homo sapiens
attacaggcatgcaccactgttgattctttatagatgttaattctctgcttaacacacatgcccctccaactcccaccacacatacagacacagacacacatacacacgcacgcacgcatgcacgcatgcacgccagccccacaacaggaggaatgtaacggaagcaatgctttgtgttctgtaacctgtttccttttcct

SEQ ID NO: 62804 - DNA, 201 bp, Homo sapiens
ttacaggcatgcaccactgttgattctttatagatgttaattctctgcttaacacacatgcccctccaactcccaccacacatacagacacagacacacatacacacgcacgcacgcatgcacgcatgcacgccagccccacaacaggaggaatgtaacggaagcaatgctttgtgttctgtaacctgtttccttttcctg

SEQ ID NO: 62805 - DNA, 201 bp, Homo sapiens
ctccaagagggccaacccttacctagggttggagccaggggtaagacacccatcacccttcttgcctcctgacccaaggcctgggctttctctgaaggacmctgactgggtggagggttagccagggtgacttagggatgcaacacagacagcttggtaaaatagtcattctcagacttgagctctggagcaaaatattac

SEQ ID NO: 62806 - DNA, 201 bp, Homo sapiens
ctcccaccacacatacagacacagacacacatacacacgcacgcacgcatgcacgcatgcacgccagccccacaacaggaggaatgtaacggaagcaatgytttgtgttctgtaacctgtttccttttcctggacacacaggaaggtcatgttctcatttttcctgcagttagtagagtcacgtgactacataaaggccag

SEQ ID NO: 62807 - DNA, 201 bp, Homo sapiens
atacgtgacccctgcgcaaaggcagttaagtgtggatgtgcctcctttgattttctgattccctttccacatgcagaggattcaggaatagattccagggraagcctggggtggaggcaggattcgggggcaaggtcactgcttggaaaagagctccctgggagagccccaacctgtatcagactttgcaggggtgagaaa

SEQ ID NO: 62808 - DNA, 201 bp, Homo sapiens
gttaagtgtggatgtgcctcctttgattttctgattccctttccacatgcagaggattcaggaatagattccagggaaagcctggggtggaggcaggattsgggggcaaggtcactgcttggaaaagagctccctgggagagccccaacctgtatcagactttgcaggggtgagaaataaactctgattgggttaaaccac

SEQ ID NO: 62809 - DNA, 201 bp, Homo sapiens
tatcagactttgcaggggtgagaaataaactctgattgggttaaaccactgagatatttggtttgttacagcagtcagcattaattacactgaataaaacwgtgtatcagttatcaattgccacaacaatgctacataacaaaccaccccaaaacttagtgccttaaaacagcaaccgtttttttagctcaagatttcatg

SEQ ID NO: 62810 - DNA, 201 bp, Homo sapiens
caggcaggtgatgtgacttgccaaggctgcatagctagggagcagtgatgtccccaccgtactcaagtttgtctgtttccagaagctaaggtcttagcctytctacagttagaaagtcctaggtttgagtctcgactctgtccattatagctgtgtgaccttgggcaagtcacttttctctctgggcctcattttttttct

SEQ ID NO: 62811 - DNA, 201 bp, Homo sapiens
ctttcccctctccccatccaaaccccacttctcccttacccttcatacttcactcacgttggtcttccatcagtttctggagattgttcctgcctcgggayatttgcgtagtctgttccccttgcctggaacacccccacccccacgtcgagaccaacttagatttttgttcaacaatttcttatcttccagacttgagca

SEQ ID NO: 62812 - DNA, 201 bp, Homo sapiens
ctaaaaatccaaaatttagccgggcgtggtggtggacacctgtaatcccagctactcgggaggctgaggaaggagaatcacttgaacctgggaggcggagrttgcagtcagccaagaccgcgccattgcactctagcctgggtgacaagagtgaaactccatctcaaaaaaaaaaaaatgttttaaagggaccaagtcctt

SEQ ID NO: 62813 - DNA, 201 bp, Homo sapiens
ccttctataaaacaggtgctggggctgggcatggtggctcacacctgtaatcccagcactttgggaggccaagaagggcggatcacctgaggtcaggagtkcaagactagcctggacaacatggtgaaatcctgtctctactaaaaatatgtaacttagccaggcgtggtggtgcacaccagtaatcctagctactcacta

SEQ ID NO: 62814 - DNA, 201 bp, Homo sapiens
aggcggatttcttgaacccaggagttcgagactagccccggcaacatagggagacccttgtctctacaaaaaataaaaaaattagccaggcatggtggcaygtgtctgtagtcccactgtgagcctgggaggtcaaggctgcagtgagccatggttgtgccactccactccagcctgggcgacagagtgagactctgtctc

SEQ ID NO: 62815 - DNA, 201 bp, Homo sapiens
ggaaggtcaaggcaggcggatttcttgaacccaggagttcgagactagccccggcaacatagggagacccttgtctctacaaaaaataaaaaaattagccrggcatggtggcacgtgtctgtagtcccactgtgagcctgggaggtcaaggctgcagtgagccatggttgtgccactccactccagcctgggcgacagagt

SEQ ID NO: 62816 - DNA, 201 bp, Homo sapiens
cagagggaggctcccattttccagatggggacactgaagctccgggggttgtgctgtagaggtggccaagttcctacatcaggcttttgtcagagacaagsaccccatctccgagcccagagcactgagaatggggacctaggagacaaaaggctagcccttgcccctctgggcctctttaccctctgtacagaaggggct

SEQ ID NO: 62817 - DNA, 201 bp, Homo sapiens
gggagaatttcactgggcagtttcggaaaccgccccatccccttccccttccccctcggtagacaatggcgctttgtacttccttccctccctcccacagytccctccttacacagcggtggggcctgggcgggtggaactcgggacacacagaggagacactgtggtccaacctttgcctccaggcccaaagggaagggt

SEQ ID NO: 62818 - DNA, 201 bp, Homo sapiens
gcccccgctggcctcgtggcaagaacgggggcgtcccgagccgggctcctccccgcggggccgggccatataaggaaaagctaggcccgctccgcccgccmtgcgccccagcgtctggccgatttggggacgcgggcagtcgcttccggccccggctcccgcacattcttgaggattgggccggggatgggaggaatgggg

SEQ ID NO: 62819 - DNA, 201 bp, Homo sapiens
tacctgtaaaatgaagggagggagggagatgtgtttgcacacaagctctaggtcctagagttggcatggggacagaatgaggcatggacccagatctcagktggaggaaagatgagcccactccatcccctttcttgttcctcttcctgagagccctgtctacctccatgcacagaggccgtagggcaacccagtggggca

SEQ ID NO: 62820 - DNA, 201 bp, Homo sapiens
ggggccagccgggctgctggcgcggctggacgggcagctctccgcagaatccaggggacggttgctgagcgggcctgggacagcgggtcgcggcacctccsgcctgcgcgtgtctaatccgtctgtcgggtcccgaaagagctaagccgagcctgcgccggacgggtgggctggactgagaggtgggtgtgcggacctcgg

SEQ ID NO: 62821 - DNA, 201 bp, Homo sapiens
gaggcggggtttgcccccacctggccccgctccagaaggaggggttattatacgtctgattgaatcaacttccaggatccttattggtccttggtggtaaytagggcgctctcttccaggatccttattggtccttggtggtaattaggccactctcgcttcaaagtcccaaattcaggcgccccgctggggactagagcg

SEQ ID NO: 62822 - DNA, 201 bp, Homo sapiens
tggccgggcgcagtggctcacgcctgtaatcctagcactttggaaggtcaaggcaggcggatttcttgaacccaggagttcgagactagccccggcaacayagggagacccttgtctctacaaaaaataaaaaaattagccaggcatggtggcacgtgtctgtagtcccactgtgagcctgggaggtcaaggctgcagtga

SEQ ID NO: 62823 - DNA, 201 bp, Homo sapiens
gaaaccaggagtttgagaccagcctggacaacatggggaaactccatctctataaaaattagtcaggtgtggtggtgagtgcctgtagtcccagctactcrggaggctgaggtgagaggatcacctgagcccagacaggtcaaggctgtagtgtgccatgatcgcaccactgcactccagcttgggtgacagagatcctgt

SEQ ID NO: 62824 - DNA, 201 bp, Homo sapiens
gttttaaagggaccaagtccttttaggggagcttctgatcatttgaatctccaataacagaagaggttttcaaatgttaccccggggattcctcattgccygctcccagtattttccaagaaagacctgaggctcctttctgagcttcattcccttgttctcctcccagcccctcagctgtcttttgtaccaattaggtag

SEQ ID NO: 62825 - DNA, 201 bp, Homo sapiens
aaatgttctggccgggcgcagtggctcacgcctgtaatcctagcactttggaaggtcaaggcaggcggatttcttgaacccaggagttcgagactagcccyggcaacatagggagacccttgtctctacaaaaaataaaaaaattagccaggcatggtggcacgtgtctgtagtcccactgtgagcctgggaggtcaaggc

SEQ ID NO: 62826 - DNA, 201 bp, Homo sapiens
tcccagcactttgggaggccaagaagggcggatcacctgaggtcaggagttcaagactagcctggacaacatggtgaaatcctgtctctactaaaaatatrtaacttagccaggcgtggtggtgcacaccagtaatcctagctactcactactcgggaggctgaggcaagagaatcgcttgaacccaggaagcggaggttg

SEQ ID NO: 62827 - DNA, 201 bp, Homo sapiens
gtcaggggttcaagaccagcctggccaacatcatgaaaccccgtctctactaaaaatacaaaaattaaccgggtgtggtggcaggagcctgtaatcccagytacttgggaggctgaggcaggaggattgcttgaacccgggaagcagaggttgcagtgagctgagatcacgccattgcactccagcctgggtgacagagtg

SEQ ID NO: 62828 - DNA, 201 bp, Homo sapiens
cctagtgccagccaccttatatgtctgggggattggtcctcccactctgcaccctggcttcttccatggtggctaggtccaggccagtgcagtggggacartagccctcagccaggcaggactcctgagcacctgtcctcagtttccccatctgtggatgaagcagtcaacccccagctgggctgtggtgtttggtgacta

SEQ ID NO: 62829 - DNA, 201 bp, Homo sapiens
atatgtaacttagccaggcgtggtggtgcacaccagtaatcctagctactcactactcgggaggctgaggcaagagaatcgcttgaacccaggaagcggargttgcagtgagctgagattgtgccattgcactccagcctgggtgacaagagtgaaactgtctcaaaaaacaacaacaacaacaacaacaacaacaaaaca

SEQ ID NO: 62830 - DNA, 201 bp, Homo sapiens
caccattactgagttggttatgtacaagcctctgctaagcaccttacctgcattatcttatttaattgtcatcacaataaacaagtattattattgtcctyctgaaacaaagtacatgagaacggtgtctctcatccatgctgccgtaatttctaacccaagccgctgctcatgcagtcccatctacctggagtgtatctc

SEQ ID NO: 62831 - DNA, 201 bp, Homo sapiens
agaatcgcttgaacccaggaagcggaggttgcagtgagctgagattgtgccattgcactccagcctgggtgacaagagtgaaactgtctcaaaaaacaacaacaacaacaacaacaacaacaaaacacaggtgctggaagagaggagtcctaacgttgggggctattgtgagaattgactgagggaatgcaccgtggaaac

SEQ ID NO: 62832 - DNA, 201 bp, Homo sapiens
tgccattgcactccagcctgggtgacaagagtgaaactgtctcaaaaaacaacaacaacaacaacaacaacaacaaaacacaggtgctggaagagaggagycctaacgttgggggctattgtgagaattgactgagggaatgcaccgtggaaacgtgtgctgtaaattacctattttattacacccaaggtgggcttaata

SEQ ID NO: 62833 - DNA, 201 bp, Homo sapiens
gacacccatcacccttcttgcctcctgacccaaggcctgggctttctctgaaggaccctgactgggtggagggttagccagggtgacttagggatgcaacrcagacagcttggtaaaatagtcattctcagacttgagctctggagcaaaatattacccctagcctctgagctgctccagccacttcccattctgcctttc

SEQ ID NO: 62834 - DNA, 201 bp, Homo sapiens
gtggaaacgtgtgctgtaaattacctattttattacacccaaggtgggcttaatagctgtcagggagtgttagtattatctcaaccaaacccccaatttayagaggagaaaacaagagcctcaggcaggtgatgtgacttgccaaggctgcatagctagggagcagtgatgtccccaccgtactcaagtttgtctgtttcc

SEQ ID NO: 62835 - DNA, 201 bp, Homo sapiens
agagtgagactctgtctcaaaaacaaaacaaaacaaaaaaaaaacaacaaaagaacgagggttctgagcctgtctccttatctgtataatggtggtcctayctcacaggactcaagctgtgaaggtcatagtggtaacaaaattgccacacatgtagtataagcatgatcaggagccagtgtccaacccatcaggtagcaa

SEQ ID NO: 62836 - DNA, 201 bp, Homo sapiens
aggtggatcacctcagttcaggagttcaagaccagcctggccaacatgtcaaaaccccgtctctactgaaaatacaaaaattagccaggcgtggtgacggrcccttgtaatcccagctacttgggaggctgaggcaggagaatcacttgaagccgggaggcaggggttgcagtgagccaagattgcgccactgcactctag

SEQ ID NO: 62837 - DNA, 201 bp, Homo sapiens
aagttctgaaccctgttggaggccaatatgagaccatgggggaccccaggccccaactggcagtggctccaggcactgcctccgtgccatttggctattaytaggcccggcgtcctcatctcaaatccagatggggatcgagaagggcgggtagggcagggcctggctggcggaaggctgggaacacggcttggaggctgg

SEQ ID NO: 62838 - DNA, 201 bp, Homo sapiens
ttggctctgaggttgttgcagagcactccctcccaccgtggccgcctcctctgggaagatgcagagcccttctgcagcctcagcacttttctccctgcccyagagaggccaggcctgcgtggaaactctgaattggacactgcgtgccttcagaaccggcaaaggagccatccaccccgctgtctacaggtcttcatgcct

SEQ ID NO: 62839 - DNA, 201 bp, Homo sapiens
cctcctctgggaagatgcagagcccttctgcagcctcagcacttttctccctgccctagagaggccaggcctgcgtggaaactctgaattggacactgcgygccttcagaaccggcaaaggagccatccaccccgctgtctacaggtcttcatgcctccagtgaggcttactggatctgctgagggggaagggcctatata

SEQ ID NO: 62840 - DNA, 201 bp, Homo sapiens
gggtgaacaaactccctcaggcttcttttataagggcactaatcccatttataaggatggagcttcatgaagtgatcgcccccaaaagtcccacctcttartactaccacattgcagattacgtttcaatatataaattggaggagacacattgagacacatggatattggttgaataattatctttcttttttctttttt

SEQ ID NO: 62841 - DNA, 201 bp, Homo sapiens
gcgagggcattatcaaccttgtctggcactgccctcactccacctgatcctcctgacagccacctttctccccactcagaactgacactggggctgcgggygcccccgaccctactcagcaccagtagtgggggcaagagcaccatcacccgtgtcaacagccctgggaccctggctcggctgggcagtgtcactcatgtc

SEQ ID NO: 62842 - DNA, 201 bp, Homo sapiens
aggctggagtgcagtggctcaatcacagcctgaacctcccaggctcaagcaatcctcccacctcagcctcctgagtagctgggactacaggcatgcaccaycacgcccagctgattttttttttttttttttgagacggagtttcactctcattgtccaggctggacactctcatgtccagtggcatgatccggactcact

SEQ ID NO: 62843 - DNA, 201 bp, Homo sapiens
tgaactcctgggctcaagcaatcctcctgccttggcctcccaaagtgctgggattacaggcgtgcaccaccggcacccaaccattctacacccttttgtcrgacagagctgacaaaaagctcagaggcgggctgtgatggtcaaagtcacatagcaagacagggactccgaacgggaatttcctggttgggggaggatggg

SEQ ID NO: 62844 - DNA, 201 bp, Homo sapiens
ggttcaaatcccttcgctaccaccaacatgcagtgtcaacttggacaaatgacttcccctctctgagcctcagtttctttgcccataaaagggacagaacrttagcatctgctttatagggctgtggtgatggttacatgagtgcatggtatgccataggcactcaatatgtgtcagttatttcatgcttaagtgtgccag

SEQ ID NO: 62845 - DNA, 201 bp, Homo sapiens
tgttacagttttttgccctaggagggcctgaaggaggcgagtcaaaccccctcattttacagatgggcagactgaggcccaggtctccccagtgctcaggygtcatccaagtggagcttccaaatggtggatggtagaatatggtgattaagaacaaatgttctggccgggcgcagtggctcacgcctgtaatcctagcac

SEQ ID NO: 62846 - DNA, 201 bp, Homo sapiens
tctccccagtgctcaggcgtcatccaagtggagcttccaaatggtggatggtagaatatggtgattaagaacaaatgttctggccgggcgcagtggctcaygcctgtaatcctagcactttggaaggtcaaggcaggcggatttcttgaacccaggagttcgagactagccccggcaacatagggagacccttgtctctac

SEQ ID NO: 62847 - DNA, 201 bp, Homo sapiens
gcgcagtggctcacgcctgtaatcctagcactttggaaggtcaaggcaggcggatttcttgaacccaggagttcgagactagccccggcaacatagggagmcccttgtctctacaaaaaataaaaaaattagccaggcatggtggcacgtgtctgtagtcccactgtgagcctgggaggtcaaggctgcagtgagccatgg

SEQ ID NO: 62848 - DNA, 201 bp, Homo sapiens
aattagccaggcatggtggcacgtgtctgtagtcccactgtgagcctgggaggtcaaggctgcagtgagccatggttgtgccactccactccagcctgggygacagagtgagactctgtctcaaaaacaaaacaaaacaaaaaaaaaacaacaaaagaacgagggttctgagcctgtctccttatctgtataatggtggtc

SEQ ID NO: 62849 - DNA, 201 bp, Homo sapiens
agcagcgccagcggaggcaacaggaggctcatcgggacccggccgcagatgatgcgcaagctggaggcgaacctccgagtcgctgcgccacgtctgggccyccaggctggccccgcccccgccccggcccccactcccgctagaggcccagtcccgctggagaccacgcccccagcgctcggtctccgccccaggactccc

SEQ ID NO: 62850 - DNA, 201 bp, Homo sapiens
  misc_feature (1)...(201): n = A,T,C or G, or insertion/deletion polymorphism (see Tables 1-2)
aagtctaaagaggtccaggctggcacatccagaactctctccttcctgttccagccccttgcctctcctttgtctgtgaggctgggtctcctggaattcantgctgcccagtgggcatctgaggccccttctcctcctgcagggccagaagtttgcctggcactgttgcccagagaacacagcggctggatgacatcctgg

SEQ ID NO: 62851 - DNA, 201 bp, Homo sapiens
aggaggctcatcgggacccggccgcagatgatgcgcaagctggaggcgaacctccgagtcgctgcgccacgtctgggcctccaggctggccccgcccccgscccggcccccactcccgctagaggcccagtcccgctggagaccacgcccccagcgctcggtctccgccccaggactccccgccgttacctcccgctagct

SEQ ID NO: 62852 - DNA, 201 bp, Homo sapiens
acacagcggctggatgacatcctggagatgatggccttgccaaactggtttcccagcaggtcctcagtcccactccgagggctgctggccatgacctaggrcgcatccagttctgcacataaggaggaaggtcataccccttggatccagccaaccccaacaagaaccatccacctctaggggctccattctccagcctca

SEQ ID NO: 62853 - DNA, 201 bp, Homo sapiens
ggctcatcgggacccggccgcagatgatgcgcaagctggaggcgaacctccgagtcgctgcgccacgtctgggcctccaggctggccccgcccccgccccsgcccccactcccgctagaggcccagtcccgctggagaccacgcccccagcgctcggtctccgccccaggactccccgccgttacctcccgctagctcagg

SEQ ID NO: 62854 - DNA, 201 bp, Homo sapiens
gaccctttctgtgacagccccttgccctaggaaggcttgaagcagaccagtctaatcacctcattttacagggggcaggctgaggcccaggcctctctggygcccacaagatacattcatcctgctcatctggcattcagaatccttggcaaagagaaccacccacatttcctgctccgcccacagcctatcctcctcctt

SEQ ID NO: 62855 - DNA, 201 bp, Homo sapiens
ggcttgaagcagaccagtctaatcacctcattttacagggggcaggctgaggcccaggcctctctggtgcccacaagatacattcatcctgctcatctggyattcagaatccttggcaaagagaaccacccacatttcctgctccgcccacagcctatcctcctccttttcccagactattggtctttgctcacactgttc

SEQ ID NO: 62856 - DNA, 201 bp, Homo sapiens
actgagacctaccagcgtgtcttcttaccatccacagctactgctgagcagactttctgacctggggtgaggaaaggaatttgctattcaaaggtgggaaratgcaaggagggttacagctgataggccacaacagggtcttaaatcagctgggttaaatttatggagtcaggatttacttttttttttaatgtggctatc

SEQ ID NO: 62857 - DNA, 201 bp, Homo sapiens
tcagaatccttggcaaagagaaccacccacatttcctgctccgcccacagcctatcctcctccttttcccagactattggtctttgctcacactgttcctmtgccacaaatgccctttcatgcctttccccctcttctatgtgggatgaattttaaaaattagctgggcgtggtggtgtgtgcctgtagtcctagcctctt

SEQ ID NO: 62858 - DNA, 201 bp, Homo sapiens
gtctaactcccttatcctacttgccaagccttactgtgatgtcatttaataaattttggagacacaaggagcgcctcatagagatggacaatttccttcartagtctcctgctgtttttagagttgcctccaggtgcctgggcctgtgggtgttgggcaggagaaccttcctcctatggcagaaataagtgggagaagtag

SEQ ID NO: 62859 - DNA, 201 bp, Homo sapiens
tcactgcttggaaaagagctccctgggagagccccaacctgtatcagactttgcaggggtgagaaataaactctgattgggttaaaccactgagatatttkgtttgttacagcagtcagcattaattacactgaataaaacagtgtatcagttatcaattgccacaacaatgctacataacaaaccaccccaaaacttagt

SEQ ID NO: 62860 - DNA, 201 bp, Homo sapiens
aaatggtggatggtagaatatggtgattaagaacaaatgttctggccgggcgcagtggctcacgcctgtaatcctagcactttggaaggtcaaggcaggcrgatttcttgaacccaggagttcgagactagccccggcaacatagggagacccttgtctctacaaaaaataaaaaaattagccaggcatggtggcacgtgt

SEQ ID NO: 62861 - DNA, 201 bp, Homo sapiens
cgcagctcctggatacagaggacatggtgcggcttcgagagcctgactggaagtgcgtgtacacgtacatccaggaattctaccgctgtctggtccagaargggctggtaaaaaccaaaaagtcctaacccctgctcggggccccacggtgagaaacgccgcctctcccacctgccccgtttcaccagaatctgctcagca

SEQ ID NO: 62862 - DNA, 201 bp, Homo sapiens
ggtggatcacctgaagtcaggagtttgagaccaacgggccaatatggtgaaaccccatctctactaaaaatccaaaatttagccgggcgtggtggtggacrcctgtaatcccagctactcgggaggctgaggaaggagaatcacttgaacctgggaggcggaggttgcagtcagccaagaccgcgccattgcactctagcc

SEQ ID NO: 62863 - DNA, 201 bp, Homo sapiens
tgggatgcgctgaggcggaggaggggcggggtcagcaggctgggcctcgcctctggcctcgcccccagcccacctcccacggcctcacctctagttcctcstagcggcggcccagcagcacgagctcagggtcggccccagggaggtgtttcatcaccaggttgtgactggaggtggtgttaaggagcggggtggtgggca

SEQ ID NO: 62864 - DNA, 201 bp, Homo sapiens
tcctgacttagctactcatgcctatagaaaccctttttggatccatacccctttgagtttagctattccgtattctctagtttctgcctgagtccatcaamcccttcccacactccattccctgtcaagttatggctgtcccctcaccccagctgctcctagagaggcccttgttacctgtgtcattcatgtttctaacaa

SEQ ID NO: 62865 - DNA, 201 bp, Homo sapiens
tgggacacagggagtggacacaggccacacattgtgccctaggcagagccgtgggcagctggtgccagccctccgcccctggcagccaaaatgacctgccyctcgcacccactgcagctggaggtcacagcagatctggcagagcggcggcgcatccgctcagccatccgggaactgcagcggcaggagctggagcgcgag

SEQ ID NO: 62866 - DNA, 201 bp, Homo sapiens
aaaaaattaatcatttccgatcgtcagtgctgtgatggggagtaattacagtacagagtaattttggggagcttcagatacgtgctctgggaagacctttytaaggaggtgatgtgtgagttaagatctgaatggtaatctggagccagccagagtgaagatgtggttgaagagcacagtcccaggggagaagaaagcaaa

SEQ ID NO: 62867 - DNA, 201 bp, Homo sapiens
tccgcccacagcctatcctcctccttttcccagactattggtctttgctcacactgttcctctgccacaaatgccctttcatgcctttccccctcttctaygtgggatgaattttaaaaattagctgggcgtggtggtgtgtgcctgtagtcctagcctcttgggaggctgagatggaaggattgcttgagccaggagttt

SEQ ID NO: 62868 - DNA, 201 bp, Homo sapiens
ccgcccacagcctatcctcctccttttcccagactattggtctttgctcacactgttcctctgccacaaatgccctttcatgcctttccccctcttctatrtgggatgaattttaaaaattagctgggcgtggtggtgtgtgcctgtagtcctagcctcttgggaggctgagatggaaggattgcttgagccaggagtttg

SEQ ID NO: 62869 - DNA, 201 bp, Homo sapiens
tgagatggaaggattgcttgagccaggagtttgaggccatggtaagctgtgatcatgcgactgcactccagcctgtgggacacagcaagaccctgtctccaaaaaaaataaaataaaataaaaacaagtgtgacacacagtttatacaccacttccctaagaagtcttccagagcttcccccatcctagtggcagcaaagt

SEQ ID NO: 62870 - DNA, 201 bp, Homo sapiens; identical to SEQ ID NO: 12483

SEQ ID NO: 62871 - DNA, 201 bp, Homo sapiens
tcatttgagactcagtgtactcctctaaaatgcgtgtgatgaggacgcctccctccctggcaggcgtttgtggcagtggagatactagtgtgctacaagacccccccctcctcctcgcgagtggtggtccaggctggggagcagccctgctctccctgcctaacatgcgcctccccaacccctagcatcttcgaccgcgag

SEQ ID NO: 62872 - DNA, 201 bp, Homo sapiens
cctcagcctcccaggcgcgcaaggccatgattgagaagctggagaaggagggcgcggccgggtgagctgcagaagtgggctgggcagtggggggcggggcktgataggcagtggggggcggggcttgatagttggcccggcagaggcgggaagaccgcgcggctagatctgtggtgcaaaggcccgaaggtcatggaaggc

SEQ ID NO: 62873 - DNA, 201 bp, Homo sapiens
tgtgtgtgtgtgtatgtgtgtgtgtctctgtttcctcccctctctcttctctgcctcttccctctcttccccacccggggccctggcctcctgcccccgtmccccaccccttcccggccccctaccctccccaggacccatgcggactgcccgcagctcctggatacagaggacatggtgcggcttcgagagcctgactgg

SEQ ID NO: 62874 - DNA, 201 bp, Homo sapiens
cctactccctgttgttagaagaccggaggcggggtttgcccccacctggccccgctccagaaggaggggttattatacgtctgattgaatcaacttccagsatccttattggtccttggtggtaactagggcgctctcttccaggatccttattggtccttggtggtaattaggccactctcgcttcaaagtcccaaattc

SEQ ID NO: 62875 - DNA, 201 bp, Homo sapiens
taaaaaaaaagatttattggaagagggttttaccagaagattttttggattctgagggttatgtagtgactagggatcaaccaaacaaccactcttggcarggacagaaaacttcaagaacaggtggaatcagcccatttgcatgcactctctctctctcttctctctctctctcctcattctgtgtctctgcttctctct

SEQ ID NO: 62876 - DNA, 201 bp, Homo sapiens
ggtggagggggtgcggcttctgggagccactgagacctaccagcgtgtcttcttaccatccacagctactgctgagcagactttctgacctggggtgaggmaaggaatttgctattcaaaggtgggaagatgcaaggagggttacagctgataggccacaacagggtcttaaatcagctgggttaaatttatggagtcagg

SEQ ID NO: 62877 - DNA, 201 bp, Homo sapiens
cccgccctgaatcccctacagggctgagaggagggctctggaaaccttgaaaaggactttgtagactctgagctgggcaccctcaaaggcttggttaggarggagacaagagaaagaattaatccacttcccaccaaggaagccaagagctgaaggagaaatggtccgtgtcctcctccagggcctgcccctcagcatggt

SEQ ID NO: 62878 - DNA, 201 bp, Homo sapiens
agggctctggaaaccttgaaaaggactttgtagactctgagctgggcaccctcaaaggcttggttaggagggagacaagagaaagaattaatccacttccyaccaaggaagccaagagctgaaggagaaatggtccgtgtcctcctccagggcctgcccctcagcatggttcctccctttgttaggagggttaagaacttg

SEQ ID NO: 62879 - DNA, 201 bp, Homo sapiens
  misc_feature (1)...(201): n = A,T,C or G, or insertion/deletion polymorphism (see Tables 1-2)
ggttaggagggagacaagagaaagaattaatccacttcccaccaaggaagccaagagctgaaggagaaatggtccgtgtcctcctccagggcctgcccctnagcatggttcctccctttgttaggagggttaagaacttggccaagtctcagctccactcatctctggctgtatgttctttgtacttcccctctctgagtg

SEQ ID NO: 62880 - DNA, 201 bp, Homo sapiens
gtgttagccaggatgttcttgatctcctgatctcatgatccgcccgtctcagcctcccaaagtgctgggataacaggtgtgagccactgcgcctggcccatttttttttgtttttttgtttgtttgtttttttgagacagagtcttgctctgtcagccaggctggagtgcagtggcacgatctcagctcactgcaacctcc

SEQ ID NO: 62881 - DNA, 201 bp, Homo sapiens
gggtgggctggactgagaggtgggtgtgcggacctcgggggggatcctggtgctgccccaacgtgtccgggggtggaacccggatgtctagacaggagttstggaacgtccagacctgggagcccccacccatacgagaggtctaagccatgggataaagttatgagactgttgggggaagacgcccccggattcctaaga

SEQ ID NO: 62882 - DNA, 201 bp, Homo sapiens
tcttccatcagtttctggagattgttcctgcctcgggacatttgcgtagtctgttccccttgcctggaacacccccacccccacgtcgagaccaacttagwtttttgttcaacaatttcttatcttccagacttgagcataattatctcctgagagataactcctctgacctcccagaactacctgttcaaaacaaaactt

SEQ ID NO: 62883 - DNA, 201 bp, Homo sapiens
aaaatatgtaacttagccaggcgtggtggtgcacaccagtaatcctagctactcactactcgggaggctgaggcaagagaatcgcttgaacccaggaagcrgaggttgcagtgagctgagattgtgccattgcactccagcctgggtgacaagagtgaaactgtctcaaaaaacaacaacaacaacaacaacaacaacaaa

SEQ ID NO: 62884 - DNA, 201 bp, Homo sapiens
cacagcggctggatgacatcctggagatgatggccttgccaaactggtttcccagcaggtcctcagtcccactccgagggctgctggccatgacctaggaygcatccagttctgcacataaggaggaaggtcataccccttggatccagccaaccccaacaagaaccatccacctctaggggctccattctccagcctcac

SEQ ID NO: 62885 - DNA, 201 bp, Homo sapiens
gagagccaagagggggccccacccagaggaatcattacctggccagcacttcactgggatttcatgtcccagtaaagttttttcctaaattggggtacacrattgccaacatcttgttatttgtcaaagaatattaaaaggaaaaataaattgctactttctgctgttaccatcatctcataaaattcaataacaaggact

SEQ ID NO: 62886 - DNA, 201 bp, Homo sapiens
ggggatcctggtgctgccccaacgtgtccgggggtggaacccggatgtctagacaggagttctggaacgtccagacctgggagcccccacccatacgagargtctaagccatgggataaagttatgagactgttgggggaagacgcccccggattcctaagagactccacgccccacaggggcgctagtctgtggcggcag

SEQ ID NO: 62887 - DNA, 201 bp, Homo sapiens
agtcaccatacattaactaagcatccacagtgtgccagaccagggcccctcaaattccagacagacattagttggggctacaggaggaaggagagatctgygctgggaggctgggccaggatttaggggtccattttgatgggcagcactggggcaagatggggctcttgcctctgtcactgagagtgttccaggcccttg

SEQ ID NO: 62888 - DNA, 201 bp, Homo sapiens
tgtctggcactgccctcactccacctgatcctcctgacagccacctttctccccactcagaactgacactggggctgcgggcgcccccgaccctactcagyaccagtagtgggggcaagagcaccatcacccgtgtcaacagccctgggaccctggctcggctgggcagtgtcactcatgtcaccagcttcagccatgccc

SEQ ID NO: 62889 - DNA, 201 bp, Homo sapiens
acagcggctggatgacatcctggagatgatggccttgccaaactggtttcccagcaggtcctcagtcccactccgagggctgctggccatgacctaggackcatccagttctgcacataaggaggaaggtcataccccttggatccagccaaccccaacaagaaccatccacctctaggggctccattctccagcctcacc

SEQ ID NO: 62890 - DNA, 201 bp, Homo sapiens
ctggcctacatatcacctatcagagcctttgttttctttatttgtaaaaacaacaacaaaaatggcggtaaaaacaagcaccattactgagttggttatgyacaagcctctgctaagcaccttacctgcattatcttatttaattgtcatcacaataaacaagtattattattgtcctcctgaaacaaagtacatgagaac

SEQ ID NO: 62891 - DNA, 201 bp, Homo sapiens
attgtcatcacaataaacaagtattattattgtcctcctgaaacaaagtacatgagaacggtgtctctcatccatgctgccgtaatttctaacccaagccsctgctcatgcagtcccatctacctggagtgtatctcttttttttttgagacggagtcttgctctgtctccagctggagtgcagtggtgcaatctttgctc

SEQ ID NO: 62892 - DNA, 201 bp, Homo sapiens
ttgcccgctcccagtattttccaagaaagacctgaggctcctttctgagcttcattcccttgttctcctcccagcccctcagctgtcttttgtaccaattrggtagttattaattgctccctaattgcaaattggctgcctccttactggctcccacccatgctggctggctgaccaaggggtcacatgcatccttcaggg

SEQ ID NO: 62893 - DNA, 201 bp, Homo sapiens
aattggctgcctccttactggctcccacccatgctggctggctgaccaaggggtcacatgcatccttcagggaaaggtgttttgtgaatccagtggttcakttgttccacacgtgtgttgagccccttcgttgacgccagatcctttctaggtcctggggaccgtgttgagcgagacaaacccaagtccctggcttctcag

SEQ ID NO: 62894 - DNA, 201 bp, Homo sapiens
ccttcagggaaaggtgttttgtgaatccagtggttcatttgttccacacgtgtgttgagccccttcgttgacgccagatcctttctaggtcctggggaccstgttgagcgagacaaacccaagtccctggcttctcagagctcacagtctagcaggagacaaacaacaaaaaaattaatcatttccgatcgtcagtgctgt

SEQ ID NO: 62895 - DNA, 201 bp, Homo sapiens
gagtgaagatgtggttgaagagcacagtcccaggggagaagaaagcaaaggcagaggccaggggagagaaagcagcatggcctctctcaggggcattcatyttatctatgaagccctaagcgattcagaagtcaaacatcaggttggggctagttgtaaggtttagggcaaaacacccctcctactccctgttgttagaag

SEQ ID NO: 62896 - DNA, 201 bp, Homo sapiens
gtgaagatgtggttgaagagcacagtcccaggggagaagaaagcaaaggcagaggccaggggagagaaagcagcatggcctctctcaggggcattcatctyatctatgaagccctaagcgattcagaagtcaaacatcaggttggggctagttgtaaggtttagggcaaaacacccctcctactccctgttgttagaagac

SEQ ID NO: 62897 - DNA, 201 bp, Homo sapiens
agcacagtcccaggggagaagaaagcaaaggcagaggccaggggagagaaagcagcatggcctctctcaggggcattcatcttatctatgaagccctaagsgattcagaagtcaaacatcaggttggggctagttgtaaggtttagggcaaaacacccctcctactccctgttgttagaagaccggaggcggggtttgccc

SEQ ID NO: 62898 - DNA, 201 bp, Homo sapiens
gtcccaggggagaagaaagcaaaggcagaggccaggggagagaaagcagcatggcctctctcaggggcattcatcttatctatgaagccctaagcgattcwgaagtcaaacatcaggttggggctagttgtaaggtttagggcaaaacacccctcctactccctgttgttagaagaccggaggcggggtttgcccccacct

SEQ ID NO: 62899 - DNA, 201 bp, Homo sapiens
aggcagaggccaggggagagaaagcagcatggcctctctcaggggcattcatcttatctatgaagccctaagcgattcagaagtcaaacatcaggttgggsctagttgtaaggtttagggcaaaacacccctcctactccctgttgttagaagaccggaggcggggtttgcccccacctggccccgctccagaaggagggg

SEQ ID NO: 62900 - DNA, 201 bp, Homo sapiens
agaccggaggcggggtttgcccccacctggccccgctccagaaggaggggttattatacgtctgattgaatcaacttccaggatccttattggtccttggwggtaactagggcgctctcttccaggatccttattggtccttggtggtaattaggccactctcgcttcaaagtcccaaattcaggcgccccgctggggact

SEQ ID NO: 62901 - DNA, 201 bp, Homo sapiens
ctcctttgtctgtgaggctgggtctcctggaattcactgctgcccagtgggcatctgaggccccttctcctcctgcagggccagaagtttgcctggcactrttgcccagagaacacagcggctggatgacatcctggagatgatggccttgccaaactggtttcccagcaggtcctcagtcccactccgagggctgctggc

SEQ ID NO: 62902 - DNA, 201 bp, Homo sapiens
  misc_feature (1)...(201): n = A,T,C or G, or insertion/deletion polymorphism (see Tables 1-2)
tgggtctcctggaattcactgctgcccagtgggcatctgaggccccttctcctcctgcagggccagaagtttgcctggcactgttgcccagagaacacagnggctggatgacatcctggagatgatggccttgccaaactggtttcccagcaggtcctcagtcccactccgagggctgctggccatgacctaggacgcatc

SEQ ID NO: 62903 - DNA, 201 bp, Homo sapiens
tcactgctgcccagtgggcatctgaggccccttctcctcctgcagggccagaagtttgcctggcactgttgcccagagaacacagcggctggatgacatcvtggagatgatggccttgccaaactggtttcccagcaggtcctcagtcccactccgagggctgctggccatgacctaggacgcatccagttctgcacataa

SEQ ID NO: 62904 - DNA, 201 bp, Homo sapiens
tcctcctgcagggccagaagtttgcctggcactgttgcccagagaacacagcggctggatgacatcctggagatgatggccttgccaaactggtttcccarcaggtcctcagtcccactccgagggctgctggccatgacctaggacgcatccagttctgcacataaggaggaaggtcataccccttggatccagccaacc

SEQ ID NO: 62905 - DNA, 201 bp, Homo sapiens
agacacccatcacccttcttgcctcctgacccaaggcctgggctttctctgaaggaccctgactgggtggagggttagccagggtgacttagggatgcaayacagacagcttggtaaaatagtcattctcagacttgagctctggagcaaaatattacccctagcctctgagctgctccagccacttcccattctgccttt

SEQ ID NO: 62906 - DNA, 201 bp, Homo sapiens
gcaattacatagtgtcccaccatgagcctagacccccactccctgcgcccaggcatcagggactcccagaagtctaaagaggtccaggctggcacatccaraactctctccttcctgttccagccccttgcctctcctttgtctgtgaggctgggtctcctggaattcactgctgcccagtgggcatctgaggccccttct

SEQ ID NO: 62907 - DNA, 201 bp, Homo sapiens
agacagcttggtaaaatagtcattctcagacttgagctctggagcaaaatattacccctagcctctgagctgctccagccacttcccattctgcctttccrgggttgaacctggaagaacctagagtagaccctttctgtgacagccccttgccctaggaaggcttgaagcagaccagtctaatcacctcattttacaggg

SEQ ID NO: 62908 - DNA, 201 bp, Homo sapiens
gacgaaagccttcacctggggaggaaccagagcatcagagaccatgacctcagtctactcgaggtacagacgagacactgaagcccagtgaggtcataaarcaagtcaggtgcaggctagactctcagcctaggctagactctcagcctagggatccttcccccctccccgccccagtcattgggaccatgttgcccactc

SEQ ID NO: 62909 - DNA, 201 bp, Homo sapiens
agccagatccggtgggctgggggttggcagaggccagcaggcaccaggtaggcaatgatgggctctatatgcagctggatcagagcacggactttgaagarcggaagctcatccgggctgcacttcgtgagctccgacaaaggaagagaggtagagagccagttgccctaccctagatccagctgccccattccccagctg

SEQ ID NO: 62910 - DNA, 201 bp, Homo sapiens
gactacttcagccagctgagcaacaatgccaaggaggccgtggaacatctccagaaatctgaactcacccagcaactcaagtaagagggactacagtgtgyggtggtgacggggaattcttaaaggccatgcaatgtactggcaagggttgagcttagagacaggagccctgagcttaggatacccactgccctgccacta

SEQ ID NO: 62911 - DNA, 201 bp, Homo sapiens
ggtgctgaaaaggaaatgagatagagaagtacaaagcagcgggtccacggagggactcacacctccctctccctcctaacgctgtgcccttcccagacagmagagtctgcaggcagaaggagcctctaacataaaaaatagagctctggcagcaagctgtcctctcagaagtaactaacaccacagtatgaaatcagaggc

SEQ ID NO: 62912 - DNA, 201 bp, Homo sapiens
tgtaaatgccaaatgtaacgtggcctccttgtgcccttccccacagtgccctcttccaggacaaacttggagaagtgaacacttacgcaggtgacctgcakaagaagctggtgccctttgccaccgagctgcatgaacgcctggccaaggactcggagaaactgaaggaggagattgggaaggagctggaggagctgaggg

SEQ ID NO: 62913 - DNA, 201 bp, Homo sapiens
cctagcacgtgtgcataaggcgagtggtatacaagcagacaaagtcttgccgtgtaaatgccaaatgtaacgtggcctccttgtgcccttccccacagtgmcctcttccaggacaaacttggagaagtgaacacttacgcaggtgacctgcagaagaagctggtgccctttgccaccgagctgcatgaacgcctggccaag

SEQ ID NO: 62914 - DNA, 201 bp, Homo sapiens
gagcctcaattttctgaggataaaatggggctggaatactgatttcccagagtggtgctgaaaaggaaatgagatagagaagtacaaagcagcgggtccayggagggactcacacctccctctccctcctaacgctgtgcccttcccagacagcagagtctgcaggcagaaggagcctctaacataaaaaatagagctctg

SEQ ID NO: 62915 - DNA, 201 bp, Homo sapiens
atctcagagcctcaattttctgaggataaaatggggctggaatactgatttcccagagtggtgctgaaaaggaaatgagatagagaagtacaaagcagcgkgtccacggagggactcacacctccctctccctcctaacgctgtgcccttcccagacagcagagtctgcaggcagaaggagcctctaacataaaaaataga

SEQ ID NO: 62916 - DNA, 201 bp, Homo sapiens
aataatccctgccatgtccttttgctttgacgttctagagtttgacaaatggccacatcctatcattcaggctcatggaagagagggagggaggaaaatgycacgtgagctgatttctaatacgtttcagaaagacaggccccagtggaatcaaggggagggaggtgggaatatttgggaggcccctgggcacaggcaagg

SEQ ID NO: 62917 - DNA, 201 bp, Homo sapiens
gcacaggcaaggaaagcagcaccttgtgccactggaagaccccagcagaggtcaagaagacaacattgtgttacacaatgtgatcctatggcccagaacaytccctctgggaaggacctcaaagtcccaccctctgcagacaaggaggggaaagcaaactgctggaggtgacatggtgggtagattctgagacaaactatg

SEQ ID NO: 62918 - DNA, 201 bp, Homo sapiens
aaaacaaatccatctacagattgatgcaaaacgtaccctcagactttgggaagtaaatacattcattaacaggtcacatccccgccacgttgaaaggcagsaggtcccctcgcgagcgtgggtgcacgcatgggctgtgccagtcccttggttcttagtgatttgcacacttctgtgaatccacacacactctggtggatg

SEQ ID NO: 62919 - DNA, 201 bp, Homo sapiens; identical to SEQ ID NO: 12555

SEQ ID NO: 62920 - DNA, 201 bp, Homo sapiens; identical to SEQ ID NO: 12534

SEQ ID NO: 62921 - DNA, 201 bp, Homo sapiens
acacacacatcactttgattgacacaccccacacaccccttccctcttagggatgtttctcttgctttgggccttggaagacacaccctcatctctggccygttccagttggtcaattggtttgtctgagatacacttattagtcctcattagggttggtcccatcttccaaggaaagcagccttcctcctgttctgagct

SEQ ID NO: 62922 - DNA, 201 bp, Homo sapiens
taactttgcttttggctgctgcagtgaactgaatgtttgcgtccccctaaattcctatgttgcaattctaatctgtaaggtgatggcattaggagagaagrcatttgggaggtgatcaggtcatgaagggggagccctcatgaatgagattagtgtccttataaaagaggccccacagaaatcccttgccccttccacgtg

SEQ ID NO: 62923 - DNA, 201 bp, Homo sapiens
cttcttttggaagacatgggtaatgacaatcctctgcttagagaggagttgtgctgaaggtttgatggagcaacggagtcaagcacttaacatcaggcacrgaataaccgtgcaatagctggtgctgcagtaaatgtgacttcctcatcccgctcacctccaggccacactctattaatgagaccgccacagctggccaag

SEQ ID NO: 62924 - DNA, 201 bp, Homo sapiens
tcatcagcacagccagctgtgggcagctgcagccttggagtggtctttcaccccacccttagagactcgaaaacctcacaaggaaagagccagttcaagcrtttgtctcaaacgactccacagcctgttacccgtggaccccagccctgcgagtctagccacctccctttcctcgccacagggggatgcaggcccttcagg

SEQ ID NO: 62925 - DNA, 201 bp, Homo sapiens
gctgtgggagcaactgggaggaacaaggtctggtgaggagagggcacagaggagttctgcggggagtcggtggtccaggaggggccgctgacccttctcgrggctgagatgtcccctgggcccacagtgaagccgcagcagggatggcaggatgagggcgcctgtcttccagatgctgacaccttggagccaggacatctt

SEQ ID NO: 62926 - DNA, 201 bp, Homo sapiens
gcagagcaggtgctggagcctgcggggccctggtctgctctgtccaggggcctcctgccaggtggcctgccagtttggggctgagtttgcagccactgggrttaggggcagagagtcagggggcctgagcagtctcatcagcacagccagctgtgggcagctgcagccttggagtggtctttcaccccacccttagagact

SEQ ID NO: 62927 - DNA, 201 bp, Homo sapiens
gtgattatgcatgcagcctcatttagagatccaatagacatctaagtagaagacctcctgggcaccaccaccattgccctccatcccccaatgggaggtcycctgagagcctcaggtcccaagattctgctcaagccagctgctcctgcccagggagtgtggctggggggcaagaagggcaggagtcaggcctcaggctgg

SEQ ID NO: 62928 - DNA, 201 bp, Homo sapiens
attttttttttttttttttttttttttaccagcgctttgggaggccgaggcgggtggatcacttgaggtcaggagttcaagaccagcctggccaacatggygaaaccccctcctctattaaaaatacaaaaattggctgggctttgtggtgcgtgcttgcaatctcagctactagggaggctgaggcaggagaatcgcctg

SEQ ID NO: 62929 - DNA, 201 bp, Homo sapiens
gctgggggaagagcagccctcactgccccctggctgtgggagcaactgggaggaacaaggtctggtgaggagagggcacagaggagttctgcggggagtcrgtggtccaggaggggccgctgacccttctcggggctgagatgtcccctgggcccacagtgaagccgcagcagggatggcaggatgagggcgcctgtcttc

SEQ ID NO: 62930 - DNA, 201 bp, Homo sapiens
atagaaattcagcatcgtaacttagtctgtgacacccatcctctccaatctgcaccaccatagggagggtgaactcggtacctctgagcactcacctgtcytagcacgtgtgcataaggcgagtggtatacaagcagacaaagtcttgccgtgtaaatgccaaatgtaacgtggcctccttgtgcccttccccacagtgcc

SEQ ID NO: 62931 - DNA, 201 bp, Homo sapiens
tggagactggggggacctgtcttcactggggtagacagaggagatgtggactttgccccccatgagcccggcacaaacccagagccgccagcagggcctcraggcatcagtcccgggctcatgggctccctgaggtgtttctcctactgttttccgttcccctcctcccttccatgctgaggttggtggggtgggggtggg

SEQ ID NO: 62932 - DNA, 201 bp, Homo sapiens
ggctgggggaagagcagccctcactgccccctggctgtgggagcaactgggaggaacaaggtctggtgaggagagggcacagaggagttctgcggggagtyggtggtccaggaggggccgctgacccttctcggggctgagatgtcccctgggcccacagtgaagccgcagcagggatggcaggatgagggcgcctgtctt

SEQ ID NO: 62933 - DNA, 201 bp, Homo sapiens
aatccctgccatgtccttttgctttgacgttctagagtttgacaaatggccacatcctatcattcaggctcatggaagagagggagggaggaaaatgtcaygtgagctgatttctaatacgtttcagaaagacaggccccagtggaatcaaggggagggaggtgggaatatttgggaggcccctgggcacaggcaaggaaa

SEQ ID NO: 62934 - DNA, 201 bp, Homo sapiens
cctgccactaactggccgggcctctgaacctaggatccacatatgtaaaccggaagtttggaccgaataatccctgccatgtccttttgctttgacgttcyagagtttgacaaatggccacatcctatcattcaggctcatggaagagagggagggaggaaaatgtcacgtgagctgatttctaatacgtttcagaaagac

SEQ ID NO: 62935 - DNA, 201 bp, Homo sapiens
atacagtataacaaccattcacacagcacttccgtcgtattaggtattataagtaatctagagatttaaagtatgtgggaggctgtgcttaggttatatgyaaatactatgccattttatatcaaggacttgaacatccatggattttggtatctgcagagggtcctggaatcaatttcccatggagactgagagatgacc

SEQ ID NO: 62936 - DNA, 201 bp, Homo sapiens
gcaagggttgagcttagagacaggagccctgagcttaggatacccactgccctgccactaactggccgggcctctgaacctaggatccacatatgtaaacyggaagtttggaccgaataatccctgccatgtccttttgctttgacgttctagagtttgacaaatggccacatcctatcattcaggctcatggaagagagg

SEQ ID NO: 62937 - DNA, 201 bp, Homo sapiens
aaaagtccaagaggcctcttgggaatgtgtcaccttccagcgtggagtcacactgaggaaggaggaggggagggcagccaggggggtggcgatagggagasagtttaaatgtctggctggctctgagcttcagtcagttcccactgcagcgcaggtgagctctcctgaggacctctctgtcagctcccctgattgtaggga

SEQ ID NO: 62938 - DNA, 201 bp, Homo sapiens; identical to SEQ ID NO: 12540

SEQ ID NO: 62939 - DNA, 201 bp, Homo sapiens
ctgccctgccactaactggccgggcctctgaacctaggatccacatatgtaaaccggaagtttggaccgaataatccctgccatgtccttttgctttgacrttctagagtttgacaaatggccacatcctatcattcaggctcatggaagagagggagggaggaaaatgtcacgtgagctgatttctaatacgtttcagaa

SEQ ID NO: 62940 - DNA, 201 bp, Homo sapiens
agctggagcagaggggccacacaggagacggggcctcatgaattgctctctgttaccacccaggagccagggctgaggtcagtgctgaccaggtggccacrgtgatgtgggactacttcagccagctgagcaacaatgccaaggaggccgtggaacatctccagaaatctgaactcacccagcaactcaagtaagagggac

SEQ ID NO: 62941 - DNA, 201 bp, Homo sapiens
cctccttgtgcccttccccacagtgccctcttccaggacaaacttggagaagtgaacacttacgcaggtgacctgcagaagaagctggtgccctttgccaycgagctgcatgaacgcctggccaaggactcggagaaactgaaggaggagattgggaaggagctggaggagctgagggcccggctgctgccccatgccaat

SEQ ID NO: 62942 - DNA, 201 bp, Homo sapiens
tcgtgccactgcactccagcctgggtgacagagcaagactccatctcaaaaaaaaaaaaaaaaaatatatatatatatatatatatatatatttttttttwaattgcatctgtgggccgggtgcagtggctcatgcctgtaagcccagcattttaggaggcagagattggaggatcacttaaggccaggagttggagacca

SEQ ID NO: 62943 - DNA, 201 bp, Homo sapiens
atcgtgccactgcactccagcctgggtgacagagcaagactccatctcaaaaaaaaaaaaaaaaaatatatatatatatatatatatatatatttttttttaaattgcatctgtgggccgggtgcagtggctcatgcctgtaagcccagcattttaggaggcagagattggaggatcacttaaggccaggagttggagacc

SEQ ID NO: 62944 - DNA, 201 bp, Homo sapiens
cactgaggaaggaggaggggagggcagccaggggggtggcgatagggagagagtttaaatgtctggctggctctgagcttcagtcagttcccactgcagcrcaggtgagctctcctgaggacctctctgtcagctcccctgattgtagggaggatccagtgtggcaagaaactcctccagcccagcaagcagctcaggatg

SEQ ID NO: 62945 - DNA, 201 bp, Homo sapiens
gatcgtgccactgcactccagcctgggtgacagagcaagactccatctcaaaaaaaaaaaaaaaaaatatatatatatatatatatatatatatttttttttaaattgcatctgtgggccgggtgcagtggctcatgcctgtaagcccagcattttaggaggcagagattggaggatcacttaaggccaggagttggagac

SEQ ID NO: 62946 - DNA, 201 bp, Homo sapiens
gctttgacgttctagagtttgacaaatggccacatcctatcattcaggctcatggaagagagggagggaggaaaatgtcacgtgagctgatttctaatacrtttcagaaagacaggccccagtggaatcaaggggagggaggtgggaatatttgggaggcccctgggcacaggcaaggaaagcagcaccttgtgccactgg

SEQ ID NO: 62947 - DNA, 201 bp, Homo sapiens
ctctggacccactgataacatcccctgggggaggagctggtctcatgtctggggccctccccagcccccaccaggactgattctctcgttcaccttcctgrgttcctcagtggggctgggggaagagcagccctcactgccccctggctgtgggagcaactgggaggaacaaggtctggtgaggagagggcacagaggagt

SEQ ID NO: 62948 - DNA, 201 bp, Homo sapiens; identical to SEQ ID NO: 12549

SEQ ID NO: 62949 - DNA, 201 bp, Homo sapiens
agccgagatcgtgccactgcactccagcctgggtgacagagcaagactccatctcaaaaaaaaaaaaaaaaaatatatatatatatatatatatatatatwtttttttaaattgcatctgtgggccgggtgcagtggctcatgcctgtaagcccagcattttaggaggcagagattggaggatcacttaaggccaggagtt

SEQ ID NO: 62950 - DNA, 201 bp, Homo sapiens
tgagccgagatcgtgccactgcactccagcctgggtgacagagcaagactccatctcaaaaaaaaaaaaaaaaaatatatatatatatatatatatatatwtttttttttaaattgcatctgtgggccgggtgcagtggctcatgcctgtaagcccagcattttaggaggcagagattggaggatcacttaaggccaggag

SEQ ID NO: 62951 - DNA, 201 bp, Homo sapiens
aacactccctctgggaaggacctcaaagtcccaccctctgcagacaaggaggggaaagcaaactgctggaggtgacatggtgggtagattctgagacaaastatgtgggagatcctgagatagaaattcagcatcgtaacttagtctgtgacacccatcctctccaatctgcaccaccatagggagggtgaactcggtacc

SEQ ID NO: 62952 - DNA, 201 bp, Homo sapiens
tagacagaggagatgtggactttgccccccatgagcccggcacaaacccagagccgccagcagggcctcgaggcatcagtcccgggctcatgggctccctsaggtgtttctcctactgttttccgttcccctcctcccttccatgctgaggttggtggggtgggggtgggggtgcccacgcacggaacagccaccacttct

SEQ ID NO: 62953 - DNA, 201 bp, Homo sapiens; identical to SEQ ID NO: 12557

SEQ ID NO: 62954 - DNA, 201 bp, Homo sapiens
tcctactgttttccgttcccctcctcccttccatgctgaggttggtggggtgggggtgggggtgcccacgcacggaacagccaccacttctaactatcgcytgagccctgatctgctgtcagcttccacgtagtctcagggtcacaaaagtccaagaggcctcttgggaatgtgtcaccttccagcgtggagtcacactga

SEQ ID NO: 62955 - DNA, 201 bp, Homo sapiens
gggcaacatggcgaaacccagtctctactaaaaatacaaaaaattagccgagcatggtgatgcacgcctgtagtcccagctactcaggaggctgaggcackagaattgcttgaaccccggaggtggaggttgcagtgagcagagatcgcaccattgcactccagtgacagagctagacttggtctaaaaaagagagagaga

SEQ ID NO: 62956 - DNA, 201 bp, Homo sapiens; identical to SEQ ID NO: 12558

SEQ ID NO: 62957 - DNA, 201 bp, Homo sapiens
agagaggttatgagacttgcccaaggacacacaggcagtacgtgttggagcctggatgccaagccagggagtggactccagcatctgaccccaacaatcayagagagatggcacaggctgcatcaaaaaggaggcagcatggtagcgtggggaccactacagggcagtggggacccagcagaaggggtgccagagtcagga

SEQ ID NO: 62958 - DNA, 201 bp, Homo sapiens
actcaagtaagagggactacagtgtgcggtggtgacggggaattcttaaaggccatgcaatgtactggcaagggttgagcttagagacaggagccctgagmttaggatacccactgccctgccactaactggccgggcctctgaacctaggatccacatatgtaaaccggaagtttggaccgaataatccctgccatgtcc

SEQ ID NO: 62959 - DNA, 201 bp, Homo sapiens
gtggctggggggcaagaagggcaggagtcaggcctcaggctggtcccacccatcaccctgcctctggcccacctggcgcccctcagagggctgagtctcaytctgccactctcactagaggagggagcactctgctaccctccctgctttgctccaaatcaggaacacagtatgattattatacagtatgattattataat

SEQ ID NO: 62960 - DNA, 201 bp, Homo sapiens
aaatgtagctcactgttgtcaggcactgcactcaccgacaggagccaatagtgcaacgtgcctggatgtcacctcatagtcactaggagtggtgtggtccrgcagagggacccatgctgacgtggtgtgtcaccttctcagtggatgtttgtgtgtgattatgcatgcagcctcatttagagatccaatagacatctaagt

SEQ ID NO: 62961 - DNA, 201 bp, Homo sapiens
gagaggttatgagacttgcccaaggacacacaggcagtacgtgttggagcctggatgccaagccagggagtggactccagcatctgaccccaacaatcacrgagagatggcacaggctgcatcaaaaaggaggcagcatggtagcgtggggaccactacagggcagtggggacccagcagaaggggtgccagagtcaggag

SEQ ID NO: 62962 - DNA, 201 bp, Homo sapiens
tagccccagaggcaaaggcacagtggggacccagatccaggcaggggcaggcaacaaggtctatgggcccgggtgtgctagaatgggctggcggggtcccrtggccccagaccctccaagcctttccatctctgcagagggtctggaggagcctggcctctctctcccgcatggcaacggacccagggaggtcaggacatg

SEQ ID NO: 62963 - DNA, 201 bp, Homo sapiens
ggtagattctgagacaaactatgtgggagatcctgagatagaaattcagcatcgtaacttagtctgtgacacccatcctctccaatctgcaccaccatagrgagggtgaactcggtacctctgagcactcacctgtcctagcacgtgtgcataaggcgagtggtatacaagcagacaaagtcttgccgtgtaaatgccaaa

SEQ ID NO: 62964 - DNA, 201 bp, Homo sapiens; identical to SEQ ID NO: 12537

SEQ ID NO: 62965 - DNA, 201 bp, Homo sapiens
ctggactgtgcctgattcaggagcagggttgggaccgatgggttccagggaggtgagccttgcaggggtaagacgtggctaacatttagtgatcacttttmctatgtgccagacattgttgcaagcactataagatcatctcagtgaatcctcacagcctaggaggcaggtacaatggttatgtctcaccaaggtaactga

SEQ ID NO: 62966 - DNA, 201 bp, Homo sapiens
tgaacccgggaggcagagcttgcagtgagccgagatcgtgccactgcactccagcctgggtgacagagcaagactccatctcaaaaaaaaaaaaaaaaaawatatatatatatatatatatatatatttttttttaaattgcatctgtgggccgggtgcagtggctcatgcctgtaagcccagcattttaggaggcagaga

SEQ ID NO: 62967 - DNA, 201 bp, Homo sapiens
ggcactgagtactgacctttgctcccgctgcaagctggactgtgcctgattcaggagcagggttgggaccgatgggttccagggaggtgagccttgcaggrgtaagacgtggctaacatttagtgatcacttttactatgtgccagacattgttgcaagcactataagatcatctcagtgaatcctcacagcctaggaggc

SEQ ID NO: 62968 - DNA, 201 bp, Homo sapiens
gtgaacccgggaggcagagcttgcagtgagccgagatcgtgccactgcactccagcctgggtgacagagcaagactccatctcaaaaaaaaaaaaaaaaaatatatatatatatatatatatatatatttttttttaaattgcatctgtgggccgggtgcagtggctcatgcctgtaagcccagcattttaggaggcagag

SEQ ID NO: 62969 - DNA, 201 bp, Homo sapiens
ggcgggtgagacagaagcgcctctggacctctcacatgctagtggcacctgctgctaggactgtaagtcctggaggtcaaactgcggctgaggtgtcattygtgactcagtctcctcctcccctctggcctggggaagggacaggggcactgagtactgacctttgctcccgctgcaagctggactgtgcctgattcagga

SEQ ID NO: 62970 - DNA, 201 bp, Homo sapiens
ctcacaggagagctggcccagtcccagtggtgggcccattggcattggtgctataccagtttcacatatccctgtggcttccaaaaagctaagctcagacrgggaaaatggcaggttgaggcacccccaccatcatccagtctgcagctcagagctggagcagaggggccacacaggagacggggcctcatgaattgctct

SEQ ID NO: 62971 - DNA, 201 bp, Homo sapiens
gacaaagtcttgccgtgtaaatgccaaatgtaacgtggcctccttgtgcccttccccacagtgccctcttccaggacaaacttggagaagtgaacacttaygcaggtgacctgcagaagaagctggtgccctttgccaccgagctgcatgaacgcctggccaaggactcggagaaactgaaggaggagattgggaaggagc

SEQ ID NO: 62972 - DNA, 201 bp, Homo sapiens
ctctcattctctccctgctccccaaaacaaatccatctacagattgatgcaaaacgtaccctcagactttgggaagtaaatacattcattaacaggtcacrtccccgccacgttgaaaggcaggaggtcccctcgcgagcgtgggtgcacgcatgggctgtgccagtcccttggttcttagtgatttgcacacttctgtga

SEQ ID NO: 62973 - DNA, 201 bp, Homo sapiens
aagtcttgccgtgtaaatgccaaatgtaacgtggcctccttgtgcccttccccacagtgccctcttccaggacaaacttggagaagtgaacacttacgcargtgacctgcagaagaagctggtgccctttgccaccgagctgcatgaacgcctggccaaggactcggagaaactgaaggaggagattgggaaggagctgga

SEQ ID NO: 62974 - DNA, 201 bp, Homo sapiens
tgcctcaccaatcattaagtctgcctgttgcacagataaggagaggcttggagaggcgatgtctccctcgagatcacacaggcctttcatgcccactaagrtggacgtccctgactcacaggaccaggcctggctggaaggcagtctgctcttcccatcagctacttgcaccctctaagactgagcacagggggctctcat

SEQ ID NO: 62975 - DNA, 201 bp, Homo sapiens
gtcttgccgtgtaaatgccaaatgtaacgtggcctccttgtgcccttccccacagtgccctcttccaggacaaacttggagaagtgaacacttacgcaggygacctgcagaagaagctggtgccctttgccaccgagctgcatgaacgcctggccaaggactcggagaaactgaaggaggagattgggaaggagctggagg

SEQ ID NO: 62976 - DNA, 201 bp, Homo sapiens
actctgtgccaggagctctataggcagccctctgtatccttggtttctgtgtccatggattcaaccaaccttggattgaaaataattttttaggccgggcrtggtggctcacgcctgtaatctcagcactttgggaggctgaggcgggcggatcacgaggtcaggagatcgagaccatcctggctaacacggcgaaacccc

SEQ ID NO: 62977 - DNA, 201 bp, Homo sapiens
gcttaaatgatgcctttggcacgtaataggacccaggtcacagagataacatctcagagcctcaattttctgaggataaaatggggctggaatactgattkcccagagtggtgctgaaaaggaaatgagatagagaagtacaaagcagcgggtccacggagggactcacacctccctctccctcctaacgctgtgcccttc

SEQ ID NO: 62978 - DNA, 201 bp, Homo sapiens; identical to SEQ ID NO: 12550

SEQ ID NO: 62979 - DNA, 201 bp, Homo sapiens
agaaggcatttgggaggtgatcaggtcatgaagggggagccctcatgaatgagattagtgtccttataaaagaggccccacagaaatcccttgccccttcyacgtgcgaggacacagcgagaaggtgccatttatgaaccaggaagtgggccctcaccagacacgggatatgctggtgccttgctcttagacttcccagcc

SEQ ID NO: 62980 - DNA, 201 bp, Homo sapiens; identical to SEQ ID NO: 12552

SEQ ID NO: 62981 - DNA, 201 bp, Homo sapiens; identical to SEQ ID NO: 12551

SEQ ID NO: 62982 - DNA, 201 bp, Homo sapiens; identical to SEQ ID NO: 12553

SEQ ID NO: 62983 - DNA, 201 bp, Homo sapiens
tcggacatgctcaaatggtgcaggcgctcccagcatgggtgcacccaggcgggcgggtgagacagaagcgcctctggacctctcacatgctagtggcacckgctgctaggactgtaagtcctggaggtcaaactgcggctgaggtgtcattcgtgactcagtctcctcctcccctctggcctggggaagggacaggggcac

SEQ ID NO: 62984 - DNA, 201 bp, Homo sapiens; identical to SEQ ID NO: 12554

SEQ ID NO: 62985 - DNA, 201 bp, Homo sapiens
ggtgcacacctgtggtccaagctactcgagagactgaggtgggaggattgcttgagcccaggaggttgaggctggggtgagttgagatcatgccactgcastccagcctgggcaacagaggaagaccctgtctcaagaaaaaaaaaaaaaaagaagaagaagaaaagaaaaaaatgccaccactttagtattacttttata

SEQ ID NO: 62986 - DNA, 201 bp, Homo sapiens
ggctgggctgggcagccctgattcagacctgttggccagaggcccttgttcatcacacatcatcatgccggaagttcctcctagtatctcacccagctccytcctatggcaacaggagctgtccttcagttctgcccgggggagggccccttgaagcatacgtgaggcacatgtccgtgtgacctgcctgtccctggctgg

SEQ ID NO: 62987 - DNA, 201 bp, Homo sapiens
ggaagaggcacttcagaatggtgaggtacattacctagcaagtggtggaatgggattttttttttttttttttttttttttaccagcgctttgggaggccraggcgggtggatcacttgaggtcaggagttcaagaccagcctggccaacatggcgaaaccccctcctctattaaaaatacaaaaattggctgggctttgt

SEQ ID NO: 62988 - DNA, 201 bp, Homo sapiens
catctcaaaaaaaaaaaaaattgcacctgtactaaacatatacagacttttttggtgattacctcctaaacaatacagtataacaaccattcacacagcayttccgtcgtattaggtattataagtaatctagagatttaaagtatgtgggaggctgtgcttaggttatatgtaaatactatgccattttatatcaaggac

SEQ ID NO: 62989 - DNA, 201 bp, Homo sapiens
gtctccaaaaaaaaaaaaaaagaagagaaagaaaaaaatatgccattttaggccaggtgtggtggctcacacctgtaatcccagcactttgggaggctgaracaggtggattgcttgagcctaggagttcgagaccagcctggcaacatggcgaaaacttgtctctacaaaaaatacaaaaattagccaagtgtggtggtg

SEQ ID NO: 62990 - DNA, 201 bp, Homo sapiens
aacaggagctgtccttcagttctgcccgggggagggccccttgaagcatacgtgaggcacatgtccgtgtgacctgcctgtccctggctggatctgagttktctgctcctgactctgacctctggactgacccctggtttgatccctgtgtggttggccaggaggggtggctgtagctaatgctgagctatcagcctcatt

SEQ ID NO: 62991 - DNA, 201 bp, Homo sapiens
ttagaaacctaaggctctaagggctccaagtgcacagcccattagtagtaaggctgggaaccttaatccaggtcttcacacaccccaggcaaataccagayggcttagagcactgagacccctatagaggcatcagtcacacgcccagaacaaacctgtctcaagtctcctgcagactttggtggtggggtagaaggtgaa

SEQ ID NO: 62992 - DNA, 201 bp, Homo sapiens; identical to SEQ ID NO: 12535

SEQ ID NO: 62993 - DNA, 201 bp, Homo sapiens
ggtctaaaaaagagagagagagagagagagagagagattcattcctttgacttaagactttgttttctgttaaaatgcaaatagaaccctgtgaagtagaygttaagtccattttataggttagaaacctaaggctctaagggctccaagtgcacagcccattagtagtaaggctgggaaccttaatccaggtcttcacac

SEQ ID NO: 62994 - DNA, 201 bp, Homo sapiens
ccctgaggtgtttctcctactgttttccgttcccctcctcccttccatgctgaggttggtggggtgggggtgggggtgcccacgcacggaacagccaccayttctaactatcgcctgagccctgatctgctgtcagcttccacgtagtctcagggtcacaaaagtccaagaggcctcttgggaatgtgtcaccttccagcg

SEQ ID NO: 62995 - DNA, 201 bp, Homo sapiens
tctcccgcatggcaacggacccagggaggtcaggacatgtgggtagagagacctggcagggtgctgagctagatgtagcacacctccaggaagcctggtaycttgtctccttccaagggcttggtacctgagaatacctgtggcccctcaccaacagtccaacctgcaccccggcaggggatctcttggtggccagcctgc

SEQ ID NO: 62996 - DNA, 201 bp, Homo sapiens
ccgggtgtgctagaatgggctggcggggtcccgtggccccagaccctccaagcctttccatctctgcagagggtctggaggagcctggcctctctctcccrcatggcaacggacccagggaggtcaggacatgtgggtagagagacctggcagggtgctgagctagatgtagcacacctccaggaagcctggtaccttgtc

SEQ ID NO: 62997 - DNA, 201 bp, Homo sapiens; identical to SEQ ID NO: 12539

SEQ ID NO: 62998 - DNA, 201 bp, Homo sapiens
tggacatgaggtctgcctggctgccaagtggctcacaggagagctggcccagtcccagtggtgggcccattggcattggtgctataccagtttcacatatycctgtggcttccaaaaagctaagctcagacagggaaaatggcaggttgaggcacccccaccatcatccagtctgcagctcagagctggagcagaggggcc

SEQ ID NO: 62999 - DNA, 201 bp, Homo sapiens; identical to SEQ ID NO: 12545

SEQ ID NO: 63000 - DNA, 201 bp, Homo sapiens; identical to SEQ ID NO: 12548

SEQ ID NO: 63001 - DNA, 201 bp, Homo sapiens
tgcccctggtgcactggccccaccctcgtggacacctgccctgccctgccacctgtctgtctgtctgtcccaaagaagttctggtatgaacttgaggacayatgtccagtgggaggtgagaccacctctcaatattcaataaagctgctgagaatctagcctcaactggttgccggatgaatcctccttgcagctggggag

SEQ ID NO: 63002 - DNA, 201 bp, Homo sapiens
ctggtttggtttggggaatctgtttatttatgggaagatgtccaagatattttatgaaaaaaaaaaaagcaaggtttcaactattatgtactttacaaccyggtcaaggaacacacatacatattggtatgtgaacgtgtaaggaagtgaaaatcctgttagcttaacagttagacctagaatacctctgaaagagagaat

SEQ ID NO: 63003 - DNA, 201 bp, Homo sapiens
actacttcagccagctgagcaacaatgccaaggaggccgtggaacatctccagaaatctgaactcacccagcaactcaagtaagagggactacagtgtgcrgtggtgacggggaattcttaaaggccatgcaatgtactggcaagggttgagcttagagacaggagccctgagcttaggatacccactgccctgccactaa

SEQ ID NO: 63004 - DNA, 201 bp, Homo sapiens
gccccatgccagccactatgcctggcacttaagttgtcatcagagttgagactgtgtgtgtttactcaaaactgtggagctgacctcccctatccaggccmcctagccctcttaggcgcacgtgaagggaggaggccggatgggctagaggttggagtaagatgcaacgaggcactattcttggctccaccacttgatatc

SEQ ID NO: 63005 - DNA, 201 bp, Homo sapiens
cccaatagaggctgcttcctttgtgtccccaccacccgaaagatgtcaggtcagagagcccgagagctgcagatggcttgagtagggctccactcttcagrtcaaaaaactgtggcccggagaggcgaaggcacttggccagcatcacagagccagcacgtggcagggccagaccttgagcccaggtcagctgcgtgtatt

SEQ ID NO: 63006 - DNA, 201 bp, Homo sapiens
gaccttgaagctctccagcacgggcagcaggccttggcggaggtcctcgagcgcgggcttggccttctcgctgagcgtgctcagatgctcggtggccttgscgtggtactcggccagtctggcgccgccgttctccttgagagcctcaaggcgcgcggccaagcgctggcgcagctcgtcgctgtagggggccagatgcgt

SEQ ID NO: 63007 - DNA, 201 bp, Homo sapiens
ccacttcttctggaagtcgtccaggtagggctgcaccttggccttcacctcctccagatccttgctcatctcctgcctcaggccctctgtctccttttccrggttatcccagaactcctgggtcacagggccgagctgttcgcgcagcttgctgaaggtggaggtcacgctgtcccagttgtcaaggagctttaggctgga

SEQ ID NO: 63008 - DNA, 201 bp, Homo sapiens
gcctctgatttcatactgtggtgttagttacttctgagaggacagcttgctgccagagctctattttttatgttagaggctccttctgcctgcagactctkctgtctgggaagggcacagcgttaggagggagagggaggtgtgagtccctccgtggacccgctgctttgtacttctctatctcatttccttttcagcacc

SEQ ID NO: 63009 - DNA, 201 bp, Homo sapiens
gtacactctcaaccaacacccctgccccgccaggccatgccccgttgtgcagctggaccgaggcacagagaggagctaaaaaggagacagagctgggactrgtgcccagttacgttggtctccaaagtgggcccttgaaggacctcgcttctatgcctccagcgcattctcctctccgaagacagcccacagtcttgctgg

SEQ ID NO: 63010 - DNA, 201 bp, Homo sapiens
accttgaagctctccagcacgggcagcaggccttggcggaggtcctcgagcgcgggcttggccttctcgctgagcgtgctcagatgctcggtggccttggsgtggtactcggccagtctggcgccgccgttctccttgagagcctcaaggcgcgcggccaagcgctggcgcagctcgtcgctgtagggggccagatgcgtg

SEQ ID NO: 63011 - DNA, 201 bp, Homo sapiens
gagcagcgtgcaggagtcccaggtggcccagcaggccaggtacacccgctggcctccctccccatcccccctgccagctgcctccattcccacccgccccwgccctggtgagatcccaacaatggaatggaggtgctccagcctcccctgggcctgtgcctcttcagcctcctctttcctcacagggcctttgtcaggctg

SEQ ID NO: 63012 - DNA, 201 bp, Homo sapiens
cagagctctattttttatgttagaggctccttctgcctgcagactctgctgtctgggaagggcacagcgttaggagggagagggaggtgtgagtccctccrtggacccgctgctttgtacttctctatctcatttccttttcagcaccactctgggaaatcagtattccagccccattttatcctcagaaaattgaggctc

SEQ ID NO: 63013 - DNA, 201 bp, Homo sapiens
gcactgagcagcgtgcaggagtcccaggtggcccagcaggccaggtacacccgctggcctccctccccatcccccctgccagctgcctccattcccacccrcccctgccctggtgagatcccaacaatggaatggaggtgctccagcctcccctgggcctgtgcctcttcagcctcctctttcctcacagggcctttgtca

SEQ ID NO: 63014 - DNA, 201 bp, Homo sapiens
tctattttttatgttagaggctccttctgcctgcagactctgctgtctgggaagggcacagcgttaggagggagagggaggtgtgagtccctccgtggacmcgctgctttgtacttctctatctcatttccttttcagcaccactctgggaaatcagtattccagccccattttatcctcagaaaattgaggctctgagat

SEQ ID NO: 63015 - DNA, 201 bp, Homo sapiens
gtgcgcagcgcgtccacatgggcgcgcgcgcggtcgcgcatctcctcgcccagtgggctcagcttctcttgcagctcgtgcagcttctggcgcgcgccctyttggagctctgcgcgcagcggctccaccttctggcggtagagctccatctcctcctgccacttcttctggaagtcgtccaggtagggctgcaccttggcc

SEQ ID NO: 63016 - DNA, 201 bp, Homo sapiens
cggtggccttggcgtggtactcggccagtctggcgccgccgttctccttgagagcctcaaggcgcgcggccaagcgctggcgcagctcgtcgctgtagggsgccagatgcgtgcgcagcgcgtccacatgggcgcgcgcgcggtcgcgcatctcctcgcccagtgggctcagcttctcttgcagctcgtgcagcttctggc

SEQ ID NO: 63017 - DNA, 201 bp, Homo sapiens
ccagggtggcagctgtgggggattcctgcctgaggtctcagggctgtcgtccagtgaagttgagagggtggtgtggtcctgactggtgtcgtccagtgggkacatgggtgtgggtcccatggttgcctacagaggagttctcatgccctgctctgttgcttcccctgactgatttaggggctgggtgaccgatggcttcag

SEQ ID NO: 63018 - DNA, 201 bp, Homo sapiens
cagatcacacaactaatcaatcctccaatgactttccaaatgagaggctgcctccctctgtcctaccctgctcagagccaccaggttgtgcaactccaggyggtgctgtttgcacagaaaacaatgacagccttgacctttcacatctccccaccctgtcactttgtgcctcaggcccaggggcataaacatctgaggtga

SEQ ID NO: 63019 - DNA, 201 bp, Homo sapiens
agcaggtcctccaacgtcgatcttggccctaagacgtccagtctgggcacggagttgttgagatccggcaggaagtccctgctccagggccaaaggccccwcccgggctcccccggatgtccccgcacccccctctattctcccaaaagaaagaagctgcttcccactttggaaacgtttattctgagcaccgggaagggg

SEQ ID NO: 63020 - DNA, 201 bp, Homo sapiens
gcagagatggggtttcaccatgttggccaggttggtcttgaattcctgacctcaggggatcctcctgcctcggcctcccaaagtgctgggattacaggcaygagccactgcgcctggccccattttccttttctgaaggtctggctagagcagtggtcctcagcctttttggcaccagggaccagttttgtggtggacaat

SEQ ID NO: 63021 - DNA, 201 bp, Homo sapiens
catccaccagagtgtgtgtggattcacagaagtgtgcaaatcactaagaaccaagggactggcacagcccatgcgtgcacccacgctcgcgaggggacctsctgcctttcaacgtggcggggatgtgacctgttaatgaatgtatttacttcccaaagtctgagggtacgttttgcatcaatctgtagatggatttgtttt

SEQ ID NO: 63022 - DNA, 201 bp, Homo sapiens
ctcttcagcctcctctttcctcacagggcctttgtcaggctgctgcgggagagatgacagagttgagactgcattcctcccaggtccctcctttctccccrgagcagtcctagggcgcgccgttttagccctcatttccattttcctttcctttccctttctttctctttctatttctttctttctttctttctttctttc

SEQ ID NO: 63023 - DNA, 201 bp, Homo sapiens
caagcgctggcgcagctcgtcgctgtagggggccagatgcgtgcgcagcgcgtccacatgggcgcgcgcgcggtcgcgcatctcctcgcccagtgggctcmgcttctcttgcagctcgtgcagcttctggcgcgcgccctcttggagctctgcgcgcagcggctccaccttctggcggtagagctccatctcctcctgcca

SEQ ID NO: 63024 - DNA, 201 bp, Homo sapiens
gcccgtaagcacttggtgggactgggctgggggcagggtggaggcaacttggggatcccagtcccaatgggtggtcaagcaggagcccagggctcgtccakaggccgatccaccccactcagccctgctctttcctcaggagcttcagaggccgaggatgcctcccttctcagcttcatgcagggctacatgaagcacgcc

SEQ ID NO: 63025 - DNA, 201 bp, Homo sapiens
ggtgccttcagcatgcagaagccccgtgctcccccactcattgcagccaggtgaggagaagggcacagagcgggagaagacctcaggtacccagaggcccrgcctggggcaaggcctgaaccttgagctggggagccagagtgaccggggcaggcagcaggacgcacctccttctcgcagtctctaagcagccagctcttg

SEQ ID NO: 63026 - DNA, 201 bp, Homo sapiens
aggactcggccagtctggcttcaacatcatcccacaggcctctgccccctgcccctgccctcaaccccaggctgggtccttactttagctgttttcccaargcggagccttcaaactgggacacatagtctctgccgctgtctttgagcacatccacgtacacagtggccaggtccttcactcgatcccaggggctctggg

SEQ ID NO: 63027 - DNA, 201 bp, Homo sapiens
gaaagaggaggggaggaggatgaagaggggcaagaggagctccctgcccagcccagccagcaagcctggagaagcacttgctagagctaaggaagcctcgsagctggacgggtgccccccacccctcatcataacctgaagaacatggaggcccgggaggggtgtcacttgcccaaagctacatagggggtggggctggaa

SEQ ID NO: 63028 - DNA, 201 bp, Homo sapiens
acttgcaggcacaatgtggctctgtgatcacgcatcgggcagccctggtctgtcctttgcaggggacatgggctgtgaccctgcctggagatcccattccrgtttctccatccagaccatctgtggggcccagctcatcagatattaggtgaggactcggccagtctggcttcaacatcatcccacaggcctctgccccct

SEQ ID NO: 63029 - DNA, 201 bp, Homo sapiens
gtgggggacctggaggagaagaagggcctggctgagtggggtgccttcagcatgcagaagccccgtgctcccccactcattgcagccaggtgaggagaagrgcacagagcgggagaagacctcaggtacccagaggcccggcctggggcaaggcctgaaccttgagctggggagccagagtgaccggggcaggcagcagga

SEQ ID NO: 63030 - DNA, 201 bp, Homo sapiens
ccgaagacagcccacagtcttgctgggcaggagcagaggaggtggtgaagaagggaaaggggcttgctacacttgcaggcacaatgtggctctgtgatcaygcatcgggcagccctggtctgtcctttgcaggggacatgggctgtgaccctgcctggagatcccattccggtttctccatccagaccatctgtggggccc

SEQ ID NO: 63031 - DNA, 201 bp, Homo sapiens
aagatgtcctggctccaaggtgtcagcatctggaagacaggcgccctcatcctgccatccctgctgcggcttcactgtgggcccaggggacatctcagccycgagaagggtcagcggcccctcctggaccaccgactccccgcagaactcctctgtgccctctcctcaccagaccttgttcctcccagttgctcccacagc

SEQ ID NO: 63032 - DNA, 201 bp, Homo sapiens
agtacactctcaaccaacacccctgccccgccaggccatgccccgttgtgcagctggaccgaggcacagagaggagctaaaaaggagacagagctgggackggtgcccagttacgttggtctccaaagtgggcccttgaaggacctcgcttctatgcctccagcgcattctcctctccgaagacagcccacagtcttgctg

SEQ ID NO: 63033 - DNA, 201 bp, Homo sapiens
gaagacaggcgccctcatcctgccatccctgctgcggcttcactgtgggcccaggggacatctcagccccgagaagggtcagcggcccctcctggaccacygactccccgcagaactcctctgtgccctctcctcaccagaccttgttcctcccagttgctcccacagccagggggcagtgagggctgctcttcccccagc

SEQ ID NO: 63034 - DNA, 201 bp, Homo sapiens
aagacaggcgccctcatcctgccatccctgctgcggcttcactgtgggcccaggggacatctcagccccgagaagggtcagcggcccctcctggaccaccractccccgcagaactcctctgtgccctctcctcaccagaccttgttcctcccagttgctcccacagccagggggcagtgagggctgctcttcccccagcc

SEQ ID NO: 63035 - DNA, 201 bp, Homo sapiens
actcctctgtgccctctcctcaccagaccttgttcctcccagttgctcccacagccagggggcagtgagggctgctcttcccccagccccactgaggaacycaggaaggtgaacgagagaatcagtcctggtgggggctggggagggccccagacatgagaccagctcctcccccaggggatgttatcagtgggtccagag

SEQ ID NO: 63036 - DNA, 201 bp, Homo sapiens
cagagatggaggtgctgggaggggctgtgagagctcagccctgtaaccaggccttgccggagccactgatgcctggtcttctgtgcctttactccaaacaycccccagcccaagccacccacttgttctcaagtctgaagaagcccctcacccctctactccaggctgtgttcagggcttggggctggtggagggaggggc

SEQ ID NO: 63037 - DNA, 201 bp, Homo sapiens
tgagagcccgtattagcagggagccggcccctactccttctggcagacccagctaaggttctaccttaggggccacgccacctccccagggaggggtccasaggcatggggacctggggtgcccctcacaggacacttccttgcaggaacagaggtgccatgcagccccgggtactccttgttgttgccctcctggcgctc

SEQ ID NO: 63038 - DNA, 201 bp, Homo sapiens
tctggcggtagagctccatctcctcctgccacttcttctggaagtcgtccaggtagggctgcaccttggccttcacctcctccagatccttgctcatctcytgcctcaggccctctgtctccttttccaggttatcccagaactcctgggtcacagggccgagctgttcgcgcagcttgctgaaggtggaggtcacgctgt

SEQ ID NO: 63039 - DNA, 201 bp, Homo sapiens
aggcctctgccccctgcccctgccctcaaccccaggctgggtccttactttagctgttttcccaaggcggagccttcaaactgggacacatagtctctgcsgctgtctttgagcacatccacgtacacagtggccaggtccttcactcgatcccaggggctctgggggggttcatcttgctgccagaaatgccgagcctgg

SEQ ID NO: 63040 - DNA, 201 bp, Homo sapiens
cagcactcgcctgcctggattgaaacccagagatggaggtgctgggaggggctgtgagagctcagccctgtaaccaggccttgccggagccactgatgccyggtcttctgtgcctttactccaaacaccccccagcccaagccacccacttgttctcaagtctgaagaagcccctcacccctctactccaggctgtgttca

SEQ ID NO: 63041 - DNA, 201 bp, Homo sapiens
ttctctttctttctttctttcctttttctttctttccctctcttcctttctctctttctttcttcttcttttttttttaatggagtctccctctgtcaccyaggctggagtgcagtggtgccatctcggctcactgcaacctccgtctcccgggttcaacccattctcctgcctcagcctcccaagtagctgggattacag

SEQ ID NO: 63042 - DNA, 201 bp, Homo sapiens
ctttagctgttttcccaaggcggagccttcaaactgggacacatagtctctgccgctgtctttgagcacatccacgtacacagtggccaggtccttcactmgatcccaggggctctgggggggttcatcttgctgccagaaatgccgagcctggctccctgagggtgggaggggagacccagatcaggccagctgtgggct

SEQ ID NO: 63043 - DNA, 201 bp, Homo sapiens
ctgttttcccaaggcggagccttcaaactgggacacatagtctctgccgctgtctttgagcacatccacgtacacagtggccaggtccttcactcgatccyaggggctctgggggggttcatcttgctgccagaaatgccgagcctggctccctgagggtgggaggggagacccagatcaggccagctgtgggctgagatc

SEQ ID NO: 63044 - DNA, 201 bp, Homo sapiens
ggcaaaatagggagcctggtggagggaggggcaaaggcctcgggctctgagcggccttggcccttctccaccaacccctgccctacactaagggggaggcrgcggggggcacacagggtgggggcgggtggggggctgctgggtgagcagcactcgcctgcctggattgaaacccagagatggaggtgctgggaggggctg

SEQ ID NO: 63045 - DNA, 201 bp, Homo sapiens
tgggtccagagggcaaaatagggagcctggtggagggaggggcaaaggcctcgggctctgagcggccttggcccttctccaccaacccctgccctacactmagggggaggcagcggggggcacacagggtgggggcgggtggggggctgctgggtgagcagcactcgcctgcctggattgaaacccagagatggaggtgct

SEQ ID NO: 63046 - DNA, 201 bp, Homo sapiens
taatttttgtatttttagcagagatggggtttcaccatgttggccaggttggtcttgaattcctgacctcaggggatcctcctgcctcggcctcccaaagygctgggattacaggcacgagccactgcgcctggccccattttccttttctgaaggtctggctagagcagtggtcctcagcctttttggcaccagggacca

SEQ ID NO: 63047 - DNA, 201 bp, Homo sapiens
tctctctctcttttttagaccaagtctagctctgtcactggagtgcaatggtgcgatctctgctcactgcaacctccacctccggggttcaagcaattctmgtgcctcagcctcctgagtagctgggactacaggcgtgcatcaccatgctcggctaattttttgtatttttagtagagactgggtttcgccatgttgccc

SEQ ID NO: 63048 - DNA, 201 bp, Homo sapiens
gagctaaggaagcctcggagctggacgggtgccccccacccctcatcataacctgaagaacatggaggcccgggaggggtgtcacttgcccaaagctacayagggggtggggctggaagtggctccaagtgcaggttcccccctcattcttcaggcttagggctggaggaagccttagacagcccagtcctaccccagaca

SEQ ID NO: 63049 - DNA, 201 bp, Homo sapiens
ctggacggagatcagtccagaccgcaggtgccttgatgttcagtctggtgggttttctgctccatcccacccacctccctttgggcctcgatccctcgccsctcaccagtcccccttctgagagcccgtattagcagggagccggcccctactccttctggcagacccagctaaggttctaccttaggggccacgccacct

SEQ ID NO: 63050 - DNA, 201 bp, Homo sapiens
gcgcagcggctccaccttctggcggtagagctccatctcctcctgccacttcttctggaagtcgtccaggtagggctgcaccttggccttcacctcctccrgatccttgctcatctcctgcctcaggccctctgtctccttttccaggttatcccagaactcctgggtcacagggccgagctgttcgcgcagcttgctgaa

SEQ ID NO: 63051 - DNA, 201 bp, Homo sapiens
cttgatgttcagtctggtgggttttctgctccatcccacccacctccctttgggcctcgatccctcgcccctcaccagtcccccttctgagagcccgtatkagcagggagccggcccctactccttctggcagacccagctaaggttctaccttaggggccacgccacctccccagggaggggtccagaggcatggggacc

SEQ ID NO: 63052 - DNA, 201 bp, Homo sapiens
ggggatggttttgggatgaagctgttccacctcagatcatcaggcattagattctcataaggagccctccacctagatccctggcatgtgcagttcacaayagggttcacactcctatgagaatgtaaggccacttgatctgacaggaggcggagctcaggcggtattgctcactcacccaccactcacttcgtgctgtgc

SEQ ID NO: 63053 - DNA, 201 bp, Homo sapiens
aagcccctcacccctctactccaggctgtgttcagggcttggggctggtggagggaggggcctgaaattccagtgtgaaaggctgagatgggcccgaggcmcctggcctatgtccaagccatttcccctctcaccagcctctccctggggagccagtcagctaggaaggaatgagggctccccaggcccacccccagttcc

SEQ ID NO: 63054 - DNA, 201 bp, Homo sapiens
gcagcccggctcctaacagtccatggaccagtacctatctatgacttgggggttggggacccctgggctaggggtttgccttgggaggccccacctgaccyaattcaagcccgtgagtgcttctgctttgttctaagacctggggccagtgtgagcagaagtgtgtccttcctctcccatcctgcccctgcccatcagtac

SEQ ID NO: 63055 - DNA, 201 bp, Homo sapiens
ttggccttctcgctgagcgtgctcagatgctcggtggccttggcgtggtactcggccagtctggcgccgccgttctccttgagagcctcaaggcgcgcggscaagcgctggcgcagctcgtcgctgtagggggccagatgcgtgcgcagcgcgtccacatgggcgcgcgcgcggtcgcgcatctcctcgcccagtgggctc

SEQ ID NO: 63056 - DNA, 201 bp, Homo sapiens; identical to SEQ ID NO: 12561

SEQ ID NO: 63057 - DNA, 201 bp, Homo sapiens
ggaggtcacgctgtcccagttgtcaaggagctttaggctggagggtgagacagaagggttgagggctggcctcccagcgccccagcctatcaggggtgagscctgggtgacacctgtccgcggaggtgcagtggcctagcatttccagtacactctcaaccaacacccctgccccgccaggccatgccccgttgtgcagct

SEQ ID NO: 63058 - DNA, 201 bp, Homo sapiens
aatgttgtcatgattacagttgagctgactgggcccttgggacccggactggagtggtggggggcagtgtcctgggaccaaaaagaagcacaaggtctccyaatagaggctgcttcctttgtgtccccaccacccgaaagatgtcaggtcagagagcccgagagctgcagatggcttgagtagggctccactcttcagatc

SEQ ID NO: 63059 - DNA, 201 bp, Homo sapiens
tggaggtcacgctgtcccagttgtcaaggagctttaggctggagggtgagacagaagggttgagggctggcctcccagcgccccagcctatcaggggtgarccctgggtgacacctgtccgcggaggtgcagtggcctagcatttccagtacactctcaaccaacacccctgccccgccaggccatgccccgttgtgcagc

SEQ ID NO: 63060 - DNA, 201 bp, Homo sapiens
ggaaggttaggaactaaaaagcccactcctttacctagggtagctaagatacactggagatggggacatggggatggggccgattatccaggggcctgcawgagggggcaaaaggccctgcagagagagggtagggaaggcactgcccagatctgtgaagccatgtgcgtgcacgcggggacattcagacatgagtgcaag

SEQ ID NO: 63061 - DNA, 201 bp, Homo sapiens
tgcagcttctggcgcgcgccctcttggagctctgcgcgcagcggctccaccttctggcggtagagctccatctcctcctgccacttcttctggaagtcgtscaggtagggctgcaccttggccttcacctcctccagatccttgctcatctcctgcctcaggccctctgtctccttttccaggttatcccagaactcctgg

SEQ ID NO: 63062 - DNA, 201 bp, Homo sapiens
tggaggcccctgagacagcctgtgaatgtaaagtgctgtgtgtccgttggtgtttgcagcaccatcttgtcaggtttctcctggaaggcccagacctcccycagcaggttactgataggacctgagtcctagagcctgtgatgcaggctgagaggaactgtgacatcactccagcctctccccatgccaccatctcacaga

SEQ ID NO: 63063 - DNA, 201 bp, Homo sapiens
gagtgtctgcaggcttgcaggtctcccgggtggggtcggggttccctgcactcatccccttcccctccatgggagtgtgtgggcagttgccattgtccatkgtgttggcagaggaggggaggggagggacgctgggactcctccaccaaggagactgcctcccccaccaccagcattccagggagactacttcactcccct

SEQ ID NO: 63064 - DNA, 201 bp, Homo sapiens
ggttccctgcactcatccccttcccctccatgggagtgtgtgggcagttgccattgtccattgtgttggcagaggaggggaggggagggacgctgggactmctccaccaaggagactgcctcccccaccaccagcattccagggagactacttcactcccctcccccttcccccgccctgtcctcccaccagtgctcttct

SEQ ID NO: 63065 - DNA, 201 bp, Homo sapiens
attataataatcatactgtataataatcatactgtgttcctgatttggagcaaagcagggagggtagcagagtgctccctcctctagtgagagtggcagartgagactcagccctctgaggggcgccaggtgggccagaggcagggtgatgggtgggaccagcctgaggcctgactcctgcccttcttgccccccagccac

SEQ ID NO: 63066 - DNA, 201 bp, Homo sapiens
acttagatgtctattggatctctaaatgaggctgcatgcataatcacacacaaacatccactgagaaggtgacacaccacgtcagcatgggtccctctgcyggaccacaccactcctagtgactatgaggtgacatccaggcacgttgcactattggctcctgtcggtgagtgcagtgcctgacaacagtgagctacattt

SEQ ID NO: 63067 - DNA, 201 bp, Homo sapiens
ctcctgactctggcaccccttctgctgggtccccactgccctgtagtggtccccacgctaccatgctgcctcctttttgatgcagcctgtgccatctctcygtgattgttggggtcagatgctggagtccactccctggcttggcatccaggctccaacacgtactgcctgtgtgtccttgggcaagtctcataacctctc

SEQ ID NO: 63068 - DNA, 201 bp, Homo sapiens
tcagttaccttggtgagacataaccattgtacctgcctcctaggctgtgaggattcactgagatgatcttatagtgcttgcaacaatgtctggcacatagkaaaagtgatcactaaatgttagccacgtcttacccctgcaaggctcacctccctggaacccatcggtcccaaccctgctcctgaatcaggcacagtccag

SEQ ID NO: 63069 - DNA, 201 bp, Homo sapiens
cttctcttgcagctcgtgcagcttctggcgcgcgccctcttggagctctgcgcgcagcggctccaccttctggcggtagagctccatctcctcctgccacwtcttctggaagtcgtccaggtagggctgcaccttggccttcacctcctccagatccttgctcatctcctgcctcaggccctctgtctccttttccaggtt

SEQ ID NO: 63070 - DNA, 201 bp, Homo sapiens
gcctcctaggctgtgaggattcactgagatgatcttatagtgcttgcaacaatgtctggcacatagtaaaagtgatcactaaatgttagccacgtcttacycctgcaaggctcacctccctggaacccatcggtcccaaccctgctcctgaatcaggcacagtccagcttgcagcgggagcaaaggtcagtactcagtgcc

SEQ ID NO: 63071 - DNA, 201 bp, Homo sapiens
gtggtactcggccagtctggcgccgccgttctccttgagagcctcaaggcgcgcggccaagcgctggcgcagctcgtcgctgtagggggccagatgcgtgsgcagcgcgtccacatgggcgcgcgcgcggtcgcgcatctcctcgcccagtgggctcagcttctcttgcagctcgtgcagcttctggcgcgcgccctcttg

SEQ ID NO: 63072 - DNA, 201 bp, Homo sapiens
ttctcccagggtggcagctgtgggggattcctgcctgaggtctcagggctgtcgtccagtgaagttgagagggtggtgtggtcctgactggtgtcgtccartggggacatgggtgtgggtcccatggttgcctacagaggagttctcatgccctgctctgttgcttcccctgactgatttaggggctgggtgaccgatggc

SEQ ID NO: 63073 - DNA, 201 bp, Homo sapiens
tcctgaatcaggcacagtccagcttgcagcgggagcaaaggtcagtactcagtgcccctgtcccttccccaggccagaggggaggaggagactgagtcacraatgacacctcagccgcagtttgacctccaggacttacagtcctagcagcaggtgccactagcatgtgagaggtccagaggcgcttctgtctcacccgcc

SEQ ID NO: 63074 - DNA, 201 bp, Homo sapiens
aggggaggggagggacgctgggactcctccaccaaggagactgcctcccccaccaccagcattccagggagactacttcactcccctcccccttcccccghcctgtcctcccaccagtgctcttctttagtccccagcaggtcctccaggcctctctccaagcctcccaaactggtaaacctggggagaggggagagccct

SEQ ID NO: 63075 - DNA, 201 bp, Homo sapiens
tgtgagagctcagccctgtaaccaggccttgccggagccactgatgcctggtcttctgtgcctttactccaaacaccccccagcccaagccacccacttgytctcaagtctgaagaagcccctcacccctctactccaggctgtgttcagggcttggggctggtggagggaggggcctgaaattccagtgtgaaaggctga

SEQ ID NO: 63076 - DNA, 201 bp, Homo sapiens
tcacagaagtgtgcaaatcactaagaaccaagggactggcacagcccatgcgtgcacccacgctcgcgaggggacctcctgcctttcaacgtggcggggaygtgacctgttaatgaatgtatttacttcccaaagtctgagggtacgttttgcatcaatctgtagatggatttgttttggggagcagggagagaatgagag

SEQ ID NO: 63077 - DNA, 201 bp, Homo sapiens
atgagagccccctgtgctcagtcttagagggtgcaagtagctgatgggaagagcagactgccttccagccaggcctggtcctgtgagtcagggacgtccaycttagtgggcatgaaaggcctgtgtgatctcgagggagacatcgcctctccaagcctctccttatctgtgcaacaggcagacttaatgattggtgaggca

SEQ ID NO: 63078 - DNA, 201 bp, Homo sapiens
ctgggctgggaggctgataagcccagccccggccctgttgctgctcactggtcctggcaatgtggaacttaagagttcaaggatcagctctgtccctgggrctgggcaaatagagtgggcaaacagcaagctgcgggggctgcagggcaggggtcaagggttcagtgggggcgggaggggagtgtctgcaggcttgcaggt

SEQ ID NO: 63079 - DNA, 201 bp, Homo sapiens
gtcgcaagtgtgccatctgtgtctgggcatgggaaagggccgaggctgttctgtgggtgggcactggacagactccaggtcaggcaggcatggaggccagygctctatccaccttctggtagctgggcagtctctgggcctcagtttcttcatctctaaggtaggaatcaccctccgtaccctgccttccttgacagcttt

SEQ ID NO: 63080 - DNA, 201 bp, Homo sapiens
cttctcgctgagcgtgctcagatgctcggtggccttggcgtggtactcggccagtctggcgccgccgttctccttgagagcctcaaggcgcgcggccaagsgctggcgcagctcgtcgctgtagggggccagatgcgtgcgcagcgcgtccacatgggcgcgcgcgcggtcgcgcatctcctcgcccagtgggctcagctt

SEQ ID NO: 63081 - DNA, 201 bp, Homo sapiens
tgctgctcactggtcctggcaatgtggaacttaagagttcaaggatcagctctgtccctggggctgggcaaatagagtgggcaaacagcaagctgcggggsctgcagggcaggggtcaagggttcagtgggggcgggaggggagtgtctgcaggcttgcaggtctcccgggtggggtcggggttccctgcactcatcccct

SEQ ID NO: 63082 - DNA, 201 bp, Homo sapiens
ccccaggcccacccccagttcctgagctcatctgggctgcagggctggcgggacagcagcgtggactcagtctcctagggatttcccaactctcccgcccrcttgctgcatctggacaccctgcctcaggccctcatctccactggtcagcaggtgacctttgcccagcgccctgggtcctcagtgcctgctgccctggag

SEQ ID NO: 63083 - DNA, 201 bp, Homo sapiens
ggccctcatctccactggtcagcaggtgacctttgcccagcgccctgggtcctcagtgcctgctgccctggagatgatataaaacaggtcagaaccctcckgcctgtctgctcagttcatccctagaggcagctgctccaggtaatgccctctggggaggggaaagaggaggggaggaggatgaagaggggcaagaggagc

SEQ ID NO: 63084 - DNA, 201 bp, Homo sapiens
ccagccagggacaggcaggtcacacggacatgtgcctcacgtatgcttcaaggggccctcccccgggcagaactgaaggacagctcctgttgccataggarggagctgggtgagatactaggaggaacttccggcatgatgatgtgtgatgaacaagggcctctggccaacaggtctgaatcagggctgcccagcccagcc

SEQ ID NO: 63085 - DNA, 201 bp, Homo sapiens
aatgaggctgatagctcagcattagctacagccacccctcctggccaaccacacagggatcaaaccaggggtcagtccagaggtcagagtcaggagcagamaactcagatccagccagggacaggcaggtcacacggacatgtgcctcacgtatgcttcaaggggccctcccccgggcagaactgaaggacagctcctgtt

SEQ ID NO: 63086 - DNA, 201 bp, Homo sapiens
ggcggaggtcctcgagcgcgggcttggccttctcgctgagcgtgctcagatgctcggtggccttggcgtggtactcggccagtctggcgccgccgttctcyttgagagcctcaaggcgcgcggccaagcgctggcgcagctcgtcgctgtagggggccagatgcgtgcgcagcgcgtccacatgggcgcgcgcgcggtcgc

SEQ ID NO: 63087 - DNA, 201 bp, Homo sapiens
agagcgctcaggaagctgaccttgaagctctccagcacgggcagcaggccttggcggaggtcctcgagcgcgggcttggccttctcgctgagcgtgctcaratgctcggtggccttggcgtggtactcggccagtctggcgccgccgttctccttgagagcctcaaggcgcgcggccaagcgctggcgcagctcgtcgctg

SEQ ID NO: 63088 - DNA, 201 bp, Homo sapiens
ccctccacctagatccctggcatgtgcagttcacaatagggttcacactcctatgagaatgtaaggccacttgatctgacaggaggcggagctcaggcggkattgctcactcacccaccactcacttcgtgctgtgcagcccggctcctaacagtccatggaccagtacctatctatgacttgggggttggggacccctgg

SEQ ID NO: 63089 - DNA, 201 bp, Homo sapiens
accgggaaggggggcggcggcgggcgcctcactgggtgttgagcttcttagtgtactcctcgagagcgctcaggaagctgaccttgaagctctccagcacsggcagcaggccttggcggaggtcctcgagcgcgggcttggccttctcgctgagcgtgctcagatgctcggtggccttggcgtggtactcggccagtctgg

SEQ ID NO: 63090 - DNA, 201 bp, Homo sapiens
gcaggctggccaccaagagatcccctgccggggtgcaggttggactgttggtgaggggccacaggtattctcaggtaccaagcccttggaaggagacaagrtaccaggcttcctggaggtgtgctacatctagctcagcaccctgccaggtctctctacccacatgtcctgacctccctgggtccgttgccatgcgggaga

SEQ ID NO: 63091 - DNA, 201 bp, Homo sapiens
gacaaggtaccaggcttcctggaggtgtgctacatctagctcagcaccctgccaggtctctctacccacatgtcctgacctccctgggtccgttgccatgygggagagagaggccaggctcctccagaccctctgcagagatggaaaggcttggagggtctggggccacgggaccccgccagcccattctagcacacccgg

SEQ ID NO: 63092 - DNA, 201 bp, Homo sapiens
atctgagccgaaaggccaagcttggaggtgggggagagggggccagtgagaaacctgctgcctctgcccaggagggtgggccacggggatttagggagaargccccccgatggttggctccctaggttaggggacacctacccgtcaggaagagcacggccaaggtcagcaccgcagctttcatcctgaagggccgtgggg

SEQ ID NO: 63093 - DNA, 201 bp, Homo sapiens
tgtgtgccccatgccagccactatgcctggcacttaagttgtcatcagagttgagactgtgtgtgtttactcaaaactgtggagctgacctcccctatccrggccacctagccctcttaggcgcacgtgaagggaggaggccggatgggctagaggttggagtaagatgcaacgaggcactattcttggctccaccacttg

SEQ ID NO: 63094 - DNA, 201 bp, Homo sapiens
ggacgcacctccttctcgcagtctctaagcagccagctcttgcagggcctatttatgtctgcagccagggtctgggctgggaggctgataagcccagcccyggccctgttgctgctcactggtcctggcaatgtggaacttaagagttcaaggatcagctctgtccctggggctgggcaaatagagtgggcaaacagcaag

SEQ ID NO: 63095 - DNA, 201 bp, Homo sapiens
gagagggtggtgtggtcctgactggtgtcgtccagtggggacatgggtgtgggtcccatggttgcctacagaggagttctcatgccctgctctgttgcttyccctgactgatttaggggctgggtgaccgatggcttcagttccctgaaagactactggagcaccgttaaggacaagttctctgagttctgggatttggac

SEQ ID NO: 63096 - DNA, 201 bp, Homo sapiens
tcccatcctgcccctgcccatcagtactctcctctcccctactcccttctccacctcaccctgactggcattagctggcatagcagaggtgttcataaacwttcttagtccccagaaccggctttggggtaggtgttattttctcactttgcagatgagaaaattgaggctcagagcgattaggtgacctgccccagatca

SEQ ID NO: 63097 - DNA, 201 bp, Homo sapiens
aatgagagagcgttcgaaccgtttggcacagcacctgcacgtaaagatgcttgatcaatgttgtcatgattacagttgagctgactgggcccttgggaccyggactggagtggtggggggcagtgtcctgggaccaaaaagaagcacaaggtctcccaatagaggctgcttcctttgtgtccccaccacccgaaagatgtc

SEQ ID NO: 63098 - DNA, 201 bp, Homo sapiens
gggaaagaggaggggaggaggatgaagaggggcaagaggagctccctgcccagcccagccagcaagcctggagaagcacttgctagagctaaggaagcctyggagctggacgggtgccccccacccctcatcataacctgaagaacatggaggcccgggaggggtgtcacttgcccaaagctacatagggggtggggctgg

SEQ ID NO: 63099 - DNA, 201 bp, Homo sapiens
ccgattatccaggggcctgcatgagggggcaaaaggccctgcagagagagggtagggaaggcactgcccagatctgtgaagccatgtgcgtgcacgcgggkacattcagacatgagtgcaaggagggaccgtgagcagggaggtcatgtgagaatacacaggcatgcctgcacacccatgtgaacttgagtgccaggccac

SEQ ID NO: 63100 - DNA, 201 bp, Homo sapiens
aggggaggaggatgaagaggggcaagaggagctccctgcccagcccagccagcaagcctggagaagcacttgctagagctaaggaagcctcggagctggaygggtgccccccacccctcatcataacctgaagaacatggaggcccgggaggggtgtcacttgcccaaagctacatagggggtggggctggaagtggctcc

SEQ ID NO: 63101 - DNA, 201 bp, Homo sapiens
taacctgaagaacatggaggcccgggaggggtgtcacttgcccaaagctacatagggggtggggctggaagtggctccaagtgcaggttcccccctcattyttcaggcttagggctggaggaagccttagacagcccagtcctaccccagacagggaaactgaggcctggagagggccagaaatcacccaaagacacacag

SEQ ID NO: 63102 - DNA, 201 bp, Homo sapiens
tcaccagtcccccttctgagagcccgtattagcagggagccggcccctactccttctggcagacccagctaaggttctaccttaggggccacgccacctcyccagggaggggtccagaggcatggggacctggggtgcccctcacaggacacttccttgcaggaacagaggtgccatgcagccccgggtactccttgttgt

SEQ ID NO: 63103 - DNA, 201 bp, Homo sapiens
tcaccatgttggccaggttggtcttgaattcctgacctcaggggatcctcctgcctcggcctcccaaagtgctgggattacaggcacgagccactgcgccyggccccattttccttttctgaaggtctggctagagcagtggtcctcagcctttttggcaccagggaccagttttgtggtggacaatttttccatgggcca

SEQ ID NO: 63104 - DNA, 201 bp, Homo sapiens
ggggtttcaccatgttggccaggttggtcttgaattcctgacctcaggggatcctcctgcctcggcctcccaaagtgctgggattacaggcacgagccacygcgcctggccccattttccttttctgaaggtctggctagagcagtggtcctcagcctttttggcaccagggaccagttttgtggtggacaatttttccat

SEQ ID NO: 63105 - DNA, 201 bp, Homo sapiens
gtttctccatccagaccatctgtggggcccagctcatcagatattaggtgaggactcggccagtctggcttcaacatcatcccacaggcctctgccccctrcccctgccctcaaccccaggctgggtccttactttagctgttttcccaaggcggagccttcaaactgggacacatagtctctgccgctgtctttgagcac

SEQ ID NO: 63106 - DNA, 201 bp, Homo sapiens
tcctcacagggcctttgtcaggctgctgcgggagagatgacagagttgagactgcattcctcccaggtccctcctttctccccggagcagtcctagggcgygccgttttagccctcatttccattttcctttcctttccctttctttctctttctatttctttctttctttctttctttctttctttctttctttctttct

SEQ ID NO: 63107 - DNA, 201 bp, Homo sapiens
ctcgcccctcaccagtcccccttctgagagcccgtattagcagggagccggcccctactccttctggcagacccagctaaggttctaccttaggggccacrccacctccccagggaggggtccagaggcatggggacctggggtgcccctcacaggacacttccttgcaggaacagaggtgccatgcagccccgggtactc

SEQ ID NO: 63108 - DNA, 201 bp, Homo sapiens
ctcccaaagtgctgggattacaggcttgagccaccgcacccgacccgcacactcttttcaataatcatggatggccaggggtgcagggtctaaaaagcgckgcctagcccatcctgctgttcactgggcaagcgacgtcacaggtccaggcttcagtgtcctcatccatgctctgcgtctgatggcaatctagccaggatg

SEQ ID NO: 63109 - DNA, 201 bp, Homo sapiens
actgaggcctggagagggccagaaatcacccaaagacacacagcatgttggctggactggacggagatcagtccagaccgcaggtgccttgatgttcagtytggtgggttttctgctccatcccacccacctccctttgggcctcgatccctcgcccctcaccagtcccccttctgagagcccgtattagcagggagccgg

SEQ ID NO: 63110 - DNA, 201 bp, Homo sapiens
ccttgttgttgccctcctggcgctcctggcctctgcccgtaagcacttggtgggactgggctgggggcagggtggaggcaacttggggatcccagtcccartgggtggtcaagcaggagcccagggctcgtccagaggccgatccaccccactcagccctgctctttcctcaggagcttcagaggccgaggatgcctccct

SEQ ID NO: 63111 - DNA, 201 bp, Homo sapiens
cacctcctccagatccttgctcatctcctgcctcaggccctctgtctccttttccaggttatcccagaactcctgggtcacagggccgagctgttcgcgcmgcttgctgaaggtggaggtcacgctgtcccagttgtcaaggagctttaggctggagggtgagacagaagggttgagggctggcctcccagcgccccagcc

SEQ ID NO: 63112 - DNA, 201 bp, Homo sapiens
atccggcaggaagtccctgctccagggccaaaggccccacccgggctcccccggatgtccccgcacccccctctattctcccaaaagaaagaagctgcttyccactttggaaacgtttattctgagcaccgggaaggggggcggcggcgggcgcctcactgggtgttgagcttcttagtgtactcctcgagagcgctcagg

SEQ ID NO: 63113 - DNA, 201 bp, Homo sapiens
ggccttctcgctgagcgtgctcagatgctcggtggccttggcgtggtactcggccagtctggcgccgccgttctccttgagagcctcaaggcgcgcggccragcgctggcgcagctcgtcgctgtagggggccagatgcgtgcgcagcgcgtccacatgggcgcgcgcgcggtcgcgcatctcctcgcccagtgggctcag

SEQ ID NO: 63114 - DNA, 201 bp, Homo sapiens
gcgcgcggccaagcgctggcgcagctcgtcgctgtagggggccagatgcgtgcgcagcgcgtccacatgggcgcgcgcgcggtcgcgcatctcctcgcccmgtgggctcagcttctcttgcagctcgtgcagcttctggcgcgcgccctcttggagctctgcgcgcagcggctccaccttctggcggtagagctccatctc

SEQ ID NO: 63115 - DNA, 201 bp, Homo sapiens
ccagcctgaggcctgactcctgcccttcttgccccccagccacactccctgggcaggagcagctggcttgagcagaatcttgggacctgaggctctcaggrgacctcccattgggggatggagggcaatggtggtggtgcccaggaggtcttctacttagatgtctattggatctctaaatgaggctgcatgcataatcac

SEQ ID NO: 63116 - DNA, 201 bp, Homo sapiens
ggtcatctctcagtctccatgggaaattgattccaggaccctctgcagataccaaaatccatggatgttcaagtccttgatataaaatggcatagtatttrcatataacctaagcacagcctcccacatactttaaatctctagattacttataatacctaatacgacggaagtgctgtgtgaatggttgttatactgtat

SEQ ID NO: 63117 - DNA, 201 bp, Homo sapiens
tggtctccaactcctggccttaagtgatcctccaatctctgcctcctaaaatgctgggcttacaggcatgagccactgcacccggcccacagatgcaattwaaaaaaaaatatatatatatatatatatatatatattttttttttttttttttgagatggagtcttgctctgtcacccaggctggagtgcagtggcacga

SEQ ID NO: 63118 - DNA, 201 bp, Homo sapiens
ggtctccaactcctggccttaagtgatcctccaatctctgcctcctaaaatgctgggcttacaggcatgagccactgcacccggcccacagatgcaatttaaaaaaaaatatatatatatatatatatatatatattttttttttttttttttgagatggagtcttgctctgtcacccaggctggagtgcagtggcacgat

SEQ ID NO: 63119 - DNA, 201 bp, Homo sapiens
gtctccaactcctggccttaagtgatcctccaatctctgcctcctaaaatgctgggcttacaggcatgagccactgcacccggcccacagatgcaatttaaaaaaaaatatatatatatatatatatatatatattttttttttttttttttgagatggagtcttgctctgtcacccaggctggagtgcagtggcacgatc

SEQ ID NO: 63120 - DNA, 201 bp, Homo sapiens
aactcctggccttaagtgatcctccaatctctgcctcctaaaatgctgggcttacaggcatgagccactgcacccggcccacagatgcaatttaaaaaaawatatatatatatatatatatatatatattttttttttttttttttgagatggagtcttgctctgtcacccaggctggagtgcagtggcacgatctcggct

SEQ ID NO: 63121 - DNA, 201 bp, Homo sapiens
ctcctggccttaagtgatcctccaatctctgcctcctaaaatgctgggcttacaggcatgagccactgcacccggcccacagatgcaatttaaaaaaaaawatatatatatatatatatatatatattttttttttttttttttgagatggagtcttgctctgtcacccaggctggagtgcagtggcacgatctcggctca

SEQ ID NO: 63122 - DNA, 201 bp, Homo sapiens
agactgcattcctcccaggtccctcctttctccccggagcagtcctagggcgcgccgttttagccctcatttccattttcctttcctttccctttctttcyctttctatttctttctttctttctttctttctttctttctttctttctttctttctttcctttctttctttcctttctttctttcttttcttctttcttt

SEQ ID NO: 63123 - DNA, 201 bp, Homo sapiens
tcctgactctggcaccccttctgctgggtccccactgccctgtagtggtccccacgctaccatgctgcctcctttttgatgcagcctgtgccatctctctrtgattgttggggtcagatgctggagtccactccctggcttggcatccaggctccaacacgtactgcctgtgtgtccttgggcaagtctcataacctctct

SEQ ID NO: 63124 - DNA, 201 bp, Homo sapiens
tggcggtagagctccatctcctcctgccacttcttctggaagtcgtccaggtagggctgcaccttggccttcacctcctccagatccttgctcatctcctrcctcaggccctctgtctccttttccaggttatcccagaactcctgggtcacagggccgagctgttcgcgcagcttgctgaaggtggaggtcacgctgtcc

SEQ ID NO: 63125 - DNA, 201 bp, Homo sapiens
tttctttctttcctttctttctttcctttctttctttcttttcttctttctttctttcctttctttctctttctttctttctttcctttttctttctttcyctctcttcctttctctctttctttcttcttcttttttttttaatggagtctccctctgtcacccaggctggagtgcagtggtgccatctcggctcactgc

SEQ ID NO: 63126 - DNA, 201 bp, Homo sapiens
ttctttctttcctttctttctttcctttctttctttcttttcttctttctttctttcctttctttctctttctttctttctttcctttttctttctttccytctcttcctttctctctttctttcttcttcttttttttttaatggagtctccctctgtcacccaggctggagtgcagtggtgccatctcggctcactgca

SEQ ID NO: 63127 - DNA, 201 bp, Homo sapiens
tttcctttctttctttcctttctttctttcttttcttctttctttctttcctttctttctctttctttctttctttcctttttctttctttccctctcttyctttctctctttctttcttcttcttttttttttaatggagtctccctctgtcacccaggctggagtgcagtggtgccatctcggctcactgcaacctccg

SEQ ID NO: 63128 - DNA, 201 bp, Homo sapiens
tctttctttcctttctttctttcttttcttctttctttctttcctttctttctctttctttctttctttcctttttctttctttccctctcttcctttctytctttctttcttcttcttttttttttaatggagtctccctctgtcacccaggctggagtgcagtggtgccatctcggctcactgcaacctccgtctcccg

SEQ ID NO: 63129 - DNA, 201 bp, Homo sapiens
ttcctttctttctttcttttcttctttctttctttcctttctttctctttctttctttctttcctttttctttctttccctctcttcctttctctctttcyttcttcttcttttttttttaatggagtctccctctgtcacccaggctggagtgcagtggtgccatctcggctcactgcaacctccgtctcccgggttcaa

SEQ ID NO: 63130 - DNA, 201 bp, Homo sapiens
catgtcctgacctccctgggtccgttgccatgcgggagagagaggccaggctcctccagaccctctgcagagatggaaaggcttggagggtctggggccaygggaccccgccagcccattctagcacacccgggcccatagaccttgttgcctgcccctgcctggatctgggtccccactgtgcctttgcctctggggcta

SEQ ID NO: 63131 - DNA, 201 bp, Homo sapiens
tctctgcctcctaaaatgctgggcttacaggcatgagccactgcacccggcccacagatgcaatttaaaaaaaaatatatatatatatatatatatatatwttttttttttttttttttgagatggagtcttgctctgtcacccaggctggagtgcagtggcacgatctcggctcactgcaagctctgcctcccgggttca

SEQ ID NO: 63132 - DNA, 201 bp, Homo sapiens
ctctgcctcctaaaatgctgggcttacaggcatgagccactgcacccggcccacagatgcaatttaaaaaaaaatatatatatatatatatatatatatattttttttttttttttttgagatggagtcttgctctgtcacccaggctggagtgcagtggcacgatctcggctcactgcaagctctgcctcccgggttcac

SEQ ID NO: 63133 - DNA, 201 bp, Homo sapiens
ggggtttcgccgtgttagccaggatggtctcgatctcctgacctcgtgatccgcccgcctcagcctcccaaagtgctgagattacaggcgtgagccaccaygcccggcctaaaaaattattttcaatccaaggttggttgaatccatggacacagaaaccaaggatacagagggctgcctatagagctcctggcacagagt

SEQ ID NO: 63134 - DNA, 201 bp, Homo sapiens
cgcgcgcgcggtcgcgcatctcctcgcccagtgggctcagcttctcttgcagctcgtgcagcttctggcgcgcgccctcttggagctctgcgcgcagcggmtccaccttctggcggtagagctccatctcctcctgccacttcttctggaagtcgtccaggtagggctgcaccttggccttcacctcctccagatccttgc

SEQ ID NO: 63135 - DNA, 201 bp, Homo sapiens
gaagggcacagcgttaggagggagagggaggtgtgagtccctccgtggacccgctgctttgtacttctctatctcatttccttttcagcaccactctgggmaatcagtattccagccccattttatcctcagaaaattgaggctctgagatgttatctctgtgacctgggtcctattacgtgccaaaggcatcatttaagc

SEQ ID NO: 63136 - DNA, 201 bp, Homo sapiens
cccagggctcgtccagaggccgatccaccccactcagccctgctctttcctcaggagcttcagaggccgaggatgcctcccttctcagcttcatgcagggytacatgaagcacgccaccaagaccgccaaggatgcactgagcagcgtgcaggagtcccaggtggcccagcaggccaggtacacccgctggcctccctccc

SEQ ID NO: 63137 - DNA, 201 bp, Homo sapiens
gtgcccctgtcccttccccaggccagaggggaggaggagactgagtcacgaatgacacctcagccgcagtttgacctccaggacttacagtcctagcagcmggtgccactagcatgtgagaggtccagaggcgcttctgtctcacccgcccgcctgggtgcacccatgctgggagcgcctgcaccatttgagcatgtccga

SEQ ID NO: 63138 - DNA, 201 bp, Homo sapiens
gtccttgatataaaatggcatagtatttacatataacctaagcacagcctcccacatactttaaatctctagattacttataatacctaatacgacggaartgctgtgtgaatggttgttatactgtattgtttaggaggtaatcaccaaaaaagtctgtatatgtttagtacaggtgcaattttttttttttttgagatg

SEQ ID NO: 63139 - DNA, 201 bp, Homo sapiens
cacagagaggagctaaaaaggagacagagctgggactggtgcccagttacgttggtctccaaagtgggcccttgaaggacctcgcttctatgcctccagcrcattctcctctccgaagacagcccacagtcttgctgggcaggagcagaggaggtggtgaagaagggaaaggggcttgctacacttgcaggcacaatgtgg

SEQ ID NO: 63140 - DNA, 201 bp, Homo sapiens
gttggtctccaaagtgggcccttgaaggacctcgcttctatgcctccagcgcattctcctctccgaagacagcccacagtcttgctgggcaggagcagagraggtggtgaagaagggaaaggggcttgctacacttgcaggcacaatgtggctctgtgatcacgcatcgggcagccctggtctgtcctttgcaggggacat

SEQ ID NO: 63141 - DNA, 201 bp, Homo sapiens
tctccccatgccaccatctcacagatgaagagactgaagagcacagagggactttgcccagaggctgtcatctctcagggagttagaagaaaggctggacytagaacccagtctctggacttgggatgcagggcagaaatgtaccctgtaccatcactccaggaaactccctaacactagaaaccaggctgacatctctgt

SEQ ID NO: 63142 - DNA, 201 bp, Homo sapiens
ctttctttctttcttttcttctttctttctttcctttctttctctttctttctttctttcctttttctttctttccctctcttcctttctctctttctttyttcttcttttttttttaatggagtctccctctgtcacccaggctggagtgcagtggtgccatctcggctcactgcaacctccgtctcccgggttcaaccc

SEQ ID NO: 63143 - DNA, 201 bp, Homo sapiens
gctgctcactggtcctggcaatgtggaacttaagagttcaaggatcagctctgtccctggggctgggcaaatagagtgggcaaacagcaagctgcgggggstgcagggcaggggtcaagggttcagtgggggcgggaggggagtgtctgcaggcttgcaggtctcccgggtggggtcggggttccctgcactcatcccctt

SEQ ID NO: 63144 - DNA, 201 bp, Homo sapiens
cctttctctctttctttcttcttcttttttttttaatggagtctccctctgtcacccaggctggagtgcagtggtgccatctcggctcactgcaacctccrtctcccgggttcaacccattctcctgcctcagcctcccaagtagctgggattacaggcacgcgccaccacacccagctaatttttgtatttttagcagag

SEQ ID NO: 63145 - DNA, 201 bp, Homo sapiens
ggagtgcagtggtgccatctcggctcactgcaacctccgtctcccgggttcaacccattctcctgcctcagcctcccaagtagctgggattacaggcacgygccaccacacccagctaatttttgtatttttagcagagatggggtttcaccatgttggccaggttggtcttgaattcctgacctcaggggatcctcctgc

SEQ ID NO: 63146 - DNA, 201 bp, Homo sapiens
gtatttttagcagagatggggtttcaccatgttggccaggttggtcttgaattcctgacctcaggggatcctcctgcctcggcctcccaaagtgctgggaytacaggcacgagccactgcgcctggccccattttccttttctgaaggtctggctagagcagtggtcctcagcctttttggcaccagggaccagttttgtg

SEQ ID NO: 63147 - DNA, 201 bp, Homo sapiens
ttcaccttctaccccaccaccaaagtctgcaggagacttgagacaggtttgttctgggcgtgtgactgatgcctctataggggtctcagtgctctaagccrtctggtatttgcctggggtgtgtgaagacctggattaaggttcccagccttactactaatgggctgtgcacttggagcccttagagccttaggtttctaa

SEQ ID NO: 63148 - DNA, 201 bp, Homo sapiens
gtgtgaagacctggattaaggttcccagccttactactaatgggctgtgcacttggagcccttagagccttaggtttctaacctataaaatggacttaacrtctacttcacagggttctatttgcattttaacagaaaacaaagtcttaagtcaaaggaatgaatctctctctctctctctctctctctcttttttagacc

SEQ ID NO: 63149 - DNA, 201 bp, Homo sapiens
gggtgccttcagcatgcagaagccccgtgctcccccactcattgcagccaggtgaggagaagggcacagagcgggagaagacctcaggtacccagaggccyggcctggggcaaggcctgaaccttgagctggggagccagagtgaccggggcaggcagcaggacgcacctccttctcgcagtctctaagcagccagctctt

SEQ ID NO: 63150 - DNA, 201 bp, Homo sapiens
gccttggcgtggtactcggccagtctggcgccgccgttctccttgagagcctcaaggcgcgcggccaagcgctggcgcagctcgtcgctgtagggggccaratgcgtgcgcagcgcgtccacatgggcgcgcgcgcggtcgcgcatctcctcgcccagtgggctcagcttctcttgcagctcgtgcagcttctggcgcgcg

SEQ ID NO: 63151 - DNA, 201 bp, Homo sapiens
agacatgagtgcaaggagggaccgtgagcagggaggtcatgtgagaatacacaggcatgcctgcacacccatgtgaacttgagtgccaggccacacactcyttttttttttttttttttttttagctggagtcttgctccgtcgcccaggctggagtgcagtggcatgatttcggctcactgtgacctctgcctcccaggt

SEQ ID NO: 63152 - DNA, 201 bp, Homo sapiens
ttggccaggctggtctcaaactcctggcctgaagtgatacgcccacctcagcctcccaaagtgctgggattacaggcttgagccaccgcacccgacccgcrcactcttttcaataatcatggatggccaggggtgcagggtctaaaaagcgctgcctagcccatcctgctgttcactgggcaagcgacgtcacaggtccag

SEQ ID NO: 63153 - DNA, 201 bp, Homo sapiens
acgagccactgcgcctggccccattttccttttctgaaggtctggctagagcagtggtcctcagcctttttggcaccagggaccagttttgtggtggacawtttttccatgggccagcggggatggttttgggatgaagctgttccacctcagatcatcaggcattagattctcataaggagccctccacctagatccctg

SEQ ID NO: 63154 - DNA, 201 bp, Homo sapiens
cagaggagttctcatgccctgctctgttgcttcccctgactgatttaggggctgggtgaccgatggcttcagttccctgaaagactactggagcaccgttraggacaagttctctgagttctgggatttggaccctgaggtcagaccaacttcagccgtggctgcctgagacctcaataccccaagtccacctgcctatcc

SEQ ID NO: 63155 - DNA, 201 bp, Homo sapiens
tttctacttgagccttgctaaggcagactctactccctcactcgtaagcagccaggcgtccagcaggtcctccaacgtcgatcttggccctaagacgtccwgtctgggcacggagttgttgagatccggcaggaagtccctgctccagggccaaaggccccacccgggctcccccggatgtccccgcacccccctctattc

SEQ ID NO: 63156 - DNA, 201 bp, Homo sapiens
aggagcagaggaggtggtgaagaagggaaaggggcttgctacacttgcaggcacaatgtggctctgtgatcacgcatcgggcagccctggtctgtcctttkcaggggacatgggctgtgaccctgcctggagatcccattccggtttctccatccagaccatctgtggggcccagctcatcagatattaggtgaggactcg

SEQ ID NO: 63157 - DNA, 201 bp, Homo sapiens; identical to SEQ ID NO: 12563

SEQ ID NO: 63158 - DNA, 201 bp, Homo sapiens
ctcaggccctctgtctccttttccaggttatcccagaactcctgggtcacagggccgagctgttcgcgcagcttgctgaaggtggaggtcacgctgtcccrgttgtcaaggagctttaggctggagggtgagacagaagggttgagggctggcctcccagcgccccagcctatcaggggtgagccctgggtgacacctgtc

SEQ ID NO: 63159 - DNA, 201 bp, Homo sapiens; identical to SEQ ID NO: 12564

SEQ ID NO: 63160 - DNA, 201 bp, Homo sapiens
gactcggccagtctggcttcaacatcatcccacaggcctctgccccctgcccctgccctcaaccccaggctgggtccttactttagctgttttcccaaggyggagccttcaaactgggacacatagtctctgccgctgtctttgagcacatccacgtacacagtggccaggtccttcactcgatcccaggggctctggggg

SEQ ID NO: 63161 - DNA, 201 bp, Homo sapiens
gtactcggccagtctggcgccgccgttctccttgagagcctcaaggcgcgcggccaagcgctggcgcagctcgtcgctgtagggggccagatgcgtgcgcrgcgcgtccacatgggcgcgcgcgcggtcgcgcatctcctcgcccagtgggctcagcttctcttgcagctcgtgcagcttctggcgcgcgccctcttggag

SEQ ID NO: 63162 - DNA, 201 bp, Homo sapiens
ccctggagaaaggagaactaatatttattgtttactctgtaccaggcagtcctctaagcctattttgtagaatatctggttggatcctcacaacaaccccrtgagatatttatataattgttgtatgtaatttttcccactgcacaaatgagataagtaggcccaacgaggttgcataacttggccagaagcacgttgctc

SEQ ID NO: 63163 - DNA, 201 bp, Homo sapiens
ctgattagagtgactgttggtttgaatgctgccctctgggcaggtagaggatctgaggttgtgagtggaaggagggcttccagagggccactgcccactayggcaggaaggatgggtggcaggaaagttctgattcctaattcaaactcctggttagggtgaggaggaggcacttctccaaggtgcagtgctttattcttt

SEQ ID NO: 63164 - DNA, 201 bp, Homo sapiens
tcatgtttcctggatgtaacatacaggaagtctcctccaggggatgtcactgtggaaaaatggcatcccctttaaatacgggagatcacttcctacattgrcaagggacctgtctaaaaataatgcaagtttgagtaatggtgattaaataaaaatcatctctattatattgctctttgtgatatatttccaaagctgtcc

SEQ ID NO: 63165 - DNA, 201 bp, Homo sapiens
acatcgcacccatcgcggtccatccattagatgagaagaggatagagtgccttctgggcaggaaccaggcagacagcacagcccctgtcccttggagtacmgtccatgtttttagctgctgctgaaataccagctgcattcaattgtcacatcccattagctggtgtgaaaaggcttttcctcactctgcactttcagact

SEQ ID NO: 63166 - DNA, 201 bp, Homo sapiens
gtgggagaggcagataaaagatctgcagaaaaacaggagttcaggaggattaagagctgaaatcaggaggcagacttctgggcttgaatacaaattctgcrgcttcctggctttgtggttttgggcaaattacctgcctctctatgcctcagtttctccatctgtaagataataagaataattatagtacttcatagagtt

SEQ ID NO: 63167 - DNA, 201 bp, Homo sapiens
gggatgtcactgtggaaaaatggcatcccctttaaatacgggagatcacttcctacattggcaagggacctgtctaaaaataatgcaagtttgagtaatgktgattaaataaaaatcatctctattatattgctctttgtgatatatttccaaagctgtcctcagaatatttctttgaataaatccttactatttaccagg

SEQ ID NO: 63168 - DNA, 201 bp, Homo sapiens
cagagtcttgctctgttgcccaggctggagtgcagtggtgccatctgagctcactgcagcctctgcctcccgggttcaagtgattatcctgcctcagcctyccgagtagctggcattacaggtgcgtgccaccatgcctggctaatttttgtatttttaatagagatggggtttcaccatgttggccaggttgctctccaa

SEQ ID NO: 63169 - DNA, 201 bp, Homo sapiens
acagccatactgaagggccaggaagctaagatgtagacagtgttttaaagggtaaaaaatggtgatgacaaattactccccacctcatttggcagccgagygtattacatggcttaatgcatgtaaagtacttagaaatgttgctagtatggtcaggcccagtggctcatgcctgtaatcccagaactttgggaggccaag

SEQ ID NO: 63170 - DNA, 201 bp, Homo sapiens
aggaggtatttaaagggcaatgcacccaggtcaaggtggaagcttgctactcatcctgaatgcccatccacacattcttttcttcagcatataccctagtycctgacagcagactgggatggcaagttgggtagaggtgacctccctctgttttttgggtattagcatctccacacaagatcctagaaggctgaaagccct

SEQ ID NO: 63171 - DNA, 201 bp, Homo sapiens
cttctggggctgcttggctctacatcatttgagtcactctgtccttatcaactttcatccccacagtatttttcctgtgaacagccatgcaaccaaaccayggcaggcaacgcgctgacatttctgaagagtcttctggaaattttccagaaagaaaagatgagagggatgagaggcaagatatgaagatgaaatattatt

SEQ ID NO: 63172 - DNA, 201 bp, Homo sapiens
gaaagacaacctaaaaggataatgatacaattttaggcctcaaagagtccccagaaaaggctttctctaatgcagagatttagggccacttaataggggtgtgtgtgtgtgtgtgtgtgtgtgtgtgtgtgtgtgtgtgtgtgtgtaaagacccctgaaatccaatttgaggtcaaccacctatgctgtctttacaccaca

SEQ ID NO: 63173 - DNA, 201 bp, Homo sapiens
gcacaaagggatacttctaagatgcatttgcattaggtggcaaacttcatcctgggtatgaaaaacattgagatttgggaataaagcatagtaagactgaggttgcaattactaaaggaaaaccccaacagagataagtgaagttctgcaatatcatgcaccctcccccaacccgctctgtctccccaggccccccttcgt

SEQ ID NO: 63174 - DNA, 201 bp, Homo sapiens
cccaagcaggatcccagcagggacagatactgatggttggtgatggtttcagaatataactcggaaatgcaatgtcttgccagaggagacgggcagagacragcttccactcactgatgcagattaatcaccagcatagcttggtgctttccctaggcttttctgcaaaagtcacataacctgcagtgttcattcctgcag

SEQ ID NO: 63175 - DNA, 201 bp, Homo sapiens
aaagacaacctaaaaggataatgatacaattttaggcctcaaagagtccccagaaaaggctttctctaatgcagagatttagggccacttaataggggtgtgtgtgtgtgtgtgtgtgtgtgtgtgtgtgtgtgtgtgtgtgtgtaaagacccctgaaatccaatttgaggtcaaccacctatgctgtctttacaccacat

SEQ ID NO: 63176 - DNA, 201 bp, Homo sapiens
aaattactccccacctcatttggcagccgagtgtattacatggcttaatgcatgtaaagtacttagaaatgttgctagtatggtcaggcccagtggctcaygcctgtaatcccagaactttgggaggccaaggcgggcggatcacgaggtcaggagttcaagaccagcctggccaacatagtgaaacctcgtctctactaa

SEQ ID NO: 63177 - DNA, 201 bp, Homo sapiens
tgcaccctcccccaacccgctctgtctccccaggccccccttcgttagaacacccatgactggctatattatatcagcatttcccataatgtaaaaagggmaaatacagacctgggcgttcatggaaagtattctaactctcacaaccagaatccctgtctttgaattttttttcttggtttttagatctttaacttttcc

SEQ ID NO: 63178 - DNA, 201 bp, Homo sapiens
ttggaggtccaaaggccaaacatctgcagctctcagggcttcacatgcagagatgaggcccagggaacactgtagtcatcctgtgttcacctcctggaaamagcaaacaacccagactcagagaagaaggcaggcaaagaacagaaaccagaaaaatcacaccaggccaccccttcctctaacccctatgttttgcacttt

SEQ ID NO: 63179 - DNA, 201 bp, Homo sapiens
gaaaaggcttttcctcactctgcactttcagacttacaagccttgaagccgggaagcacccgttgaaaagaacattcagagccgactatttcagggcccasagccctcatgtttcctggatgtaacatacaggaagtctcctccaggggatgtcactgtggaaaaatggcatcccctttaaatacgggagatcacttccta

SEQ ID NO: 63180 - DNA, 201 bp, Homo sapiens
ttcatttcttgctgctcagaacaaagaaagctacaagtgttgttaaggggaagaatagatcagagactcctgtaggagtctctgtgataagactcctgatrctgaatacagaccctcaggctcataggctgtggctggagctgcaggagggctgcagggagcagttacaaagaatgtctatgaggaccatctgagggttgc

SEQ ID NO: 63181 - DNA, 201 bp, Homo sapiens
tgttggttaatcacttttcaaatgtgttccttgttcaggtaaatgtgacatctgctttttgtttgttacctgtctactgggaaccatgtgttggtcatttyatcagtaacacaaatttaataaatgttcacaaaattaaatgtattagtcatttattcatttaaccaggaattcctgagcactctgtatagactatgccct

SEQ ID NO: 63182 - DNA, 201 bp, Homo sapiens
tagtctcatggttttattttttattgcctttctgaatatttgctatttatgaaaaatgttagtgttgccattgctgtaattctcttgtccatttcttcatmgttataatattgctgctgaagctcctgccatcacacccaaattggaattaaggggaaagacagggttcagccacttttgtctcctattaccaggaaagca

SEQ ID NO: 63183 - DNA, 201 bp, Homo sapiens
gaaatttcccttgcaggtgaccagttgtctctgtttgggcattccctctgtaagtatagtgaaataacataatgttgaccttggatttttttggtttgttwttaagtaaaaataagttgctttatttaatatttaatgttatacattgttgcttaatttaattgttacagattagtattccctgttaaaaccacattgtta

SEQ ID NO: 63184 - DNA, 201 bp, Homo sapiens
tttaatatttaatgttatacattgttgcttaatttaattgttacagattagtattccctgttaaaaccacattgttacaaattattcccttttaaaactaygatcttgaaatcctatattatgaacatttctttgtatttaattaactttatgcctcttgagaagtttgaacacttttcaacattaaaaaaagaatcctga

SEQ ID NO: 63185 - DNA, 201 bp, Homo sapiens
aagacaacctaaaaggataatgatacaattttaggcctcaaagagtccccagaaaaggctttctctaatgcagagatttagggccacttaataggggtgtktgtgtgtgtgtgtgtgtgtgtgtgtgtgtgtgtgtgtgtgtgtaaagacccctgaaatccaatttgaggtcaaccacctatgctgtctttacaccacatg

SEQ ID NO: 63186 - DNA, 201 bp, Homo sapiens
catcacacccaaattggaattaaggggaaagacagggttcagccacttttgtctcctattaccaggaaagcaaaataattttacatactttgcattgatcraaacatgctgcatggctacatgtagcagcaaaagaggctgaaaatgtgggtgtttggctggatacattggtaccccaaactaatcagaattctaccatca

SEQ ID NO: 63187 - DNA, 201 bp, Homo sapiens
atctgaagaatctgagcttcttgccctggctagggtaagacatcgcacccatcgcggtccatccattagatgagaagaggatagagtgccttctgggcagkaaccaggcagacagcacagcccctgtcccttggagtaccgtccatgtttttagctgctgctgaaataccagctgcattcaattgtcacatcccattagct

SEQ ID NO: 63188 - DNA, 201 bp, Homo sapiens
ggagacaccagcccaagcaggatcccagcagggacagatactgatggttggtgatggtttcagaatataactcggaaatgcaatgtcttgccagaggagaygggcagagacgagcttccactcactgatgcagattaatcaccagcatagcttggtgctttccctaggcttttctgcaaaagtcacataacctgcagtgtt

SEQ ID NO: 63189 - DNA, 201 bp, Homo sapiens
accagctgcattcaattgtcacatcccattagctggtgtgaaaaggcttttcctcactctgcactttcagacttacaagccttgaagccgggaagcacccrttgaaaagaacattcagagccgactatttcagggcccagagccctcatgtttcctggatgtaacatacaggaagtctcctccaggggatgtcactgtgga

SEQ ID NO: 63190 - DNA, 201 bp, Homo sapiens
gcaccctcccccaacccgctctgtctccccaggccccccttcgttagaacacccatgactggctatattatatcagcatttcccataatgtaaaaagggavaatacagacctgggcgttcatggaaagtattctaactctcacaaccagaatccctgtctttgaattttttttcttggtttttagatctttaacttttcct

SEQ ID NO: 63191 - DNA, 201 bp, Homo sapiens
agtactaaagaacaacaagtgtccagtaagtttgttttcatatgtgatatgttcctgttggtgatttctatgtgaatggtgatgccaaccctgtttgaacrcaaaaggatgataaagttggaattggtagttcaaggttgataaaagacatctaagaattttaatcagaagtaatataattaaagtgagatccactgaaac

SEQ ID NO: 63192 - DNA, 201 bp, Homo sapiens
gtcatagactttgcctagataaacatctgctgttttaatggtattttgaactgcagagctaccgtttaacaaccctgtattcttttcttttttataactgrgtgggtggggaaatgggaaagaattctaaagaaccagtcacctcacctgtctccttctctctgtttcatcctttgcagaggagctcctgcaccacgcatg

SEQ ID NO: 63193 - DNA, 201 bp, Homo sapiens
agaacaggtcacgtagggaggagctgaggaaggagccagcaggccaagcttagcaagggtaaaggcctggaggatggaaatgaaaagaaactgatgtgacrggagggtagtaatgagggggtatcaaagagcgaggcacctggaccagaccagaccacatttccaaacagaaacatgcctcattcctgagagtatatccca

SEQ ID NO: 63194 - DNA, 201 bp, Homo sapiens
gacccctcccagatctggctacctcatgagatttgtttgggctggagctgagtttcttcaataaagccgagtttcattcattgcagcccaggtgctcctgrgtgggagtgaaggtgcagaagatgtgctgaggcattgtctgcccagcatggaggagggcggggggagggggtgtggcaggggctgttactcagagctggg

SEQ ID NO: 63195 - DNA, 201 bp, Homo sapiens
agcacgttgctcacaagcagtgaagttgctaccctctccaggttgccaggccccaggcagagttgtttccagcagattccagatcaaagcacacactgcargccaagatgtggccagccataaagctagcttgcccatctatccatccatccctccctctttacatccacccagtttgaagcaggaagatgctgtgatgtt

SEQ ID NO: 63196 - DNA, 201 bp, Homo sapiens
cagggtccctgccattgtcacccaatgcctgtaacagcactggccacagtcagactacacacacacacacacactctctctctctctctctctctctctcwcacacacacacacacacacacacatatatatattttatatatatatatatatatatatatatatatatatatatatatatatatttggttaaatagaacc

SEQ ID NO: 63197 - DNA, 201 bp, Homo sapiens
catctccacacaagatcctagaaggctgaaagccctgagctcagctgtttagctgcatgcgtttctaccatcaatggcatctagttctaagtgcttaatayatgctgtctcactgaataaatacataccttagggacaattattcaatttattactctcagtgaggttaactaatttgcctaaggctgcatatttgataag

SEQ ID NO: 63198 - DNA, 201 bp, Homo sapiens
tgttacctgtctactgggaaccatgtgttggtcatttcatcagtaacacaaatttaataaatgttcacaaaattaaatgtattagtcatttattcatttamccaggaattcctgagcactctgtatagactatgccctgggaatagtgatgagcaagagagtccgttgtagtgtccattgtcatggaactgacattctcct

SEQ ID NO: 63199 - DNA, 201 bp, Homo sapiens
cataccttagggacaattattcaatttattactctcagtgaggttaactaatttgcctaaggctgcatatttgataagtggcagagctgagatttgaactsaggcctatatgacctcagagccccactcttagccattgtactgtcaaatgaccttggaaagacaacctaaaaggataatgatacaattttaggcctcaaa

SEQ ID NO: 63200 - DNA, 201 bp, Homo sapiens
tagggccacttaataggggtgtgtgtgtgtgtgtgtgtgtgtgtgtgtgtgtgtgtgtgtgtgtgtaaagacccctgaaatccaatttgaggtcaaccacmtatgctgtctttacaccacatgagctagcctggacctgcccacctatttgctctgtgtctcaagccacttcccttcccatccccacaatcctcaccaccg

SEQ ID NO: 63201 - DNA, 201 bp, Homo sapiens
tctctatctactttaggaagatccagcttccaagtgccactgcagtgctaatgtgagtgaatgctctttaagaactttccaaattaattttaattttcacrtctggaatcttcactctgaaatttcccttgcaggtgaccagttgtctctgtttgggcattccctctgtaagtatagtgaaataacataatgttgaccttg

SEQ ID NO: 63202 - DNA, 201 bp, Homo sapiens
ctgtttaagccagacttcgccgcaaaaacggaaaacgcaagtcttctcgttaattatattggtttagaaagaatcgttattttcatagaatgttatttatkttaaaatgtcatgggtttattattatacctaaatggataaatatttttgaaattctgtttgaatttccagtaattgttggtaaatatataagcagttgtt

SEQ ID NO: 63203 - DNA, 201 bp, Homo sapiens
taatgtgagtgaatgctctttaagaactttccaaattaattttaattttcacatctggaatcttcactctgaaatttcccttgcaggtgaccagttgtctmtgtttgggcattccctctgtaagtatagtgaaataacataatgttgaccttggatttttttggtttgtttttaagtaaaaataagttgctttatttaata

SEQ ID NO: 63204 - DNA, 201 bp, Homo sapiens
aaggggaaagacagggttcagccacttttgtctcctattaccaggaaagcaaaataattttacatactttgcattgatcgaaacatgctgcatggctacakgtagcagcaaaagaggctgaaaatgtgggtgtttggctggatacattggtaccccaaactaatcagaattctaccatcaagaaaaaggcatacatccagt

SEQ ID NO: 63205 - DNA, 201 bp, Homo sapiens
catatgagcttttatcacaaaataaaaacatcaaactttatctttggaacaaaataaatggttgatcattgtcttttgtcatttattgtaaaatatgttayctatgataactcttggtatgcatctcactctaatcttgatatttaaaataggtgagtaattgatttctgagcgtggtgtatttgctctgtagcttatatg

SEQ ID NO: 63206 - DNA, 201 bp, Homo sapiens
ttgccacaggctgggaatcctttgagttttctcttcagtgtctgcaaagagcagggatggaagtcagagatgtgggatggcttaagggaatttagcaaaayacctgtttctctttaccttgtttaccaccaagacactcccttccccatagtgcagtggaacactgacgagccatcatcactcctaagaaacaatacaaaa

SEQ ID NO: 63207 - DNA, 201 bp, Homo sapiens
ctggccacagtcagactacacacacacacacacactctctctctctctctctctctctctctcacacacacacacacacacacacatatatatattttatwtatatatatatatatatatatatatatatatatatatatatatatttggttaaatagaaccataatgtgttgatggaggaagactcacaagctgttggcc

SEQ ID NO: 63208 - DNA, 201 bp, Homo sapiens
gcacctccttaagtgctgagaatataggggtgaactggacccataaagccctggagtatatatcctggtgggagaggcagataaaagatctgcagaaaaayaggagttcaggaggattaagagctgaaatcaggaggcagacttctgggcttgaatacaaattctgcggcttcctggctttgtggttttgggcaaattacc

SEQ ID NO: 63209 - DNA, 201 bp, Homo sapiens
atggtgatgacaaattactccccacctcatttggcagccgagtgtattacatggcttaatgcatgtaaagtacttagaaatgttgctagtatggtcaggcmcagtggctcatgcctgtaatcccagaactttgggaggccaaggcgggcggatcacgaggtcaggagttcaagaccagcctggccaacatagtgaaacctc

SEQ ID NO: 63210 - DNA, 201 bp, Homo sapiens
cgtggtggagggtgcctgtaattctagctactcgggaggctgaggcaggagaatcgcttgaacccgggaggcagaggttgcagcgaacctggattgtgccmccgcactccagcctggtgacagagggagactctgtctcaaaaaaaaaaaaaaaaaaaaaagaaatgttactagtatgtagtaagttctcagtaaatgtta

SEQ ID NO: 63211 - DNA, 201 bp, Homo sapiens
ttgagcctaagaggctgaagatacagtgagtcaagatcacaccactgcacttcagcctcgtcaacagagcgagaccctgtctcaaaaaaaaaaaaatacayacacacacacacacacacacacacacacacacgtatatgtatatatattttttaaattaagaaaaaatgtctgctctatgctggacacttaaagtgactt

SEQ ID NO: 63212 - DNA, 201 bp, Homo sapiens
ccctacccctgcagcatccagaagccaggccaggaggctccacctcctgaaggcagtgcagaagctgagggtggaggccagggtgccagcccgggcttccyttagagctccctgggagaaagtgggctacgtggtttcgggagcgaggggtgctgaagtgccaaggaagccctcaccccctgcctctgaggcccaggaggg

SEQ ID NO: 63213 - DNA, 201 bp, Homo sapiens; identical to SEQ ID NO: 12581

SEQ ID NO: 63214 - DNA, 201 bp, Homo sapiens
cacgccattcttctgtgtcagcctcctgagtagctgggactacaggcgcctgccaccatgcccggctaattttttgtatttttagtagagacgaggtttcwccatgttagccaggatggtctcgacctcgtgatccgcctgcctcagcctcccaaagtgctgggattacaggcgtgagccaccatgcccaggccttttttt

SEQ ID NO: 63215 - DNA, 201 bp, Homo sapiens
cgaacccgcggcctgcaggctccaagacaccactgccgttgaggcagacagaagagctggccttacggcaggcgctcctctccctgtggcctgaggctccracgggcagacaggaccccagcccatgcctcgagggcaccgcggccccgcttcacacggtgacctcggtcttgctattggtccttaggtaccgggacccgc

SEQ ID NO: 63216 - DNA, 201 bp, Homo sapiens
actacaggcgcctgccaccatgcccggctaattttttgtatttttagtagagacgaggtttcaccatgttagccaggatggtctcgacctcgtgatccgcytgcctcagcctcccaaagtgctgggattacaggcgtgagccaccatgcccaggcctttttttttttttttttttttgagatggagtttcgctcttgttgc

SEQ ID NO: 63217 - DNA, 201 bp, Homo sapiens
ctttctctgctttcctgcctcttctcccaaaaaactgctactcattcttcagaccccatcagcggcctcctccaggaatccttttttttaatttttttatyttttgaagcagagtctcgctctgttgtccaggctggagtgcaatggcgcaatcttggctcactgcaacctccacctccccggttcaagtgattctccagc

SEQ ID NO: 63218 - DNA, 201 bp, Homo sapiens
agcaactcaaatgtccatccacaggaaaataagcacattgtgatatattcatacaatgaaattatgcctagcaattaaaaaacagaactgctgacaggcayggtggctcacgcctgtaatctcagcactttgggaggccaagaggggtggatcacctgaggtcaggagtttgagaccagcctggccaacacggtgaaaccc

SEQ ID NO: 63219 - DNA, 201 bp, Homo sapiens
caggggttttcaccatgtttgtcaggctggtctcgaactcctgacttcaggtgatccacctgccttggcctcccaaagtgctgggattacaagcataagcyaccacccctggcctatttacatttaattatgatttatttttcctatccttctgcaagcatatatatatatatatatatatatatatatatatatacacac

SEQ ID NO: 63220 - DNA, 201 bp, Homo sapiens
ggccaaggtgggcagatcacgaggtcaggagatcgagaccatcctggctaacacggtgaaaccccgtctactaaaaatacaaaaaattagccaggcgtggkggcgggcgcctgtggtcccagctattccggaggctgaggcaggagaatggcatgaatccgggaggcggagcttgcagtgagccaagattgcgccactgca

SEQ ID NO: 63221 - DNA, 201 bp, Homo sapiens
taaaaatacaaaaaattagccaggcgtggtggcgggcgcctgtggtcccagctattccggaggctgaggcaggagaatggcatgaatccgggaggcggagsttgcagtgagccaagattgcgccactgcactccagcctgggtgacagagctagactctgtctcaaaaaaaaaaaaagaaaggggatgggaatgaaatgtg

SEQ ID NO: 63222 - DNA, 201 bp, Homo sapiens
ggtggcgggcgcctgtggtcccagctattccggaggctgaggcaggagaatggcatgaatccgggaggcggagcttgcagtgagccaagattgcgccactrcactccagcctgggtgacagagctagactctgtctcaaaaaaaaaaaaagaaaggggatgggaatgaaatgtgacgagctcagcagaaggcagacacatc

SEQ ID NO: 63223 - DNA, 201 bp, Homo sapiens
tgagtcaccgcgcccggcccaaaaaatctttgtgtttttttgtttgtttgttttgtgttcagagaagggatctggctaggtgccctggctcatgcctgtaktcccagcactttgggaggccaaaccgagaggttgcttttcaggagtttgagaccagcctgggcaacatggtgaaatctcgtctctacagaaaatacaaaa

SEQ ID NO: 63224 - DNA, 201 bp, Homo sapiens
agaatgaagggtgagactcgaggggaggacagggactcaggacacacccacacacaagcctacgtcccattccaggtctccccagcagagaaaagggagtyggggccatgggagcctgaagcccagaaaggagaagggactggcctacaccacacagcacagcaagggtgggcatggctttcctgcggcatcaccaaacct

SEQ ID NO: 63225 - DNA, 201 bp, Homo sapiens
tgatgtgggaaacaaagcacagatagtgtaccagctgcccaatagaggaaaataggagaatttactttcatttcccaagactatatagcctgtcctctagkttccagcagtgagagagagaaagcgagcggtctccagtacagtgccgtagactctccattagaccctctcaggttgacaaagattagttcatctgaatcc

SEQ ID NO: 63226 - DNA, 201 bp, Homo sapiens
cttgacagcacaagtcagggcccttgttagtttcatcacatccattacctttccttgatcacttgtaccatcatctgtaatttatttttatgtttaatacrggtgtgggatttctgattttttttttgctagactggaagctctcagagggcaggaaccatttgtttccctgccacagagatgttcaataaatattgtcaa

SEQ ID NO: 63227 - DNA, 201 bp, Homo sapiens
cttctgaaaatgaggtagaagactctttcctgtgatagtgctggggtctgtcaggtgcctggctgctccgcaaggcctttcctagcagactctgctgagaygctccttcttaggttctgggggctggtttgactggatgatgcctactcttctcttatggctggtaaatggtgtgattgtcctgagcgtctttgtgaagct

SEQ ID NO: 63228 - DNA, 201 bp, Homo sapiens
aagccaccacccctggcctatttacatttaattatgatttatttttcctatccttctgcaagcatatatatatatatatatatatatatatatatatatayacacacacacacacacacacaaaatatcaaaatatatatatatatgtatatatatatatatttttttttttttttgagactgagtctcgctctgttgccc

SEQ ID NO: 63229 - DNA, 201 bp, Homo sapiens
ttatttttcctatccttctgcaagcatatatatatatatatatatatatatatatatatatacacacacacacacacacacacaaaatatcaaaatatatrtatatatgtatatatatatatatttttttttttttttgagactgagtctcgctctgttgcccaggctggagtgcagtggcacgatctctgctcactgcaa

SEQ ID NO: 63230 - DNA, 201 bp, Homo sapiens
tctgcaagcatatatatatatatatatatatatatatatatatatacacacacacacacacacacacaaaatatcaaaatatatatatatatgtatatatrtatatatttttttttttttttgagactgagtctcgctctgttgcccaggctggagtgcagtggcacgatctctgctcactgcaagctctgcctcccgggt

SEQ ID NO: 63231 - DNA, 201 bp, Homo sapiens
aatacggtctttgatcaacttcattgaggtgtaatttaaatgcaataaaatatacctactttaaaagtacagtaccaagagttttaacataatgtacagtrctatgtaactgtcactgtaatcaagatatagaacatttccatcaccccaaaaagctcttttgtacacctttgcaggtagtttcccacacccctctccagc

SEQ ID NO: 63232 - DNA, 201 bp, Homo sapiens
tcgtgtcaaagaaagtcctatgatagatgcttgtggtgagaggaaaaagggaccctgctgctgaatagtcacagggcagtggagtgggcgcctctgcatarataattaattccagggacatgagatgatctatgtctccggtatgacaggaataatgaagttgagttctgagggaggggttctagggcttgagcggggctg

SEQ ID NO: 63233 - DNA, 201 bp, Homo sapiens
ttcatgtgaactcagggtctctttgtgagtcatggggctgcttgcaatgcacggatgataacaggaacctctaattttggttatttgcttttagagaccasaacccagatacagtttcctggggcctcacctactttgttaagcaacttagctataagtttacaaagcagctaaaaacaggagcaggggagtgagatgagc

SEQ ID NO: 63234 - DNA, 201 bp, Homo sapiens
agggggagtagaagtctatatcaaaacaaaaagccggagcaaggccagtgaccattaacaccttttgatactttgtagggagattttgcagctgctgccgscaacctacaaacctgcctggcagttttgggccgggcactgcccacctcccgcctggacctggcctgcagcctctcctggaacgtgatccgctacagcctg

SEQ ID NO: 63235 - DNA, 201 bp, Homo sapiens
tccagctgagaagctttacgtcactcattccttccatactcactggcattccctgtgtgaggcactgaggggacagaggtaactacagtatggttgccacrctgccctctcacctcccttcctgtgtctcctgcaggaggaacacctgaggccagtacagaatggagtgtggaggctgagatctccctaggctgataaaaa

SEQ ID NO: 63236 - DNA, 201 bp, Homo sapiens
ggcgggcgcctgtggtcccagctattccggaggctgaggcaggagaatggcatgaatccgggaggcggagcttgcagtgagccaagattgcgccactgcaytccagcctgggtgacagagctagactctgtctcaaaaaaaaaaaaagaaaggggatgggaatgaaatgtgacgagctcagcagaaggcagacacatctgg

SEQ ID NO: 63237 - DNA, 201 bp, Homo sapiens
ttccaagtagctgcaattacaggcgtgtgccaccacgtccagctaattttttctatttttagtagagatggggtttcactgtgtttgccaggctggtctcraactcctgatcttaagtgatccgccggccttggcctcccaaagtgctgggattacaggtgtgagccactggcacccagccacattgtgaaggttttttaa

SEQ ID NO: 63238 - DNA, 201 bp, Homo sapiens
tttggaaacacacagtgtggctgtgctgctgacattgttatgttgcactgtgcgcctctgagtcctatacaacaacctgcaattgtgacagctctgggtgygacagaaatgggtgccatgttcccagctaccctgtgaggtagacaggaacacacagccagtatatcacagagcctggcatcccatcctgtgatcaggcct

SEQ ID NO: 63239 - DNA, 201 bp, Homo sapiens
ccctgagcacttacctagccaggagttaagatgcagaagcagttatgaacccccttccccatcaggtgctgcccacctggaggggtaggcaggcattcatkcagtcgctcatttcaccaggactcccagcaaccgataaaacagaccaaaattcctccccttgtggccttaataccataagccttgtaggcaggacatttt

SEQ ID NO: 63240 - DNA, 201 bp, Homo sapiens
gcagctggaagagagctgggtgtgggggctgggaggagtgctggagaaatttccccatcagaaggcccctcactgggcagtggaggcagggcagtgtggtrggactgactcaacagacatagtttcatctccaccctgcccttctcaggttgtgtgaccccagccacatggacacccgagtctgtgaactaaagggctggt

SEQ ID NO: 63241 - DNA, 201 bp, Homo sapiens
caggagacctaggggccaggtttgggaaaagtggttccatgtcttcagttgatcaacaagtattcaagtgctggctgtggtttctgagctgtaaggaatcrtgaaagatagcatagaattttatggcttcatggagcttgagatgagaaactctagtgccagtatggaacagcttaaaattgcacagcacaacaagtaaaa

SEQ ID NO: 63242 - DNA, 201 bp, Homo sapiens
ggcaacagagcgagactccatctcaaaaaaaaaaaaaaagtaatgacatgattacctaagtgcccctccacacagccccaaatctcctttgttgtcactcsgagtctgtcttacagcttttccccaagttgtgatgagcataaatgtaaaatccaagaaatgtttattttgtaaggggaaaaaagtgtgggtagaggagag

SEQ ID NO: 63243 - DNA, 201 bp, Homo sapiens
caaaaagagttgggcatgctgaaggtcagtggtctgaagataaaattatcccttgattctcacccctgtgttcccattactgaatgttagctccttgaggyagagaccttcgtttcattcccactaaattctttgaacctagaacagtgcctggcacagtgagagtgcccattaaatatttgtggaatgcctgagtgatcc

SEQ ID NO: 63244 - DNA, 201 bp, Homo sapiens
ctccacctcctgaaggcagtgcagaagctgagggtggaggccagggtgccagcccgggcttcccttagagctccctgggagaaagtgggctacgtggtttygggagcgaggggtgctgaagtgccaaggaagccctcaccccctgcctctgaggcccaggagggggaagtgtccacatctggcctgccagggtatgaaggc

SEQ ID NO: 63245 - DNA, 201 bp, Homo sapiens
agactgccaaaaatgggattactagcttaacgggagtgaacttttttattttttttgagacggagtcttactcttgttgcccaggctggagtgcaatggcrcgatctcggctcactgcaacctccgcccgcaccgaggttcaagcgattctcttgcctcagcctccctagtagctgggattacagtcacccgccaccatgc

SEQ ID NO: 63246 - DNA, 201 bp, Homo sapiens
ctccctagtagctgggattacagtcacccgccaccatgcccagctaatttttttgtgtatttttagtagagagggggtttcaccatgttggccaggctggyctcaaactcctgacctcaggtgatccacctgcctcagcctcccaaaatgctgggattacaggcgtgagccaccgcggccaaccaggaatgaacattttta

SEQ ID NO: 63247 - DNA, 201 bp, Homo sapiens
tggccgcggggacgtctttgggattcccggggcccagcccccagtctccgcgccccgaatccctgggcttctcaggattgaccgacggccaggtcgccggrtgctccgcgaaactttgggcagcgactgcagaagcaagttgctgatgaagagagcagtggcggcggagtgtggacacatctctccgggatggagacccgg

SEQ ID NO: 63248 - DNA, 201 bp, Homo sapiens
actgtttccgtagtcacctctactttttgatcgttcaccaggttttgaaatcactgtgtaggcagcacccactatgcagttcaaaactttatgtaggcctsttttgtactgggctccaggttcagtgctggcaaataaacaagttccttgttctcacagaatgtgtatggccttgggtgccaggcaccgttccatgcctta

SEQ ID NO: 63249 - DNA, 201 bp, Homo sapiens
tgtaagcaggcttctaagttgcaaataccaggtggtgtggtgtgctttgaagctatttattcaacatgtgtttatcaagaagtgtctgtccaggcgcagtrgctcatacctgtaatcctagcactttgggaggccaagatgagaggatcccttgagcccaggagtttgagactagcctgggcaacatacctggacaacata

SEQ ID NO: 63250 - DNA, 201 bp, Homo sapiens
agatcatctgaggtggaaaagagtccctggtaaaagtaattttaaatagttttgaagtagaattgtgaaattcagagtttggagaaaggaagagggtggtsacaagtagaaaagagaagacatggcacttacattcaaagaaagattgccctaccccacccctcaaaggcatgtgcagaagagggagtgagtacttttcca

SEQ ID NO: 63251 - DNA, 201 bp, Homo sapiens
taacaagctcctaagagctgatgctactggcctctgggggccacactttgagaccctgaaagcctaaaggatcatgcagttcatctaaatctgtgtcaccmccttatgtctaaaagctactgctggccgggcatggtggctcacgcctgtaatcccaacactttggaaggccgaggcaggtagatcacttgaggtcaggag

SEQ ID NO: 63252 - DNA, 201 bp, Homo sapiens
ctgatggatggggacagtagtcagctaagacggttccctggttcttccttgggagtttgggtgagcgatggtgccaccaacaaaggtaaagaaaatagaasgaagagcaactttccaggaaaagggtggtgagttcccttttggacacttgcctgtgagatgtggaggtgagctggacatgcaggatctacagcccaaaga

SEQ ID NO: 63253 - DNA, 201 bp, Homo sapiens
accactcttctgaattctgtcactggagtttaatctgtctattgttcatcatttcagtaaacttatcaaagtacatgcttagaagtctggctgggagggcygggcacggtggcttacccctgtaatcccggcactttgggaggccaaggcgagcagatcacctgaggtcaggagttcaagaccagcctgaccaatatgatg

SEQ ID NO: 63254 - DNA, 201 bp, Homo sapiens
gctgaggcgggtggatcacctaaggtcaggagtttgagaccagcctggccaacatgatgaaactccgtgtctactaaaaatacaaaaattagccagggatsgtagcacgcacctgtaatcccagctactcggaaggctgagacagaatcacttgaacccaggagtcagaggttgccgtgagccgagattgtgccactgcac

SEQ ID NO: 63255 - DNA, 201 bp, Homo sapiens
taagacacaccaggggacaggaccacagactgggatgggagtgctgggcctcgtcgcaagaggagtcaggatgtgactgagcatgtggctgaatccctcakctatgagccacatccttctctgaagggtagtcacagcaggctaccctgagaccagagcagcccggtgaggcccaattgcagctggtcccgtgcacagctc

SEQ ID NO: 63256 - DNA, 201 bp, Homo sapiens
gaaaggattcagggaggcactggttggggctgttaactggtccttggttgaagatgtggtctacatactaagaaggaccaaccagagtgtacacaaagcarcttgtagggcgccaggatgcacctgtgagcagcgtatagtgacctggctgagtccatatctgtagatagacactggcactcaggaaaggctggtgcagtc

SEQ ID NO: 63257 - DNA, 201 bp, Homo sapiens
gatcacctaaggtcaggagttcgagacccacctatcaatatggtgaaaccctgtctctactaaaattacaaaaattagccgggcatggtgccgtgcacctrtagtcccagctactcaggaggctgaggcgggagaatcgcttgaacccaggaggcagaggttgaagtaagacaagttcgcgccactgcactccatccagcg

SEQ ID NO: 63258 - DNA, 201 bp, Homo sapiens
ccaaaattcctccccttgtggccttaataccataagccttgtaggcaggacattttggtcccctgaggtaatatgaggtaatatgaagattggttcagcartagcagagctactgtacttgggggttaatatgcaacttttctgttcttcaagtggtcataaaaattcttagaatcccctggttatgtctcatggttcttt

SEQ ID NO: 63259 - DNA, 201 bp, Homo sapiens
acttttctgttcttcaagtggtcataaaaattcttagaatcccctggttatgtctcatggttctttcatttactcagaaggtatttattgggcatcttgtrttgatcacagcactgtgaatccagaaataaaagccagtgcctttgccaagctacagagttaaagaaaagaaaaatgaaatgaataaaagtaaaagaaaac

SEQ ID NO: 63260 - DNA, 201 bp, Homo sapiens
tggaggccagggtgccagcccgggcttcccttagagctccctgggagaaagtgggctacgtggtttcgggagcgaggggtgctgaagtgccaaggaagccstcaccccctgcctctgaggcccaggagggggaagtgtccacatctggcctgccagggtatgaaggcttctctatggtcacttttaaataccagcctgtca

SEQ ID NO: 63261 - DNA, 201 bp, Homo sapiens
gttaaagaaaagaaaaatgaaatgaataaaagtaaaagaaaacctgtgcctgtctacaaggagctcaggtcagacgagggcagggattgtggctatcaagyacctcccatatgcctagctaggagccaggcttgggaactctcaaatgggtaattcccggtccttgttatcagctagctcacaacatgctgacctcaggct

SEQ ID NO: 63262 - DNA, 201 bp, Homo sapiens
ggccagtgattcttaattagttcatgatattttggagttctaggcaggacagcagcctctgcctcctcaaccccatgtaaaccagaatgagcaactgctgrgctggaggagctctccttcttagagcattgtgggacaacttgctatgagttctccttcattttttcatttcaccaccatgagttgtagggccctttgtgc

SEQ ID NO: 63263 - DNA, 201 bp, Homo sapiens
ggtgtcactgtttcttaccaatacatgaacctgtcaagcactgcacacctcaagctttggaatcagactagcaaccatcactctctctcttttccacattrattttcacacagtactatgacagatatcacatctccaaaggaagctagtgtggtctcaatgctgaggctgcatgctctccccatctagtcacttacagtg

SEQ ID NO: 63264 - DNA, 201 bp, Homo sapiens
gactagattattgcagatgaactttttagttgttttctggctttggttattatgaagggtgctgctgtgaacctccttgtacacacatctttcaggaaacrtgactgcatttttaggaatggcatcgctgggtcagaggttgtgcgtatttccaaattgttggccattctccactccatcagcagtgaacaagacttctag

SEQ ID NO: 63265 - DNA, 201 bp, Homo sapiens
gagccagttgttgggggcaagtggagggctggcctctgtgaaaatggtttagactagaggttcccaaacttgctcaactcatgactcaagattcccaaacwttctctactcactatgtctcagtaaatttttcatggcatcccttagccaaaagaaatacctaacggttctggttttcgttttttgaaacagtgtcttgct

SEQ ID NO: 63266 - DNA, 201 bp, Homo sapiens
aattgggggcagggggagtagaagtctatatcaaaacaaaaagccggagcaaggccagtgaccattaacaccttttgatactttgtagggagattttgcarctgctgccggcaacctacaaacctgcctggcagttttgggccgggcactgcccacctcccgcctggacctggcctgcagcctctcctggaacgtgatccg

SEQ ID NO: 63267 - DNA, 201 bp, Homo sapiens
caaagaggaaggacggactattggtgcccctggtcccagtgattagaaatgtaagtgaaacaccccacctcatctcataagctgctttgagattatgagtrtgtgtctatagaacaggttgttttctctcagactcaggcagtgtctccaggttccccctggagagagatagtcttctctgtctgtgtcctcgagtggcac

SEQ ID NO: 63268 - DNA, 201 bp, Homo sapiens
ctgggtgacagagtaagaccctgtctctaaaacagaaacccagaacttactgtgaaatggagggttaaggatcacaacaataaaaaatctcataggtgacsaaaaaaaggaaaagatttattttttaaaaaagatagggacctgccgggcacagtggctcacacctgtaatcccagcactttggaaggctgaggcgggtgg

SEQ ID NO: 63269 - DNA, 201 bp, Homo sapiens
gagtccgtttgtttgtttgtttgtttgtttgtttgaaccaaagctcagggaggttgagtaacttgcttaaggtcacaagcctgatcagaaattgtcagtgrctaagctgggtgtgcagctctgctctctctaacattcagagcccatggtccttacatcacacagcaataaattgtgattaagctccaagggtactcttag

SEQ ID NO: 63270 - DNA, 201 bp, Homo sapiens
gttgtaccccttcagtccacttggcgaggcatcacgccctctgggcaggctcagtggggaactatgggagcaggtgctgtgtgccacctctggagggggtyactgaggttctgggttgtggggggtgccctgggccagagtgagttgtatgggagttgttgctgaatccccccagagtaccagtcacacaccagtgtgagg

SEQ ID NO: 63271 - DNA, 201 bp, Homo sapiens
tgaaggcttgtccctgaaggcagagcagagggagaattctaagatcccattaagactttgagcctggagcactgggggagttaggagtcagcagaaagagstggttaggggaaatgatgaaaatttatcttaattgtgctgaaattggggtgcctgggggtcatccattaggaaatgagatgtagatacttaggagaaggt

SEQ ID NO: 63272 - DNA, 201 bp, Homo sapiens
tagtcttttcctttacagttagacattttaagtcctgttcaataaatctttgtcctacctcaaagtcatgaagatattctcctatgttgtctgctagacgytttattttttactctttacacatatgtacctaatccacctggaattaatttttataagagttggaggtaggagtgcaagatctgtttttctccataagga

SEQ ID NO: 63273 - DNA, 201 bp, Homo sapiens
tctgtggtaggaaagtgagcctagaagacaacgccatgcagcctgatggccctcggagggcagaatccagacataggcctgctgcctccatgcccacaggygcttctgcagcatgcacagcttagaagtgccaggttttgaggagagggatccttttccacatccccttgaagcacacaacagccagaaaacagtgtaggc

SEQ ID NO: 63274 - DNA, 201 bp, Homo sapiens
aacaaatagaactactccactcgctccctctctccctccctttactgccactattgattgttatagtcacttgctccaggaagtccacttgctgagtcttmctgcagacagagcccaccccctgagctgtaaaggccctagggcacatgtttgtccagctgcctcttgcagctgggattgttaggtcactatagcgctacc

SEQ ID NO: 63275 - DNA, 201 bp, Homo sapiens
ctgtaatcccagcactttggaaggctgaggcgggtggatcacgaggtcaggggttcgagaccagcctgaccaacatggtgaaaccccgtctctactgggcktggtggcgggcgcctgtaatcccagctactcaggaggctgaggcaggagaagtgcttgaacccaggaggtggaggttgcagtgagccgagatcccgccac

SEQ ID NO: 63276 - DNA, 201 bp, Homo sapiens
acggggtttcaccatcttggccaggctggtcttgaactcctgaccttgtgatccacccgactcggtctcccaaagtgctgggattacagacgtgagccacygcgcccggcccacatgcttagtttctatgttcctgtaactaatttgccctaaatcttgtgacagaaacttgcaatgtggtggtcaattcctttctttcct

SEQ ID NO: 63277 - DNA, 201 bp, Homo sapiens
cttctgcaagcatatatatatatatatatatatatatatatatatatacacacacacacacacacacacaaaatatcaaaatatatatatatatgtatatrtatatatatttttttttttttttgagactgagtctcgctctgttgcccaggctggagtgcagtggcacgatctctgctcactgcaagctctgcctcccgg

SEQ ID NO: 63278 - DNA, 201 bp, Homo sapiens
tcccaacactttggaaggccgaggcaggtagatcacttgaggtcaggagttcgagaccagcctgaccaacatggtgaaaccctgtctctactaaaaatacaaaaaaaaaaaaaaaaaaagtgctactctgagggaactctgaccagcatttgctcatagaacaaacgcacgcagtacaatctcaatcgagtaaaaagtctg

SEQ ID NO: 63279 - DNA, 201 bp, Homo sapiens
ctttgcctctgtttaaactatattaatataaggagagtcttgcagtatacactgttttgtgtctgacttattttgctcaatatcatgtgtaagaatcattwtgttgttatgtagaattatagattgttcgttctcatatttatagtgttccattgtatgactagattattgcagatgaactttttagttgttttctggctt

SEQ ID NO: 63280 - DNA, 201 bp, Homo sapiens
gctttgcctctgtttaaactatattaatataaggagagtcttgcagtatacactgttttgtgtctgacttattttgctcaatatcatgtgtaagaatcatkatgttgttatgtagaattatagattgttcgttctcatatttatagtgttccattgtatgactagattattgcagatgaactttttagttgttttctggct

SEQ ID NO: 63281 - DNA, 201 bp, Homo sapiens
ggataggtgaaaaggagaccctcagggccattcagaagaacaccctcatctaaagaacagataggccatcgcggtggctcacacctgtaatcccagcactytgggaggccaaggcaggtggatcacctgaggtcaggagttcgagacctgcctggccaacatggcaaaaccctgtctctactaaaaatacaaaaattagcc

SEQ ID NO: 63282 - DNA, 201 bp, Homo sapiens
taccttgtgggtatctcagcctcctagccagccatggtgggactcccatggggtggaagaacctgcgccttcaacccacaagggttttatttctgcccctrccacctgcctgtgctgtattccctatacaagctgctgtccctgtcagagccttgctttctcacctgcagaatggggagggcttgtctcccacctcctggg

SEQ ID NO: 63283 - DNA, 201 bp, Homo sapiens
gctcatttcaccaggactcccagcaaccgataaaacagaccaaaattcctccccttgtggccttaataccataagccttgtaggcaggacattttggtccmctgaggtaatatgaggtaatatgaagattggttcagcaatagcagagctactgtacttgggggttaatatgcaacttttctgttcttcaagtggtcataa

SEQ ID NO: 63284 - DNA, 201 bp, Homo sapiens
tcagaccccatcagcggcctcctccaggaatccttttttttaatttttttatcttttgaagcagagtctcgctctgttgtccaggctggagtgcaatggcrcaatcttggctcactgcaacctccacctccccggttcaagtgattctccagcctcagcttccctagtagctgggattataaggtgcctgccaccacacct

SEQ ID NO: 63285 - DNA, 201 bp, Homo sapiens
cctggcctcccacccactaacccaacatgtgttcagctgtccttgctcagtttacgtcacttccccctcaaacgggtatgtgtttgtgtattgtgaaggcrggtttttttttggcttttttgggggacagagtctcgctctgttgcccaggctggagtgcagtggtgcgatctcagctcactgcaacctccgcatcgcagg

SEQ ID NO: 63286 - DNA, 201 bp, Homo sapiens
ttggggtagatggagttttgctctttttgctctttttgcctaggctggagtgcagtggcacagtctcagctcactgcaccctccacctcctgggttcaagkgattcttctgcctcagcctcccaagtagctgcaggcatgtgccaccatgcccagctaatttttttatttttagtagagacggggtttcaccatgttggcc

SEQ ID NO: 63287 - DNA, 201 bp, Homo sapiens
cctgcctgcctaactgcccctgcagccgcggcttctgctgggacctgggataaagctgccatcacgggcatgaaggacagatgggtgacggaatggggatkttgggagaccccctggtggcagcccaggacccacaggctgtgtgaccttggacagccacctccttggacccaacacccagcccccacccagctgtgatgt

SEQ ID NO: 63288 - DNA, 201 bp, Homo sapiens
aggatgcttgagtcaccagcttgccatcctgtgtcattcaacacctcctccagactcttcgcaggaaggtgacccagaaaccccttgaaggacatgatacygtccctgtgctctgatgtgccccctggtgtttgagtggagtgatttttagatagcggtttgcctgttaaaaccttccctttgttccctatattattgctt

SEQ ID NO: 63289 - DNA, 201 bp, Homo sapiens
gtgagttagctgtaattgttagccacaatgtacagttgagaaaaactgcagctgaaagaggtaaaacttgccccaggttccaaggctaggatatggtgatyctttttttttttttttttttttttttttttgagacggagtctcgctctgtcacccaggctggagtgcagtggcgcaatctcggtgcaagctccgcctccc

SEQ ID NO: 63290 - DNA, 201 bp, Homo sapiens
cagtaaaagagttcactcatctgttgcttaaaatataggatgcttgagtcaccagcttgccatcctgtgtcattcaacacctcctccagactcttcgcagraaggtgacccagaaaccccttgaaggacatgataccgtccctgtgctctgatgtgccccctggtgtttgagtggagtgatttttagatagcggtttgcct

SEQ ID NO: 63291 - DNA, 201 bp, Homo sapiens
gctccttcttaggttctgggggctggtttgactggatgatgcctactcttctcttatggctggtaaatggtgtgattgtcctgagcgtctttgtgaagctkctggttcatggggagccagtgatccggccacactcgcgctcctcggtcaccttctggaggcaccggaaacaggcagatctggatctcgccagagtgagtt

SEQ ID NO: 63292 - DNA, 201 bp, Homo sapiens
cacgcggagacacgggttgtctcttaatcttgttgagtccgtttgtttgtttgtttgtttgtttgtttgaaccaaagctcagggaggttgagtaacttgcytaaggtcacaagcctgatcagaaattgtcagtggctaagctgggtgtgcagctctgctctctctaacattcagagcccatggtccttacatcacacagca

SEQ ID NO: 63293 - DNA, 201 bp, Homo sapiens; identical to SEQ ID NO: 12578

SEQ ID NO: 63294 - DNA, 201 bp, Homo sapiens
ctgtctactcagctgctagtctgtgagctccctgatatcctttaagacagcgttttccagcagcggcactattaacgtttggggctaggtaatcgttgggkgtgtgagtgtgaagagggctgtcctgtgtgttgtaggctattttagcagcatcccggcctctccctgccaggtgcctgtagcagtcccccagttacgaca

SEQ ID NO: 63295 - DNA, 201 bp, Homo sapiens
agatcaagaccatcctggctaacacggtgaaaccccgtctctactaaaaatacaaaaaattagctgggcgtggtggcgggcgcctgtagtcccagctactygggaggctgaggcaggagaatggcgtgaacccgggaggcggagcttgcagtgagctgagatcacgccactgcactccatcctgggcgacagagcgagact

SEQ ID NO: 63296 - DNA, 201 bp, Homo sapiens
cccaaagtgctgggattacaggcgtgagccaccttgcccggactctctttgtattttttctttcttttttttgagacagagtcttgctctgtctcccaggstggagtgcagcgacatgatctcagctcactgcagcctctatctcccaggttccggcagttctcctaccggttagctgggattacaggcatgcgccaccac

SEQ ID NO: 63297 - DNA, 201 bp, Homo sapiens
gtgtacaactttagaagtggttaacagtttgacagcaaagcagaaatcatatgacttgtttctggcatacgtagatcaaaacttaaaacatatttagccaygttaatcctcttgtggtgtagtttatcagcagtgattcttgaagggaggtagtaaccaaggttccgtggctcctgagacttcttggggcctgatttgatt

SEQ ID NO: 63298 - DNA, 201 bp, Homo sapiens
atcactaagcaacagctgcctctcacaaactggcaggaaacttcaacttttcccttttatcaatatattgtgaacgccttttcttgctaataaatatacayttgtgtgcgtaatttttaatgatcccatggtattccatcgtgtggatgtaatttacatattcatttccttattctcacttcttcctagttacagcacttc

SEQ ID NO: 63299 - DNA, 201 bp, Homo sapiens
atggtagaattttagcagaaggtccctatctgcaaatttgccccgctgttatcttgtctgttcctcagtgtgcccttgggacagaataagcccatactcasgtctctgatcaggctgtgtcctccttgctgccaaattctggagaattccagctgagaagctttacgtcactcattccttccatactcactggcattccct

SEQ ID NO: 63300 - DNA, 201 bp, Homo sapiens
tttcttttcttcctagtgaattctccagtgctctggagtacttgaaattacttcattcttttgtggactctgtgggggttatgagccccccactctccagsagctccgtgctcaagtccgccctgggtaagcacctgcgggtggcccacagtctcagggtgctcagttcaggtcttcacagtgcttttgccccaggggtcc

SEQ ID NO: 63301 - DNA, 201 bp, Homo sapiens
gaaggcactgagacagagaaattagatgatttgccaatgcttcctatgctgatgacggggaatgaacttggattttctgatgtgggattccatattcttcrctgtcctatgaaaatgaggtgggagatgccttgattcaggaagcctgtctgtctaggagccccttctctggtcaaaagttgtttttaaaaaatccttgct

SEQ ID NO: 63302 - DNA, 201 bp, Homo sapiens
gatgtgtcctataaacagtggcacattgtagataagttggcagtgtttttctttagtgatacttaaattaatggtgagacttaaaattgctgacatcttakagtcaatgaaatatgatcatctgtttcattcagtaagctcctgctataataggcagagaggtcaacaaatgaatgacagttcagcgtgagtatgttagac

SEQ ID NO: 63303 - DNA, 201 bp, Homo sapiens
agttttctctggtgccaactcgtggttcaccgtgtacaactttagaagtggttaacagtttgacagcaaagcagaaatcatatgacttgtttctggcataygtagatcaaaacttaaaacatatttagccatgttaatcctcttgtggtgtagtttatcagcagtgattcttgaagggaggtagtaaccaaggttccgtgg

SEQ ID NO: 63304 - DNA, 201 bp, Homo sapiens
ccagtggctcacgcctgtattcccagcattttgggaggctgaggtgggcagatcacctgaggtcagtagtttgagatcagcctggccaacatgatgaaatyccatctctactaaaaatacaaaaatgagccaggtgtggtggtgggtgcctgtattcccagctactcaggaggctgaggcaggagaatcacttgaaccagg

SEQ ID NO: 63305 - DNA, 201 bp, Homo sapiens
ggaggcagagacaggagaatcacttgaacctgggaggcagaggttgcagtaagctgagatcatgccactgcactccagcctaggcaacagaatgagactcygtctaaaaaaaaaaaaaaaaaaaatgctggacacggtggctcacacctataatcccagcactttgggaggccgaggcgggtggatcacctgaggttggga

SEQ ID NO: 63306 - DNA, 201 bp, Homo sapiens
gctgggattataggcacccacctccacacccagctaattttttgtatttttagtagagacggggtttcaccatcttggccaggctggtcttgaactcctgwccttgtgatccacccgactcggtctcccaaagtgctgggattacagacgtgagccaccgcgcccggcccacatgcttagtttctatgttcctgtaactaa

SEQ ID NO: 63307 - DNA, 201 bp, Homo sapiens
ctggatgtatctgatgcatttgaacaaattcacattttcaaagtaagagttaaagcaaaagtgtcaaaaaaaaaaaacccactatgaataatgtgtactarctaatactaagtgccaggcatggtgccatagattccacatgagttatctcatcaatccgtgagttagctgtaattgttagccacaatgtacagttgagaa

SEQ ID NO: 63308 - DNA, 201 bp, Homo sapiens
agttccctcctagtgtttgtttttgactaagctgtttattgtatcatatacttaattttactaaggaagctccatttttgaaatattcttataaatgtggwtctgtttggcaacaacaggctgtttgacatataaattgaattagctgggcttctgagtcatcagaagaaaatcttaaatggttttaaaatattgaaaaga

SEQ ID NO: 63309 - DNA, 201 bp, Homo sapiens
cccgccaccacgcccagctaattttttatatttttagtagagacggggtttcaccgtgttagccaggatggtctcgatctcctgacctcatgatccgcccrcctcggcctcccaaagtgctgggattacaggcgtgagccaccgcgccaggccgacatggtgattcttaattgctatgtcattctttttttctgaacatat

SEQ ID NO: 63310 - DNA, 201 bp, Homo sapiens
ctgcctcagcttcctgagtagctgggattacaggcatgcaccatcacgcctggctaatttttgtatttttagtagagacggggtttcaccaagctggccargctggtctcgaactcccgacctcaggcaatccgcccacctcagcctcccaaagtgctgggattacaggcgtgagccaccttgcccggactctctttgtat

SEQ ID NO: 63311 - DNA, 201 bp, Homo sapiens
cagcacttctttaagcacttgtaatttttattcctttggataaattcctagaagtttacaacacgaccagctgcaagatggggcagtgaggtgcttgaagsagtgggtgggctgcacttcagaatcccggtggaactttttcaaaaaactcgtgcccggggcccccctctcaggaggccgtcggtgggcctgggcactggc

SEQ ID NO: 63312 - DNA, 201 bp, Homo sapiens
ttgtgctgaaattggggtgcctgggggtcatccattaggaaatgagatgtagatacttaggagaaggtaaaactgggatggagattgaagagagtcactgytgagtcaagaggagagaactgggagattagaggttaggaaagtgttagcttttcaaggagtagtctgtagatggtggagacaatgccacagagaacaaca

SEQ ID NO: 63313 - DNA, 201 bp, Homo sapiens
tccctttgggtttctcctccctcctctgtctatttggcctcgcccttgacaaacattccccacattcacacccaggcctttggcctaatgttcttgaatgytgcttgcctctcattgaataggcttttatgtagctctcatattcagttcatattttggcattttaaaaaatatatatttttgcttctttctcaactagat

SEQ ID NO: 63314 - DNA, 201 bp, Homo sapiens
ttcactcctcaaatttgtaattaaaaaaaggaaattctcaagcagttttattcaattagaactttgcaaatatcaaattgtccgtatccttctggattctygtctgaacattgcttatctgcgtacatatcacagtgttttcacatagggattgctgtatgttgaagtagttgaggtgtaatagccatataatctaatgtg

SEQ ID NO: 63315 - DNA, 201 bp, Homo sapiens
tttgcagttttttcttaacataagcactgttctgaatacttgtgaacaagtcacttgggagtttgttcatgggcgtgtatcttccaaagaggagtcttcamgttcagctgggtaacacactatcagctgtagccctttcattttaaaaacatttccagtgctgcaaattactatggtgattgggaattacaacttggaaat

SEQ ID NO: 63316 - DNA, 201 bp, Homo sapiens
tgggagatgggaagaaaacgaatacttttcagtctttgccctgtgcggagttccacacaaggcacataggatcctccagctcccagcccagagtacatagygtatgcaaatttgagtggatgtttgtatttgtagcgtgatttgataacctgctttgcaagtattctttttctctttagttttagggagatttgggggcat

SEQ ID NO: 63317 - DNA, 201 bp, Homo sapiens; identical to SEQ ID NO: 12579

SEQ ID NO: 63318 - DNA, 201 bp, Homo sapiens
ttaaccctgacattcaaccctggcccccctctccagccacttccccctggctctggccggtgcactggagcagtcctccaaccttgcactcgccgtgcccwctgcctgcactgccatctgtacagtcagtgaccaatggtgcctcgcagccacgctggggcttctttattctcaggggcaggaaccacataaaagggctta

SEQ ID NO: 63319 - DNA, 201 bp, Homo sapiens
ctccaaccttgcactcgccgtgccctctgcctgcactgccatctgtacagtcagtgaccaatggtgcctcgcagccacgctggggcttctttattctcagrggcaggaaccacataaaagggcttatttacaagacgaacccgcggcctgcaggctccaagacaccactgccgttgaggcagacagaagagctggccttac

SEQ ID NO: 63320 - DNA, 201 bp, Homo sapiens
tcattggttttgttcttaaatatcaatagtgcaaccactggcttttattcaaaggtttaattggaatctaacctggggattttcccctttttaaatttatrtttaaaaaaaaaaactatggaaagtcggcatggtctgggctgcttgggagcctgaggcaggaggatcacttgagtccaggaatttgagactctcctgggc

SEQ ID NO: 63321 - DNA, 201 bp, Homo sapiens
gagaggagaagaggggccagcccagctcccacatctggcattggtgcccagcacacctctcgcctctctgagaatgaaagaagcccgaggccgcccttggygggttgcaggggttggggtggtcatgggtcatgctgtgatcagggaaggagggttggggtggcgtcccagcacaggtgcaggcatagaagcagaagctcg

SEQ ID NO: 63322 - DNA, 201 bp, Homo sapiens
tggtccagcctcagatcatcaagacagattcccttgttttgaccacactgaagacagatggcagccctgttatggctgcggtccagaacccggccctcacygccctcaccacccctatccagacggctgcccttcaagtaccagtaagagctgccttctcccccaccctcctccctccccctttattcctggaggtgttag

SEQ ID NO: 63323 - DNA, 201 bp, Homo sapiens; identical to SEQ ID NO: 12590

SEQ ID NO: 63324 - DNA, 201 bp, Homo sapiens
aaagacagagaaaccaggacagcagccccctttcaaaaaagttacggcttattggcctaggtggactcctttttcatcccttttcagcctctgaggcaagygtgtttctacctgcacctttcttaggctcccagagtcccaggtcctgctggcccatagcctctgtaagcccaggtgcaccccagctggccaggggttcac

SEQ ID NO: 63325 - DNA, 201 bp, Homo sapiens
cggtctcggcctcccaaagtgctgagatgacaggtgtgagccaccgcgcccggcccaggatgccttatttacctgcctgcctaactgcccctgcagccgcrgcttctgctgggacctgggataaagctgccatcacgggcatgaaggacagatgggtgacggaatggggatgttgggagaccccctggtggcagcccagga

SEQ ID NO: 63326 - DNA, 201 bp, Homo sapiens
tttctttagtgaatatattacttttatgattttaacaaattattaaaaacagggccaggcgcagtggctcacacctgtaatcctagcactttgagaggccraggtaggcggatcatctgaggtcaggagttcgagaccagcctggccaacatggtgaaaccctgtctctactaaaaatacaaaaattagcagggcgtggtg

SEQ ID NO: 63327 - DNA, 201 bp, Homo sapiens
ctttcctgcggcatcaccaaacctgctgccccatccccagcaggtgcagggagttcaggatgaacatgtcagctgggctgctgcagccacccctcaccatygcagccctaagttcctttttccccgcccctgtcaaagacatatccaggcctcttccaagctaccctcacccatcatgggggacccccaaatttgggcagc

SEQ ID NO: 63328 - DNA, 201 bp, Homo sapiens
tcttgtcaccagttgggaaaagcaggccttttgcctctctctcctctcatcctgctcctgctgttcagccaggtttcctgcctggctcagggtcagagtaygggacaacagaggttgcttttcaggggtgagcaaggcagggtggtgtgggaagggatgtcatgaggtggcaggcgagatggctcagggagagctaccctg

SEQ ID NO: 63329 - DNA, 201 bp, Homo sapiens
caccccggcacctccccaggtgttcctgcatgaagccaccgtgcgcctgatggcaggagccagccccacccgcacccaccagctgctggaacacagcctgmggcggcgcaccacgcagagcaccaagcacggtgagtccacccctccccagctcacaggctgggccaggccctgcgccctaggaagagaggagaagagggg

SEQ ID NO: 63330 - DNA, 201 bp, Homo sapiens; identical to SEQ ID NO: 12575

SEQ ID NO: 63331 - DNA, 201 bp, Homo sapiens
ggagcagcctcaacgtcagtggggccacctctgaccctgccctcaaccacgtgagtgggagctgagttggcccctgggggaggtgctctgcactggtttasgagaacactcccactcacctcatgctgaccctgcgggtggggccatccgaaagacagagaaaccaggacagcagccccctttcaaaaaagttacggctta

SEQ ID NO: 63332 - DNA, 201 bp, Homo sapiens
gatgctgaaggctgagctgagcaaagtgatatttatgttacctccaagccacaagctccataaagttcatgtgaactcagggtctctttgtgagtcatggrgctgcttgcaatgcacggatgataacaggaacctctaattttggttatttgcttttagagaccagaacccagatacagtttcctggggcctcacctactt

SEQ ID NO: 63333 - DNA, 201 bp, Homo sapiens
ggagccttaatcggtagtaaatagaaagtcaaacaaggtgatggttccatagagcatcagataacttttaggcaggcagcttagacagtgctgtagtatamctttttttttttttttttgagtcaggggtcttgctctgttgttccaggcttgagtacagtggtacagtcgtggctcactgcagccttgaactctggcctc

SEQ ID NO: 63334 - DNA, 201 bp, Homo sapiens
ctggctccagggagacgatgcagctgtgcgctctcattttaccaaagtggaacgcatccccaaggccctggaagtgacagagtgcgtaaccctccttggcmactcacttgcttctctccaggggaatcttgtttgagttagcaggagcaaactggactgggtgggcgtgttggggtgaagggtcaggactgcatgacaggt

SEQ ID NO: 63335 - DNA, 201 bp, Homo sapiens
tttctgttctccatattttctgctgtggatcctgaacatatattgggttggggggagggggggcatgtattattaatcttttttttaattttttttttttkgagacagttttgctcttgttgcccaggttggagtgcagtggcgtgatcttggctccctgcaacccccgcctaccaggttcaagcgattctcctgcctcag

SEQ ID NO: 63336 - DNA, 201 bp, Homo sapiens
gttcttgtacttgttgggcagctctaatatgaaagataaaatgaacgaaaagtacaaatgaagaaagtttaggtgactattcctctgatcttgaggatgarggtttttcttaagcgttacacagaagccatgtaatttcactatacaatgtaaaaatggtgtatagtcagttctgctatagttcatcatgtgcatttctaa

SEQ ID NO: 63337 - DNA, 201 bp, Homo sapiens
agaaaagtcgggggtgagggcaccatggagaactcaagttgggccagcaggtcctctgtgcaagtgtcctgctctgcacaacacgacagttgtcccagcavctgtcagcactgtgtccgggtcctcctccctgcagccttcatggcgccacaggctgaaaagaagagacgagagcagtgtggcccccagcatcttcagaag

SEQ ID NO: 63338 - DNA, 201 bp, Homo sapiens
gtgcattgagcggagatcacgccattgcactccagcctgggcaacagagcaagactccatctcaaaataaatacatacgtacatacaaacaaaaattagcyggatgtggtggtgcacacctgtaatcccagctacttgggaggctgaggcaggagaatcgcctgaacctgggaagtggaggttgtaatgagccaagattgc

SEQ ID NO: 63339 - DNA, 201 bp, Homo sapiens
cgcttgagcctgggaggtggaggctgcagtgagctgaaattgcaacactgcactccaacctgggtgacagagcaataccctatctcaaaaaaaagagagasagagtctcgctgtgttgcccaggctgttctcaaactcctgacctcaagtgaccctcccaccttggcctcacaatgcactgggattacaggcatgagccac

SEQ ID NO: 63340 - DNA, 201 bp, Homo sapiens
cctgtgctgatctttcccagtctcccccaaagcccacctccaccatggtgctttctgcaccccacagtggctgcagccagcattctgccaccttggtgttrcccctggtccttgtccttccacagagctacttcctcagccgagcccagagcctgtgtggccccgagcacagtgctgttcctgactccctgcgctggctct

SEQ ID NO: 63341 - DNA, 201 bp, Homo sapiens
gctggctggccggtcgggcccctcacccgcagaggccgcggctcatttccaccggggaagcctctatgccccagccgagggaccgcctctcggcctctcasgcccctccgcgtgctccgccgccgctcagccccgcccgccaccgactcacctgcgctgttgtggggggagccccgggggaggccgtcccccatctgcacc

SEQ ID NO: 63342 - DNA, 201 bp, Homo sapiens
cttaaggtcacaagcctgatcagaaattgtcagtggctaagctgggtgtgcagctctgctctctctaacattcagagcccatggtccttacatcacacagyaataaattgtgattaagctccaagggtactcttagcccttgttttgggcactttggagacacaaaggatgtgtgaggcttgctttccctggcctccaggt

SEQ ID NO: 63343 - DNA, 201 bp, Homo sapiens
agcatcagataacttttaggcaggcagcttagacagtgctgtagtataactttttttttttttttttgagtcaggggtcttgctctgttgttccaggcttkagtacagtggtacagtcgtggctcactgcagccttgaactctggcctcaagtgatcctcccacctcagcctcccaagtagctgggactacaggcatgtgc

SEQ ID NO: 63344 - DNA, 201 bp, Homo sapiens
ggctgaggcaggagaatggtgtgaacccgggaggtggagcttgcagtgagcagagattgtgccactgcactccagcctgggcgatagagagagactccatytcaaacaaacaaacaaacaaaaggcaaacctatggggacctggcctgggagtgaaggagggagggaggcagggagggaggaaggaaaaaaccagaaaaaa

SEQ ID NO: 63345 - DNA, 201 bp, Homo sapiens
gcttgtaagtgatggaacagtggcctaaatccaacatgtgcaactttagaacccatgtatttttcctctgtcccatgccctgtctgatgtaagcaggcttytaagttgcaaataccaggtggtgtggtgtgctttgaagctatttattcaacatgtgtttatcaagaagtgtctgtccaggcgcagtagctcatacctgta

SEQ ID NO: 63346 - DNA, 201 bp, Homo sapiens
aataggattttagaaggtaaaggagcaggcatggtgtttatttagatagatttagacaaagttgggaataatttggcatgctctaggaatatgtgtgtcasagtactgcataggacagaggttctcaaacttgaatgtgtctatgaactcccagggtatacccccaaagatctgaatgtggaaggtctgggatgttgtcca

SEQ ID NO: 63347 - DNA, 201 bp, Homo sapiens
tgtgcacattttgtgcattcctgcatggctcatttcagccgaatatggttttctgcacttcctagtgtttttctcatgcataagcaaatgcaaaatttatrttatgctcagattgtttctggatgtatctgatgcatttgaacaaattcacattttcaaagtaagagttaaagcaaaagtgtcaaaaaaaaaaaacccact

SEQ ID NO: 63348 - DNA, 201 bp, Homo sapiens
taaaatccaagaactggaagcaactcaaatgtccatccacaggaaaataagcacattgtgatatattcatacaatgaaattatgcctagcaattaaaaaamagaactgctgacaggcacggtggctcacgcctgtaatctcagcactttgggaggccaagaggggtggatcacctgaggtcaggagtttgagaccagcctg

SEQ ID NO: 63349 - DNA, 201 bp, Homo sapiens
ctctgtctcaaaaaaaaaaaaaaaagaaagaaagaaagaaatacccagatttttatatgttggctcatttaaaaaaaaagtactataggcacccaataaarcatgtgtgctagttgatctctggggtcttgtactactgcagaacgtcctgttgtcccaggcccccaggtttcccataatagagtaagtctaccatttcat

SEQ ID NO: 63350 - DNA, 201 bp, Homo sapiens
tgaggcaggagaattgcttgaacctgagaggtggaagctgcagtgagccgagatcgcaccactgcactccagcctggatgacagaacgagactgactctcaaaaaaaaaaaaaaaagctactgatgcatgaaacaacatggggctgtccctcagaaatagtgtgtcaagccaccgggcgcagtggctcacacctgtaatcc

SEQ ID NO: 63351 - DNA, 201 bp, Homo sapiens
aaataccaaaaattagccaggtgtggtggcgggcacctgtagtcccagctactcaggagggtgaggcaggagaatcacttcagaaccagggaggcggaggytgcagtgagccgagatggtgccactgcactccagcctggcaacagagcgagactccatctcaaaaaaaaaaaaaaagtaatgacatgattacctaagtgc

SEQ ID NO: 63352 - DNA, 201 bp, Homo sapiens
ctttctttcctgtcccatctgatggctatggtttaggtctgctctcccttcacttatcttgggacaacccctaaccatcacccttgggggcaatgttgaarctcttctttcccagttcttgatttttactcacttattttagtggagcacatcctccagtggcttcctgagaaagagtacatttaggtaactcttcgaggc

SEQ ID NO: 63353 - DNA, 201 bp, Homo sapiens
gctggagtgcagtggtgcgatctcagctcactgcaacctccgcatcgcaggctcaagcaattcttctgcctcagccttccaagtagctgcaattacaggcrtgtgccaccacgtccagctaattttttctatttttagtagagatggggtttcactgtgtttgccaggctggtctcaaactcctgatcttaagtgatccgc

SEQ ID NO: 63354 - DNA, 201 bp, Homo sapiens
ccttgtgatccacccgcctcggcctcccaaagtgctgggattacagacgtgagccactgcccttggctttcatagttttctgttctccatattttctgctrtggatcctgaacatatattgggttggggggagggggggcatgtattattaatcttttttttaattttttttttttggagacagttttgctcttgttgccc

SEQ ID NO: 63355 - DNA, 201 bp, Homo sapiens
gagttcgagacccacctatcaatatggtgaaaccctgtctctactaaaattacaaaaattagccgggcatggtgccgtgcacctgtagtcccagctactcrggaggctgaggcgggagaatcgcttgaacccaggaggcagaggttgaagtaagacaagttcgcgccactgcactccatccagcgtgggcgatagaggaag

SEQ ID NO: 63356 - DNA, 201 bp, Homo sapiens
tgggcgtggtggcgggcgcctgtagtcccagctactcgggaggctgaggcaggagaatggcgtgaacccgggaggcggagcttgcagtgagctgagatcaygccactgcactccatcctgggcgacagagcgagactccatctcaaaaaaaaaaaaaaaagaagaaagcatgatcaccatttttataagttgcatgaaagt

SEQ ID NO: 63357 - DNA, 201 bp, Homo sapiens
gaggccgaggtaggagaatgtcgtgaacctgggaggtggagcttgcagtgagccaagattgcgccactgcactccagcccgggcgacagagcaaatctccrtctcaaaaaaaaaaaaaaagaaatagtgtgtcaagccaaaggagttcatgctaatgagtccatttatatgaagtttaaaaagaggcaaaatgaagctatg

SEQ ID NO: 63358 - DNA, 201 bp, Homo sapiens
cgaggtaggagaatgtcgtgaacctgggaggtggagcttgcagtgagccaagattgcgccactgcactccagcccgggcgacagagcaaatctccgtctcaaaaaaaaaaaaaaagaaatagtgtgtcaagccaaaggagttcatgctaatgagtccatttatatgaagtttaaaaagaggcaaaatgaagctatggtgct

SEQ ID NO: 63359 - DNA, 201 bp, Homo sapiens
gaggtaggagaatgtcgtgaacctgggaggtggagcttgcagtgagccaagattgcgccactgcactccagcccgggcgacagagcaaatctccgtctcaaaaaaaaaaaaaaagaaatagtgtgtcaagccaaaggagttcatgctaatgagtccatttatatgaagtttaaaaagaggcaaaatgaagctatggtgctg

SEQ ID NO: 63360 - DNA, 201 bp, Homo sapiens
cctcacccctctgtccctgtcacacctgtccttttgtcaaactgcaggcagcctccagggccttggggcttcacccagggcacttgtctaccagccccacraggtgcgtccagggctttcttgtcaccagttgggaaaagcaggccttttgcctctctctcctctcatcctgctcctgctgttcagccaggtttcctgcct

SEQ ID NO: 63361 - DNA, 201 bp, Homo sapiens
agcagcaggtgcagacagtacaggcccagcgggtgctgacacaaacggccaatggcacgctgcagacccttgccccggctacggtgcagacagttgctgcrccacaggtgcagcaggtcccggtaagtggctggaaaggattcagggaggcactggttggggctgttaactggtccttggttgaagatgtggtctacatac

SEQ ID NO: 63362 - DNA, 201 bp, Homo sapiens
agaatagtggaactgctggatgatttttatttttgttcttttcatttatatgctttctaaatttttctttagtgaatatattacttttatgattttaacarattattaaaaacagggccaggcgcagtggctcacacctgtaatcctagcactttgagaggccgaggtaggcggatcatctgaggtcaggagttcgagacc

SEQ ID NO: 63363 - DNA, 201 bp, Homo sapiens
tcatgtgcatttctaaaaatcatgccatgcgaaatcatgcagtaaaaaacacggagtgggcatgttggctcatgcttgtaatcaggaggctaaggtgggaggatcgcatgaggcagggagttcaagaccagcctgggcaacaaagcaagacccagtctctcttacaaataaaaaataaaaattatctggacatggtggtgt

SEQ ID NO: 63364 - DNA, 201 bp, Homo sapiens
cccatcagcctgggaaacacggggagactccatctctccaaaaaaaattcaaaaaattagctggtttttgtggtgtgtgtctgtggttccagctacttgakaggccaaggtgggaggatcacttgagcctgggaggtagatcgaggctgcagcgagctgtgattgtgccactgcacatgcatgcagagatgaacagataga

SEQ ID NO: 63365 - DNA, 201 bp, Homo sapiens
ggaaagaggttagagcaagtttgggtctgcagtgctaggattagaggtggcctcacaagccaaaaccgctatactcacagccttaggacagtgactccctrctcgctgcctcagtgtttccagctgtaaaaaaggacccttggtaccttcgacagaacagcacccatctagtacaaaggtagttccttttatgatcaaaac

SEQ ID NO: 63366 - DNA, 201 bp, Homo sapiens
ccacagcctctttcacatcaggcaattagcagatgagttacagggggaggctcctaggccccagttggggaagattctggtgtctataaaatttaggaaamcttaaaaaaaaatttttttttttttggcttgggattacaagccaagccaccagcgtggccaagatggtgaaaccctgtctctactaaaaatataaaaatt

SEQ ID NO: 63367 - DNA, 201 bp, Homo sapiens
tttagtagagacggggtttcaccgtgttagccaggatggtctcgatctcctgacctcatgatccgcccgcctcggcctcccaaagtgctgggattacaggygtgagccaccgcgccaggccgacatggtgattcttaattgctatgtcattctttttttctgaacatattaaaagagaaataacaaagtgggggaagtact

SEQ ID NO: 63368 - DNA, 201 bp, Homo sapiens
acgccactgcactccagcttttgggcaacagagtgagactttgtctcaaaaaaaaaaacaaaaacaaaaaaacaggacgtggtggctcacgcctgtaatcycagcactttgggaggccaaggcgggtggatcacctgaggtcagcagtttgagaccagcctgaccaacatggagaaaccccgtctctactaaaaatacaaa

SEQ ID NO: 63369 - DNA, 201 bp, Homo sapiens
tctgaacatattaaaagagaaataacaaagtgggggaagtacttgcagacatttaagaagaataagtatctataatatctggaagttttttaaatcagtgaaaaaaaaaaaaagacaaaatagcctgatagcaaaaatggacgaaggtcaagagcaggcggtttacaaaggaagaaatgcaaatgctcaataaaattggga

SEQ ID NO: 63370 - DNA, 201 bp, Homo sapiens
ctatgccttaagataactgtccaggctaggcactgtggcttacgcctgtaatcccagcactttgggaggctgaggcgggtggatcacgaggccaggagttmaagaccagcctggccaacatggtgaaaccccgtctctactaaaaatacaaaaaattagccgggcgtgctggcaggtgcctgtaatcccagctacttggaa

SEQ ID NO: 63371 - DNA, 201 bp, Homo sapiens
gtctttcaacctaaaaacccatgacctggctgagcaccatggctcacgcctgtaatctcagcactttgggaggctgaggcaggtggatttcttgaacccaraagttcaggaccagcctgggcaacatggtgaaaccctgtctctacaaaaaaatacaaacaattagccaggcatggtggcacacacctgtagtcccagcta

SEQ ID NO: 63372 - DNA, 201 bp, Homo sapiens; identical to SEQ ID NO: 12586

SEQ ID NO: 63373 - DNA, 201 bp, Homo sapiens
tctgcctcagcctcctgagtagctaggactacaggtgcttgccaccatgaccagctaatttttgtattttcagtagagatgggtttcaccatattggccargatggtctcgatctcttgacttcgtgatctgcctgcctcggcctcctaaagtgctgggattacaggcgtaagcaaccgtgcccggctgtccatctctttt

SEQ ID NO: 63374 - DNA, 201 bp, Homo sapiens
ggggaatcccgccccgccctttctgtgcggcgcccgggcgcaacgcaaacatggcggcgggtggcacccgtcggtgaggcggtgccgggcgggggttgtcsggtgtcatgggcggtggcgacggcaccgcccccgcgtctccctgagcgggacggcagggggggcttctgcgctgagccgggcgatggacgacagcggcga

SEQ ID NO: 63375 - DNA, 201 bp, Homo sapiens
ttcgcgcgggaagaaccccgtgcgcacggtgcccccggcggtcctcaacccttccggcgctgcgagcgtgagcccgacccagctgcgccgctccgggaggycgtgggatctggggcgccgcggggccgaaagcggcgcgagggtcgcgggttccagagcgcggggctagggacgtcgcgggggcgtctcagggagcggcct

SEQ ID NO: 63376 - DNA, 201 bp, Homo sapiens; identical to SEQ ID NO: 12572

SEQ ID NO: 63377 - DNA, 201 bp, Homo sapiens
tgctgcccacctggaggggtaggcaggcattcattcagtcgctcatttcaccaggactcccagcaaccgataaaacagaccaaaattcctccccttgtggccttaataccataagccttgtaggcaggacattttggtcccctgaggtaatatgaggtaatatgaagattggttcagcaatagcagagctactgtacttgg

SEQ ID NO: 63378 - DNA, 201 bp, Homo sapiens
ggagagtcctggagattcagattctcagccactccctggggcttggtcttagctggctaggctagtacttcaagctagatattgtcagtggacctgggcaytgggatgaacccaggacagcgtggcagcccctacagggacaggcaatgtgcagaaaaggcccaaactggctggacgcggtggctcacacctgtaatccca

SEQ ID NO: 63379 - DNA, 201 bp, Homo sapiens
ttgtttatctgatttttaaatttaaatttttatttatttagttattttttgagacagggtctcattctgtcacccaggctggaatgcagtggcacaatcayagctcactgcagccttgaccttctgggctcaagcaatcctcccacctcagccgggaggctgggaccacagaacgcatgccaccacacccagcaaattttt

SEQ ID NO: 63380 - DNA, 201 bp, Homo sapiens; identical to SEQ ID NO: 12573

SEQ ID NO: 63381 - DNA, 201 bp, Homo sapiens
tcccgagtagctgggattacaggcatgcgccaccacgcccggctaattttgtatttttagtagagacagggtttctccatgttggtcgggctggtctccamctcccaacctcaggtgatccgcccaccttggcctcctaaagtgctgagattacaggcatgagccactgtacctggccgagccaccgtgcctggccgagcc

SEQ ID NO: 63382 - DNA, 201 bp, Homo sapiens
attacaggcatgcgccaccacgcccggctaattttgtatttttagtagagacagggtttctccatgttggtcgggctggtctccaactcccaacctcaggygatccgcccaccttggcctcctaaagtgctgagattacaggcatgagccactgtacctggccgagccaccgtgcctggccgagccacctaatttttttta

SEQ ID NO: 63383 - DNA, 201 bp, Homo sapiens
aatcccaacactttggaaggccgaggcaggtagatcacttgaggtcaggagttcgagaccagcctgaccaacatggtgaaaccctgtctctactaaaaatmcaaaaaaaaaaaaaaaaaaagtgctactctgagggaactctgaccagcatttgctcatagaacaaacgcacgcagtacaatctcaatcgagtaaaaagtc

SEQ ID NO: 63384 - DNA, 201 bp, Homo sapiens
atagaaaaaagaatgcaggaataagattgcaaatttaaatacaaaactagggccagattccgtggttcatgcctgtaatctcaggactttgggagactgargcgagtggatcacttgaggtcaggagctgaagaccagcctagccaacatggttaaattaaacttcgtctactaaaaatacaaaaattagctgggtgtggt

SEQ ID NO: 63385 - DNA, 201 bp, Homo sapiens
ggtttcaccatgttagccaggatggtctcgacctcgtgatccgcctgcctcagcctcccaaagtgctgggattacaggcgtgagccaccatgcccaggcctttttttttttttttttttttgagatggagtttcgctcttgttgcccaggctggagtgcaatggaccagtctcagctcactgcaacctctgcctcccgggt

SEQ ID NO: 63386 - DNA, 201 bp, Homo sapiens
tttttcgctcgaaaaagtattagcaatgtgtgttcgatgtgggagtactggagtctacaaggaggtagaaaagaatagcagaaggaccctctattcttggstaatagctccacacaagaccattcacctcttagatcctgctgatgacttctgaaggaccctagggccaccaggcagggaagggctccaaggtgaagaaca

SEQ ID NO: 63387 - DNA, 201 bp, Homo sapiens
agccccccagactcgaggccgcaggacccgtggggggtccctttccaccctggcgagctggctggccggtcgggcccctcacccgcagaggccgcggctcwtttccaccggggaagcctctatgccccagccgagggaccgcctctcggcctctcacgcccctccgcgtgctccgccgccgctcagccccgcccgccaccg

SEQ ID NO: 63388 - DNA, 201 bp, Homo sapiens
tttgtatttttagtagagacagggtttctccatgttggtcgggctggtctccaactcccaacctcaggtgatccgcccaccttggcctcctaaagtgctgrgattacaggcatgagccactgtacctggccgagccaccgtgcctggccgagccacctaattttttttagagacagtgtctggctgttgcccaggctggag

SEQ ID NO: 63389 - DNA, 201 bp, Homo sapiens
atgttgcagtgtagtgttccattgcatggacacaccgcattctgttttatctactcttcagttggtggacatttgggccgtttccactctggctacattaygaatgaagctgctacaaacttgtgtacaagttgctgtgtggacatatatgttcatttctcttgggtagatcttctacattttttgttgtttatgttttcc

SEQ ID NO: 63390 - DNA, 201 bp, Homo sapiens
gctgaggcaggagaatcgcttgaatccaggaggtggaggttgcagtgagctgaaatcgcaccactgtattctagctgggacaccagagcgagacgtccgtytcaaaaaaaaaaaaaagattataatggagctattgccataccatctaggtgtgtgtaagtatactctgtgatgtttgcacaatgaagcagttgcctaatg

SEQ ID NO: 63391 - DNA, 201 bp, Homo sapiens
ttcgtgaatgaagcacttactgagcacctgtccagtgtcaggctgtctttggtgatatccgtatgatgatagaaccaaagcatctgcattatgtggtagcyaagagcttgactttaaatcccagctccaccacctgctgactgggtgacattagacaagttacttagcctctgagtgcctcattttccttacctgtaaagt

SEQ ID NO: 63392 - DNA, 201 bp, Homo sapiens
ctgtactttttaaaaatcattactactaatttgctcagtttttcttcttgattgttgttctcaaagtctgtttcttttatttattttcattattattattwttttttttttttttgagacggagtctcgctctgtcgcccaggctggagtgcagtggcgcaaactcggctcagtgcaagctccgcctcccgggttcatggc

SEQ ID NO: 63393 - DNA, 201 bp, Homo sapiens
ttttgagacggagtctcgctctgtcgcccaggctggagtgcagtggcgcaaactcggctcagtgcaagctccgcctcccgggttcatggcattctcctgcstcagcttcccgagtagctgggactacaggcgcccgccaccacgcccagctaatttttttttgtatttttatttatttattattattatactttgagtttt

SEQ ID NO: 63394 - DNA, 201 bp, Homo sapiens
attattattatactttgagttttagggtacatgtgcacaatgtgcaggttagttacatatgtatacatgtgcagtgctggtgcgctgtacccactaactcrtcatctagcattaggtatatctcccaatgctatccctccctcctccccctgtatttttttagtagagacggagtttcaccgtgttagccaggatgatctc

SEQ ID NO: 63395 - DNA, 201 bp, Homo sapiens
tggtgactcacgcctgtaatcccagcactttgggaggcggaggtgggtggatcacgaggtcaggagatcgagaccatcctgactaacatggtgaaaccccrtctctgttaaaaaaatacaaaaaattagccgggcgtagtggcacacacctgtagtcccagctactcgggaggctgaggcgagagaatcgctttaacctgg

SEQ ID NO: 63396 - DNA, 201 bp, Homo sapiens
gactaacatggtgaaaccccgtctctgttaaaaaaatacaaaaaattagccgggcgtagtggcacacacctgtagtcccagctactcgggaggctgaggcragagaatcgctttaacctgggaggcggagtttgcagtgagccgagattaccccactgcactctagcctgggtgacagagtgagactccgtctcaaaagaa

SEQ ID NO: 63397 - DNA, 201 bp, Homo sapiens
cagttttcagaatgctttcatgtccaggatctcactacagccttgcaggcatgtatgatggctacatccccgttgtgcagatgaagaagcagaagcagcaraagattctcttttgggggaagagataaatgcagcagctaattgaaaaggatctgtttgccattttcccattttgcttttgtaatatttctccccttggtt

SEQ ID NO: 63398 - DNA, 201 bp, Homo sapiens
tagaaaacagcatcttgtcaaggcatatggtctcatttgaagaataatttaataatttggataggaaggtatacttgtaaaatacagccagtcaaaaataycttttccccattccccttgatgcgtccattacatacatgttcaccctgagattgatcttccatcagcattgaaatgaacattgaaagtaataagatgggc

SEQ ID NO: 63399 - DNA, 201 bp, Homo sapiens
gttgggttcaggatctagtttggaacagtgatgaaatttcgagctgctgaaccagatatggaactgctttgctaacctggtgtctgcccagcttaagcccyctccatcccacagctgtgaaaggaaatcatgcttcttcccaagtgctaacattcctgtgaggccttacactttacccaagtcctcctgatacatttgtct

SEQ ID NO: 63400 - DNA, 201 bp, Homo sapiens
gaggtgatgaagggtgacaaatttggatgggaagtggccctcattcaaatacctttccatggcactgacttgggcctctgcttgcttctccctgcagaaayccagtttgacagagtaccctgcagtacctggcactgactaggtgttctgtaaaggtgtgtctgatgaggaaaggaaagcacctcaagttcagtctgagtg

SEQ ID NO: 63401 - DNA, 201 bp, Homo sapiens
agcaggatttgtataatttgaagcagagctgggcaactgcagagcaatggggaagccagcccagtgtggtggcaagacctgggcaacttgggaccagcctgggctgtctcttgccagctgttgttatcagaaccaggctcttcacactcagatccttgggccccccatctcagaatgcccagtggttgaaaggatgaaacc

SEQ ID NO: 63402 - DNA, 201 bp, Homo sapiens
tgcctcctcaaccccatgtaaaccagaatgagcaactgctgggctggaggagctctccttcttagagcattgtgggacaacttgctatgagttctccttcmttttttcatttcaccaccatgagttgtagggccctttgtgctttggcccctaacaacttgcccagtatggtgccctgcccatcacccattgtcttcaaca

SEQ ID NO: 63403 - DNA, 201 bp, Homo sapiens
tcacacagtactatgacagatatcacatctccaaaggaagctagtgtggtctcaatgctgaggctgcatgctctccccatctagtcacttacagtgcccarctgatgttgagcatcactgttttcctcgaaagtttaaaatagccagtggctcccttgatcacttgctgtggcacctcagactgccttggcacacgatttg

SEQ ID NO: 63404 - DNA, 201 bp, Homo sapiens
aagaaagagtccagttgactaggctagtaatcttattaactggatagttgcactcttatgtttaggccccaaaatgctttgtattatttcacttcttcctmaacaatcctgtgagatactcttattacctctattttaatacggtaattaaagaagccgaggccaggagatgttgacttatctaaggccactcaccttaga

SEQ ID NO: 63405 - DNA, 201 bp, Homo sapiens
ctaagttgcaaataccaggtggtgtggtgtgctttgaagctatttattcaacatgtgtttatcaagaagtgtctgtccaggcgcagtagctcatacctgtratcctagcactttgggaggccaagatgagaggatcccttgagcccaggagtttgagactagcctgggcaacatacctggacaacatagtgagaccccatt

SEQ ID NO: 63406 - DNA, 201 bp, Homo sapiens
taaggctcttgatatatattgccaaacactttccaagattgtgctggtctattcccctcccccagaatcctgggtgtgggagcccagaggctgctggcccrttcccagcaggcaaagatgttacccatctcctaggaaggaagtgtagcagcctctgagcgccacaggtctcgtttctgtgggtgctggagtgcgtttggt

SEQ ID NO: 63407 - DNA, 201 bp, Homo sapiens
taagttgcaaataccaggtggtgtggtgtgctttgaagctatttattcaacatgtgtttatcaagaagtgtctgtccaggcgcagtagctcatacctgtartcctagcactttgggaggccaagatgagaggatcccttgagcccaggagtttgagactagcctgggcaacatacctggacaacatagtgagaccccattt

SEQ ID NO: 63408 - DNA, 201 bp, Homo sapiens
agtagctcatacctgtaatcctagcactttgggaggccaagatgagaggatcccttgagcccaggagtttgagactagcctgggcaacatacctggacaayatagtgagaccccatttctgtaaaaaaaaaaaaaatacaaaaattagccaggcttggtggcaccagcctgtagtcccaactacttgggaggctgaggtgg

SEQ ID NO: 63409 - DNA, 201 bp, Homo sapiens
cccatttctgtaaaaaaaaaaaaaatacaaaaattagccaggcttggtggcaccagcctgtagtcccaactacttgggaggctgaggtgggaggatcactygagcctaagaggctgaagatacagtgagtcaagatcacaccactgcacttcagcctcgtcaacagagcgagaccctgtctcaaaaaaaaaaaaatacata

SEQ ID NO: 63410 - DNA, 201 bp, Homo sapiens
aagatcacaccactgcacttcagcctcgtcaacagagcgagaccctgtctcaaaaaaaaaaaaatacatacacacacacacacacacacacacacacacaygtatatgtatatatattttttaaattaagaaaaaatgtctgctctatgctggacacttaaagtgacttcccctgggtcctagggtactttctgagcctta

SEQ ID NO: 63411 - DNA, 201 bp, Homo sapiens
gcccacgactctgaccagcacccacactcaggctctggccgcagtgtcctgtcattcgagtcaggtaggtggaggccccttgccccacctgggcatggctrgaccactatggcaggagaaggaccctgtgtacaaacttcttggcttggctaccaggtcccaaagggcttttatagtgggcccccacctgcttgcttctga

SEQ ID NO: 63412 - DNA, 201 bp, Homo sapiens
tactttttaaaaatcattactactaatttgctcagtttttcttcttgattgttgttctcaaagtctgtttcttttatttattttcattattattattattwtttttttttttgagacggagtctcgctctgtcgcccaggctggagtgcagtggcgcaaactcggctcagtgcaagctccgcctcccgggttcatggcatt

SEQ ID NO: 63413 - DNA, 201 bp, Homo sapiens
ttttggggtagatggagttttgctctttttgctctttttgcctaggctggagtgcagtggcacagtctcagctcactgcaccctccacctcctgggttcargtgattcttctgcctcagcctcccaagtagctgcaggcatgtgccaccatgcccagctaatttttttatttttagtagagacggggtttcaccatgttgg

SEQ ID NO: 63414 - DNA, 201 bp, Homo sapiens
cagtgcagagaggccactgttgcccccaaaactcatgtgcactggagcatcttgcccctgtgtgctagcattttatccactttccttccagccacctccasccccaccatcaaccctggcaactttgtcctgtaactaaaatagcctttagcacatggcataaccggagagcttttgacattcctctttggagattcatgt

SEQ ID NO: 63415 - DNA, 201 bp, Homo sapiens
acctgaggagagggggagggggcagttctgcctgggagataagaaaacttttgggaggagatgacactggacttggggcttaaggagaggagtgagggtaggctgtgggggatgctagggaaaggcccccagtagagggaagagtgtcagtgacagcccagagacacggaggaaggatgcctgaggaatacaaagggtaca

SEQ ID NO: 63416 - DNA, 201 bp, Homo sapiens; identical to SEQ ID NO: 12589

SEQ ID NO: 63417 - DNA, 201 bp, Homo sapiens
cacttcattggttttgttcttaaatatcaatagtgcaaccactggcttttattcaaaggtttaattggaatctaacctggggattttcccctttttaaatktatgtttaaaaaaaaaaactatggaaagtcggcatggtctgggctgcttgggagcctgaggcaggaggatcacttgagtccaggaatttgagactctcct

SEQ ID NO: 63418 - DNA, 201 bp, Homo sapiens
ctcagctcactgcaccctccacctcctgggttcaagtgattcttctgcctcagcctcccaagtagctgcaggcatgtgccaccatgcccagctaatttttwtatttttagtagagacggggtttcaccatgttggccaggcttgtctcgaactcctgacctcaagtgatccacccgccttggcgtcccaaagtgctgggat

SEQ ID NO: 63419 - DNA, 201 bp, Homo sapiens
aaaaagtaatgacatgattacctaagtgcccctccacacagccccaaatctcctttgttgtcactccgagtctgtcttacagcttttccccaagttgtgawgagcataaatgtaaaatccaagaaatgtttattttgtaaggggaaaaaagtgtgggtagaggagagactcagacaaacctaaatatagatataaattcaa

SEQ ID NO: 63420 - DNA, 201 bp, Homo sapiens
tcaagcgattctcctgcctcagccttccaagtagctgggattacaggtgcgtaccaccacgcccagctgattttttgtattttaagtagagagagggtttyaccctgttggccaggctgatcttgaactcctgactgcaggtgatccacccgcctcggcctcccaaagtgctggtattacaggcatgagccaccgcaccca

SEQ ID NO: 63421 - DNA, 201 bp, Homo sapiens
tctcctgactttcatctgaaaccctgaaccctacaggccatgggagatgacctgtttcccagttttggtcactttttgggccatatttataaccaaaactyttatttaaccagttttcagaaaattctcagcttcttcatcaattgatgaagttatctgactgactttttattccagccattctcatactctcagaatgat

SEQ ID NO: 63422 - DNA, 201 bp, Homo sapiens
ggtttcaccatgttggccaggcttgtctcgaactcctgacctcaagtgatccacccgccttggcgtcccaaagtgctgggattacaggcatgagccactgkgcccggccagtgattcttaattagttcatgatattttggagttctaggcaggacagcagcctctgcctcctcaaccccatgtaaaccagaatgagcaact

SEQ ID NO: 63423 - DNA, 201 bp, Homo sapiens
ttgggaaaagcaggccttttgcctctctctcctctcatcctgctcctgctgttcagccaggtttcctgcctggctcagggtcagagtacgggacaacagasgttgcttttcaggggtgagcaaggcagggtggtgtgggaagggatgtcatgaggtggcaggcgagatggctcagggagagctaccctgggcatagatggg

SEQ ID NO: 63424 - DNA, 201 bp, Homo sapiens
acccaaatttcctcctctgtaaagacacacccacttgaggcgcttgtggatttcctgagaaaggccaacaaatggtggccattgttcttaaaacagtacaycacacttcaggtactcaggagggaaacagacccacctgggtggctttgctgaggtcacacacctcaaccagccacagccctggcccctagcctccccaca

SEQ ID NO: 63425 - DNA, 201 bp, Homo sapiens
taatcccagcactttgggaggccgaggcaggtggatcacaaggtcagcagttcgagacgagcctgtccattgtggtgaaaccccctctctactaaaaatamaaaaattagctgggcatggtggcacgcacctgtaatcccacctactcagtgggattacaccgggaggctgaggcaggagaattgcttgaacctgggatgt

SEQ ID NO: 63426 - DNA, 201 bp, Homo sapiens
ctgggatgtggacctagtcagcaagtccagcacactctactggtgggcttgccctagtttccatggtgggctttactttcaggtacctgtgggagtcctakccctgtgctgatctttcccagtctcccccaaagcccacctccaccatggtgctttctgcaccccacagtggctgcagccagcattctgccaccttggtgt

SEQ ID NO: 63427 - DNA, 201 bp, Homo sapiens; identical to SEQ ID NO: 12577

SEQ ID NO: 63428 - DNA, 201 bp, Homo sapiens
cagcatccagaagccaggccaggaggctccacctcctgaaggcagtgcagaagctgagggtggaggccagggtgccagcccgggcttcccttagagctccytgggagaaagtgggctacgtggtttcgggagcgaggggtgctgaagtgccaaggaagccctcaccccctgcctctgaggcccaggagggggaagtgtcca

SEQ ID NO: 63429 - DNA, 201 bp, Homo sapiens; identical to SEQ ID NO: 12580

SEQ ID NO: 63430 - DNA, 201 bp, Homo sapiens
cactctggggcttgcctgttctgtcttaatggtgtctagtgagagcacaagctcttaatttcagtgaaatccagattattagtcttttcctttacagttaracattttaagtcctgttcaataaatctttgtcctacctcaaagtcatgaagatattctcctatgttgtctgctagacgctttattttttactctttacac

SEQ ID NO: 63431 - DNA, 201 bp, Homo sapiens; identical to SEQ ID NO: 12583

SEQ ID NO: 63432 - DNA, 201 bp, Homo sapiens
cagacgtgagccaccgcgcccggcccacatgcttagtttctatgttcctgtaactaatttgccctaaatcttgtgacagaaacttgcaatgtggtggtcarttcctttctttcctgtcccatctgatggctatggtttaggtctgctctcccttcacttatcttgggacaacccctaaccatcacccttgggggcaatgtt

SEQ ID NO: 63433 - DNA, 201 bp, Homo sapiens
cgagccaggtcatgtgggcccatctcagccccaccacgggctggccgtgagaggctggacaagttcacttcttttccgtggattgggtggggcagcagacyccacctcccaggatggatgtgagcgttcagtgaatgagtccaggtaacgccaaggaactgcaccaacttcatggtagattctcggttgtgacacacatct

SEQ ID NO: 63434 - DNA, 201 bp, Homo sapiens
cacccgcacccaccagctgctggaacacagcctgcggcggcgcaccacgcagagcaccaagcacggtgagtccacccctccccagctcacaggctgggccrggccctgcgccctaggaagagaggagaagaggggccagcccagctcccacatctggcattggtgcccagcacacctctcgcctctctgagaatgaaagaa

SEQ ID NO: 63435 - DNA, 201 bp, Homo sapiens
gagaaccctcccccatccctagcctccccttccactcccagtctcctctacagaaagaagctaactaagtatctccagagagtttaataccacatctctgsgggggtggtcccttaaagaacgggtacaacaccttattgtggccactttataggtaaggaaactgaggcacacgttggaatgactatcttgggtggcttc

SEQ ID NO: 63436 - DNA, 201 bp, Homo sapiens
aataaaataaaatttatttatttagtgaccttgtctcactttgttgcctaggccgaccttgaattcctaggttcaagcgatcctcccatcttagcctcccrtgtagctggaccaacaggcatgtgcagcattaaaaaaaaaaaaaaaacttactatgtgtaatatagcaaagttttttaaaagttaaaaacatagccttga

SEQ ID NO: 63437 - DNA, 201 bp, Homo sapiens
ctgttccctcacgtcctgcggagttcaccagactctggggctctccacttcctcccagagctgctgagtgttggtctggggagaggcctggtaggtgctargatccttgcctcagggatgggccagtcacctgtctcccctctctcgtggctgaccccacaggtggtccagctgctcacctgtgacctgctactgtcgcta

SEQ ID NO: 63438 - DNA, 201 bp, Homo sapiens
cctatccttctgcaagcatatatatatatatatatatatatatatatatatatacacacacacacacacacacacaaaatatcaaaatatatatatatatrtatatatatatatatttttttttttttttgagactgagtctcgctctgttgcccaggctggagtgcagtggcacgatctctgctcactgcaagctctgcc

SEQ ID NO: 63439 - DNA, 201 bp, Homo sapiens
tgcccctgccacctgcctgtgctgtattccctatacaagctgctgtccctgtcagagccttgctttctcacctgcagaatggggagggcttgtctcccacytcctggggccatggaaggaactggttctcccctgagctgttccctcacgtcctgcggagttcaccagactctggggctctccacttcctcccagagctgc

SEQ ID NO: 63440 - DNA, 201 bp, Homo sapiens
ctcctgcctcaaccgcccaagtagctgggactacaggcgcccgccaccacgcccagctaattttttatatttttagtagagacggggtttcaccgtgttarccaggatggtctcgatctcctgacctcatgatccgcccgcctcggcctcccaaagtgctgggattacaggcgtgagccaccgcgccaggccgacatggtg

SEQ ID NO: 63441 - DNA, 201 bp, Homo sapiens
ttcaggtgagcacacagatccttattttttcttttcttttctttcttttttttttttttttgagacgcagtctcctgttgcccaggctggagtgcaatggygcgatctctgctcaccgtaacttctgcctcccgggttcaagcaagtctcctgcctcagcttcctgagtagctgggattacaggcatgcaccatcacgcct

SEQ ID NO: 63442 - DNA, 201 bp, Homo sapiens
tgtaaaaacctatgcagtatttattccaacctcgaggccttgttttgaaggtcaaagatgagccagactctcctcctgtggcgctgggcatggtagaccgstcacggattcttctgtgtgtcctcaccttcctgtgcctctcctttaaccccctgacttccctgctgcagtggggaggggcccacgactctgaccagcacc

SEQ ID NO: 63443 - DNA, 201 bp, Homo sapiens
ctactcctgtaactatgtctgacagccagctgttgggtcttccatcgtttttaaccttcaggtgagcacacagatccttattttttcttttcttttctttyttttttttttttttttgagacgcagtctcctgttgcccaggctggagtgcaatggtgcgatctctgctcaccgtaacttctgcctcccgggttcaagcaa

SEQ ID NO: 63444 - DNA, 201 bp, Homo sapiens
cccgtctctactaaaaatacaaaattagccaggcatggtggcgcatgcctgtaatccaagctactcgggaggctgaggcagcagaatcacttgaagctggraggcagagtttgtggtgagccgagatcacaccattgcattccagcctgggcaacaagagcgaaactccgtctcaaaaaaaataaaataaaataaaataaa

SEQ ID NO: 63445 - DNA, 201 bp, Homo sapiens
tcaaagtgtcattgagattaaacgaaatttgtgtaaagtgtttaattgctgatacatagtaagagctcagcaaatgttaattcctgtactttttaaaaatyattactactaatttgctcagtttttcttcttgattgttgttctcaaagtctgtttcttttatttattttcattattattattattttttttttttttgag

SEQ ID NO: 63446 - DNA, 201 bp, Homo sapiens
tttgggaacaataggtggcaggcagtcatcaactgctcagagtggtgacagggacgaggcttcaggcattggaaggaggtgctggctttctgtccctggcrtttgatagtgattggagttgactcgcccggccttggagcagtagaggctggtcaggattgacttagaccttgagtgctcagtggctgtctgctttctgct

SEQ ID NO: 63447 - DNA, 201 bp, Homo sapiens
gggaaaggcccccagtagagggaagagtgtcagtgacagcccagagacacggaggaaggatgcctgaggaatacaaagggtacacatagacagcgcttgcrtgtgcctgggatgacaggaaagggacagaaatggccattgggtcttagagctggagagctgaacagctaggccatgaggtgggccttgtgtatatgtttt

SEQ ID NO: 63448 - DNA, 201 bp, Homo sapiens
gacccttggtaccttcgacagaacagcacccatctagtacaaaggtagttccttttatgatcaaaacaatcaggaaaaagagagaggctgggtgcggtggmtcacacctgtaatcccagcactttgggaggctgaggtgggtggatcacctaaggtcaggagttcgagacccacctatcaatatggtgaaaccctgtctct

SEQ ID NO: 63449 - DNA, 201 bp, Homo sapiens
aagatggagtggactccatctaggccatgttgcctggaaaagctggaagaggcccctgtagagtgagcagtgattgagaggcaggccatggggactgagcrggggcggggccagagtgtttgggaagcatgtctgtcagcagagggttcttagggagaattggactggggagtcaggaggggtaagagccaaagactggga

SEQ ID NO: 63450 - DNA, 201 bp, Homo sapiens
agtgagggtaggctgtgggggatgctagggaaaggcccccagtagagggaagagtgtcagtgacagcccagagacacggaggaaggatgcctgaggaatayaaagggtacacatagacagcgcttgcgtgtgcctgggatgacaggaaagggacagaaatggccattgggtcttagagctggagagctgaacagctaggcc

SEQ ID NO: 63451 - DNA, 201 bp, Homo sapiens
atttcaaagaatcttatagttcttcaatggagttcaagaattgggacaggtgggggaatgtaaaggcaaaaagctgagacagtcctcccaaagtgcacttkccgtccagaaaggatggaagaaaatgaagccccagggagttgttgattctcaacatctgttaactcccttgctgggtgcagtcatttgctgattagcttc

SEQ ID NO: 63452 - DNA, 201 bp, Homo sapiens
tcccaatgcgagctttctctgctttcctgcctcttctcccaaaaaactgctactcattcttcagaccccatcagcggcctcctccaggaatcctttttttwaatttttttatcttttgaagcagagtctcgctctgttgtccaggctggagtgcaatggcgcaatcttggctcactgcaacctccacctccccggttcaag

SEQ ID NO: 63453 - DNA, 201 bp, Homo sapiens
gtgcagtggcgtgatcttggctccctgcaacccccgcctaccaggttcaagcgattctcctgcctcagcctcccaagtagctgggattacaagcacctgcyactgcacctggctagttttttgtatttttagtagagatggggtttctccaggttggccaggctggttttgaactcctggcctcaaacagtgcatcgatct

SEQ ID NO: 63454 - DNA, 201 bp, Homo sapiens
agatcgagaccatcctggctaacacggtgaaaccccgtctctactaaaaatacaaaaattagccgggcatggtggcgcgcgcctgtagtcccagctacacrggaggctgaggcaggagaatggcgtgaacccgggaggcagagcttgcagtgagtcgagatcgcgccactgcactccagcctgggcgacagagcgaaactc

SEQ ID NO: 63455 - DNA, 201 bp, Homo sapiens
agtcttcagagatgttaaatctctatatgctgagtaggtatgggagggtctatagcacaaatcagtcaaattgtaaatgtcacccctcttagttgtttttygctcgaaaaagtattagcaatgtgtgttcgatgtgggagtactggagtctacaaggaggtagaaaagaatagcagaaggaccctctattcttggctaata

SEQ ID NO: 63456 - DNA, 201 bp, Homo sapiens
aagtcacagccatcccaggaaacaggagggcacccagctgaaagtggagcatcacctggtctacggggaacatgtccttagctccagagtgggagggaccrggagagtcctggagattcagattctcagccactccctggggcttggtcttagctggctaggctagtacttcaagctagatattgtcagtggacctgggca

SEQ ID NO: 63457 - DNA, 201 bp, Homo sapiens
ttgggcagcgactgcagaagcaagttgctgatgaagagagcagtggcggcggagtgtggacacatctctccgggatggagacccgggcgctcctgctgtcmcgctgcaaggggaattgagcagaagaaattttgagttgtggcccctcgggtacgggctggggagcgggtggcctttgttccagcgccttaacagcggagt

SEQ ID NO: 63458 - DNA, 201 bp, Homo sapiens
catacgtagatcaaaacttaaaacatatttagccatgttaatcctcttgtggtgtagtttatcagcagtgattcttgaagggaggtagtaaccaaggttcygtggctcctgagacttcttggggcctgatttgattaacccaggaagagtctcagacctcatgaagtactgccaggtctggcagcacttggccaaagcggg

SEQ ID NO: 63459 - DNA, 201 bp, Homo sapiens
cccctgtagagtgagcagtgattgagaggcaggccatggggactgagcaggggcggggccagagtgtttgggaagcatgtctgtcagcagagggttcttakggagaattggactggggagtcaggaggggtaagagccaaagactgggacttgggaatagcccatctttgagggaaaggcaggggaggagccagggaacac

SEQ ID NO: 63460 - DNA, 201 bp, Homo sapiens
caggagttcaagaccagcctgggcaacatagcaaaacccccatctctaaaaatgaaaagaaacgctttagcagacatggcatgagaatcacctagagggcygcaataccagagattctgattcagtagccctggggtaaggtccaagtgcttgcatttctaacaagctcctaagagctgatgctactggcctctgggggcc

SEQ ID NO: 63461 - DNA, 201 bp, Homo sapiens
gcactgggattacaggcatgagccaccacaaccggtctcagcagctttctgtttgtcagatatacaaatataccccaggctccaggcccccacatcccccaaaaaacacacacacacacacacacacagcatcagagacctgagaaggacatcttggtggaggtttgggggaatggagatggttccttttatttttttata

SEQ ID NO: 63462 - DNA, 201 bp, Homo sapiens
ggtcttgctatgtggcccaggctggtctcaaacccctagcctcaagctgtcctcctgcctcggcctcccaaagtgctgggattacaggtgtgagccacctygcctggtccaaaggcctcctcttaaataccatttccattctgctgctccctgctgagagcccatcagcggctccccattgcctaccaggaccagaatcca

SEQ ID NO: 63463 - DNA, 201 bp, Homo sapiens
ccaagcactaaggcactctgtggttctgtcttctgagacacctgtctccctctcccactcctcctcctccttcccccagccccatcgacaggctctgctgycacttcaggcttttccttggtaccttgtgggtatctcagcctcctagccagccatggtgggactcccatggggtggaagaacctgcgccttcaacccaca

SEQ ID NO: 63464 - DNA, 201 bp, Homo sapiens
tttattggctgattagatattgaggccattatttaagaaattaaactaaaattggtccaggcccagtggctcacgcctgtattcccagcattttgggaggytgaggtgggcagatcacctgaggtcagtagtttgagatcagcctggccaacatgatgaaatcccatctctactaaaaatacaaaaatgagccaggtgtgg

SEQ ID NO: 63465 - DNA, 201 bp, Homo sapiens
aaagcaatcctaaatctttctaccccacccctgctggctaaacatggacttctcagtggctttgtcatctctggcagtctctggctccaggccttgttacytggaatgtgttcataagtgtccctcctcctggtcattagatcgaggcccacatatctgccacatgtgaggagagagaaggggctggtgatttgaggcctg

SEQ ID NO: 63466 - DNA, 201 bp, Homo sapiens
tgtaccccaggcctggagcggcacccctgcctcctggagcccactctggtcagctctctggtctgctcacagcatggctggcatcagtggcctttttttcrtaatagatggggtcttgctatgtggcccaggctggtctcaaacccctagcctcaagctgtcctcctgcctcggcctcccaaagtgctgggattacaggtg

SEQ ID NO: 63467 - DNA, 201 bp, Homo sapiens
ttgtctaacacaaggtgcataataaatacaaaatataagaataaatgacctttgtaaactaggtttcccagcccctaatagggctgggtaacaaatacctrttaaaggattattgactgaatctgtaatttggagaaactgtaaccctatttggaggcttcacattctttattcttgaccagaattaatttaaccagattt

SEQ ID NO: 63468 - DNA, 201 bp, Homo sapiens
accagcccatatctttcccacaaaagggtttcaagagtacttgacaaaatgagatcagtgcacccacatgcctgtgtagtgggtgctctggaagtaccgcyaacattgacctgcataagggtctacccttcaccaagcacttcggataaattatcttattaatcctcagggcaaagaggccaagtgtgtattttcaaagca

SEQ ID NO: 63469 - DNA, 201 bp, Homo sapiens
cttgcccctgtgtgctagcattttatccactttccttccagccacctccacccccaccatcaaccctggcaactttgtcctgtaactaaaatagcctttarcacatggcataaccggagagcttttgacattcctctttggagattcatgtctgcgtcttgggggcattcggcactagtgatgggcagccctgcctgctga

SEQ ID NO: 63470 - DNA, 201 bp, Homo sapiens
gtgagactttgtctcaaaaaaaaaaacaaaaacaaaaaaacaggacgtggtggctcacgcctgtaatcccagcactttgggaggccaaggcgggtggatcmcctgaggtcagcagtttgagaccagcctgaccaacatggagaaaccccgtctctactaaaaatacaaaattagccaggcatggtggcgcatgcctgtaat

SEQ ID NO: 63471 - DNA, 201 bp, Homo sapiens
cactgggattacaggcatgagccaccacaaccggtctcagcagctttctgtttgtcagatatacaaatataccccaggctccaggcccccacatcccccaaaaaacacacacacacacacacacacagcatcagagacctgagaaggacatcttggtggaggtttgggggaatggagatggttccttttatttttttatag

SEQ ID NO: 63472 - DNA, 201 bp, Homo sapiens
ccagttatcccatatggagactacactagaaagccccagcagctttatttatttacatttatttatttatctatctatttatttatttattttttgggacrgagtcttgctctgttccctaggctggagtacagtgacgcagtcatctcggcttactgcaacctctgcctcctgggttcaagcgattctcctgcctcagcc

SEQ ID NO: 63473 - DNA, 201 bp, Homo sapiens
attaaagatgagagttgctgaaaggacagatgagaggaaattagaaggtggaattgactggactggggactcattggactgatggatggggacagtagtcrgctaagacggttccctggttcttccttgggagtttgggtgagcgatggtgccaccaacaaaggtaaagaaaatagaaggaagagcaactttccaggaaaa

SEQ ID NO: 63474 - DNA, 201 bp, Homo sapiens
ggattacaggcatgagccaccacaaccggtctcagcagctttctgtttgtcagatatacaaatataccccaggctccaggcccccacatcccccaaaaaacacacacacacacacacacacagcatcagagacctgagaaggacatcttggtggaggtttgggggaatggagatggttccttttatttttttatagtggtg

SEQ ID NO: 63475 - DNA, 201 bp, Homo sapiens
attacaggcatgagccaccacaaccggtctcagcagctttctgtttgtcagatatacaaatataccccaggctccaggcccccacatcccccaaaaaacacacacacacacacacacacagcatcagagacctgagaaggacatcttggtggaggtttgggggaatggagatggttccttttatttttttatagtggtggt

SEQ ID NO: 63476 - DNA, 201 bp, Homo sapiens
aaggatagatctaaattgtttctgaaatgtttaaatttcaaaccccgcatagtcaaggataataaaacagactcatctttttttgccctcttgttaaattmtaagcttcacaggcatttgaatacatctaaaaaatttggtttgtgagccttagaatttaaccacttacaaaactcttgagctccctccacttctgaggac

SEQ ID NO: 63477 - DNA, 201 bp, Homo sapiens
tttgttcatttaatgtagtcaacataatttccatactttgaacactcttacggaattgtttatttatagagactagtataaagttgttctatcttacttartttgaactaatccagagttatacaatctagaaagtaaagaaagtttttattgtctcttaaatatcaatgtaattgtagagtgtgaaataatttcttgggt

SEQ ID NO: 63478 - DNA, 201 bp, Homo sapiens
atatacctgggaaatagctggttaagcttcaccacaaaggatagatctaaattgtttctgaaatgtttaaatttcaaaccccgcatagtcaaggataataraacagactcatctttttttgccctcttgttaaattctaagcttcacaggcatttgaatacatctaaaaaatttggtttgtgagccttagaatttaaccac

SEQ ID NO: 63479 - DNA, 201 bp, Homo sapiens
ggcaggagaatggtgtgaacccaggaggcggagcttgcagtgagccgagatcacaccactgcactccagcctgggtaatagagccagactccatctcaaarcaaaacaaaacaaaaaaacccaccaaaaaccaagtactacaaactaaagggaagcaattaaggaaatgtatctttaagtatgtttactgcagccctgctt

SEQ ID NO: 63480 - DNA, 201 bp, Homo sapiens
cctgtttcagccgggaagggaatgagagaatcgcctgtggctgatttattggcgcctgtggttgcccagagaggccaagcaggactttcagctgccctctrtgccttacaaagtggagctgtgagcttccaccctatctcctgaggggaatgtgaaggagccaggctgtctagctggggaggaggtgccttggccgtaaaa

SEQ ID NO: 63481 - DNA, 201 bp, Homo sapiens
aaattaaagttgatgaaagaaataacagattccccggctctatatacctgggaaatagctggttaagcttcaccacaaaggatagatctaaattgtttctraaatgtttaaatttcaaaccccgcatagtcaaggataataaaacagactcatctttttttgccctcttgttaaattctaagcttcacaggcatttgaata

SEQ ID NO: 63482 - DNA, 201 bp, Homo sapiens
gagtttgagacaagcctaggaaacataacaagaccccatctctacaactgagaagttaattaaaaaaaaaaaaaaaaaaagggccggacctggtggcttaygcctgtcatcccagcactttggggggccgaggcaggtggatcacaaggtcaagagattaagactatactggccaacatggtgaaaccccgtatctattaa

SEQ ID NO: 63483 - DNA, 201 bp, Homo sapiens
atattatgtgtacgcacatgtatgaacctagatataaagttctgaaaataagccatcacactttgaattaatatagaaaatattcaaataatctgagtctygttaaggccccaacggcaactggaaggtgttagaatagtgattaaaccatttgatcatgtgtggaaacgccttggtccaacttaaagttaaaagcctctg

SEQ ID NO: 63484 - DNA, 201 bp, Homo sapiens
ttacaggcatgagccacctccacgcccagccagaagaggaggaaaaaaaatattaggttggtgcaaaagtaattgtggtttttaccaacctaatgttttasgaaaaagaaagtctgggccaggtatggtggctcatgcctataatcccagctacttgggaggctgaggcaggagaatcacttgaacccaggagacggaggt

SEQ ID NO: 63485 - DNA, 201 bp, Homo sapiens
atccatgatgttagcttttcctctataaatcaacttaactctcttttataatggtgacacttacaaagctaaaaccccaggaaaattaaagttgatgaaakaaataacagattccccggctctatatacctgggaaatagctggttaagcttcaccacaaaggatagatctaaattgtttctgaaatgtttaaatttcaaa

SEQ ID NO: 63486 - DNA, 201 bp, Homo sapiens
tggcacagttttcacttttttcctgatccataaaaccagcaaagtggatacattcagtgttctataactacatttaagatccatgatgttagcttttcctytataaatcaacttaactctcttttataatggtgacacttacaaagctaaaaccccaggaaaattaaagttgatgaaagaaataacagattccccggctct

SEQ ID NO: 63487 - DNA, 201 bp, Homo sapiens
gcatcaaactacagtttgcttctacttggaccttaactttctcaaataatgcaagagcttttgttttatactatgaccctttgatatccttgtcttttctrgctttttctagtttttctcaggtgctcccccaacctgttccacacaggatttgtaacttcaggtcatttgcatggttatcagaatgccccttcgctaatg

SEQ ID NO: 63488 - DNA, 201 bp, Homo sapiens
ctggagtgcagtggtgcccaggctgaagtgcagtggcatgatctcagctcactgcaacctccgcctcccaggttcaagcaattctcttgcttcagtctccytagtagctaggaccacaggtgtgcgccaccacacccggctaattttttgtaattttagtagagacagggtttcaccatgttggttaggctcctcttgaac

SEQ ID NO: 63489 - DNA, 201 bp, Homo sapiens
catgcggcaccacgcccagctaacttttgtattgtttgtagagacagggtttcgccatgttggccaggctggtctcaaactcctgagatcaaacaatccgyctgcctaggcctcccaaggtgctgggattacaggtgagagacattgtgcctggcctctttgggaagttttttctgatcttagggtgaggcagatgcctct

SEQ ID NO: 63490 - DNA, 201 bp, Homo sapiens
aaattatctaatctgaagtagagaaataagttattgtatatgaaagttctctgtaaacttcagtgctctatgtaagtttcagagtttattactccaggttkctttcatatgtaaagggaagaggtatgtttgggtcttctgatctgcagcttccttaatgtcctgtcctgtcatgtctgtgtctaagctttataccctctg

SEQ ID NO: 63491 - DNA, 201 bp, Homo sapiens
gttttcttttttctcctcctctgtcttattttgtcttttctgttttccaaagattcattcttagcttttttccctcttatttcattctactttttagtctrctttattattttcatacttggttacttcagccttgtcgtttcagaggcctcttctccctctctggctctgctctctctagagccctgtcctgcttcttgt

SEQ ID NO: 63492 - DNA, 201 bp, Homo sapiens
gtgctgggattataggcatttatttaccgttctgctttccctttgctagcaggaattttctttctctctctctctctcttttttttttttttttttttttygctttattgggagaaaaagtgcttagagtgttcagttattttttatatttttctaattcatttcttctctggttacaaatcagtcatgcatggatgtttt

SEQ ID NO: 63493 - DNA, 201 bp, Homo sapiens
gaggcagaaagaaaagcgggggaaaaacccactctccctgtttctacacttttgcacttagtaacaatttgcctgattgaaggatttgtgaatggttctcyttttttttttttttttttttgagaaggagtctcgctctgttgcccagactggagtgcagtggtgcaatcttggctccctgcaacctccacctctcgggtt

SEQ ID NO: 63494 - DNA, 201 bp, Homo sapiens
agtgctgggattataggcatttatttaccgttctgctttccctttgctagcaggaattttctttctctctctctctctctttttttttttttttttttttktgctttattgggagaaaaagtgcttagagtgttcagttattttttatatttttctaattcatttcttctctggttacaaatcagtcatgcatggatgttt

SEQ ID NO: 63495 - DNA, 201 bp, Homo sapiens
gattagtttcttttgttagaggtctcaatatgtatttacagaaagaaatgaagatgattctgtaggacaaagtagcaaatactttctatatgcaatccatrcacaatgcaagaattcacccagatcatttaaaatcatctaatgtgcattatttcctccaagtggagctcttgaacaaataccttacatctcatacttcat

SEQ ID NO: 63496 - DNA, 201 bp, Homo sapiens
caacaagcaggcggcctggcagccgcccgtcaccgggtcctcgcagcgcgtccgccgcgctccggctccccgcacggatcggcgcccctccggccccgcastccgccaggcccgcggcccgtcgccctccggcctgggccaaagttgcgcaaatagccccacaactggcaaatacttaccggccgcaacaggaaccagagc

SEQ ID NO: 63497 - DNA, 201 bp, Homo sapiens
tgttgaatcaaattgaatttaattaggacacctgaattttatgtagcttccttctaatttttgtaactaaggagcattacaaattttcttttcaaaatgtmccataaaatataccatggattgaaattttgaattatgtataagagagttcatgttacccaataaaacatcataggaatttgaacctaaagaactctaaat

SEQ ID NO: 63498 - DNA, 201 bp, Homo sapiens
gccaaatgttgtgttcctagtgttgaggcaagtagtctttgtactgggtaacattttggaggtgtgatgcaaaaatgcatttgtggacctaattcttaccraccataatctgtgttaatcgaaaattgacgtcctaatcaaatgctttccaactgctgtctctggaaagaaaggtagtatttcgtcatttcccagaagttt

SEQ ID NO: 63499 - DNA, 201 bp, Homo sapiens
caaaggaaaaggaacaaaaacaataaataaatacctttgtttttttttcttttttgagacggagtctcgctctgttgcccaggctggagtgcagtggtgcratctcggctcactgcaacctccgcctcccaggttcaagcgattcttcttcctcagcctcccgagtagctggaactataggcacgcaccaccacacccagc

SEQ ID NO: 63500 - DNA, 201 bp, Homo sapiens
ctactaaaaatacaaaaaattagccgggtgtggtggcacacacctgtaatcccagctactcgagaggctgaggcagtggaatagcttgaacccgggaggcrgaggttgcagtgagcggagatcgcaccactgcactccagcctgggtgacagagcgagactccatctcaaaaaaaaaaaagttcttccagctaaaaccttt

SEQ ID NO: 63501 - DNA, 201 bp, Homo sapiens
agatccagaccatcctggctaacacagtgaaaccgcgtctctactaaaaatacaaaaaattagccgggtgtggtggcacacacctgtaatcccagctactsgagaggctgaggcagtggaatagcttgaacccgggaggcagaggttgcagtgagcggagatcgcaccactgcactccagcctgggtgacagagcgagact

SEQ ID NO: 63502 - DNA, 201 bp, Homo sapiens
tatttgctgtttgaaaggaattagttacccttacccaaattatatttaccaattgtgtttatagattttatgtattcatagggttatgataatacaaattractctactctgcacagcacagacccttccatcagaagacagagcctaacaacatagtggctggcacagaagaggtattcgttatatggctgccgtaaata

SEQ ID NO: 63503 - DNA, 201 bp, Homo sapiens
tcttgcttcagtctccctagtagctaggaccacaggtgtgcgccaccacacccggctaattttttgtaattttagtagagacagggtttcaccatgttggytaggctcctcttgaactcctgacctcagatgatccacctgcctcggcctcccaaagtgctggaattacaggcgtgagccaccgcaccctgctgatttcaa

SEQ ID NO: 63504 - DNA, 201 bp, Homo sapiens
tgcctggccaaattataataattttttatacattagtaattaaactcagtgtgtaggatccataatggaaaataagaatgaaaataagaatagctaaaatkggctgggcgccatggctcacgcctgtaatcccagcactttgggaggccaaggtgggcggatcacaaggtcaggagttcgagaccagcctggccaatatgg

SEQ ID NO: 63505 - DNA, 201 bp, Homo sapiens
catctaatgtgcattatttcctccaagtggagctcttgaacaaataccttacatctcatacttcatctttattacttcatctgtttcaagtagtaacacartcactcaatttacacaatgggggaatacacactttgaatcctaacctgtgaggtagggaagtgcactctggtattatggccatttcacacaaggaaagat

SEQ ID NO: 63506 - DNA, 201 bp, Homo sapiens
gtttctgaagtttcaagtgggcttgcttgctggggttgaacatcttgtttttccttgatcgtttcaatttcttcaaggattagagttcccgtttgaatagsagaatgcccattatctaatccaagttctactgaaatcactttctctccagaagttatgctattgctcacatttgattcacagacctcatcaccatctttc

SEQ ID NO: 63507 - DNA, 201 bp, Homo sapiens
tgacctggaaggaaaagaaacagagtcagaggcatttcctatttaaatctcctagcttaaaatggtgcttttcatgtgttaaaggcaagacgctgcaatgyttgcaggctgtacagtagtataagattatttcctgccctaaggacttagggtatgtgaccaatcacacagcacagaacaaaatcgactgctttgggcagc

SEQ ID NO: 63508 - DNA, 201 bp, Homo sapiens
gcatgaacccgggaggcagagcttgcagcgagtggagatcgtgccactgcactccagcctgggcaacagagacagacttcgtcccccaaaaaaaaaaaaaagattttttgcttcccattctactacggtgaggccattataacaaaaccctgaccaccaatgcaatacctaaacaacccacacaagttcttgcatgacccc

SEQ ID NO: 63509 - DNA, 201 bp, Homo sapiens
gtccatgaatcaccacaggccatccccaggcagagtgaggcacacacagctgtgatcaaatgttgccttctctcgttttaaacaaggaattaactgtacayggtgattatctctggggagtgggagtcaaaatgactttcatttttgtattttatgtacttcaatacaggctgaatttttcaaagagcatggattttataa

SEQ ID NO: 63510 - DNA, 201 bp, Homo sapiens
ctggccaacatggcaaaaccccatctatactgaaaatacaaaaaattagccaggcatggtggtgcgaacctgtaatcccagctactcgggaggctgaggtsggagaatcgcttgaacccgggaggcagaggttgcagtgagctgagatcacgtcactacactgcagcctgggcaaaagagcacgactcttgtcccaacccc

SEQ ID NO: 63511 - DNA, 201 bp, Homo sapiens
gaaagtccccgggtcacgcggttgtttgtggggagcctgtgacgctcaggcttgtccctatgcttccgcctacagagtcacaactgcgaactgtggcggcrgcactcagagcgcgggccgacccccgcccggccactgaggcgggcgggcgggagggcgcgcacgtacgcacgcacgcacgcacgcacaccccggccctgg

SEQ ID NO: 63512 - DNA, 201 bp, Homo sapiens
tttttttttttttttttttttttttttggcgacagagtcttgctctgtcacccaggctggagtgcaatggttcagtgtcggctcactgcaacctctgcctyccaggtacaagcgattctcctgcctcagcctcccgagtacctgggattacaggcgcctgccaccacgcccggttaatttttgtatttttagtagaggcag

SEQ ID NO: 63513 - DNA, 201 bp, Homo sapiens
ctctactaaaaatacaaaaattagctgggcatggtggcgggcacctgtaatgccagctacttgggaggctgaggcaggagaatcgcttaaacccaggaggyggaggttgcagtaagccgagatggagccgttgcactccagcctggtcaacaagagcaaaactccgtctcaaataataataataataataataatataact

SEQ ID NO: 63514 - DNA, 201 bp, Homo sapiens
tcgtttcagaggcctcttctccctctctggctctgctctctctagagccctgtcctgcttcttgtccccgctgatcactaaacatttctacttagataccyggtagacacttggagctcagagtgtctgaagtgaaacccctattcttcttcttcttttttttttttttgaggtggggtctcagaacctcttatcaagacg

SEQ ID NO: 63515 - DNA, 201 bp, Homo sapiens
tcctttcttgccttttgttcattttttgtacatccacaatctatgaggtatgttacctactgaaatttactttcttttccaactgtggttcaacaactgaytttcttctctcatactttccaacccattccattctgaataagttaagagttttcttaccttcagctcttctcaccttccaatactaagtgaatacagcct

SEQ ID NO: 63516 - DNA, 201 bp, Homo sapiens
ctgtgtgtacatcttcagtgcacagaaacagcctctgaagtgagatcagagaatgtacaatttgtttatcagtaatattactaataaggggaaggaaggcwttagcagcccagagaagagaaagggcacgggaaagccactaatctggagggactcttagcaccaaggtaaaggcactagaccttctctgccagcacatgc

SEQ ID NO: 63517 - DNA, 201 bp, Homo sapiens
tgaataatttcatttaaatttagatctccttgttactctgtaggtttgtgtgaactgtagacaattttgtattaataaaaaataatgcgtatatacatacwcacctatctacatttatcttgtcctttttttcagaaccacaatggacactgccagccatagccttgttcttctccagcagctgaacatgcagcgagaatt

SEQ ID NO: 63518 - DNA, 201 bp, Homo sapiens
gttgggactcagacatcaatacagctctgcatagaaggttttacagtatagtcagcaataagaacctctgtttcaggataaaatgatttctacaaacattstttcattctctacataattaaatgtcacacctctacagtcatgtgaaagttccattaaaaagttagtcgctatataaagtcttttatcatatggcacttg

SEQ ID NO: 63519 - DNA, 201 bp, Homo sapiens
agcttatcatgttaatatcactagatacagtgtgccagtaaaatagcttacatatttatctgagcaatactctactgatcttaccatttatcccatcttgrtctctacccattgcctgggcctatagctaccaaaaatgacttataactccttgttaatagctcttacatttcagaggccttctgggaataagccctccaa

SEQ ID NO: 63520 - DNA, 201 bp, Homo sapiens
tactcaggaggctgagtccgggagaagcacttgaacccaggaggcggaggttgcattgagccgagatcgcgccattgcactccagcctgcagcctgggcgwcagagcgagactctgtctcaaaaaaaaaaaaaaaagaatctgtgcctcacccctagcaattcaattctgtttgggctaagcctgggttgggactcagaca

SEQ ID NO: 63521 - DNA, 201 bp, Homo sapiens
gctcacgcctgtaatcacagcactttgggaggccgaggcgggtggatcatgaggtcaggaaatcgagaccatcctggctaacacagtgaaaccccgtctckactaaaaatacaaaaaaattagctgggtgtggtggtgggcgcctgtagtcccagctactcgggaggctgaggcaggagaatggcgcgaacccgggaggcg

SEQ ID NO: 63522 - DNA, 201 bp, Homo sapiens
actatttgaaaagaagtctgaaaatagtgtgttcctccacccccccacccatgcccatcctgccagtttaggagcacttttgattcttttttttctttttytttttttttttgagatggagtttcactcttgttgcccagactggagtgcaatgacacaatctcagctcaccacaacctctgcctcctgggttcaagcgat

SEQ ID NO: 63523 - DNA, 201 bp, Homo sapiens
cagtggctcacgcctgtaattccagcactttgggaggccaaggcaggtggatcacgaggtcaggagttcgagaccagcctggccaagatggtgaaaccccrtctctactaaaaaaataagaaaaattagctgggcacggtggcagacgcctgtaatcccagctacttgggaagctgaggcaggagaatcacttgaacccag

SEQ ID NO: 63524 - DNA, 201 bp, Homo sapiens
ttttcctaaatactatttgaaaagaagtctgaaaatagtgtgttcctccacccccccacccatgcccatcctgccagtttaggagcacttttgattctttyttttctttttctttttttttttgagatggagtttcactcttgttgcccagactggagtgcaatgacacaatctcagctcaccacaacctctgcctcctgg

SEQ ID NO: 63525 - DNA, 201 bp, Homo sapiens
cgggttctgattttttttaaaggtctattaacaatttgtgcttactgttgttagtattcttgtgtgcttggctttatcaggcatcctacaatgtaatgttrgttagatgggaattagaggtgcttggaggttggctatgtctgccaacaggcaggaggccccaaactaacgtttcccagttccattaaaggtttctagagc

SEQ ID NO: 63526 - DNA, 201 bp, Homo sapiens
gcaaacacgtctatcgaaatggtctgcgtatctctctatgggttgctagcgctgcttgttgccagttttgaactttaagccaaaagaaatccattatgctyataagcaattgagaactattccttattgagatccaaggtttctcaaaactagcagacctgggagtttgcaagagtttcaggcaaaaaataagatgagctt

SEQ ID NO: 63527 - DNA, 201 bp, Homo sapiens
aagtgctgggattataggcatttatttaccgttctgctttccctttgctagcaggaattttctttctctctctctctctcttttttttttttttttttttkttgctttattgggagaaaaagtgcttagagtgttcagttattttttatatttttctaattcatttcttctctggttacaaatcagtcatgcatggatgtt

SEQ ID NO: 63528 - DNA, 201 bp, Homo sapiens
ctactattagtttcagatcttctgggcaggggctgacttctcttggcttacttatacttcctaactcccagtgggcctgaatagacactggccagactttyaaagtagcttcttgaagatggatggtgatctggaaggaaaaacaagaaataaatgttttctctaagcactgaaatgtttcctgttccttccatactgcac

SEQ ID NO: 63529 - DNA, 201 bp, Homo sapiens
ccaccttcaccttacaagaatgagtgctggggagtagaggagttgctcactcgcctcctcagctcacgctttgcaagaccaaaaggaggtacagggcttgyctgcttttaaattttgtttcgttcagtcttgctagctgagctgcccatgtgatttttgcttcagcaacacgatggtaggagttagtatcctttaacttgg

SEQ ID NO: 63530 - DNA, 201 bp, Homo sapiens
taaacagacatgcatgatttatgttaatttatacatgatgagaattaaggctgaaaatgacttctggggaaactcctactattagtttcagatcttctggrcaggggctgacttctcttggcttacttatacttcctaactcccagtgggcctgaatagacactggccagactttcaaagtagcttcttgaagatggatgg

SEQ ID NO: 63531 - DNA, 201 bp, Homo sapiens
caaacttgtttccttttattctgtggaacgtcactaaagtaaacagacatgcatgatttatgttaatttatacatgatgagaattaaggctgaaaatgacktctggggaaactcctactattagtttcagatcttctgggcaggggctgacttctcttggcttacttatacttcctaactcccagtgggcctgaatagaca

SEQ ID NO: 63532 - DNA, 201 bp, Homo sapiens
agactttgttatatcagaggtcattaaaaagcttatggcataccataagtgctcaataaatacaccttcctcccccaaagcactccaatctccatatgccrttttagcaactccctgtatgttatgtcattttacactgcaatctgtgctgacttcctccaatccagaagtgactgcatttcagtggtagagttttataaa

SEQ ID NO: 63533 - DNA, 201 bp, Homo sapiens
cacttgggcccagaaggtcaaggctgctgtgagccactactgcaccactgcacgccagcctgggcaacaaagtgagaccctgcctcaaaaaaaaaaaaaaattcagtcagccttgttcactcagcaaacacgtctatcgaaatggtctgcgtatctctctatgggttgctagcgctgcttgttgccagttttgaactttaa

SEQ ID NO: 63534 - DNA, 201 bp, Homo sapiens
atcttggctccctgcaacctccacctctcgggttcaagcaattctcctgcctcagcctcccaagtagctgggattacaggcgtgcaccaccacgcccagcyaatttttgtattttcagtagagatggggtttcaccacattggccaggctggtctcgaactcctgaccttagctgatccacccgccttggcctcccaaagt

SEQ ID NO: 63535 - DNA, 201 bp, Homo sapiens
actggagtgcagtggtgcaatcttggctccctgcaacctccacctctcgggttcaagcaattctcctgcctcagcctcccaagtagctgggattacaggcrtgcaccaccacgcccagctaatttttgtattttcagtagagatggggtttcaccacattggccaggctggtctcgaactcctgaccttagctgatccacc

SEQ ID NO: 63536 - DNA, 201 bp, Homo sapiens
tgcacaccctggggaaagtccccgggtcacgcggttgtttgtggggagcctgtgacgctcaggcttgtccctatgcttccgcctacagagtcacaactgckaactgtggcggcggcactcagagcgcgggccgacccccgcccggccactgaggcgggcgggcgggagggcgcgcacgtacgcacgcacgcacgcacgcac

SEQ ID NO: 63537 - DNA, 201 bp, Homo sapiens
cagatctcaacaacccaaaaaacagttgtcaaacaaggactggaggtcaaagaagctccttccagtaacagtggaaacagagctgctgtccagggtgaccwcccccagttgcagttgtctcttgctattggtctggatgatggcactgcagaccagcagagggcctgtcctgccacccaggccctggaggagcaccagaag

SEQ ID NO: 63538 - DNA, 201 bp, Homo sapiens
aggccctggaggagcaccagaagcccccagtttccatcaagcaggagagatgtgacccagaatctgtgatctcccagagccacccctcaccctcatcagargtgacaggccccacttttactgaaaacagtgtcaaaatacacttatgccattactgtggggaacgttttgattcccgtagtaacctaaggcaacatctcc

SEQ ID NO: 63539 - DNA, 201 bp, Homo sapiens
ctatgacactagagtagagctctgcttgtttcccagccttcaagaaaaaaagagctggtatgtttcctgtcattatgccacatcattatagcttatttgcygtttgaaaggaattagttacccttacccaaattatatttaccaattgtgtttatagattttatgtattcatagggttatgataatacaaattaactctac

SEQ ID NO: 63540 - DNA, 201 bp, Homo sapiens
ttgtgtgttacttcccccagtggaaaggaaaagggcccataggagctgaatctgactttgggaccctcagtgggtgaggtggtgagcccgcagtgacgtaygcaatgcctgtcacagtgcaggctaaaaccacaggctataaccaatagcagtaactgaaaaacaaaataaagctaaaagcagtgctgtacaatcagctcc

SEQ ID NO: 63541 - DNA, 201 bp, Homo sapiens
ccaccctcctcggcctcctaaagtgctgggattataggcatttatttaccgttctgctttccctttgctagcaggaattttctttctctctctctctctcyttttttttttttttttttttttgctttattgggagaaaaagtgcttagagtgttcagttattttttatatttttctaattcatttcttctctggttacaa

SEQ ID NO: 63542 - DNA, 201 bp, Homo sapiens
atccaccctcctcggcctcctaaagtgctgggattataggcatttatttaccgttctgctttccctttgctagcaggaattttctttctctctctctctcyctttttttttttttttttttttttgctttattgggagaaaaagtgcttagagtgttcagttattttttatatttttctaattcatttcttctctggttac

SEQ ID NO: 63543 - DNA, 201 bp, Homo sapiens
gcgcccctctttcccctgctaccagacacgcggtcacgtggggccatcgcgggctgccggcgcgggaagccgcgcgagaggcggccgaggggtgcgtgagycggcgccactgcttgcagtgcgcggcttgggagcccgcccctcctgcacggaggagtcggcctgccgccgcggcggcatctgggtaagcgacgcggtcct

SEQ ID NO: 63544 - DNA, 201 bp, Homo sapiens
tgtgacgctcaggcttgtccctatgcttccgcctacagagtcacaactgcgaactgtggcggcggcactcagagcgcgggccgacccccgcccggccactraggcgggcgggcgggagggcgcgcacgtacgcacgcacgcacgcacgcacaccccggccctggcgcccctctttcccctgctaccagacacgcggtcacg

SEQ ID NO: 63545 - DNA, 201 bp, Homo sapiens
cctgtgacgctcaggcttgtccctatgcttccgcctacagagtcacaactgcgaactgtggcggcggcactcagagcgcgggccgacccccgcccggccamtgaggcgggcgggcgggagggcgcgcacgtacgcacgcacgcacgcacgcacaccccggccctggcgcccctctttcccctgctaccagacacgcggtca

SEQ ID NO: 63546 - DNA, 201 bp, Homo sapiens
ggcaggtgaatcacaaggtcaggtgtttgacaccagtctggccaacatggtgaaaccccgtctttcctaaaaagagaaaaaaattagccgggcatagtggygggcgcctgtaatctcagcggcaggctgaggcaagagaatagcttgaacctgggatgtggaggttgcagtgagccgagatcactccactgcactccggcc

SEQ ID NO: 63547 - DNA, 201 bp, Homo sapiens
acttctagtaagcgcccaccgctgcaagcgaaagcactcccttcccaagaaacagatcttttccacttaaaattcccaaactcagaccttccactttttamtgaacaaaaagcgtgtgtgccggcgagagggggtgggaaacagcgtaacaagaatttgcacggatcttacgcctcctccctcggagcgcgcccaagtctg

SEQ ID NO: 63548 - DNA, 201 bp, Homo sapiens
agagatgcagtgaatagtggtgtgggactgacccccagtttttgttattgttgttttcatttattctgcaggcttttttttttttttttttttttttttttgagacagtcgtgctgtgtcgccaggctggagtgcagtggtgcaatctcagctcactgcaacctccgcctctcgaattcaagtgattctcctgcctcagcc

SEQ ID NO: 63549 - DNA, 201 bp, Homo sapiens
atttcagtgtctgtaataataatagcaattggctccattcttttgctttcttctgatttggatttctcttcagtgatcccattttctttaaaatctgattyttggctcaattcagtatcttttggcttagtttcttcagctacaatctctgtactttcatagtcttttccatttggtgcactttctagggtactgttactg

SEQ ID NO: 63550 - DNA, 201 bp, Homo sapiens
cagagatgcagtgaatagtggtgtgggactgacccccagtttttgttattgttgttttcatttattctgcaggcttttttttttttttttttttttttttttgagacagtcgtgctgtgtcgccaggctggagtgcagtggtgcaatctcagctcactgcaacctccgcctctcgaattcaagtgattctcctgcctcagc

SEQ ID NO: 63551 - DNA, 201 bp, Homo sapiens
ccagagatgcagtgaatagtggtgtgggactgacccccagtttttgttattgttgttttcatttattctgcaggcttttttttttttttttttttttttttttgagacagtcgtgctgtgtcgccaggctggagtgcagtggtgcaatctcagctcactgcaacctccgcctctcgaattcaagtgattctcctgcctcag

SEQ ID NO: 63552 - DNA, 201 bp, Homo sapiens
aagcgattctcctgccttagcctcccaagtagcttgggattacaggcatgcaccaccatacccagctaattttgtgtttttagcagagacagggtttcacyatcttggtcaggctggtctggaactcctgacctcaggtcatgcaccagcctcggcctcccatagtgctgggattacaggtgtgagccaccgtgccaggcc

SEQ ID NO: 63553 - DNA, 201 bp, Homo sapiens
cttggtgaagtgcatccccttaatgaaaacagcgaggcccttgaatgccgcaggctcagctccttcattgttaaggagaatgaacagcagccagaccacascaaccggggtaccacagagcctttgcagatcagtcaagtatctttgatctccaaagacacagagccagtagaattaaactgtaatttttctttttcaagg

SEQ ID NO: 63554 - DNA, 201 bp, Homo sapiens
ggaggcggaggttgcagtaagccgagatggagccgttgcactccagcctggtcaacaagagcaaaactccgtctcaaataataataataataataataatwtaacttggggattattccacatcagtacattaaatatgtagttttaatagagtctgccttttttttttttttttttttttgagatagggtcttgctctgt

SEQ ID NO: 63555 - DNA, 201 bp, Homo sapiens
atcactaaacatttctacttagatacctggtagacacttggagctcagagtgtctgaagtgaaacccctattcttcttcttcttttttttttttttgaggkggggtctcagaacctcttatcaagacggtttctgtacttcttctctaatgttctgggactctgcctttatatcaacacctagcacatggcagttactctg

SEQ ID NO: 63556 - DNA, 201 bp, Homo sapiens
ctctaatactttttttttgagatggagtctcgctctgtagcccaggctggaatgcagtggtgtgatctcggctcactgcaacctcttcctcccaggtcccrgttcaaacagttctcctgcctcagcctcccgagtagctgggattacaggcacacgccactgtgcccagcttttttttttgtatttttagtagagacgggg

SEQ ID NO: 63557 - DNA, 201 bp, Homo sapiens
attcttctgcctcagcctcccaagtagctgggattacagacgtctgccaccacgcccaactaatttttgtatttttagtagagacggtttcaccatattggccaggctggtcttgaactctgacctcaggtgatccaccctcctcggcctcctaaagtgctgggattataggcatttatttaccgttctgctttccctttg

SEQ ID NO: 63558 - DNA, 201 bp, Homo sapiens
cctcatcagaggtgacaggccccacttttactgaaaacagtgtcaaaatacacttatgccattactgtggggaacgttttgattcccgtagtaacctaagrcaacatctccatacacatgtgtctggatccctgccattcggtgtccctgcttccattctggaaagtaatgaccttggtgaagtgcatccccttaatgaaa

SEQ ID NO: 63559 - DNA, 201 bp, Homo sapiens
atgggcatgaataaagtgaacattcaataaggactttataaagatgaaacacagattattttcatatgcatctcataactggagctctataaatgccaagrcacatttagaacttctgaagcaaaagcactttggttgaagggtgatttaagactagcagacgctgagtaagacaaaaagtggcagcctcctgtttgccag

SEQ ID NO: 63560 - DNA, 201 bp, Homo sapiens
gtttgtgagccttagaatttaaccacttacaaaactcttgagctccctccacttctgaggacgtttcctgacacattcaacagcatcagcgtccaatcagsagggagctcaaagagtaatccagctaattctaaggacacaaaggttttctctaggtaaacagtttaggtaaattacaaagtggtaagtttttcttgagga

SEQ ID NO: 63561 - DNA, 201 bp, Homo sapiens
gctcacacaagaaaatgtggatactatcctagttgagtagcagcttctctttcagaatttttataccaattctgaaaaagaaaatttgcgtggcatttttwattcataaattattttcctcctcaagtttcattgactttttttcttcacagcttatccatggttttaaggttgtatatattagatcttctcataagacat

SEQ ID NO: 63562 - DNA, 201 bp, Homo sapiens
agagctggggctctgcactgtgacccctttgccatatgcctctcaaggcagcgctatcatttctgtggactgtaaaattgactgtattacaacattgacayggacctagggaattaaaaataataaaaccaaggtcactgggaaaaatactgctttgccaacatcagcagtgtttagcactggcgccagtgggatgcagca

SEQ ID NO: 63563 - DNA, 201 bp, Homo sapiens
tccatttttacactgcactcttattctctagaaaactgtattctctcttccttagcagccttttgtgacaaaaagatgagcaaaaatgtcacactaggtamaatttcttccaggcatattcatacctttcatcttactccatacagttgttttaggtggtttctctagtatagaaatgcccagtttctctatggcttgtaa

SEQ ID NO: 63564 - DNA, 201 bp, Homo sapiens
aagattcccccgatcccaaataacctaacacaccaaaagccttgccatttcacacatgctgttcctttgcttagaaccttttcaatgtctagctcactctstttgggacttcttttttcttttcttttttttgagacagggtctggctctgtcatccaggctggagtgcaatggggcaatttcggctcactgcaacctccg

SEQ ID NO: 63565 - DNA, 201 bp, Homo sapiens
tttctcttttgtagagtatatctaaaggatggaggtgtctggtgcctccccgccccgccccccagcccccagtcttgatctatgccgtggctcagccctgytgcatccacagaaatgagcaaatgggtgaaggtgtccatttcatgggccccaccatgggcagtggatagtgattaagaagctctgccctcttccattgca

SEQ ID NO: 63566 - DNA, 201 bp, Homo sapiens
gatcgtttcaatttcttcaaggattagagttcccgtttgaatagcagaatgcccattatctaatccaagttctactgaaatcactttctctccagaagttrtgctattgctcacatttgattcacagacctcatcaccatctttccgtgagatgccttcacttagatcctgggttgacttagcctttgttgcctgatcatt

SEQ ID NO: 63567 - DNA, 201 bp, Homo sapiens
cccgccgccgggtgcgccccctccccaccgcgcggggacagacagcaggcagcgccaatgcgagcggagcggagcgggcgggcaggggcggggcgaccgcsggaggcgcggggcggcgcgggcgccgggacccacctgcagcagcagcctgcctgcctgccgcggggaagcccatcgtgctccgcccgggcgccaatctcc

SEQ ID NO: 63568 - DNA, 201 bp, Homo sapiens
tgtggcttgacatctattttaagagttcctgagctactgtgatgataagtcccccaaacatttgatgagagttgggaagccagtatcccctgagcaccagwggatccctgaggaggagtgacatctctagctcagccaggataccgtgttatgttattaacatttatagctaacatcgaatagcagtttccattacaacat

SEQ ID NO: 63569 - DNA, 201 bp, Homo sapiens
gggctgtggttacgaaaagatagagtgttaacattaccaaaatgaaatcagtgtcttagtaaacacagaactttttaaacacccacctttagtatgtaccrtctgaataattctagcattttcacattgattagtcttttgaaaaatcataaagatgaacaattcataggttaatgcagaaaataatgagtatatcaagag

SEQ ID NO: 63570 - DNA, 201 bp, Homo sapiens
gaaacagatcttttccacttaaaattcccaaactcagaccttccactttttactgaacaaaaagcgtgtgtgccggcgagagggggtgggaaacagcgtarcaagaatttgcacggatcttacgcctcctccctcggagcgcgcccaagtctgcagcctcgggctccgggacacttcccctcccacccgccgccgagccgc

SEQ ID NO: 63571 - DNA, 201 bp, Homo sapiens
tgcaggcttttttttttttttttttttttttttttgagacagtcgtgctgtgtcgccaggctggagtgcagtggtgcaatctcagctcactgcaacctccrcctctcgaattcaagtgattctcctgcctcagcctcctgagcatgtgccaccatgcccagctaatttttgtatttttagtagagacagggtttcaccatg

SEQ ID NO: 63572 - DNA, 201 bp, Homo sapiens
tgtacatggttggttggataagacagcaagtgcctcagggcagagtttggataaatggtaagagtttgctagcagctgattggccgtgatagacaacactsatttaaagcagaaatatatctgttcgttgagagttaagaaaatagtggttaactgtatttctattcttatagttccttttaatattagaaattcaaagca

SEQ ID NO: 63573 - DNA, 201 bp, Homo sapiens
ggaactataggcacgcaccaccacacccagctaatttttgtatttttagtagagatggggtttcatcatgttggcaaggctggtttcgaactcctgacctygtgatctgcctatctcagcctcccaaagtgctgggattacaggtatgggccactgggcccagcctatttttatttctttgatgtaggtgatctaaatagt

SEQ ID NO: 63574 - DNA, 201 bp, Homo sapiens
gacaccctatgtgggacaattctattttgtgaggtgcatcttccctatctactcatttaatataactcctcagcacactgcaggccttttggcaccctgcrccctgggtcacagcaataacccattcatttccacatgggccaggtggagaaatgctgattcaaggtgtggtgctttctaggacacgtgatgagaaataac

SEQ ID NO: 63575 - DNA, 201 bp, Homo sapiens
ttccaaaaataagttgaggtagcttacaagttacccatgattcccttcaggacattccctatgagggcattcctgggagctccagctgtaaaatctagtasgatccatcacaatcccagcctcctcctctggcccccatagcatagcatccagatgaagaacctggtaaggtgaagtgaagaactactgaaaagcagccgc

SEQ ID NO: 63576 - DNA, 201 bp, Homo sapiens
gggtggaggtagagttgtacatggttggttggataagacagcaagtgcctcagggcagagtttggataaatggtaagagtttgctagcagctgattggccrtgatagacaacactcatttaaagcagaaatatatctgttcgttgagagttaagaaaatagtggttaactgtatttctattcttatagttccttttaatat

SEQ ID NO: 63577 - DNA, 201 bp, Homo sapiens
gaaatgtatctttaagtatgtttactgcagccctgcttgtagcattggaaaattataaacataaacctcctccaagggggactgggccaatgaattatgayatatacactcaataaatatttatcatgcagatgttatgaaagtgagacccatctgtgttaacatggaacctgtccaagatgtactaaaggtgcaaaacca

SEQ ID NO: 63578 - DNA, 201 bp, Homo sapiens
gtgccaggcccactcattattctttgacacaggaaatccttgtatatagctaaagggtggaggtagagttgtacatggttggttggataagacagcaagtrcctcagggcagagtttggataaatggtaagagtttgctagcagctgattggccgtgatagacaacactcatttaaagcagaaatatatctgttcgttgag

SEQ ID NO: 63579 - DNA, 201 bp, Homo sapiens
cctgggcaacatagggagaccccgtctctacaaaaaattaaaaaattagcctggtgtggtggcgtgttcctgttcttccagctagttgggaggttgaagcrgggagactgcttaagcccaagagttagaggctgcagctatgatcacgcctctgcagtccagcctaggtgacagagtgagaccctgtctgtaaaaaaaacc

SEQ ID NO: 63580 - DNA, 201 bp, Homo sapiens
tgtcaggaataaaagaatacaaagaaacccaatttgggggatttctattctagtcatgtttagagcaagtattggagtatgagatgtgttcagaattaaawtctatttgtattatccttgatcccagcttttaaaagataaaaatgtgattattagaaataaaaggaaaaaatgtgattattaaaaatcagagatgtatta

SEQ ID NO: 63581 - DNA, 201 bp, Homo sapiens
tgaataaatgtttaaacaggtaagttttattttgcttatcaattttttgtttatttcaatcatggcaacttttatatagtggttggaaattaaaattaaarttaaaatttaaagcattttcccatacattatacaactgatctcacaaccaccctgagataggtatttttattatcctcattttgcaaatgaagaaacagg

SEQ ID NO: 63582 - DNA, 201 bp, Homo sapiens
gcactttggttgaagggtgatttaagactagcagacgctgagtaagacaaaaagtggcagcctcctgtttgccagaatggataaaagttgcaagtagaaaygggttctaaagtccatatgtccctgctctttcaggtctcctgctggttttcaaggactgggcttccagccttgggtgctatgcattggagcctggagagg

SEQ ID NO: 63583 - DNA, 201 bp, Homo sapiens
gctgggattataggcatgcgcaaccaagcccggctaattctgtatttttagtagagacggagtttctccatgttggtcaggctggtcttgaactcccaacytcaggtgatctgccagccttggcctcccaaagtgctgggattacaggtgtgagccactgcacccagccaggaacactttcttttaatatcaagcctcaga

SEQ ID NO: 63584 - DNA, 201 bp, Homo sapiens
gcctatgggtaaataaagaaccagggactgtgccacctaatccaaactcagtatttcagaggagagaaggctgccacccagagaagtgaagcaacgggtayttggcagggctgggaggacccagagattgtgactccaagtcctgctttgcaaagagttgaaaggacaaactaaccaaacatctacctgcttcgtgtagac

SEQ ID NO: 63585 - DNA, 201 bp, Homo sapiens
gggtaacccataattttatgaactgtagaaggaactggaaccctgaaaatcagtttatgatctaagtaaatattatcttaggttgggtgtttcatactgtrtgcctctaacagaaagataaagtcattctagaacaatgacggaactaaaatatgaacatttgacagtgtttctcctcacaatgtttcagtgagcactaga

SEQ ID NO: 63586 - DNA, 201 bp, Homo sapiens
gtttcaccacattggccaggctggtctcgaactcctgaccttagctgatccacccgccttggcctcccaaagtgctgggattataggcgtgagccactgcscctggccaaatagcgcttataagagacttaagactaggaaaccactcacgtttaatatcaatatgcatattctgcacactatctgctgaaattgggaaaa

SEQ ID NO: 63587 - DNA, 201 bp, Homo sapiens
tcaaaaataaaaagaaggctgtctacagctgggagtccaggctgtggttgtgtaagtcacctacgtgggaatcaaaccgcaaggctgaagctgcgaagcawggggctctaatagaagtagccacacagaaacttcactgtgcccttttcgtcttttttctttttttgcagacagcaaatcacccaccttgaggtcataaag

SEQ ID NO: 63588 - DNA, 201 bp, Homo sapiens
cctttcttgccttttgttcattttttgtacatccacaatctatgaggtatgttacctactgaaatttactttcttttccaactgtggttcaacaactgacyttcttctctcatactttccaacccattccattctgaataagttaagagttttcttaccttcagctcttctcaccttccaatactaagtgaatacagcctg

SEQ ID NO: 63589 - DNA, 201 bp, Homo sapiens
gcctataatcccaggctgaggtggagaggatcacttgaggccaggagttctaaaccaccctgggcaacatagtgagacccccatctctacaggaaataaamaattagctggatatgatggcatgtgcctgtagttccagctacttgggatgctaaggcaggaggattgcttgaggctaggaggttgaggccacagtgagcc

SEQ ID NO: 63590 - DNA, 201 bp, Homo sapiens
ggtggggagtccaggcattgtgctcatctaggatgtaaaaaagcattacaaataaactaatgctgggcacagtggctcacgcctataatcccaggctgagrtggagaggatcacttgaggccaggagttctaaaccaccctgggcaacatagtgagacccccatctctacaggaaataaaaaattagctggatatgatggc

SEQ ID NO: 63591 - DNA, 201 bp, Homo sapiens
tgccacctaatccaaactcagtatttcagaggagagaaggctgccacccagagaagtgaagcaacgggtacttggcagggctgggaggacccagagattgygactccaagtcctgctttgcaaagagttgaaaggacaaactaaccaaacatctacctgcttcgtgtagacttcagctttgtgttgagcttcgggaagtaa

SEQ ID NO: 63592 - DNA, 201 bp, Homo sapiens
ttagagtcagagctcacacaagaaaatgtggatactatcctagttgagtagcagcttctctttcagaatttttataccaattctgaaaaagaaaatttgcrtggcatttttaattcataaattattttcctcctcaagtttcattgactttttttcttcacagcttatccatggttttaaggttgtatatattagatcttc

SEQ ID NO: 63593 - DNA, 201 bp, Homo sapiens
cgccggcaacaagcaggcggcctggcagccgcccgtcaccgggtcctcgcagcgcgtccgccgcgctccggctccccgcacggatcggcgcccctccggcyccgcagtccgccaggcccgcggcccgtcgccctccggcctgggccaaagttgcgcaaatagccccacaactggcaaatacttaccggccgcaacaggaac

SEQ ID NO: 63594 - DNA, 201 bp, Homo sapiens
taaattgtttctgaaatgtttaaatttcaaaccccgcatagtcaaggataataaaacagactcatctttttttgccctcttgttaaattctaagcttcacrggcatttgaatacatctaaaaaatttggtttgtgagccttagaatttaaccacttacaaaactcttgagctccctccacttctgaggacgtttcctgaca

SEQ ID NO: 63595 - DNA, 201 bp, Homo sapiens
tctgtagaaagtgaagtcacacctgttactttttgaaggtgaaaacatatttgcaaaggcaagggaagaggttttaaaatgcagatcaaagattcgagggsagtgaatctcaacagtattcctagctaaccacttctcatttcccaacattgctcttttttcacatgtgtgctgtctggtggtgtgagctcagtggtttct

SEQ ID NO: 63596 - DNA, 201 bp, Homo sapiens
tagaattctaagtttttccagttatagaatcagtaaaatcaaattgaatataaagtaaatgaaatctgttttaaagcatattctaaactatcacttctgcytacatttcacatgaattcactcctaccaggattatttttaaatattttcttccatataggaaattaatagttactttaatgcataactgtatgttataca

SEQ ID NO: 63597 - DNA, 201 bp, Homo sapiens
gaggcggagcttgcagtgagccgagatcgtgccactgcactccagcctgggcaacagagtgagactctgtctcaaaaaaataaaaataaaaataaataaayaaataaacaatctggccgggaacagtggcctacgcctgtaatcccagcactttgggaggccaaggcaggcggatcgcctgaggtcaggagttcaagacca

SEQ ID NO: 63598 - DNA, 201 bp, Homo sapiens
cttttgtgtgtgtgtgtgtgtttttgagacagagtctcactgttgcccaggctggagtgcagtggtgtgatcacagctcactgcagccttgacctcccagkcttaagtgatcctcctgcctcagcccctcaagtagttgggagtacaggtgcatgccaccatacctagctaattgttttattttttgtggagatgacgttt

SEQ ID NO: 63599 - DNA, 201 bp, Homo sapiens
gtctcatttccctatggttcagtagttcaatataatgggaagaactggtgaaaatgtttatgatccgagggtttggttttgttttttttttttgagacaayttatcaggctagtttaagatgcttcaatatgaaccatttcattgattctaagacacgtttttcacatgctgaaattgtcaatacagatttttagtttgtt

SEQ ID NO: 63600 - DNA, 201 bp, Homo sapiens
gagtaagttaactgatcatgctgttcttactcaaacatcttacatagttcacttcaaacacgacactactttttagtcttatattctgtatgctttttgarctgaccacatttcattatttctgttactttttttttctatgccaagctgaatccttctgttatctaactattcatattcttcccagtaattttattcatt

SEQ ID NO: 63601 - DNA, 201 bp, Homo sapiens
cctcccacagagtaagttaactgatcatgctgttcttactcaaacatcttacatagttcacttcaaacacgacactactttttagtcttatattctgtatsctttttgaactgaccacatttcattatttctgttactttttttttctatgccaagctgaatccttctgttatctaactattcatattcttcccagtaatt

SEQ ID NO: 63602 - DNA, 201 bp, Homo sapiens
tcccccttattggcaattcttctgcctcagcctcccaagtagctgggattacagacgtctgccaccacgcccaactaatttttgtatttttagtagagacrgtttcaccatattggccaggctggtcttgaactctgacctcaggtgatccaccctcctcggcctcctaaagtgctgggattataggcatttatttaccgt

SEQ ID NO: 63603 - DNA, 201 bp, Homo sapiens
ggtttcgccatgttggccaggcgggtcttgaactcctgacctcaagtgatccgcccaccttggcctcccaaagtgctgggattataggtgtgagccactgygcctggtccatgttttctttatccatttgactatccatggacatttgagtttttcccccttattggcaattcttctgcctcagcctcccaagtagctggg

SEQ ID NO: 63604 - DNA, 201 bp, Homo sapiens
gggtgatcttctttacgcagtctactgattcagattttgtctccctccagaacaccctcacggacacacccagaataatgtttgactaactattggggcascccatggcccagtcatttggacacataaaattaaacattacacagggctatccccccccatagagacatttgacgatgtggagatgtttttggttgtcac

SEQ ID NO: 63605 - DNA, 201 bp, Homo sapiens
catggccactgtgtgggtttgatggtatttctaggtgaggtaggccgcctatggtgtatttttggaactaaaagcctacaccccccagccacccctgaaartttcattgctgttctctattatttgcagcattggttgcttccttatgttaaggcatcaaagtcttctttaacaatctggatatattttagttaagggtaa

SEQ ID NO: 63606 - DNA, 201 bp, Homo sapiens
cgagattgcgccattgcactccagcctgggcgacagagtgagactccgtctcaaaaaaaaaaaggcagggtgtggtggctcacacctgtaatcccagcacyttgggaggccaaggcgggcggattatgaagttaggagatcgagaccatcctggacaacatggtgaaaccctgtctctagtaaaacacaaaaaattagctg

SEQ ID NO: 63607 - DNA, 201 bp, Homo sapiens
tgcactctccaccatgccaggaccgcagtgccagtttaccccactcacctgtagagaatgtatccggcggaggtcattatatatacttggcttgattcagkttatggagaagtcaggcatggccactgtgtgggtttgatggtatttctaggtgaggtaggccgcctatggtgtatttttggaactaaaagcctacacccc

SEQ ID NO: 63608 - DNA, 201 bp, Homo sapiens
agaatgcccattatctaatccaagttctactgaaatcactttctctccagaagttatgctattgctcacatttgattcacagacctcatcaccatctttcygtgagatgccttcacttagatcctgggttgacttagcctttgttgcctgatcattcaatggggtctgtgtttgtatatccaaaatttcagcttcttcctg

SEQ ID NO: 63609 - DNA, 201 bp, Homo sapiens
ctcatgcctgtaatcccagcactttgggaggccaaggcccaggagtccgagaccagcctgggcaatatagtgagacctcatctctgccaaaaattttggcyaggggcagtggctcacgcctgtaatcccagcactttgggaggtcgaggtgggcggatcaccagaggtcaggagttcaagatcagcctggctaacatggcg

SEQ ID NO: 63610 - DNA, 201 bp, Homo sapiens
catatagatttgtggcacttaaattattaatttttgatttcttaagagtgaagtctgtaaatgatttctctctgctgtacttctgtgtttgtatggttggwcattttgaaaactggtgagattgcacagtcccaaacctggatgtcttaaatacaaggaattacaaactgtgatttttgtcttgaagacctggaagaattc

SEQ ID NO: 63611 - DNA, 201 bp, Homo sapiens
cgcaccaccacacccagctaatttttgtatttttagtagagatggggtttcatcatgttggcaaggctggtttcgaactcctgaccttgtgatctgcctayctcagcctcccaaagtgctgggattacaggtatgggccactgggcccagcctatttttatttctttgatgtaggtgatctaaatagtagatgaggacagg

SEQ ID NO: 63612 - DNA, 201 bp, Homo sapiens
cattattgggaataaaactttgtcaatttcagctttattgaaagttctcccaaatatattgtttttgtttacacaaaggaaaaggaacaaaaacaataaakaaatacctttgtttttttttcttttttgagacggagtctcgctctgttgcccaggctggagtgcagtggtgcgatctcggctcactgcaacctccgcctc

SEQ ID NO: 63613 - DNA, 201 bp, Homo sapiens
tactgtaatttaatcatcactgtttctttttagccttcagtaaggaggatactagttctttggcattattgggaataaaactttgtcaatttcagctttaytgaaagttctcccaaatatattgtttttgtttacacaaaggaaaaggaacaaaaacaataaataaatacctttgtttttttttcttttttgagacggagt

SEQ ID NO: 63614 - DNA, 201 bp, Homo sapiens
gccctataattcataaataagctacatgaggaaaaaagccaaattattacccagtaacaacttacctgtttagaataatccattcacctgttctgtttcarggtccaaatcaatatcataaaaacagggccgggtggggagtccaggcattgtgctcatctaggatgtaaaaaagcattacaaataaactaatgctgggca

SEQ ID NO: 63615 - DNA, 201 bp, Homo sapiens
ttttcttagaaagatcagcatcctcagcatttattgcaggttgcatttcaccctccaatggcttttgctgctttgaagactctgaccttttcctgcgtgtkacaagacgtttgagtgaggcccaggccccccgtgtgggctctggctgatcagaagctcctgcttcttgtggacacttccttgccacatcagcagcttcag

SEQ ID NO: 63616 - DNA, 201 bp, Homo sapiens
tgggaattttatgcagggaatcttaagtctagattttgcctttttcttagaaagatcagcatcctcagcatttattgcaggttgcatttcaccctccaatrgcttttgctgctttgaagactctgaccttttcctgcgtgttacaagacgtttgagtgaggcccaggccccccgtgtgggctctggctgatcagaagctcc

SEQ ID NO: 63617 - DNA, 201 bp, Homo sapiens
ttccttgatcgtttcaatttcttcaaggattagagttcccgtttgaatagcagaatgcccattatctaatccaagttctactgaaatcactttctctccaraagttatgctattgctcacatttgattcacagacctcatcaccatctttccgtgagatgccttcacttagatcctgggttgacttagcctttgttgcctg

SEQ ID NO: 63618 - DNA, 201 bp, Homo sapiens
cttttggcaccctgcaccctgggtcacagcaataacccattcatttccacatgggccaggtggagaaatgctgattcaaggtgtggtgctttctaggacaygtgatgagaaataactcaggttacctcctgtatgtaagccttgggaagaggcagtccagcagtgacctggaaggaaaagaaacagagtcagaggcatttc

SEQ ID NO: 63619 - DNA, 201 bp, Homo sapiens
taagccttgggaagaggcagtccagcagtgacctggaaggaaaagaaacagagtcagaggcatttcctatttaaatctcctagcttaaaatggtgcttttyatgtgttaaaggcaagacgctgcaatgcttgcaggctgtacagtagtataagattatttcctgccctaaggacttagggtatgtgaccaatcacacagca

SEQ ID NO: 63620 - DNA, 201 bp, Homo sapiens
tataattttttttttttttttttttttttttttttttttggcgacagagtcttgctctgtcacccaggctggagtgcaatggttcagtgtcggctcactgmaacctctgcctcccaggtacaagcgattctcctgcctcagcctcccgagtacctgggattacaggcgcctgccaccacgcccggttaatttttgtatttt

SEQ ID NO: 63621 - DNA, 201 bp, Homo sapiens
accacgccaggctaatttttgtacttttagtagagatggggtttcgccatgttggccaggctggtctcgaactcctgacctcgggtgatccacccgcctcrgcctcccaaagtgttgggattacaggcgtgagccactgcgcccggcccagtttcctgtttctttaagaggaggaaccccctttctagctcccaaagtcat

SEQ ID NO: 63622 - DNA, 201 bp, Homo sapiens
ttttaaatcagcccaatgcaaaacactcccctttcctctacctggcaattcttaccaacctgagtaatgtgaacagagaacatgagtccatgaatcaccayaggccatccccaggcagagtgaggcacacacagctgtgatcaaatgttgccttctctcgttttaaacaaggaattaactgtacatggtgattatctctgg

SEQ ID NO: 63623 - DNA, 201 bp, Homo sapiens
gggtgaggcagatgcctcttctgtgctgccaaaacagcctatacatacaacaatatggtaccaataatgcatcatcccaactgtgatgctctgttaccacrcttaaggcagatattgcaattatttggctcccctgctttactgcaagctccttgacatcagggcagtatctcagtcattactgaatgtctgacatttagt

SEQ ID NO: 63624 - DNA, 201 bp, Homo sapiens; identical to SEQ ID NO: 12615

SEQ ID NO: 63625 - DNA, 201 bp, Homo sapiens
cgcgggggccgtcgcggcggcggcggcttgaccacccctcttgcccctctcaagggtaggcttgggacctcctcctcctcctgtttgcacagctggatggractgggctcctcccgactccccagggcaggatgcgaggctgctttcccactccgtccagatgtcagacccctgcccgttgggcccagcagctgggccgtc

SEQ ID NO: 63626 - DNA, 201 bp, Homo sapiens
gaaatggatatatacagatctgttgaggcagaaagaaaagcgggggaaaaacccactctccctgtttctacacttttgcacttagtaacaatttgcctgaytgaaggatttgtgaatggttctctttttttttttttttttttttgagaaggagtctcgctctgttgcccagactggagtgcagtggtgcaatcttggctc

SEQ ID NO: 63627 - DNA, 201 bp, Homo sapiens
tttaacagtgaatgcataaaaatacaaccaactgacatccaacctgacatattcagctatttgttgcacattatgtacacggggaaagggccaaaacagaytgtggatcatagtcgtttggaggaagggattcgatttcttcacgccgactacctttctcacattgcaactgaaatgaatcaagtgttctcaccagagact

SEQ ID NO: 63628 - DNA, 201 bp, Homo sapiens
tttgcagacagcaaatcacccaccttgaggtcataaaggagctggaagctgctgggtgcttgtgctgctctctggacggcctgagccagggctaaggcacmcttgcccccttctgcccagtgagtgcacttcacggcatcaaaagccccatgttctctggaaaggcggctgatgaggtccagctcagactctgtatccgtc

SEQ ID NO: 63629 - DNA, 201 bp, Homo sapiens
caaatgtccccggggtcaaaatcagctgttgagaatcaaccactggtctagggcagtggcttattgacaccctatgtgggacaattctattttgtgaggtrcatcttccctatctactcatttaatataactcctcagcacactgcaggccttttggcaccctgcaccctgggtcacagcaataacccattcatttccaca

SEQ ID NO: 63630 - DNA, 201 bp, Homo sapiens
ttaaattctaagcttcacaggcatttgaatacatctaaaaaatttggtttgtgagccttagaatttaaccacttacaaaactcttgagctccctccacttstgaggacgtttcctgacacattcaacagcatcagcgtccaatcaggagggagctcaaagagtaatccagctaattctaaggacacaaaggttttctctag

SEQ ID NO: 63631 - DNA, 201 bp, Homo sapiens
cccagctactcgggaggctgaggcaggagaatggcgtgaacctgggaggtggagcttgcagtgagccgagattgcaccactgcactccagcctgggcaacrcagccagactccgtctcaaaaaataaataatttaataattggcaacttcatagcatatccagaaaaaaaccatgaatggtccaattcaggtgaaagtatc

SEQ ID NO: 63632 - DNA, 201 bp, Homo sapiens
aagcagggctgcagtaaacatacttaaagatacatttccttaattgcttccctttagtttgtagtacttggtttttggtgggtttttttgttttgttttgytttgagatggagtctggctctattacccaggctggagtgcagtggtgtgatctcggctcactgcaagctccgcctcctgggttcacaccattctcctgcc

SEQ ID NO: 63633 - DNA, 201 bp, Homo sapiens
actgagtatcctatgatttaactcaattctgacactaactgtctggagcagatcctacaggtaaagggctcagtcctaaaagactgccccacttcagacaygaatcgcaagtccaggttgtcacctgtgcttctgaccaactggttataaactggagggtccccacaaccccctgctcaggttcatttgctagaatggctc

SEQ ID NO: 63634 - DNA, 201 bp, Homo sapiens
ttaatagatacggggtttcaccatgttggccagtatagtcttaatctcttgaccttgtgatccacctgcctcggccccccaaagtgctgggatgacaggcrtaagccaccaggtccggccctttttttttttttttttttaattaacttctcagttgtagagatggggtcttgttatgtttcctaggcttgtctcaaactc

SEQ ID NO: 63635 - DNA, 201 bp, Homo sapiens
cagaggcttttaactttaagttggaccaaggcgtttccacacatgatcaaatggtttaatcactattctaacaccttccagttgccgttggggccttaacragactcagattatttgaatattttctatattaattcaaagtgtgatggcttattttcagaactttatatctaggttcatacatgtgcgtacacataatat

SEQ ID NO: 63636 - DNA, 201 bp, Homo sapiens
acctccgtctcctgggttcaagtgattctcctgcctcagcctcccaagtagctgggattataggcatgagccaccatacctggcccagactttctttttcstaaaacattaggttggtaaaaaccacaattacttttgcaccaacctaatattttttttcctcctcttctggctgggcgtggaggtggctcatgcctgtaa

SEQ ID NO: 63637 - DNA, 201 bp, Homo sapiens
agtaattagttaatgtatatatgaatgattcattatctttttttttttttacatggtagctgctgccttgagatctatttttttttttgagatgaagtctkgctgtgtccaatcttggctcactgcaacctctgcctcctgcatacaagcaattctctcatatcagcctcctgagtacctgggattacaggtgcccgccat

SEQ ID NO: 63638 - DNA, 201 bp, Homo sapiens
tctcactctgttgctcaggctggagtgcagtggcactatctcggctcactgcaaactctgccccctgagttcaagcagttctcctgcctcagcctccctartagctgggattacaggcacgcgctaccacacctggctaatttttgtatttttatagagacggaggtttcgccatgtttgtcaggctggtctagaactcct

SEQ ID NO: 63639 - DNA, 201 bp, Homo sapiens
gctcatagcttttcccactataccatagtcttatcatacgctaagtgaaatctaatacatttttcctttctcttcaatctcgtgcttctctctaacagccrtctctctgccctggtcctagagttacttgaaacgtaatttggctcctgagtcctgagaatattctgcattccacttgacctctgcctgttctacccttgc

SEQ ID NO: 63640 - DNA, 201 bp, Homo sapiens
cattagcgaaggggcattctgataaccatgcaaatgacctgaagttacaaatcctgtgtggaacaggttgggggagcacctgagaaaaactagaaaaagcyagaaaagacaaggatatcaaagggtcatagtataaaacaaaagctcttgcattatttgagaaagttaaggtccaagtagaagcaaactgtagtttgatgc

SEQ ID NO: 63641 - DNA, 201 bp, Homo sapiens
tttggcatgtgtagaaatgagcacggcatgtgaagggctgtcagaaacagtgtgtggcttacatttgaggccttaacccaatatcttatgaaatagcttaygacacttaagaatttaatacaaagctcagggatatccttttcatttctgggtttttttttggtgtgtatttcattatttcatttctgatgtccaaatccc

SEQ ID NO: 63642 - DNA, 201 bp, Homo sapiens
gagactgggcggaaaccggagactcgcctcccgaacccgcgaaactatctcccgcgagactgccccgccccaaccccgccccgcaactctactccctgatkggctggaattacggccggattccggagtcctttccagctccctcttcggccgggtttcccgccgaatacaaaggcgcactgtgaactggctctttctttc

SEQ ID NO: 63643 - DNA, 201 bp, Homo sapiens
ctgtgcttctgaccaactggttataaactggagggtccccacaaccccctgctcaggttcatttgctagaatggctcacagaactcagagaagcatttcayttgtgtttatggtttattataaaggatacagctcagaaacaaccagatggaagagaagcgtagggggcatcactctcccagcacctggatgtgttcacca

SEQ ID NO: 63644 - DNA, 201 bp, Homo sapiens
ttcagatgtagacgctgagctgccaggaacattagtcactgtcaagccttcaccgtttttaacctccctcccactctccctaccgtgcttttaagacagtrgctcataattgatcactcattttcttgtagtgtaattatctaacaggcgataaagaaattgctctcctacaactcctcactttgaatacttgcgatatga

SEQ ID NO: 63645 - DNA, 201 bp, Homo sapiens
tcaatctcgtgcttctctctaacagccatctctctgccctggtcctagagttacttgaaacgtaatttggctcctgagtcctgagaatattctgcattccwcttgacctctgcctgttctacccttgcgggacatctgaatgcttaattagtgggtatcgttgccagctttactcccaggaagtaacactggctgcttttt

SEQ ID NO: 63646 - DNA, 201 bp, Homo sapiens
tgagccaccacacccagccctaattttttttttttttttttgaggtggagtttcactattgttgcccaggctggagtgcaatggcacaatctcaactcacygctggagtgcagtggcactatctcagcgcactgcaacctccacctcccaggttcaagcaattctcctgcctcagcctcccgagtagctaggattacaggc

SEQ ID NO: 63647 - DNA, 201 bp, Homo sapiens
tatttacggcagccatataacgaatacctcttctgtgccagccactatgttgttaggctctgtcttctgatggaagggtctgtgctgtgcagagtagagtyaatttgtattatcataaccctatgaatacataaaatctataaacacaattggtaaatataatttgggtaagggtaactaattcctttcaaacagcaaata

SEQ ID NO: 63648 - DNA, 201 bp, Homo sapiens
ttttttttttttgaggtggagtttcactattgttgcccaggctggagtgcaatggcacaatctcaactcaccgctggagtgcagtggcactatctcagcgsactgcaacctccacctcccaggttcaagcaattctcctgcctcagcctcccgagtagctaggattacaggcatgtgccaccacacctggctaattttgta

SEQ ID NO: 63649 - DNA, 201 bp, Homo sapiens
ccagagcagtatacaagccccgtttgttttggctatattgcacaccctacaccctccagaagagttgttaaaatgtgaggctcagaagcttccatgttggyattttaccagctaaggcatgaccaagatggtgacattatttctttttcttgccacctctctcagtatctctccttattagctatcatcaaatctctttgt

SEQ ID NO: 63650 - DNA, 201 bp, Homo sapiens
tgggcaggggaaaaatcagatatacatttgtgtctggtgggctggggggatttacattgccatggtgaaattttaacagaaacatcataaagatgttgcarctcactacgaatttctttgtgggcaaaatatgggggaggcatgtagcttttcatcttgtaacatcttatttaggaaccaaaaagggggaggcagatttgc

SEQ ID NO: 63651 - DNA, 201 bp, Homo sapiens
ctaatgggctaggcatggtggctcacgcctgtaatcccaccactttaggaggccaaggcgagtggattgcttgagcccaggagttcaagaccagcctgggmaatatagagagactttgtctccaaaaaaatacaaaaattagctggttgtggtggtgcttgcctgtagtccccactactgaggaggctgagctgggaggat

SEQ ID NO: 63652 - DNA, 201 bp, Homo sapiens
gtgtgtctgattgctatataagacactgcttttggtatgaaattatgacagtctttatggaaaataatttggcatattatcaagtgccttaaaaatgcttctcctccttgactcatttagagtatgaactgggtttttttgttcattttgtgtgtgtgtgtgtttttactttgaaattattttaattttgaaatagaaaac

SEQ ID NO: 63653 - DNA, 201 bp, Homo sapiens
tgtgtctgattgctatataagacactgcttttggtatgaaattatgacagtctttatggaaaataatttggcatattatcaagtgccttaaaaatgcttctcctccttgactcatttagagtatgaactgggtttttttgttcattttgtgtgtgtgtgtgtttttactttgaaattattttaattttgaaatagaaaaca

SEQ ID NO: 63654 - DNA, 201 bp, Homo sapiens
gtgtctgattgctatataagacactgcttttggtatgaaattatgacagtctttatggaaaataatttggcatattatcaagtgccttaaaaatgcttctcctccttgactcatttagagtatgaactgggtttttttgttcattttgtgtgtgtgtgtgtttttactttgaaattattttaattttgaaatagaaaacat

SEQ ID NO: 63655 - DNA, 201 bp, Homo sapiens
cgaggcgggcggatcacttgaggtcaggagttcgagatcagcccggccaaaccccatctctactaaaaaaatacaaaaactagctgggcatggtggcacgygcctgtaatcccagctacttgggaggctgaggcgcgaaaattgcctgaacccaggaggtggatgttgcattgagccaagattgtgccactgcactccagc

SEQ ID NO: 63656 - DNA, 201 bp, Homo sapiens
actgcactccagcctgggcaacagaccgagactctgtctccaaaaaaaaaaaaaaaaaaaaaaaatgacaactcagggtcttggaataattaattaatatatttttttgctattagaggattattttcattaagtattttgggtagtattctgttattctatccttttaagctatttgtttaagcctcagatgtaaaagag

SEQ ID NO: 63657 - DNA, 201 bp, Homo sapiens
ttgggaggctgaggcgggtggatcacaaggtcaggagattgagaccatcctggctaacacaatgaaaccctgtctctactaaaaatacaaaaaaattagcygggcatagtggcgggtgcctgtagtcccagctactcgggaggctgaggcaggagaatggcgtgaacctgggaggtggagcttgcagtgagccgagattgc

SEQ ID NO: 63658 - DNA, 201 bp, Homo sapiens
caaagaaagagaacccgggcacaacctgcgtttgcaagtggactgcctagtggctgtagccgctggctcctgtgcttcggggaaaagtcctgtgccgactrtgctcccaaacgcgcagctgctggtgactttctgccgggagagtgggtagttgcggcttcctggagcccccctagtcagaactcagaaatccaatctact

SEQ ID NO: 63659 - DNA, 201 bp, Homo sapiens
cggttagttaagggactcgggtccttccgaactgcgcatgcgccaccgcgtctgcagggggagaagcgggcaggggcgcaggcgcagtagtgtgatccccyggccagtccctaagcacgtgggttgggttgtcctgcttggctgcggagggagtggaacctcgatattggtggtgtccatcgtgggcagcggactaataaa

SEQ ID NO: 63660 - DNA, 201 bp, Homo sapiens
catgtgtagaaatgagcacggcatgtgaagggctgtcagaaacagtgtgtggcttacatttgaggccttaacccaatatcttatgaaatagcttatgacasttaagaatttaatacaaagctcagggatatccttttcatttctgggtttttttttggtgtgtatttcattatttcatttctgatgtccaaatcccctacc

SEQ ID NO: 63661 - DNA, 201 bp, Homo sapiens
aaagacaggtagcaaacaaaaatataaagaaataaagtcattttagatggtagtaagtgctatgaataaaacaggttaatgagatagtaatggggatgtaratggagaggtaacttttgatagtgtaatcaaagaaggcctttttttggatatagcaacataatattatacattttattaacctgtctttatcatttaaaa

SEQ ID NO: 63662 - DNA, 201 bp, Homo sapiens
ctcactaggcatatttgtggcatcccaggttataatcctcgttgctcattcctgaataaactcaacctacttggagataattttttgtaatgtctttcttyaggctgacagtaggaaataacccccagctttcagtttttccttctgaatttaagatggtttgcatttcctagaggggatcccatttagaggtaggggtca

SEQ ID NO: 63663 - DNA, 201 bp, Homo sapiens
ttgtggcatcccaggttataatcctcgttgctcattcctgaataaactcaacctacttggagataattttttgtaatgtctttctttaggctgacagtagraaataacccccagctttcagtttttccttctgaatttaagatggtttgcatttcctagaggggatcccatttagaggtaggggtcaaaatttttgtctta

SEQ ID NO: 63664 - DNA, 201 bp, Homo sapiens
gctgcccaaagcagtcgattttgttctgtgctgtgtgattggtcacataccctaagtccttagggcaggaaataatcttatactactgtacagcctgcaarcattgcagcgtcttgcctttaacacatgaaaagcaccattttaagctaggagatttaaataggaaatgcctctgactctgtttcttttccttccaggtca

SEQ ID NO: 63665 - DNA, 201 bp, Homo sapiens
ggttgaggcagaatggcgtgaacctgggaggcagagcttgcagtgagccgagatcacgccactgcactccagactgggcgacagagcgagactccgtgtcaaaaaaaaaaaaaaaaaattaagcacacttaacctgggtagtcaagaccttctccacttgctcatctctttcttctcattcttcctcacacctgtgactgg

SEQ ID NO: 63666 - DNA, 201 bp, Homo sapiens
ggggtcatgcaagaacttgtgtgggttgtttaggtattgcattggtggtcagggttttgttataatggcctcaccgtagtagaatgggaagcaaaaaatcttttttttttttttgggggacgaagtctgtctctgttgcccaggctggagtgcagtggcacgatctccactcgctgcaagctctgcctcccgggttcatgc

SEQ ID NO: 63667 - DNA, 201 bp, Homo sapiens
ggggttgggacaagagtcgtgctcttttgcccaggctgcagtgtagtgacgtgatctcagctcactgcaacctctgcctcccgggttcaagcgattctccsacctcagcctcccgagtagctgggattacaggttcgcaccaccatgcctggctaattttttgtattttcagtatagatggggttttgccatgttggccag

SEQ ID NO: 63668 - DNA, 201 bp, Homo sapiens
gcatgtgctggcagagaaggtctagtgcctttaccttggtgctaagagtccctccagattagtggctttcccgtgccctttctcttctctgggctgctaawgccttccttccccttattagtaatattactgataaacaaattgtacattctctgatctcacttcagaggctgtttctgtgcactgaagatgtacacacag

SEQ ID NO: 63669 - DNA, 201 bp, Homo sapiens
ttggagggcttattcccagaaggcctctgaaatgtaagagctattaacaaggagttataagtcatttttggtagctataggcccaggcaatgggtagagaycaagatgggataaatggtaagatcagtagagtattgctcagataaatatgtaagctattttactggcacactgtatctagtgatattaacatgataagct

SEQ ID NO: 63670 - DNA, 201 bp, Homo sapiens
ctgggttcaagtgattctcctgcctcagcttcccaagtagctgggattacaggcgtctgccaccgtgcccagctaatttttcttatttttttagtagagayggggtttcaccatcttggccaggctggtctcgaactcctgacctcgtgatccacctgccttggcctcccaaagtgctggaattacaggcgtgagccactg

SEQ ID NO: 63671 - DNA, 201 bp, Homo sapiens
agcaccaacacacagcgatttcagaattcatttatgtaactgcagaaattggaacattacatagacatagagtcggtgctgctcccgtgcactcctcctcrctgttttgaggtgtgtcctcagtaacccagtgtggctgttgatcccagtggtgtggtatttgtggtctctggacatctcattttggaaaaactgcaagtt

SEQ ID NO: 63672 - DNA, 201 bp, Homo sapiens
aagctcatcttattttttgcctgaaactcttgcaaactcccaggtctgctagttttgagaaaccttggatctcaataaggaatagttctcaattgcttatragcataatggatttcttttggcttaaagttcaaaactggcaacaagcagcgctagcaacccatagagagatacgcagaccatttcgatagacgtgtttgc

SEQ ID NO: 63673 - DNA, 201 bp, Homo sapiens
gtgcagtatggaaggaacaggaaacatttcagtgcttagagaaaacatttatttcttgtttttccttccagatcaccatccatcttcaagaagctactttraaagtctggccagtgtctattcaggcccactgggagttaggaagtataagtaagccaagagaagtcagcccctgcccagaagatctgaaactaatagtag

SEQ ID NO: 63674 - DNA, 201 bp, Homo sapiens
ccaagttaaaggatactaactcctaccatcgtgttgctgaagcaaaaatcacatgggcagctcagctagcaagactgaacgaaacaaaatttaaaagcagrcaagccctgtacctccttttggtcttgcaaagcgtgagctgaggaggcgagtgagcaactcctctactccccagcactcattcttgtaaggtgaaggtgg

SEQ ID NO: 63675 - DNA, 201 bp, Homo sapiens; identical to SEQ ID NO: 12620

SEQ ID NO: 63676 - DNA, 201 bp, Homo sapiens
aacctatgatacttatggggtcttcaactcatttcaacaccaggaatgtcattctcacaaacctctgtagtcatgcttttgatgaaggctgtcattggatytccccagctcctgctgtcactgttggccactgcacagggattctctgggatgggtgatatgtagctggaggtgcttttatttgaccctcatagtccactg

SEQ ID NO: 63677 - DNA, 201 bp, Homo sapiens; identical to SEQ ID NO: 12622

SEQ ID NO: 63678 - DNA, 201 bp, Homo sapiens
ttaaagttcaaaactggcaacaagcagcgctagcaacccatagagagatacgcagaccatttcgatagacgtgtttgctgagtgaacaaggctgactgaatttttttttttttttgaggcagggtctcactttgttgcccaggctggcgtgcagtggtgcagtagtggctcacagcagccttgaccttctgggcccaagtg

SEQ ID NO: 63679 - DNA, 201 bp, Homo sapiens
gagactcgcctcccgaacccgcgaaactatctcccgcgagactgccccgccccaaccccgccccgcaactctactccctgattggctggaattacggccgsattccggagtcctttccagctccctcttcggccgggtttcccgccgaatacaaaggcgcactgtgaactggctctttctttccgccaatcatttccgcca

SEQ ID NO: 63680 - DNA, 201 bp, Homo sapiens
gtagagttaatttgtattatcataaccctatgaatacataaaatctataaacacaattggtaaatataatttgggtaagggtaactaattcctttcaaacrgcaaataagctataatgatgtggcataatgacaggaaacataccagctctttttttcttgaaggctgggaaacaagcagagctctactctagtgtcatag

SEQ ID NO: 63681 - DNA, 201 bp, Homo sapiens
ggagctgattgtacagcactgcttttagctttattttgtttttcagttactgctattggttatagcctgtggttttagcctgcactgtgacaggcattgcrtacgtcactgcgggctcaccacctcacccactgagggtcccaaagtcagattcagctcctatgggcccttttcctttccactgggggaagtaacacacaa

SEQ ID NO: 63682 - DNA, 201 bp, Homo sapiens
gctggtctagaactcctgacctcaagtgatccacccaccttggcctcccaaagtgctgggattacaggcatgagacaccatgccaggcctcctcacttgtmttctaaggtgggatgctcttggggttttccttagaacacactggactctcctttccttttaagagacagggtcttgctctgttgcctaggttggagtgca

SEQ ID NO: 63683 - DNA, 201 bp, Homo sapiens
ctaacttttttttttgagacggagtttcgctcttgttgcccaggctggagtggaatgctcactgcagcctccgcctcccgggttcaagtgagtctcctgcytcagcctctgagcagctgggattacaggtgcccgctaccaagcccagctgattttttaatatttttagtagagacggggtttcaccatgctggccaggct

SEQ ID NO: 63684 - DNA, 201 bp, Homo sapiens
ctcccgcctccgcctcccgagtagctgggactacaggcgcccgccaccacgcccggctaattttttttgtatttttagtagagatggggtttcaccatgtyagccaggatggtctcgatctcctgacctcgtgatccgcccacctttgcctcccaaagtgctgggattacaggcgtgagccaccgcacccagcaagctcag

SEQ ID NO: 63685 - DNA, 201 bp, Homo sapiens
gactcctggtataaaaaaaaagtgtccctaacctgttctggaataggatcttttttggatgatgtagtactcagccaccttcaaggagaaatcagcattcytttttttttttttttttttgagatggagtttcactcttgtcgcccaggctggagtgcaatggcacgatcttggctcactgcaacttctgcccccggggtt

SEQ ID NO: 63686 - DNA, 201 bp, Homo sapiens
tttagagtatgaactgggtttttttgttcattttgtgtgtgtgtgtgtttttactttgaaattattttaattttgaaatagaaaacatcttgaaaaaaaamcccacaaaatatataggcaaatttgtactctgtgagcttctcacatccttacactgcttcaccaatctctaagatgaaaaactctgttctaaaacatatt

SEQ ID NO: 63687 - DNA, 201 bp, Homo sapiens
ctggcaaacaggaggctgccactttttgtcttactcagcgtctgctagtcttaaatcacccttcaaccaaagtgcttttgcttcagaagttctaaatgtgycttggcatttatagagctccagttatgagatgcatatgaaaataatctgtgtttcatctttataaagtccttattgaatgttcactttattcatgcccat

SEQ ID NO: 63688 - DNA, 201 bp, Homo sapiens
aaaaaatcagttttaggccaggtgcggtggctcacgcctgtaatcccagcactctgggaggccgaggcgggtggatcacgaggtcaggagttcaagaccakcctagccaagatggtgaaaccccgtctctactaaaaatacaaaaattagccgggcgtggtggcgggctaattaggtggtgcctgtaatcccagctactcg

SEQ ID NO: 63689 - DNA, 201 bp, Homo sapiens
tgctgcatcccactggcgccagtgctaaacactgctgatgttggcaaagcagtatttttcccagtgaccttggttttattatttttaattccctaggtccrtgtcaatgttgtaatacagtcaattttacagtccacagaaatgatagcgctgccttgagaggcatatggcaaaggggtcacagtgcagagccccagctct

SEQ ID NO: 63690 - DNA, 201 bp, Homo sapiens
gatgatcatttataattcttcctggcacataataagtattcgatatatgttgtattaataatcagtaattagttaatgtatatatgaatgattcattatctttttttttttttacatggtagctgctgccttgagatctatttttttttttgagatgaagtcttgctgtgtccaatcttggctcactgcaacctctgcctc

SEQ ID NO: 63691 - DNA, 201 bp, Homo sapiens
ggctggagagcaatgatgcgatctcgactccctgcaacctccgcctcccaggttcaagcaattctcctgcctcagcctcccgagtagctgggattacaggygcccaccgcctcacctggctaatttttatatttttaatagagacgcggtttcaccacgttggccaggctggtcttgaactcctgacctgaggtgatttac

SEQ ID NO: 63692 - DNA, 201 bp, Homo sapiens
ggtcacacacggacggtaacaatttgtccctttccaaggaaattagttcagaggcactagatcttgctgcttctctcctcctccatcctctctcatacgaytgatactgccaggtgttgttctgccttctcccttttaaaatggaagtgagtaggtgtgtggcattgagcactcctgacagcttttgcaataaatcccatg

SEQ ID NO: 63693 - DNA, 201 bp, Homo sapiens
ctccttctttgctagtaaaatcttcccttccctcactaggcatatttgtggcatcccaggttataatcctcgttgctcattcctgaataaactcaacctayttggagataattttttgtaatgtctttctttaggctgacagtaggaaataacccccagctttcagtttttccttctgaatttaagatggtttgcatttcc

SEQ ID NO: 63694 - DNA, 201 bp, Homo sapiens
aattggttttggacagtcagagcagagtggttataaagcacacttgcaaggcgcggtggctcacacctgtaatcccagcactttgggaggccaaggtgggyagatcacaaggtcaggagatcgagaccatcctggctaacatggtgaaaccccgtctctactaaaaatacaaaaaattagccgggcatggtggcgggcgcc

SEQ ID NO: 63695 - DNA, 201 bp, Homo sapiens
gtgctgggattacaggctcagccacaggctgagcttcacgcctagctgaagctctccttctttgctagtaaaatcttcccttccctcactaggcatatttrtggcatcccaggttataatcctcgttgctcattcctgaataaactcaacctacttggagataattttttgtaatgtctttctttaggctgacagtaggaa

SEQ ID NO: 63696 - DNA, 201 bp, Homo sapiens
attggttttggacagtcagagcagagtggttataaagcacacttgcaaggcgcggtggctcacacctgtaatcccagcactttgggaggccaaggtgggcrgatcacaaggtcaggagatcgagaccatcctggctaacatggtgaaaccccgtctctactaaaaatacaaaaaattagccgggcatggtggcgggcgcct

SEQ ID NO: 63697 - DNA, 201 bp, Homo sapiens
agatatttgacctgggtttttttctaggctgagaggataaatctagccttttaatcatgtccaaaactgtactcggcatcctcatccccaagttacccctwactcccgtcttttggttagtatcaccattcttccttcccgcaagtctgaagccttttagtttccctcccaagcattccctatattggaccagtctctaaa

SEQ ID NO: 63698 - DNA, 201 bp, Homo sapiens
taggatgccaaagccccatgaaccccattgaacagttttgaaagtattgaaccatctgaattagtgttggtgtcttgggtgctgaggatgcaggtagcaargcagtggggctcctctcattttaaagcccctttcttttctttaaggctctctttaatcgtttggtgccatcagtaaatggagtgagaaggttctctgaca

SEQ ID NO: 63699 - DNA, 201 bp, Homo sapiens
ttgcactccagcctgggcaaaagcgagtccccatctcaaaaaaaaaaaaaaaaaaagaaaaaagaaaaagattcacatctacttgaggcctggaaaattgytgggaagttcctgtacatattaaaccagataatgtccattcagtggtgtttttattttattttattttattttggagacagtcttgctctatcgtccagg

SEQ ID NO: 63700 - DNA, 201 bp, Homo sapiens
atgccaaagccccatgaaccccattgaacagttttgaaagtattgaaccatctgaattagtgttggtgtcttgggtgctgaggatgcaggtagcaaagcartggggctcctctcattttaaagcccctttcttttctttaaggctctctttaatcgtttggtgccatcagtaaatggagtgagaaggttctctgacatcca

SEQ ID NO: 63701 - DNA, 201 bp, Homo sapiens
tgggaggattgattgaacctgggaggcggaggttgcagtgagccgagatcacctgactgcactccagcctgggcaacagagcgagactctgtctctaaaayaaacaaacaaacaaacaaacaaacaaaaccagctcagagagagcaagtaacttgtctgggagacaacggaaccaagatttgaattcagagttatctgagt

SEQ ID NO: 63702 - DNA, 201 bp, Homo sapiens
cagctcacggtgtcctggtttccacagggcactccagtgtttgtccatgctggcccgtttgccaacatcgcacatggcaattcctccatcattgcagaccrgatcgcactcaagcttgttggcccagaagggtttgtaggttagtgttttttgcaaaaccagtgaatagactgtatgtttcttttaacatcaggggaattg

SEQ ID NO: 63703 - DNA, 201 bp, Homo sapiens
ttttttcttccacattttttatattgtatggaatctggaatctgatcattgattaggacataaaagtcttcttggagtagcctattttagatgaagttacrtcagtaatcatagtcttaaagtcatgatatacatagcaaagatggatggtagaggttatttctcatttatctatagattagaagtggctagtgtggaata

SEQ ID NO: 63704 - DNA, 201 bp, Homo sapiens
caagctcatcagagaagttttcaagtattgagaagctgtcaagctcacaggggtggataaaaaattttaattttcacccaaaaactcacattttatcattrgcaacaaatacaattaattgtttcccttgaaataccagtttcactttattcatttttgagaaaatatttgtcaaatactcaagcctgaataatcattgct

SEQ ID NO: 63705 - DNA, 201 bp, Homo sapiens
cctctgcccccacgtggtggtgcttgttgccactgtcagggctctcaagatgcacgggggcggccccacggtgagtggtgggttgaagtatctgattatcrgcagtgtgctgacggccaaaaggaagttggatgacttctgcctgtttcttcattgagttgctcttatcctcgtgattaacaggcagcaaaagcaagggac

SEQ ID NO: 63706 - DNA, 201 bp, Homo sapiens
tcttccacattttttatattgtatggaatctggaatctgatcattgattaggacataaaagtcttcttggagtagcctattttagatgaagttacatcagyaatcatagtcttaaagtcatgatatacatagcaaagatggatggtagaggttatttctcatttatctatagattagaagtggctagtgtggaataaatag

SEQ ID NO: 63707 - DNA, 201 bp, Homo sapiens
tgtttttgtgcacttattctaatttctccacgtggcatgcgaaggagggcagcttctatcctccaactctgatgcaggctggcttttctttcaggggtgcygattgccggaaggcatgctgtggtggttgggcgcagtaaaatagttggggccccgatgcatgacttgcttctgtggaacaatgccacagtgaccacctgc

SEQ ID NO: 63708 - DNA, 201 bp, Homo sapiens
tgcaatggaagagggcagagcttcttaatcactatccactgcccatggtggggcccatgaaatggacaccttcacccatttgctcatttctgtggatgcarcagggctgagccacggcatagatcaagactgggggctggggggcggggcggggaggcaccagacacctccatcctttagatatactctacaaaagagaaa

SEQ ID NO: 63709 - DNA, 201 bp, Homo sapiens
tgagtaggtatatatttgttcatggttttgtcatttaaactcagatttcaattgagagactagtattagaaaacacttgatcaaaactgtccaaatgattstaaaaaataaataaataaatgtgcttagtagttacaataatgcatttgcatttatttgatttctaagtcattggagaagcatgcttaactgagcttccac

SEQ ID NO: 63710 - DNA, 201 bp, Homo sapiens
tcgagtgatcctcctgcatcaaccttctgagtagctgggactacaggcatgtgccaccatgcctggctaatttttaagctttttgtagcgacaggggtctyactgtgttgcccaggctggactcaaactcctggactcaagcgatcctcctggttcaccttcctaaagtgctgagattacaggcgtgacccaacatgcctg

SEQ ID NO: 63711 - DNA, 201 bp, Homo sapiens
ggagattggcgcccgggcggagcacgatgggcttccccgcggcaggcaggcaggctgctgctgcaggtgggtcccggcgcccgcgccgccccgcgcctccsgcggtcgccccgcccctgcccgcccgctccgctccgctcgcattggcgctgcctgctgtctgtccccgcgcggtggggagggggcgcacccggcggcggg

SEQ ID NO: 63712 - DNA, 201 bp, Homo sapiens
caactgcatccatcctgacagaaattttgttttttgctattgaaatcagtgttgtgattaacagttttacacatggtttttttgttttgtttagttttagyttttgtttttttgagatggagtttcgcttttgttgctcaggctggagtgcaatggtgtaatcttggctcactgcaaccttcgtctcctgggtttaagcta

SEQ ID NO: 63713 - DNA, 201 bp, Homo sapiens
tttgtttagttttagtttttgtttttttgagatggagtttcgcttttgttgctcaggctggagtgcaatggtgtaatcttggctcactgcaaccttcgtcycctgggtttaagctatcctcctgcctcagcctcccgagtagctgggattacaggggctggccaccacgcccagctaatttttgtatttttagtagagatg

SEQ ID NO: 63714 - DNA, 201 bp, Homo sapiens
gcttctttctctgccatggtcctgttaaaaggagctgtgcttcagttgtctttgatatgaagggaccaccacctttccctctgtgataccctctgcaattytgggagaaacacaacttatggtagcatgtatcaaccttgagaaggagaaataccaaccactggagcatgaaacaatattagtacaataaaattttacaaa

SEQ ID NO: 63715 - DNA, 201 bp, Homo sapiens
tattactttaagataaattcctaaactgggagaggtggctcacgcctgtaatcccaacgttttggaaggtcaaggtgggaggatggtttgaggccaggagytggagaccagtctgggcaacatagcaagactatctctacaggaaaattttttaattaatcaggggtggtggcatgtgcctatagtcccaactactcagaa

SEQ ID NO: 63716 - DNA, 201 bp, Homo sapiens
tgggaggccgaggcgggcggatcacctgaggtcgggagttttagaccagcctaagaaacatggagaaaccccatctctactaaaaatacaaaaaattagcygggtgtggtggcgcatgcctgtaatcccagctactcgggaggctgaggcaggagaatcgcttgaacctgggaggcggaggttgtggtgagccaagatagt

SEQ ID NO: 63717 - DNA, 201 bp, Homo sapiens
aacccattattttccttttactcttactgcaaattgcctcactgcacggtctctgcctcacaaaaacaaaatacatattaatatatctctgggctgggtgmagtggctcatgcctaaaatcccagcactttgggagggtgaggtggtagattacttgaggccaggagttcgagaccagccaggccaacatggcaaaccccg

SEQ ID NO: 63718 - DNA, 201 bp, Homo sapiens
gttttggaaggtcaaggtgggaggatggtttgaggccaggagttggagaccagtctgggcaacatagcaagactatctctacaggaaaattttttaattartcaggggtggtggcatgtgcctatagtcccaactactcagaaggatcactttagcccaggagttcagggttgcagtgagctgattgtgttactgcactcc

SEQ ID NO: 63719 - DNA, 201 bp, Homo sapiens
ggggtggtggcatgtgcctatagtcccaactactcagaaggatcactttagcccaggagttcagggttgcagtgagctgattgtgttactgcactccagcstgggtgacagagtaaaatcctgtccaaaaaaaaaaaatcctggaagtggaattacaatgtcaaagaaaatacaaatttaaaattttcgggccaggtatgg

SEQ ID NO: 63720 - DNA, 201 bp, Homo sapiens
agcatagttgttctataagtgggcctttcaaaggggggcttactacatttatatgatttgtttggtttttccttcccttagtttgctataattaagcctgytctctccattggtggcatttttcttgattaagtctcctttctaaagagactggttgtgaagaggcagatggtttgagtaggtgctgcgagtgtttgctgg

SEQ ID NO: 63721 - DNA, 201 bp, Homo sapiens
ctctccattggtggcatttttcttgattaagtctcctttctaaagagactggttgtgaagaggcagatggtttgagtaggtgctgcgagtgtttgctggcsaagtgcagggcaagttgggtatatttgtaagctcgctgtggatggtagctccagagcctaagcacggtgctgcctcctctgtgcatcactgggtcatgca

SEQ ID NO: 63722 - DNA, 201 bp, Homo sapiens
tcctgtagattaaatacatgtaggcccttttgtgcttaaaaagatttgtctgggcagggcgtggtggctcatgcctgtaatcctaggactttgggaggccsaggcaggaggatcacctgagatcaggagttggagaccagcctgactaacatggtgaaaccccatctctactaaaaatacaaaattagctgggcatggtgg

SEQ ID NO: 63723 - DNA, 201 bp, Homo sapiens
ctacttactttgctggctaagctttttttttttctttgcccctcaccacaagcctggacgggagacgtactgcttggtatctggtgcttgagaggtcccaggagataagggagcatttctgtgaaaggttttgccagagcctgtcaggaacttaatcttgactgcaatgaatgacttaacattataagtgatctttgggtt

SEQ ID NO: 63724 - DNA, 201 bp, Homo sapiens
ttgtactttagcaccagagtcaacagctttctgtgatacaaggtttatataatatgttgtaatcacatctccctgcctcagacctctagtctttttcgctstggtgctggcaccaccatcttcccacattccctgagctagaagcctgaggccgtctccttaggagctctcttcctcactccctgcatccagttaggggct

SEQ ID NO: 63725 - DNA, 201 bp, Homo sapiens
gccttggcctcccaaagtgctggcattacaggtgtgagccaccacacctggccctaatttttaataaaagagctgatgctacagctaatctcttttttttytgagacagagtctcgctctgttgcccaggctggagtgcagtgacgcaatctccgctcactgcaagctccgccccccgggttcatgccattctcctgcctc

SEQ ID NO: 63726 - DNA, 201 bp, Homo sapiens
ccagtgacttctaaatctagatttcttctgagctccaggctcttggtctgggacaccactggtttccttcccaccttcaagtctcctttgcttgttgttgytcatcaccctaatacctaaaccatttgaatgccttgggctcacccttgagatctcttccccatcttattctttccctaagtaacctcacccagtcccata

SEQ ID NO: 63727 - DNA, 201 bp, Homo sapiens
aaggccagtttattgactgtttttgtgattttccttgactcaataaccgttgctagctaatggccttatttagatgacactctcaatgtctaaaaccacaytggaatttctcttcctttgcttcaatagctttagacaaatggtataatattttataaggaataagctaaaagtccattttgaagatttagtatccgattt

SEQ ID NO: 63728 - DNA, 201 bp, Homo sapiens
gagactgcgtctcaaaaaaaaaaaaaaaaaaaaaaaaaaaaaaaaaaatatatatatatatatatatatatatatatatatatatatatatatatatatawaacagtaatctattggggcaggggataaattgtgtccttgtttagaagaagactttttttttttttaaaaaaagccctgttgtttttgttgttgttattt

SEQ ID NO: 63729 - DNA, 201 bp, Homo sapiens
tcactctcccagcacctggatgtgttcaccagcccagaggctcatcaaatcatgttgttcaagagttttttttttgagacggagttttgttcttgttgccyaggctagagtgcaatggagtgatctcagctcactgcaacctctgcttcccgggttcaagcgattctcctgcctcagcctcctgagaagctgggattacag

SEQ ID NO: 63730 - DNA, 201 bp, Homo sapiens
ctggatgtgttcaccagcccagaggctcatcaaatcatgttgttcaagagttttttttttgagacggagttttgttcttgttgcctaggctagagtgcaayggagtgatctcagctcactgcaacctctgcttcccgggttcaagcgattctcctgcctcagcctcctgagaagctgggattacaggcatgcaccaccaca

SEQ ID NO: 63731 - DNA, 201 bp, Homo sapiens
gttatttctcatcacgtgtcctagaaagcaccacaccttgaatcagcatttctccacctggcccatgtggaaatgaatgggttattgctgtgacccagggygcagggtgccaaaaggcctgcagtgtgctgaggagttatattaaatgagtagatagggaagatgcacctcacaaaatagaattgtcccacatagggtgtc

SEQ ID NO: 63732 - DNA, 201 bp, Homo sapiens
gcggctgcttttcagtagttcttcacttcaccttaccaggttcttcatctggatgctatgctatgggggccagaggaggaggctgggattgtgatggatcstactagattttacagctggagctcccaggaatgccctcatagggaatgtcctgaagggaatcatgggtaacttgtaagctacctcaacttatttttggaa

SEQ ID NO: 63733 - DNA, 201 bp, Homo sapiens
tggttttgcacctttagtacatcttggacaggttccatgttaacacagatgggtctcactttcataacatctgcatgataaatatttattgagtgtatatrtcataattcattggcccagtcccccttggaggaggtttatgtttataattttccaatgctacaagcagggctgcagtaaacatacttaaagatacatttc

SEQ ID NO: 63734 - DNA, 201 bp, Homo sapiens
ggttttttttacagacagggtctcactctgtcacctaggctggactgcagaggcgtgatcatagctgcagcctctaactcttgggcttaagcagtctcccygcttcaacctcccaactagctggaagaacaggaacacgccaccacaccaggctaattttttaattttttgtagagacggggtctccctatgttgcccagg

SEQ ID NO: 63735 - DNA, 201 bp, Homo sapiens
tggaagccaggcgattcagaccccgccaccgcgtccccagagactgggcggaaaccggagactcgcctcccgaacccgcgaaactatctcccgcgagactkccccgccccaaccccgccccgcaactctactccctgattggctggaattacggccggattccggagtcctttccagctccctcttcggccgggtttcccg

SEQ ID NO: 63736 - DNA, 201 bp, Homo sapiens
cctctccaggctccaatgcatagcacccaaggctggaagcccagtccttgaaaaccagcaggagacctgaaagagcagggacatatggactttagaacccrtttctacttgcaacttttatccattctggcaaacaggaggctgccactttttgtcttactcagcgtctgctagtcttaaatcacccttcaaccaaagtgc

SEQ ID NO: 63737 - DNA, 201 bp, Homo sapiens
tctgaggcttgatattaaaagaaagtgttcctggctgggtgcagtggctcacacctgtaatcccagcactttgggaggccaaggctggcagatcacctgargttgggagttcaagaccagcctgaccaacatggagaaactccgtctctactaaaaatacagaattagccgggcttggttgcgcatgcctataatcccagc

SEQ ID NO: 63738 - DNA, 201 bp, Homo sapiens
gtctacacgaagcaggtagatgtttggttagtttgtcctttcaactctttgcaaagcaggacttggagtcacaatctctgggtcctcccagccctgccaartacccgttgcttcacttctctgggtggcagccttctctcctctgaaatactgagtttggattaggtggcacagtccctggttctttatttacccataggc

SEQ ID NO: 63739 - DNA, 201 bp, Homo sapiens
caccatgtccagctagtttgtttgtttgtttgagacagagtttcactcttgttgcccaggctggagtgcaatggcatgatcttggctcactgcaacctccrcctcccaggttcaagcgattctcctgcctcagcctcccgagtagctgagactacaggtgtgtgccaccccgtccggctaatttttgtatttttagtagag

SEQ ID NO: 63740 - DNA, 201 bp, Homo sapiens
ttcaaatacgtatttgaggtaactgtcaaatttggtaaatgtctgggttaaattataataatttttttagtaaatattcttatgtaataatagtactattrtcagttgactgtcttgtatactgatatagcttttgctatattagtgataggtgaaaatcagttttctttcaacaagaaggtaatttagtgttttaatttg

SEQ ID NO: 63741 - DNA, 201 bp, Homo sapiens
gagcttgcagtgagccgagatcgcgccactgcactccagcctgggagacggagggagactgcgtctcaaaaaaaaaaaaaaaaaaaaaaaaaaaaaaaaawatatatatatatatatatatatatatatatatatatatatatatatatatataaaacagtaatctattggggcaggggataaattgtgtccttgtttaga

SEQ ID NO: 63742 - DNA, 201 bp, Homo sapiens
tatatatatatatatatatatatatatatataaaacagtaatctattggggcaggggataaattgtgtccttgtttagaagaagactttttttttttttaraaaaagccctgttgtttttgttgttgttatttgtttgtttgtttgttttgagacggagtctcagtgggtcgcccaggctggagtgcagtggcgcgatctc

SEQ ID NO: 63743 - DNA, 201 bp, Homo sapiens
ctttatgacctcaaggtgggtgatttgctgtctgcaaaaaaagaaaaaagacgaaaagggcacagtgaagtttctgtgtggctacttctattagagccccwtgcttcgcagcttcagccttgcggtttgattcccacgtaggtgacttacacaaccacagcctggactcccagctgtagacagccttctttttatttttga

SEQ ID NO: 63744 - DNA, 201 bp, Homo sapiens
atatatatatatatatatatatatatataaaacagtaatctattggggcaggggataaattgtgtccttgtttagaagaagactttttttttttttaaaaraagccctgttgtttttgttgttgttatttgtttgtttgtttgttttgagacggagtctcagtgggtcgcccaggctggagtgcagtggcgcgatctctgc

SEQ ID NO: 63745 - DNA, 201 bp, Homo sapiens
agtgacctggagcttgaaactgaggtgaggattaaaataaccacctcttctaagtttcatttatttcattttgcttagagcacagtagagagtgccaagcrtttcctggagaaatttaagccaggaaagtggatgattcagtataacaaccttaacctcaagacacctgttccaaggtaaaaataaagttttactgattta

SEQ ID NO: 63746 - DNA, 201 bp, Homo sapiens
atttagccaagacctccaggtatttttttttttttttttttttgagacacagttttgctcatgtcacccaggctggagagcaatgatgcgatctcgactcyctgcaacctccgcctcccaggttcaagcaattctcctgcctcagcctcccgagtagctgggattacaggcgcccaccgcctcacctggctaatttttata

SEQ ID NO: 63747 - DNA, 201 bp, Homo sapiens
cctgttgtttttgttgttgttatttgtttgtttgtttgttttgagacggagtctcagtgggtcgcccaggctggagtgcagtggcgcgatctctgctcacygcaacctccgcctcccgggttcaagcgattctcctgcctcagcctcctgagtagctgagactacaggcgcgtgccaccacgcctggctgatttttcgtat

SEQ ID NO: 63748 - DNA, 201 bp, Homo sapiens
cctttctaacatgcaccagctgacaggggccaggcgagcagccccaaagcatgttaggtgcctcttgactcttagctaggattgaagcatggtaataagtrggtctgaagcagttcattttgtgattgaactggagtgacctggagcttgaaactgaggtgaggattaaaataaccacctcttctaagtttcatttatttc

SEQ ID NO: 63749 - DNA, 201 bp, Homo sapiens
tttgttgttgttatttgtttgtttgtttgttttgagacggagtctcagtgggtcgcccaggctggagtgcagtggcgcgatctctgctcaccgcaacctcygcctcccgggttcaagcgattctcctgcctcagcctcctgagtagctgagactacaggcgcgtgccaccacgcctggctgatttttcgtattttttagtg

SEQ ID NO: 63750 - DNA, 201 bp, Homo sapiens
ggctcactgtggcctcaacctcctagcctcaagcaatcctcctgccttagcatcccaagtagctggaactacaggcacatgccatcatatccagctaattktttatttcctgtagagatgggggtctcactatgttgcccagggtggtttagaactcctggcctcaagtgatcctctccacctcagcctgggattataggc

SEQ ID NO: 63751 - DNA, 201 bp, Homo sapiens
tcagttactaaaagtgttttccctgtgccatttgagaattatttgagaactactctaagcttatggcacatttcagcatttttgttgtctaaaggcagctktattttaatcatgtaaatttcatgctgcctcctttgcctaccatatagcttctgttgaaatgtccatgttatattttattttatttactcatttttctat

SEQ ID NO: 63752 - DNA, 201 bp, Homo sapiens
gccatcatatccagctaattttttatttcctgtagagatgggggtctcactatgttgcccagggtggtttagaactcctggcctcaagtgatcctctccayctcagcctgggattataggcgtgagccactgtgcccagcattagtttatttgtaatgcttttttacatcctagatgagcacaatgcctggactccccacc

SEQ ID NO: 63753 - DNA, 201 bp, Homo sapiens
aacggagcaactactgtgtatccagcacaatgccaggccttgggctacacaactgaataaggttcaacttcaccttcaccttcagctgcttcctccccatstcctctctgtcatgtctgttattccttccaaaccttgtttgatttccccttatcaagggatgatctttccttctctccctccctcctctcccatagaaca

SEQ ID NO: 63754 - DNA, 201 bp, Homo sapiens
taaaaaaaaaattccaatggtctattcttcttttgagctatattattgtagagaatactgacttgaaaaaacaaagtcactaactagaaataaaatttgarctgggtgcagtggcttataactgtaatcccagcacttttgggaggccaaggtgggaggatcacttgagctcaggagttcaagatcagcctgggcaacatg

SEQ ID NO: 63755 - DNA, 201 bp, Homo sapiens
aaaattaataatgtatatttcttcatcaagggtggtcctagtgaaactggcatttagttttactgggagtgtgtggtagtgaaggataccttgactactartccaaagccattgtcttgatttgtgctggttcactagtagtcttacacaccattgcttttgcaccatcggtacagacgttaacacaatgaaaaaggcaaa

SEQ ID NO: 63756 - DNA, 201 bp, Homo sapiens
tattgaggatggtatctaggtcatcaaaagaagcctgagagagaagcttgtctcattttatgcttgtagtactaaggtttaggagactgactagcccaagrgtgcacagagttagtagatagaagagttgccacttgcaggcaggtctgcctggtgccagagcctttgattttcatcatgtgctgtacagcttccaagatg

SEQ ID NO: 63757 - DNA, 201 bp, Homo sapiens
taacatcaccaacaagctcatcagagaagttttcaagtattgagaagctgtcaagctcacaggggtggataaaaaattttaattttcacccaaaaactcayattttatcattagcaacaaatacaattaattgtttcccttgaaataccagtttcactttattcatttttgagaaaatatttgtcaaatactcaagcctga

SEQ ID NO: 63758 - DNA, 201 bp, Homo sapiens
cttcccctccctcttccgtcccgcagtccccgacctgttagctctcggttagttaagggactcgggtccttccgaactgcgcatgcgccaccgcgtctgcrgggggagaagcgggcaggggcgcaggcgcagtagtgtgatcccctggccagtccctaagcacgtgggttgggttgtcctgcttggctgcggagggagtgg

SEQ ID NO: 63759 - DNA, 201 bp, Homo sapiens
ttgccaggctggaatgtagtagtgcaatcatagctcactgtagcgttgaactcctggcttcaagcagtcctcctgcctctgcctgccaaagcatgggtatyacaggcgtgagccactgtacctggccccgtttacactcttaaagatgtaagacctcaagaagctattgtttatacagatttatccattaatgtttactat

SEQ ID NO: 63760 - DNA, 201 bp, Homo sapiens
ttacttcccgaagctcaacacaaagctgaagtctacacgaagcaggtagatgtttggttagtttgtcctttcaactctttgcaaagcaggacttggagtcrcaatctctgggtcctcccagccctgccaagtacccgttgcttcacttctctgggtggcagccttctctcctctgaaatactgagtttggattaggtggca

SEQ ID NO: 63761 - DNA, 201 bp, Homo sapiens
aggactggtgccgagcatcctgcagtgcacaggatagtccccataacaaaggatgatctggtccaaatgtcagtggtgctgagatcgaaaaaccctgatcragaagcttaatgtgagttattgtgtcattgtgtgtgtggattaatgatggactttaccctcactaagaattataggattcattaaaattttacactattc

SEQ ID NO: 63762 - DNA, 201 bp, Homo sapiens
tattaagtttttaaaaattttttgaaggttttttttttttttttttgagatggagtttcactcttgttgcctaggctggagtgcaatggcgcgatctcggytcaccgcaacctctgcctcccgggttcaagcgattcccgtgcctcagcctcccgagtagctgggattacaggcatgcgccaccgctcccagttaattttt

SEQ ID NO: 63763 - DNA, 201 bp, Homo sapiens
atgcgccaccgctcccagttaatttttttttttttttttttgtatttttagtagagacggggtttcaccgctcaggctgtgtcaaaccccccagctcaggkgatccacccacctcagcctcccaaagtgctgggattataggcgtgagccaccgtgcccagccgaagtattttttagtagtataaaaattgttaatgaaca

SEQ ID NO: 63764 - DNA, 201 bp, Homo sapiens
atggagaaaccccatctctactaaaaatacaaaattagctgggcatggtggtgcacgcctgtagccccagctactcgagaggctgacacaagagaatcgcytgaacctgggaggcggaggttgcagtgagctgaggatgccccactgcactccagcctgggtgacagacagagactgtctcaaaaaaaattgggtttgtgt

SEQ ID NO: 63765 - DNA, 201 bp, Homo sapiens
ggtttcaccattttggccaggctggtctcgaactcttgacctcaggtgatccacctgcctcagcttcccaaagtgctgagattacaggtgtaagccactgygcccagccttaattttttgtatttttttgtagagttttttttttgccttgttgccctagctggtcttgaactctgggacccaaagtgatcctcccatttt

SEQ ID NO: 63766 - DNA, 201 bp, Homo sapiens
tgtttattctgtgtaaactagagggaggtccttccaccctcctttctattgtctgtgtggcggggccagggagctttccattgcccctgcgggtgggggaragggtgtggaatgtgccctctgggtgctcctgcctctcaggcatttttcttgcctgatgacagtttctcagccctccatactctgtttttctggtatggc

SEQ ID NO: 63767 - DNA, 201 bp, Homo sapiens
taaaataatacttgccttgccctgaatagataagggtctgtgttaaacagttaaaaccatagttatatctatattttatttgaatttctgtaacaaatacmtagttagtaagcatacaccataccacctgacccagaaatctcacccaaaataaatgaaaactctgttcacataaaaatctgtacattaatgtttttagca

SEQ ID NO: 63768 - DNA, 201 bp, Homo sapiens
aggcagtagatttagagaagaaacatcaggtttggggcctataccagccacagctatgcagctttgggtattatccttcaaagtctatccctctgtaaaaygggatttctgccatcttcctcaacaaataagaaagctggaatagtcaatacctatttgatagtataagacaaaagattcactatctgcaatttaccagaa

SEQ ID NO: 63769 - DNA, 201 bp, Homo sapiens
gaggcaggaggattgattgaacccaggaggcagaggttgcagtgagctgagatcgcaccactgcactccagtctgggcaacagagcaagactccatctcaaaacaaacaaacaaacaaacaaacaaaaaaagcttaaaaattaaattctggtgtaaaagacaggtagcaaacaaaaatataaagaaataaagtcattttag

SEQ ID NO: 63770 - DNA, 201 bp, Homo sapiens
tgcccagcattagtttatttgtaatgcttttttacatcctagatgagcacaatgcctggactccccacccggccctgtttttatgatattgatttggaccytgaaacagaacaggtgaatggattattctaaacaggtaagttgttactgggtaataatttggcttttttcctcatgtagcttatttatgaattatagggc

SEQ ID NO: 63771 - DNA, 201 bp, Homo sapiens
aggcaggaggattgattgaacccaggaggcagaggttgcagtgagctgagatcgcaccactgcactccagtctgggcaacagagcaagactccatctcaaaacaaacaaacaaacaaacaaacaaaaaaagcttaaaaattaaattctggtgtaaaagacaggtagcaaacaaaaatataaagaaataaagtcattttaga

SEQ ID NO: 63772 - DNA, 201 bp, Homo sapiens
tcgcttgaacccaggaggtggaggttgcagtgagcagatatcgcaccattgcactccagcctgggcaaaagcgagtccccatctcaaaaaaaaaaaaaaaraaagaaaaaagaaaaagattcacatctacttgaggcctggaaaattgttgggaagttcctgtacatattaaaccagataatgtccattcagtggtgtttt

SEQ ID NO: 63773 - DNA, 201 bp, Homo sapiens
ggcaggaggattgattgaacccaggaggcagaggttgcagtgagctgagatcgcaccactgcactccagtctgggcaacagagcaagactccatctcaaaacaaacaaacaaacaaacaaacaaaaaaagcttaaaaattaaattctggtgtaaaagacaggtagcaaacaaaaatataaagaaataaagtcattttagat

SEQ ID NO: 63774 - DNA, 201 bp, Homo sapiens
tagagacagggtctcactcttttgcctcagctgcagcacagtggtgtgatcatagctcattgtagcctcaacctcctaagctcaagtgatcctcccacctyagcctcttgagcagctgggactataggcatgagccaccatgcccagctaattttattttatttttgaggcagagttttactcttgtcgcccaggctagag

SEQ ID NO: 63775 - DNA, 201 bp, Homo sapiens
tgctctcctacaactcctcactttgaatacttgcgatatgacattcaagctcagtctttttatttatttatttttttaattttttttttttttcttgagayggagtctcgctctgttgcccaggctggagtgctgtggcgcgatctcggctcactgcaagctccgccttgcgggttcatgccattctcccgcctccgcctc

SEQ ID NO: 63776 - DNA, 201 bp, Homo sapiens
gcgggttcatgccattctcccgcctccgcctcccgagtagctgggactacaggcgcccgccaccacgcccggctaattttttttgtatttttagtagagayggggtttcaccatgttagccaggatggtctcgatctcctgacctcgtgatccgcccacctttgcctcccaaagtgctgggattacaggcgtgagccaccg

SEQ ID NO: 63777 - DNA, 201 bp, Homo sapiens
tgccattctcctgcctcagcctcccaagtagctgggactacaggtgcccgccaccatgcccagctaatttttttgtatttttagcagagacggggtttcaytgtgttagccaggatggtcttgatctcctgatctggtgatccgcccgcctcggcctcccaaagtgcctgctaatctcttaattctggcttcttgcctcca

SEQ ID NO: 63778 - DNA, 201 bp, Homo sapiens
caaacatctgtcattccatagcttttaagttaagtaggcactggagcctgatgggactaacacaccctacaattctgctgagtttttgtcgtaactgatcwccaggactgtgattctgagacttagttttgatttctcccccacttgaccagatgataaaaaaccaaatgggagaaaagttgtgggtgatgtggcatacga

SEQ ID NO: 63779 - DNA, 201 bp, Homo sapiens
gaacttctgacctcaagtgatctgcctgtctcagccttccaaactggtaggactataggcatgagccaccgtgccaagctgctgtcttaattaaaataatktttattaattatgataggttcttagagttagctttctctgcttggtgagggtatcacattttgcttgttctagcaattactacaaatgttgacaccggga

SEQ ID NO: 63780 - DNA, 201 bp, Homo sapiens
attgtgaataaaagtttctataagagttctgaaaagctgatcgagttttggctgcttttctccccaagtagaaatgtcaaaaacctactcagaagtaaagrtgtgaatttattgagaaaaagggaagggaagaatagagaaataagatcaggcacattaatagaggaaagtagggatggcataattccagtctgttttgga

SEQ ID NO: 63781 - DNA, 201 bp, Homo sapiens
cttattgaacccattattttccttttactcttactgcaaattgcctcactgcacggtctctgcctcacaaaaacaaaatacatattaatatatctctgggstgggtgcagtggctcatgcctaaaatcccagcactttgggagggtgaggtggtagattacttgaggccaggagttcgagaccagccaggccaacatggca

SEQ ID NO: 63782 - DNA, 201 bp, Homo sapiens
gaaatgcctctgactctgtttcttttccttccaggtcactgctggactgcctcttcccaaggcttacatacaggaggtaacctgagttatttctcatcacrtgtcctagaaagcaccacaccttgaatcagcatttctccacctggcccatgtggaaatgaatgggttattgctgtgacccagggtgcagggtgccaaaag

SEQ ID NO: 63783 - DNA, 201 bp, Homo sapiens
gtgttgggattactggcgtgagccaccacgtctggccacaagggattttttgtttttgtttttctgttttttaatttttcaaaaatttattggttggttgkttgtttgtttgtttaagacagagtctcactctatctcccaggctggagtgcaatggtgtgatctcagctcactgcaacctccacctctcaggttcaagca

SEQ ID NO: 63784 - DNA, 201 bp, Homo sapiens
tgctgtgtgattggtcacataccctaagtccttagggcaggaaataatcttatactactgtacagcctgcaagcattgcagcgtcttgcctttaacacatraaaagcaccattttaagctaggagatttaaataggaaatgcctctgactctgtttcttttccttccaggtcactgctggactgcctcttcccaaggctta

SEQ ID NO: 63785 - DNA, 201 bp, Homo sapiens
atcgcttgaacctgggaggcggaggttgcagtgagctgaggatgccccactgcactccagcctgggtgacagacagagactgtctcaaaaaaaattgggtktgtgttttacaacacttcttggtcactatgatactatgattatttaggtctaggcttagggaaatcttctggtgctcagttatagggacaaacatgttaa

SEQ ID NO: 63786 - DNA, 201 bp, Homo sapiens
accagatcgcactcaagcttgttggcccagaagggtttgtaggttagtgttttttgcaaaaccagtgaatagactgtatgtttcttttaacatcaggggarttgggatggcatttttactgttgctttcctctttacagtgacggaagcaggatttggagcagacattggaatggaaaagttttttaacatcaaatgccgg

SEQ ID NO: 63787 - DNA, 201 bp, Homo sapiens
agggggtgagtggtgcactgacagtgcttatgaaggacgcaatcaagcccaatctcatgcagacactggaggtgagcagagtgactcctgccttcttgaaytggttttggacagtcagagcagagtggttataaagcacacttgcaaggcgcggtggctcacacctgtaatcccagcactttgggaggccaaggtgggcag

SEQ ID NO: 63788 - DNA, 201 bp, Homo sapiens
cacaagcctggacgggagacgtactgcttggtatctggtgcttgagaggtcccaggagataagggagcatttctgtgaaaggttttgccagagcctgtcargaacttaatcttgactgcaatgaatgacttaacattataagtgatctttgggtttaggtgcccaaataccagtccctccttagtaagcagccttttagac

SEQ ID NO: 63789 - DNA, 201 bp, Homo sapiens
tgcttatgaaggacgcaatcaagcccaatctcatgcagacactggaggtgagcagagtgactcctgccttcttgaattggttttggacagtcagagcagastggttataaagcacacttgcaaggcgcggtggctcacacctgtaatcccagcactttgggaggccaaggtgggcagatcacaaggtcaggagatcgagac

SEQ ID NO: 63790 - DNA, 201 bp, Homo sapiens
agccagactccgtctcaaaaaataaataatttaataattggcaacttcatagcatatccagaaaaaaaccatgaatggtccaattcaggtgaaagtatcarttggtccaagatggctaacatgggtaagcctagaatgtcaaatattggtttcagaaggttgggtttttttgctggtgggagttgatgctgcacacatttg

SEQ ID NO: 63791 - DNA, 201 bp, Homo sapiens
ctcctgagtacctgggattacaggtgcccgccatcacgcctagctaatttttttttttgagatggagtttcactcgtcgcccagactggagtacaatggcrtgatctcggctcactgcaacctctgcctcctgggttcaagcgattctcctgcctcagcctcccaagtagctgggattacaggcgtccgccaccatgtcca

SEQ ID NO: 63792 - DNA, 201 bp, Homo sapiens
tttgccagagcctgtcaggaacttaatcttgactgcaatgaatgacttaacattataagtgatctttgggtttaggtgcccaaataccagtccctccttartaagcagccttttagacctaaccttttctacctaaggttttgttcagtctttttgaaaagcaggaaggccaggtccttgtgaggcttttctcattacaag

SEQ ID NO: 63793 - DNA, 201 bp, Homo sapiens
acccatttgttcttcccctttgttttcctaattccttagcaatgcattcaagaacattcatgatctggcccaagtatatatttaaaagttgagttttcatytttttttaataaagtggatgagtaacttcccaaataactgaatatttataggaaattaagacttgacttttcattataagagatactaatgggctaggca

SEQ ID NO: 63794 - DNA, 201 bp, Homo sapiens
atacagcataaatgtttctaaagagtaaagacatctaattgcctttatttccttcttatttccatcacttttttaagattgactagcatcaatgctgggaracttgctagaggtgacctcaatgactgtttcattccttgtacgcctaagggatgcttggaactcatcaaagagacaggtaaaaacaacaaaccaaacaac

SEQ ID NO: 63795 - DNA, 201 bp, Homo sapiens
gacaggtctatacctttctccgaagatgatttcgagttctccaaatttaaagaggaaagggtgggttattgaaaagtacacgttttcatgtaagaggtggrtagggaaaaatagtcattcatgaccttctctggctcagtgaatctgcattttttacataagatgacagatggccggacgcggtggctcacgccagtaatc

SEQ ID NO: 63796 - DNA, 201 bp, Homo sapiens
atgcaggcaatctgcattttacataagataacatagacagaattgggcaggggaaaaatcagatatacatttgtgtctggtgggctggggggatttacatygccatggtgaaattttaacagaaacatcataaagatgttgcagctcactacgaatttctttgtgggcaaaatatgggggaggcatgtagcttttcatctt

SEQ ID NO: 63797 - DNA, 201 bp, Homo sapiens
ttatcttcatgtagagatcaccctttattttagcaaagttgatggatggatttaaaatacagtataattattgcaaagtgctatgagagtccagaagaggractcattctgccaagaggagggctttacaaagaagatatttgacctgggtttttttctaggctgagaggataaatctagccttttaatcatgtccaaaac

SEQ ID NO: 63798 - DNA, 201 bp, Homo sapiens
tgctctcctgcctagatagctcctcaagggcagtggtcactgtggcgccacatccagcttcctgccatctgaccactggcactcatatctattgaattgtygaagggagttatagctggaagtcttttttctcccttcccatctcaagtttcagatgtagacgctgagctgccaggaacattagtcactgtcaagccttca

SEQ ID NO: 63799 - DNA, 201 bp, Homo sapiens
atcagtgggtaattcacatgaggtttaatggcaaaaagaagacaattctgtctctccagccattttccatgctttgatatgaaatgcttcctttataggayggatacagagtctgagctggacctcatcagccgcctttccagagaacatggggcttttgatgccgtgaagtgcactcactgggcagaagggggcaagggt

SEQ ID NO: 63800 - DNA, 201 bp, Homo sapiens
tcttagagttagctttctctgcttggtgagggtatcacattttgcttgttctagcaattactacaaatgttgacaccgggaacaccttcacccttccacctttttttttttttttggagacacagtctcgctctgttgcctgggctggagtacagtggcacgatcttggctcactgcaacctccgcctcctggtttcaagc

SEQ ID NO: 63801 - DNA, 201 bp, Homo sapiens
gcaggaggattgattgaacccaggaggcagaggttgcagtgagctgagatcgcaccactgcactccagtctgggcaacagagcaagactccatctcaaaacaaacaaacaaacaaacaaacaaaaaaagcttaaaaattaaattctggtgtaaaagacaggtagcaaacaaaaatataaagaaataaagtcattttagatg

SEQ ID NO: 63802 - DNA, 201 bp, Homo sapiens
aatcagttttaggccaggtgcggtggctcacgcctgtaatcccagcactctgggaggccgaggcgggtggatcacgaggtcaggagttcaagaccatcctrgccaagatggtgaaaccccgtctctactaaaaatacaaaaattagccgggcgtggtggcgggctaattaggtggtgcctgtaatcccagctactcgggag

SEQ ID NO: 63803 - DNA, 201 bp, Homo sapiens
tctgtatatacatagggatgagatccaattctaaagcaaaatttatttgtgtttcattatataccttatacttgtagactgaaggtaattttatatatatrtgtgtgtgtgtatatatatatataataataattattattattattattttttttgagactgagttttgctcttgtcacccaggctggagtgcaatggcac

SEQ ID NO: 63804 - DNA, 201 bp, Homo sapiens
ttgtgtttcattatataccttatacttgtagactgaaggtaattttatatatatgtgtgtgtgtgtatatatatatataataataattattattattattwttttttttgagactgagttttgctcttgtcacccaggctggagtgcaatggcacgatctcggcgcactgcaacctccacctcctgggttcaagtgattct

SEQ ID NO: 63805 - DNA, 201 bp, Homo sapiens
caaaggactcttctggctcttgcaattcaaattagcaccacaaaactgagaactgtctgtataagggacaactgaagctaagattcaggccatgtcctgakatctgaggagagcgtccagtaatagcaccaatatgacaagctcagaaaatcctgtgttacaaaagccggcttctttctctgccatggtcctgttaaaagg

SEQ ID NO: 63806 - DNA, 201 bp, Homo sapiens
tataggcatgagccaccatgcccagctaattttattttatttttgaggcagagttttactcttgtcgcccaggctagagtgcagtggtgcaatattggctyactgcaacctccacctcccaggttcaagcgattctcatgcctcagcctcctgagtagctgtgactacaggcatgcgccaccacgcccagctaatttttgt

SEQ ID NO: 63807 - DNA, 201 bp, Homo sapiens
cctccacctcccaggttcaagcgattctcatgcctcagcctcctgagtagctgtgactacaggcatgcgccaccacgcccagctaatttttgtatttttarttgcccatattgcccaggctggtctcaaactactgacctcaagtgatctgcccactcaagcctcccaaagtgctgggattacaggcgtgagccaccgcac

SEQ ID NO: 63808 - DNA, 201 bp, Homo sapiens
gacggatacagagtctgagctggacctcatcagccgcctttccagagaacatggggcttttgatgccgtgaagtgcactcactgggcagaagggggcaagkgtgccttagccctggctcaggccgtccagagagcagcacaagcacccagcagcttccagctcctttatgacctcaaggtgggtgatttgctgtctgcaaa

SEQ ID NO: 63809 - DNA, 201 bp, Homo sapiens
aatcccagctacttgggaggctgaggcgcgaaaattgcctgaacccaggaggtggatgttgcattgagccaagattgtgccactgcactccagcctgggcracagaccgagactctgtctccaaaaaaaaaaaaaaaaaaaaaaaatgacaactcagggtcttggaataattaattaatatatttttttgctattagagga

SEQ ID NO: 63810 - DNA, 201 bp, Homo sapiens
cgcacctgtccccgctttttttttttttttttttgagacagagtcttgctctgttgcccaggctggatgcagtggcatgatctcagctcactgcagcctcygcttcctgggttcaagcgattctcatgcctcagcctcctgagaggctgagattacaggcatgcgccactatgcccggcttattttttatatttttgtaga

SEQ ID NO: 63811 - DNA, 201 bp, Homo sapiens
tgtggaaatgaatgggttattgctgtgacccagggtgcagggtgccaaaaggcctgcagtgtgctgaggagttatattaaatgagtagatagggaagatgyacctcacaaaatagaattgtcccacatagggtgtcaataagccactgccctagaccagtggttgattctcaacagctgattttgaccccggggacatttg

SEQ ID NO: 63812 - DNA, 201 bp, Homo sapiens
tgtttctagagttacatgtttttccagatattacatgtgaatgtcatttgtattctatctggcaactttggccaggcgtggtggctcatgcctgtaatccyagcactttgggaggctgaggcgggtggatcacaaggtcaggagattgagaccatcctggctaacacaatgaaaccctgtctctactaaaaatacaaaaaa

SEQ ID NO: 63813 - DNA, 201 bp, Homo sapiens
gcctgccacgctcccgtgcggggacccgcccaaaactccctggaagccaggcgattcagaccccgccaccgcgtccccagagactgggcggaaaccggagwctcgcctcccgaacccgcgaaactatctcccgcgagactgccccgccccaaccccgccccgcaactctactccctgattggctggaattacggccggatt

SEQ ID NO: 63814 - DNA, 201 bp, Homo sapiens
tttctagagttacatgtttttccagatattacatgtgaatgtcatttgtattctatctggcaactttggccaggcgtggtggctcatgcctgtaatcccarcactttgggaggctgaggcgggtggatcacaaggtcaggagattgagaccatcctggctaacacaatgaaaccctgtctctactaaaaatacaaaaaaat

SEQ ID NO: 63815 - DNA, 201 bp, Homo sapiens
agatattacatgtgaatgtcatttgtattctatctggcaactttggccaggcgtggtggctcatgcctgtaatcccagcactttgggaggctgaggcgggwggatcacaaggtcaggagattgagaccatcctggctaacacaatgaaaccctgtctctactaaaaatacaaaaaaattagccgggcatagtggcgggtgc

SEQ ID NO: 63816 - DNA, 201 bp, Homo sapiens
catttgtattctatctggcaactttggccaggcgtggtggctcatgcctgtaatcccagcactttgggaggctgaggcgggtggatcacaaggtcaggagwttgagaccatcctggctaacacaatgaaaccctgtctctactaaaaatacaaaaaaattagccgggcatagtggcgggtgcctgtagtcccagctactcg

SEQ ID NO: 63817 - DNA, 201 bp, Homo sapiens
ggggaaaatttctccccagcagaaatggggatttacaagttttacaggtccttgtcatttccgtgaaggaaaacaaagcaaagacagttacgagttctggwgagcttcccactgagctgggcgacagagttcaggtctccaagtgccgggccctgctgggtgtgacatttgcgtcccctgcaccagactgcttgtcgggca

SEQ ID NO: 63818 - DNA, 201 bp, Homo sapiens
ggggccctgactggacctggcctggccagcttactggggagcagtgggcctccagggagcagctcctcctccaggtgagcctcatcgctcctgccacgcargtgccacggtgttaagggaggggcagtggggaatcctggcccagcaccctggaccctgcgagtaggccctgccgtgtggggcgtgtccgctccagcggtg

SEQ ID NO: 63819 - DNA, 201 bp, Homo sapiens
agttccaggcccacatcaggcagtgtagctcctgggaggtctgcggggaggggttgtgatggagaagaaagggggggcccctccccagaacctcctggagmcccctgccctgccctgctggggcctgggatgccagcacccacagacctaaagtgataactcccccgctgcctgggaagaacaggcccgcctccagggggc

SEQ ID NO: 63820 - DNA, 201 bp, Homo sapiens
tggcttctctgccttgtggagaccctgccagcgaggggtctggcggcttagctgccccttgcgcaccccacccggttagacccagggctcagtacgctctmctgagactgggcacagtgatgccatctgcgccactgactctctcttcccctggcttgccaggacttgatcatcttccctgacgactgtgagttcaagcgg

SEQ ID NO: 63821 - DNA, 201 bp, Homo sapiens
ggtccttgtcatttccgtgaaggaaaacaaagcaaagacagttacgagttctggtgagcttcccactgagctgggcgacagagttcaggtctccaagtgcygggccctgctgggtgtgacatttgcgtcccctgcaccagactgcttgtcgggcagagtggagccctgaccctccagccagcacagatgtggacgaggggc

SEQ ID NO: 63822 - DNA, 201 bp, Homo sapiens
tcattccagacaccccagtcccaactgctccgacggccaccgcggggtggggaatgggcacgggtgtgaggtctcaccggggacgcccggtagtagagcarggcactgtcctgggcgctgtggaagccgaagccggagtagacgttgccagtgagcggtgccacgttcgagagcgccaggcgaaggaagccgtggccatgg

SEQ ID NO: 63823 - DNA, 201 bp, Homo sapiens
tgcaagtctggggttgttttttttttgctaaacaggatgaatagaaatctcttttgggggatctcttagtccaaatcctttagctgaatgcgcgtgtcccrgtgaggctgctcctctagatgctgcgggcattttgcagacgtcccaccaactgccatcagcgaccaattagaagatagggacagctgcacatgtcacaca

SEQ ID NO: 63824 - DNA, 201 bp, Homo sapiens
tgccccagcaccttcgtgcttttcaggagcgtaagctgagcagactcagtcgtcccagtggtcagtgtggctggggcagagggacacacggtccacaagaygtccatgctctcggaatgctccaggggtttggctgtggggctccaccaccattgcctgagcccggagccagaggctcctcccacactgcctggtctgccc

SEQ ID NO: 63825 - DNA, 201 bp, Homo sapiens
gagggcagtgtaggcagcaaggtcggcaagatcccgtggggtgcgcagctgcacccctgagcgcccgttgaacttcatgggcaccttgacctgcggggcayggtccatcagcgtccaccaccaccctccctgatgtccaccttcccctgggactctcacccaccttactggcagccccccgggcctgggcaatgagctctc

SEQ ID NO: 63826 - DNA, 201 bp, Homo sapiens
ccagccccaaagtcatacaacagcacgaggctgccttcttgcacggccaagcacaggaactggctctgcagaaacagggcagggttagtgtggggcagggycagtgcaagtggggatggcaggacgggtgtgcctggcgcacctgctgcttcaggaagaagagcaccccgctgtaggacacgagccgcagctcctgctcga

SEQ ID NO: 63827 - DNA, 201 bp, Homo sapiens
tggccgaggtcaggggcggtgggggctgcagtgggacggcctttttcaggccagccccaaagtcatacaacagcacgaggctgccttcttgcacggccaarcacaggaactggctctgcagaaacagggcagggttagtgtggggcagggtcagtgcaagtggggatggcaggacgggtgtgcctggcgcacctgctgctt

SEQ ID NO: 63828 - DNA, 201 bp, Homo sapiens
agcaggtcggcggtgcagccggcgctcacgcctgtcgtgttcagccgcttgaggtccacatacttgcccagggccttgatgcctttgacgcagccacggastgagcctccggtggggaagagccgtcgcaggctgtggggaagcggggatgcgggtcagggcgccacctccaagcccagcctaccgccccaacagcctggc

SEQ ID NO: 63829 - DNA, 201 bp, Homo sapiens
ctgcggaccctggggcttctgctttactgtctgtgacataaacaagtgacgcttgccaccttcttgccgggaaagccaggctgggttttctcatttccacyttttccctgttttacacgagggcacgaggatggggctgcagtatcagtgacgcacctgtcaccagcgggccacagagctttgtgttagcccctctcaagc

SEQ ID NO: 63830 - DNA, 201 bp, Homo sapiens
ggaactcctgggcttcaagggaccctctcagctcggcctcccaaagtgctgggattgcaggtgtgagccatcatgcaagtctggggttgttttttttttgytaaacaggatgaatagaaatctcttttgggggatctcttagtccaaatcctttagctgaatgcgcgtgtcccggtgaggctgctcctctagatgctgcgg

SEQ ID NO: 63831 - DNA, 201 bp, Homo sapiens
agcacgacggtggctctgcagagggcgatggtgtgcagccgggctttcctgtcgcccacaccttgcaggccctcacccctccccgtgccttcacccagctsctcctccagtgccattcatcccagcaggcagcaaggacatggcagctgagaaaagatgccagcagaacgcacttattttataatatttaacaactgtcag

SEQ ID NO: 63832 - DNA, 201 bp, Homo sapiens
ggagtgggcaggggggaggaggaggccctgccccaccttcaccatggccagtgcttcatgtgcctgacccgcagagctggcagctgagcagtgtggctctrgggtgcagcccgggttggagctcagccctcgcctggctcttcttgcaggccctgggcatgttcagcgcagccttggcctcggggcagctgggccccctca

SEQ ID NO: 63833 - DNA, 201 bp, Homo sapiens
ccagggtgtcctccactgtgtgctcagggagtgggcaggggggaggaggaggccctgccccaccttcaccatggccagtgcttcatgtgcctgacccgcasagctggcagctgagcagtgtggctctggggtgcagcccgggttggagctcagccctcgcctggctcttcttgcaggccctgggcatgttcagcgcagcct

SEQ ID NO: 63834 - DNA, 201 bp, Homo sapiens
caggggcagggtccattcctgtccccctggatctgcagaagtggggctgagggggtaaaggtcacagcccttctgcccttgatcccatcgctttgatcccmagttctgggcaagggttagacaccaccttgtgtctttaacgtgttctagatgtggaagcgtttgccaaagccatgcagaacaacgccaagcccgagcaga

SEQ ID NO: 63835 - DNA, 201 bp, Homo sapiens
agtcgctgccgcagaccgcggatgagatccagaataccctgacctcgccccagttccagcaggtagaggccgggcccagggtgtcctccactgtgtgctcmgggagtgggcaggggggaggaggaggccctgccccaccttcaccatggccagtgcttcatgtgcctgacccgcagagctggcagctgagcagtgtggctc

SEQ ID NO: 63836 - DNA, 201 bp, Homo sapiens
ttctaaagacagggtctcactgtcttgattaagctggtcttggaactcctgggcttcaagggaccctctcagctcggcctcccaaagtgctgggattgcargtgtgagccatcatgcaagtctggggttgttttttttttgctaaacaggatgaatagaaatctcttttgggggatctcttagtccaaatcctttagctga

SEQ ID NO: 63837 - DNA, 201 bp, Homo sapiens
cttgccatctggggagtcgctgccgcagaccgcggatgagatccagaataccctgacctcgccccagttccagcaggtagaggccgggcccagggtgtccyccactgtgtgctcagggagtgggcaggggggaggaggaggccctgccccaccttcaccatggccagtgcttcatgtgcctgacccgcagagctggcagct

SEQ ID NO: 63838 - DNA, 201 bp, Homo sapiens
aatcctggcccagcaccctggaccctgcgagtaggccctgccgtgtggggcgtgtccgctccagcggtgccctctctcttcgcagctcccggagccagtckgcagcggtcaccccgtcatccaccacctcttccacccgtgccaccccagccccttctgctccagcagctgcctcagcaactagcccgagccccgcgccca

SEQ ID NO: 63839 - DNA, 201 bp, Homo sapiens
gggcttgcagggcgggtgcacagcccgtgctcacattgacgctgcccaggttctgctgcagatcaaatacgcgctgtgggcccaggagcctgtgcagggcrggcaggcggtcagcagctgcggaaggccagctgggaccttgtcccccagcgcccaccaggctcaccgctgcacgaagacgttgctgatgcagccactgaa

SEQ ID NO: 63840 - DNA, 201 bp, Homo sapiens
ctggactgaatcttctaatctaagcacatgaattgtgtaatgggatggaacagaaatgaccttgcttccagaacacagccgcaagtgtccacccgccccaygccgctcctccaggcctgtgggtccccaccgccccgcttcttcctggctttggtgttgggaattcctgctcctctggcctggggaggggccaggctcttt

SEQ ID NO: 63841 - DNA, 201 bp, Homo sapiens
ttgcttaactggggtgcagaggccactgcacctcagggttctcacgaagcgcctgacctctctattttattactattattattattattttttttttttgmgaaggagtcttcctctgtcgcccaggctggagtgcagtggcgcaatctcggctcactgcaacctccacctcccgggttcaggcgattctcgtgcatcagc

SEQ ID NO: 63842 - DNA, 201 bp, Homo sapiens
cagacccgtgtgcttggcccttcagaaatgcttgtccctttgggtgggatctggactgaatcttctaatctaagcacatgaattgtgtaatgggatggaayagaaatgaccttgcttccagaacacagccgcaagtgtccacccgccccatgccgctcctccaggcctgtgggtccccaccgccccgcttcttcctggctt

SEQ ID NO: 63843 - DNA, 201 bp, Homo sapiens
accaccttgtgtctttaacgtgttctagatgtggaagcgtttgccaaagccatgcagaacaacgccaagcccgagcagaaagagggcgacacgaaggacamgaaggacgaagaggaggacatgagcctggactgagccacgcgccgtcctccgaggaactgggcgcttgcagtgcgttgcacaccctcacctcccacccac

SEQ ID NO: 63844 - DNA, 201 bp, Homo sapiens
ggccaccgcggggtggggaatgggcacgggtgtgaggtctcaccggggacgcccggtagtagagcagggcactgtcctgggcgctgtggaagccgaagccrgagtagacgttgccagtgagcggtgccacgttcgagagcgccaggcgaaggaagccgtggccatggaaagtcatggcgcgccccacctgcggggaggcca

SEQ ID NO: 63845 - DNA, 201 bp, Homo sapiens
cgcctgagctgcagtgttttccaggtgagggtggcctgcagagcctgctgggaaacatgagccacagccagctcatgcagctcatcggaccagccggcctyggaggactgggtaacgtgcgccacccgggctctcgggcagcttctgctgggaatgctttgaggcccggtctctgtttcctttaaacttctgctggctctg

SEQ ID NO: 63846 - DNA, 201 bp, Homo sapiens
aaaaaaaaaaaaaaaaagtttaaaaaaccctacccctgccaaatgcttttccgaagtagccgtgccattggtgtttccaactttgcctggcaccttccatygtttgctaagttccagcaggtgtatttcatttgcatttccctcatgaataatggtgttgagcagcttgccatggtgcctttgccgcctgtgacctctttg

SEQ ID NO: 63847 - DNA, 201 bp, Homo sapiens
caggcgccggccacacccggccacacggcctgagatgccacctcagggctgcggtgcatgctacctggggccgaggtcctctcccagagtacggaggctcyaggctgggctgcgggcaaccgattgcggtgtgaaatttccaggcagacagacatgctggccctggttctaacgatgcccagtgccctctctctgcccctt

SEQ ID NO: 63848 - DNA, 201 bp, Homo sapiens
ggtaggacgggtctgcatcccaccgtcgcctcacttcaagtggtgccccctgtagggttcaggggcagccgagtgcggtgctcagcagaggcgcaggcagygcggtggggcccgcgtggatctggctggggcaggcccgcctgagctgcagtgttttccaggtgagggtggcctgcagagcctgctgggaaacatgagcca

SEQ ID NO: 63849 - DNA, 201 bp, Homo sapiens; identical to SEQ ID NO: 12646

SEQ ID NO: 63850 - DNA, 201 bp, Homo sapiens
gctcatcggaccagccggcctcggaggactgggtaacgtgcgccacccgggctctcgggcagcttctgctgggaatgctttgaggcccggtctctgtttcstttaaacttctgctggctctgtctgcgtagtgtcggggagcctgtgtgtccgcaagctggttcccctttgggaatgcgcttgtttgcctgtggctagagc

SEQ ID NO: 63851 - DNA, 201 bp, Homo sapiens; identical to SEQ ID NO: 12648

SEQ ID NO: 63852 - DNA, 201 bp, Homo sapiens
cagggcgggtgcacagcccgtgctcacattgacgctgcccaggttctgctgcagatcaaatacgcgctgtgggcccaggagcctgtgcagggcgggcaggyggtcagcagctgcggaaggccagctgggaccttgtcccccagcgcccaccaggctcaccgctgcacgaagacgttgctgatgcagccactgaagttgtaa

SEQ ID NO: 63853 - DNA, 201 bp, Homo sapiens
acgaggctgccttcttgcacggccaagcacaggaactggctctgcagaaacagggcagggttagtgtggggcagggtcagtgcaagtggggatggcaggaygggtgtgcctggcgcacctgctgcttcaggaagaagagcaccccgctgtaggacacgagccgcagctcctgctcgaagcgcttggtggtgctgatctgac

SEQ ID NO: 63854 - DNA, 201 bp, Homo sapiens
agagccgtcgcaggctgtggggaagcggggatgcgggtcagggcgccacctccaagcccagcctaccgccccaacagcctggcctcggagccccagctgcrcacagtgcttacctcgggggcagctggtcgggcggcacgccccccaggtagtaggcgtcggccagctccagatcattgtcctgctccacgctgtacaccg

SEQ ID NO: 63855 - DNA, 201 bp, Homo sapiens
ctcacgcctgtcgtgttcagccgcttgaggtccacatacttgcccagggccttgatgcctttgacgcagccacggactgagcctccggtggggaagagccrtcgcaggctgtggggaagcggggatgcgggtcagggcgccacctccaagcccagcctaccgccccaacagcctggcctcggagccccagctgcgcacagt

SEQ ID NO: 63856 - DNA, 201 bp, Homo sapiens
cccacctgcggggaggccatccctgagtgcccgcgggtgcccctgcatgtccacagatgccacccccagcccggggagggctgctcaccagcaggtcggcrgtgcagccggcgctcacgcctgtcgtgttcagccgcttgaggtccacatacttgcccagggccttgatgcctttgacgcagccacggactgagcctccgg

SEQ ID NO: 63857 - DNA, 201 bp, Homo sapiens
ccgcccacagccggaccgcactcctcggcctccgcctaacccctggctcagccacacgagtgacagctctgcccgcccgggcgggcgacgccgaggggtgsgctcggccccacctgagcagttccccagcgcccctctgaaacccgcctgtggtccctggcgccgcctctaggggccgccgccgctcccctatgacacagc

SEQ ID NO: 63858 - DNA, 201 bp, Homo sapiens
gtgagcggtgccacgttcgagagcgccaggcgaaggaagccgtggccatggaaagtcatggcgcgccccacctgcggggaggccatccctgagtgcccgckggtgcccctgcatgtccacagatgccacccccagcccggggagggctgctcaccagcaggtcggcggtgcagccggcgctcacgcctgtcgtgttcagcc

SEQ ID NO: 63859 - DNA, 201 bp, Homo sapiens
ggtcctgaggtgtgggggcagcatgcaggcaggatgccgggcgggctgacggctgcggcgggaggcctgggggcgtggatggtgaatgcaggggccgcccrcacaggggccacccttccagccaccccagctctgcctgctcacccctggggtgcccaccttccgggcggtggcctgcagtcctctaggccccaggcccgg

SEQ ID NO: 63860 - DNA, 201 bp, Homo sapiens
gggcctggccttaccagttcctatgtcgggccaggatgcccacaaactccaggtgactggacagggaacccccaaactggtaggagtctcgggtggtcctsaggtgtgggggcagcatgcaggcaggatgccgggcgggctgacggctgcggcgggaggcctgggggcgtggatggtgaatgcaggggccgcccacacagg

SEQ ID NO: 63861 - DNA, 201 bp, Homo sapiens
ggcctgggggcgtggatggtgaatgcaggggccgcccacacaggggccacccttccagccaccccagctctgcctgctcacccctggggtgcccaccttcygggcggtggcctgcagtcctctaggccccaggcccggggtctgggcttgcagggcgggtgcacagcccgtgctcacattgacgctgcccaggttctgctg

SEQ ID NO: 63862 - DNA, 201 bp, Homo sapiens
acccgctagccggtgccactggccatcacacagcactgaggggcgggtcactgacgtggagaactcccctgctccgtcatccgcccgcagcaggacctggmggggtaggaagggagggtcaggctatgcccccgaggtcaccagaatggggaggcaaaccctgccctggcacgccacctctgccaggcttacttgcttctc

SEQ ID NO: 63863 - DNA, 201 bp, Homo sapiens
gctgcagccgccagcaaggggcccacggtgtggttgctctgcgcgtccacctccagccggagcacattcccgcttttcatcactgggagaaagggggactyctgaggccaggtggtcctcagcccagcctctctccagccccaaaagaagccaccccacccagagtcccgcctggctcccgctctgcagaagggtgggggt

SEQ ID NO: 63864 - DNA, 201 bp, Homo sapiens
gcctggcaccttccatcgtttgctaagttccagcaggtgtatttcatttgcatttccctcatgaataatggtgttgagcagcttgccatggtgcctttgcygcctgtgacctctttggtgaaacatccggaggtgtcttctgcccacgtggaggcgcagcctgggctctgccgcccacctttcacccgaggagcctgcagc

SEQ ID NO: 63865 - DNA, 201 bp, Homo sapiens
gacatccggcattttgctggtgcaggctgtcctgaagccagaccctcccgagactgctgtctgggaggagagcgagccagcggcccagatgccttggtcgyggggaggtgcctgtgtgtaccgtgagtttcccagcctccggcggcaagtgggaaagccggtacaggaagagtggtgcctgcaggtgctcccggtcaccac

SEQ ID NO: 63866 - DNA, 201 bp, Homo sapiens
gtggccctggagagcctggagctctgtgcctggcggcttcactcagtcttctttgtttttcaaactcttagttgttctttgttacatttgagagcagttcrgcgttgactttttaactactctgggaatgttgtttccagcacgtctcagaaaccccgttgccatctgaaaggcccctttccctgctctctcccccggcct

SEQ ID NO: 63867 - DNA, 201 bp, Homo sapiens
gggtggcgagtgggcacagagagatgaggggtggcgagtgggcacggagagatgaggggtggcgagtgggcacggagagacgaggggtggcgagtgggcayggagagacgggtggcgagtgggcacagagacgaggggtggcgagtgggcacagagacgaggggtggcgagtgggcacggagagacgagggatggcgagtg

SEQ ID NO: 63868 - DNA, 201 bp, Homo sapiens
aattacaggcatgtgccagcatacctggctaatttttgcatttttagtagagtcggggtttcattcaccatgttgcccaggctggtcttgaactcctggcytcaagtaatccgcccgcctcggcctcccaaagttctgggtttacaggcgtgagccaccgcgcctgagccctctaagagcccccgcctggcgtcgctgtag

SEQ ID NO: 63869 - DNA, 201 bp, Homo sapiens
gagttcaagcgggtgccgcagtgccccagcgggagggtctacgtgctgaagttcaaggcagggtccaagcggcttttcttctggatgcaggtatggggcargccttggggttgtgcctttttgttgccctgcgattcggttaggaacttgcttacagtgtggtgcaattggcttttataaaccagcaggcgccggccacac

SEQ ID NO: 63870 - DNA, 201 bp, Homo sapiens
tcgctcctgccacgcaggtgccacggtgttaagggaggggcagtggggaatcctggcccagcaccctggaccctgcgagtaggccctgccgtgtggggcgygtccgctccagcggtgccctctctcttcgcagctcccggagccagtcggcagcggtcaccccgtcatccaccacctcttccacccgtgccaccccagccc

SEQ ID NO: 63871 - DNA, 201 bp, Homo sapiens
ttcctgggaggccagagtctactgtggatgactcgccccctcagcacaggttgtttggaagtggaaatagaagattctaaaagttagagaccctgtgagckccctgggtcactccccactcccaccttcacggggtaggacgggtctgcatcccaccgtcgcctcacttcaagtggtgccccctgtagggttcaggggcag

SEQ ID NO: 63872 - DNA, 201 bp, Homo sapiens
ctttcgtttaagaagctataacttaaaccatcttcagaaacaagatctgtcacccgtagagcttagagtccaaatagacacctatgaggcgagcacaaggrgcggtgtgaggcagctgcaggggcctgaccaggggccggggttggctgtgtcctaggcggctgggcagccactggcccccactgccccgtggacctccac

SEQ ID NO: 63873 - DNA, 201 bp, Homo sapiens
gaggccagagtctactgtggatgactcgccccctcagcacaggttgtttggaagtggaaatagaagattctaaaagttagagaccctgtgagctccctggrtcactccccactcccaccttcacggggtaggacgggtctgcatcccaccgtcgcctcacttcaagtggtgccccctgtagggttcaggggcagccgagtg

SEQ ID NO: 63874 - DNA, 201 bp, Homo sapiens; identical to SEQ ID NO: 12641

SEQ ID NO: 63875 - DNA, 201 bp, Homo sapiens
cttacatgcccttcctcttgcaggaacccaagacagaccaggatgaggagcattgccggaaagtcaacgagtatctgaacaaccccccgatgcctggggcrctgggggccagcggaagcagcggccacgaactctctgcgctaggcggtaactgtcacatgtgtcacgtgagctcagggtttcctgggaggccagagtcta

SEQ ID NO: 63876 - DNA, 201 bp, Homo sapiens
acagcagccagcccgacccagcccatccagctgagcgacctccagagcatcctggccacgatgaacgtaccagccgggccagcaggcggccagcaaggtarcgtgtgctgtcgcctggagctgggtggggggcatggggcctgctgaccctcgcacgctcaccttccaaggcatctgcctagtgtgcgcgcctggggtgct

SEQ ID NO: 63877 - DNA, 201 bp, Homo sapiens
cctcagcattgtgtggccaggcacacgcgcctctgcgtctcaggtccctcacctggaagccaggtcagaggatggctgtggtggccctgggtgagctggcrccagctcctgcccttacatgcccttcctcttgcaggaacccaagacagaccaggatgaggagcattgccggaaagtcaacgagtatctgaacaacccccc

SEQ ID NO: 63878 - DNA, 201 bp, Homo sapiens
tttgttacatttgagagcagttcagcgttgactttttaactactctgggaatgttgtttccagcacgtctcagaaaccccgttgccatctgaaaggccccyttccctgctctctcccccggccttgcctttcatgggctgtctctgaccctggcttctctgccttgtggagaccctgccagcgaggggtctggcggcttag

SEQ ID NO: 63879 - DNA, 201 bp, Homo sapiens
tcacgaagcgcctgacctctctattttattactattattattattattttttttttttgagaaggagtcttcctctgtcgcccaggctggagtgcagtggygcaatctcggctcactgcaacctccacctcccgggttcaggcgattctcgtgcatcagcctcctgagtagatggaattacaggcatgtgccagcatacct

SEQ ID NO: 63880 - DNA, 201 bp, Homo sapiens
ccacccgtgccaccccagccccttctgctccagcagctgcctcagcaactagcccgagccccgcgcccagttccgggaatggagccagcacagcagccagmccgacccagcccatccagctgagcgacctccagagcatcctggccacgatgaacgtaccagccgggccagcaggcggccagcaaggtagcgtgtgctgtc

SEQ ID NO: 63881 - DNA, 201 bp, Homo sapiens
ggaagaaggctggttggtgggcagctagagacccacaggcccttcccaaacgtcagtgccccacccagcccctgtctcattccacatcataggagggtggkaggggggtgggaggagggtgggagggggcagggggtggaggggtggggggagggtggtaggttacgcagcacctagtcctgaggggcagctcccccaccc

SEQ ID NO: 63882 - DNA, 201 bp, Homo sapiens; identical to SEQ ID NO: 12638

SEQ ID NO: 63883 - DNA, 201 bp, Homo sapiens
cagcccctgtctcattccacatcataggagggtggtaggggggtgggaggagggtgggagggggcagggggtggaggggtggggggagggtggtaggttaygcagcacctagtcctgaggggcagctcccccacccttgatcaaggccgcactcaccaggcaggcccccgaggtacagaggggctggggcaccagctgcag

SEQ ID NO: 63884 - DNA, 201 bp, Homo sapiens
gtgtaccgtgagtttcccagcctccggcggcaagtgggaaagccggtacaggaagagtggtgcctgcaggtgctcccggtcaccaccaccccttccagacrccatccccagagctcacatctgtgctggctggagggtcagggctccactctgcccgacaagcagtctggtgcaggggacgcaaatgtcagacccagcagg

SEQ ID NO: 63885 - DNA, 201 bp, Homo sapiens
aaaattaaccgggtctggtgacacatgcctgtaatcccagctactcaggaggctgaggtaggagaactgcttgaactcaggaggcgggggctgcaatgagytgagatcaagccactgcactccagcctatgggatagagtgagattccatctcaaaaaaaaaaaaaaaaaaaagtttaaaaaaccctacccctgccaaatg

SEQ ID NO: 63886 - DNA, 201 bp, Homo sapiens
gagagatgaggggtggcgagtgggcacggagagacgaggggtggcgagtgggcatggagagacgggtggcgagtgggcacagagacgaggggtggcgagtgggcacagagacgaggggtggcgagtgggcacggagagacgagggatggcgagtgggcacagacgaggggtggcgggtgggcacagagacgaggggtggcg

SEQ ID NO: 63887 - DNA, 201 bp, Homo sapiens
ggagagatgaggggtggcgagtgggcacggagagacgaggggtggcgagtgggcatggagagacgggtggcgagtgggcacagagacgaggggtggcgagtgggcacagagacgaggggtggcgagtgggcacggagagacgagggatggcgagtgggcacagacgaggggtggcgggtgggcacagagacgaggggtggc

SEQ ID NO: 63888 - DNA, 201 bp, Homo sapiens
cccccacctcagaggagacagaggtccaggcaagtgcaggcgggcgtccctccagaccttcacgatgagggcccagcggccaggctcaccccgtggcattrctgtagaaggcgacgtaatggggggcaccatcggcgaagcccgcttgagttttcacttcagtcctcaggagctgtaggctcacacggccctgctgcaggg

SEQ ID NO: 63889 - DNA, 201 bp, Homo sapiens; identical to SEQ ID NO: 12639

SEQ ID NO: 63890 - DNA, 201 bp, Homo sapiens
cagtgtagctcctgggaggtctgcggggaggggttgtgatggagaagaaagggggggcccctccccagaacctcctggagccccctgccctgccctgctgrggcctgggatgccagcacccacagacctaaagtgataactcccccgctgcctgggaagaacaggcccgcctccagggggcccaagatgcagggtgtgacc

SEQ ID NO: 63891 - DNA, 201 bp, Homo sapiens
aggaccccagctgggtacttcagaggagggtggctggccgagcggtggggctggaggactggagggagctggggttcctgcgccctgggtcccctggcccyacatggctgcctgcctgctgccagctcatggagtgcagacccgtgtgcttggcccttcagaaatgcttgtccctttgggtgggatctggactgaatcttc

SEQ ID NO: 63892 - DNA, 201 bp, Homo sapiens
caccccgtggcattgctgtagaaggcgacgtaatggggggcaccatcggcgaagcccgcttgagttttcacttcagtcctcaggagctgtaggctcacacrgccctgctgcagggacacctggcatagcccatcctggggacggcagccaggtcagccggccggcctggggacccagactcattccagacaccccagtccc

SEQ ID NO: 63893 - DNA, 201 bp, Homo sapiens
aggtgtcttctgcccacgtggaggcgcagcctgggctctgccgcccacctttcacccgaggagcctgcagcacgtggagagcatcagggtgtgctttcttyacagtttggggcttttttgagacagggtctcgctctgtcacccaggctgcagtgcagtggtgccatcacggctcaccgccagccttgaccttcacctcag

SEQ ID NO: 63894 - DNA, 201 bp, Homo sapiens
tctgtctgcgtagtgtcggggagcctgtgtgtccgcaagctggttcccctttgggaatgcgcttgtttgcctgtggctagagctgggtaggcgagggcttmtgggcccctggtgaggaccccagctgggtacttcagaggagggtggctggccgagcggtggggctggaggactggagggagctggggttcctgcgccctg

SEQ ID NO: 63895 - DNA, 201 bp, Homo sapiens
gaacgtgtttttccacggttttgccaagaaatagtgtccaactgttaccaccatctcccttttttccccgattttcctgttggtggcttttaagtcccccrtccctgctttgccatgagagcagggactcccagtgtccctggcgccctgcagcttccatagccattcggggtgtgcgtgggtgctctgctcccagctctg

SEQ ID NO: 63896 - DNA, 201 bp, Homo sapiens
ctcctccaggtgagcctcatcgctcctgccacgcaggtgccacggtgttaagggaggggcagtggggaatcctggcccagcaccctggaccctgcgagtargccctgccgtgtggggcgtgtccgctccagcggtgccctctctcttcgcagctcccggagccagtcggcagcggtcaccccgtcatccaccacctcttcc

SEQ ID NO: 63897 - DNA, 201 bp, Homo sapiens
tccactctggggccggtccccacaggcctccggaacagcttaattctgtctctctggagaccctaatccagaaggctgtgggcaagatctggaggtggggsggggtctggccgcctggatcccggccctgacggtccttctgtctgcagctcccccttccgccccctggcttgctgcattttgtccaagcctctctggagc

SEQ ID NO: 63898 - DNA, 201 bp, Homo sapiens
gtgacacgtggaagcgtaggtgcccggcctcggggtggacgctgcagccgtgtgccactgcatgtttaccccgggcgatgccttttctggggctccccagrgatctgggggcaggagtcctggactctgcctcacaccccagcaaggtgctgggaggtgccctgacaggggcccccacttgagggaggggatgggttgggg

SEQ ID NO: 63899 - DNA, 201 bp, Homo sapiens
gggtccctgaatccaccccaggcccagctctgttgaggtgcgggcagccccctggctgggaacccatcctctccctccagctggggagctcctgtcccccygcccactcctggaagttttcctgtcctgcttaggacatctgtagttgggcatggcggcgtccaaccccagagttgggggttctggcctcagagttgttat

SEQ ID NO: 63900 - DNA, 201 bp, Homo sapiens
gggaggtagacgatgacctcagagcctggcagccggtgaataggcctgtgccccgcccccaccccggaaggctgcgcttggctcccacagtccccgcaacrccaagccctccgagaagggtgggatttggacctgggatgtctggagtcctggaaccttgccccctacctggagtctgggcagctggtgcccccaagggct

SEQ ID NO: 63901 - DNA, 201 bp, Homo sapiens
tggggggcagtgcagtccaacgggccaggccccttcagccagtgagctgtggtctctgtcacgcggcctcttggcctgtgggagcctcagtggcaaggccsggagacgtcaaggggcccgggcaccgcggggacccaggcttttctggtgatccagcgccctcccctcctgccattccccgcagcctccaagagggactgt

SEQ ID NO: 63902 - DNA, 201 bp, Homo sapiens
gccactctgcatgcggctagggacaccctggccagcgtcttcagattgctgcacagcctggaccaggctaaggaggtgagtgcagcccctggcccctgtcrccaccccatccacggccaactccctcccaggcccgtgggcagctttgtgtgcacacttgcgtgcagagcccgccctcagggtcgtggatcaggtggctgt

SEQ ID NO: 63903 - DNA, 201 bp, Homo sapiens
aggaagagggctatgggaggagccgcataggcctgtgggcccaggaactggccaacacgctggtctgcggttggggtttgtgcagctggaggaggagcaakggcatcttggaaagagcagggctcggtcggacgcctgggtttgcagtttcctgggtctgagctgtgtgaccggcccccccatcgtaccgcctgcaccccc

SEQ ID NO: 63904 - DNA, 201 bp, Homo sapiens
caggggccaggcagcggtgggtcagagtccttcattcctggttagtgtcaacccggagcctggactctgtgctttccaacaaccacatgtcccagaggccrtcaggagcccagcagtggcccagctggggtcacagccagggaggaaaaagcaccactccttccaaacgggctgtttccagaccctgcctaggccaggaag

SEQ ID NO: 63905 - DNA, 201 bp, Homo sapiens
ttggccaggctattctcaaactcctgacctcaggtgatccgccctcttgggcctcccaaaatgctgggattacagacaggagccaccatacctggcctggmactttctataaatgccacacaacatgttctgtgcagccgcgtctcccaccgttgtgtcagcggataagttgccgtgttccgagacaccaacctcacatgg

SEQ ID NO: 63906 - DNA, 201 bp, Homo sapiens
cagtggcccagctggggtcacagccagggaggaaaaagcaccactccttccaaacgggctgtttccagaccctgcctaggccaggaaggccggactatccsttggccccatccttctggcagcaggaacctgcagaccctcggaggctggaggcaggtggcagccctgggggaaggcaggctccaggcctgggggaggggt

SEQ ID NO: 63907 - DNA, 201 bp, Homo sapiens
ccccccacagcaccctgtgccggggcactgcccgggatacccaggaccacctggctgtcttccacctggactcggaggccagcgtgaggctcacagccgarcaggcacgcttcttcctggtaaggacccctcaggtccccaccccaaggggtcagcttctttcagaagatttgaaacatgcatgagaggggagaggacagt

SEQ ID NO: 63908 - DNA, 201 bp, Homo sapiens
ggggaccgggtaagcagggcatcaggtctgggggaggcactttgaggatggccaggacgcctgagagggttgggagccaggagtggggtctgtccagggarggggagctccatgggggtccgtgagggtgcccaggccctgtcccggtagggaatgagcgcaagtatccaggcccagcacagggctctgtgctgggggtgc

SEQ ID NO: 63909 - DNA, 201 bp, Homo sapiens
tggttttgctgcatcgtggttagacttggcacactgatagtttctgccttttgtctttggaatttgagattttctttgtttctaacctagaatgtgacgayttttattttttaattttatttatttatttatttatttatttatttatttatttattttgacacagagtctcactctgtcacccaggctggcgtccagttg

SEQ ID NO: 63910 - DNA, 201 bp, Homo sapiens
gtatttatttaaacaacccccagtggttggaaatctaggttctttttttttttaattatgctgtgataaagcattattaagatgaggtagaaaactggccsggcacagtggctcacacctgtaatcccagcactttgggaggctgaggcaggtggattacctgaggtcaggagttagacaccagcctggccaacatggtga

SEQ ID NO: 63911 - DNA, 201 bp, Homo sapiens
cacctggggacccgctactgcccagaggccactctctgcctcacacgggatctaaagcagctcagagccggactctgcgcctggactgcagattccttgaygtctccgccccctctccagccagcccctcccccacttggagcttctcctgccaaggggagccgcctcctctcccccctcccccaggtgggagaactaata

SEQ ID NO: 63912 - DNA, 201 bp, Homo sapiens
caccgctgtggaccctgatgcagagcccaccctgctgcgtgagccccaggtgagggccatagtctctagagggacgggggtgtcagggcaggactccgggycccaacccagggcaggttgtccagggggcggcaggggctcatagctcagcctgctcactagggcctatccctgcaggccaccgtggtcttcaccacccat

SEQ ID NO: 63913 - DNA, 201 bp, Homo sapiens
ataagacctgctgaggtttttctttctttagttgggaggagagattttcctttctaatattcaatttctttaatccactttctttgatttatcactttttwaaaatagcttcttgagttattatttttagtctgtcttcattcccaacaaaaaggcttaaagcagtggttctcagccagtggtgactttgatgcacaggaa

SEQ ID NO: 63914 - DNA, 201 bp, Homo sapiens
caggtggattacctgaggtcaggagttagacaccagcctggccaacatggtgaaaccccatttctactaaaaatacaaaaattagccaggcgtggtggtgygtgcctgtaatcccagctacttggggggctgaggcaggagaatcatttgaacctggttgcagtgagctgagaaccaccatcacactccagcctaggtgac

SEQ ID NO: 63915 - DNA, 201 bp, Homo sapiens
ggaaaaccttcggaaatataggtcggcataaagccaaagaaaaaagttagcccaggcaacatggtaaaaccctgtctctacagcaaatacaaaaattagcygggtgtagtgatgtgtgcctgtagttcgagctactccggaggctgaggtggaaggattgcttgagcctggaaggccgaagctgcagtgagccatgatcac

SEQ ID NO: 63916 - DNA, 201 bp, Homo sapiens
gctccatggcacgtggcgaattgagggcttgccccaggatgccgctggcagcacatgtggccctgtgtgtttgtctggttcctggctcggccaagcctggkgtcccgcacatggagttgaccggtacctagaggtgtcccgcatgacatctgtaggtcatgatgcggccaacccccgtgacatgaggggccggccttgcag

SEQ ID NO: 63917 - DNA, 201 bp, Homo sapiens
gctgctaatctgccctgctaatctgtctgtctgctgtaactttgctccttctgtatgaggaggtttgtggttgaatacctcctagaaggagtggaaagagyaggccctggtccacatggagtgggtggtcaccagccccaaggcctggtcattcccgagacaggacatccgtgtggctttgagagctatgtcctcaaacag

SEQ ID NO: 63918 - DNA, 201 bp, Homo sapiens
gccaggctgttggggcggtaggctgggcttggaggtggcgccctgacccgcatccccgcttccccacagcctgcgacggctcttccccaccggaggctcastccgtggctgcgtcaaaggcatcaaggccctgggcaagtatgtggacctcaagcggctgaacacgacaggcgtgagcgccggctgcaccgccgacctgct

SEQ ID NO: 63919 - DNA, 201 bp, Homo sapiens
tcagctccacggcaagctggggcccagagtgacaggagcagtacacccagcaggcgacaggcacgggcaaagacctggaggcgggacttggcgggcaggcrcgggcacggctggttgtgagcgcaggaggctggagagccaggccgagggcgtctgcgcttacccactccttcgaccctcccttccgctgcagcatcatcc

SEQ ID NO: 63920 - DNA, 201 bp, Homo sapiens
acaggcacgggcaaagacctggaggcgggacttggcgggcaggcacgggcacggctggttgtgagcgcaggaggctggagagccaggccgagggcgtctgygcttacccactccttcgaccctcccttccgctgcagcatcatcctggacgtcaaccaggaccgcctcacccagagggccatcgaggcctccaacgcctac

SEQ ID NO: 63921 - DNA, 201 bp, Homo sapiens
ctgtggaagagacccccacagtgggcagctggggccagacacagaaagcctaccagggaggtgccagggctgcagatagcacagacagccccagccgtcgrgagcctggcaagcttggaagtgctttgggtagaaatggaggtataggtgggagggctgtaggccttgggggggattggggcacaccctgcaggaagggca

SEQ ID NO: 63922 - DNA, 201 bp, Homo sapiens
aggaccagagggctgtctcttctgagcctctattgtttcatctgtacaatggggacagctatgcctgcagtgggaccagaggccttcagggaacagaggcyacgctgagactcaacacctccccacaggctaagggactccatgtctgagtgtccctgtccatctgtctgctgtgtgtcagccttggtcctcctggggtca

SEQ ID NO: 63923 - DNA, 201 bp, Homo sapiens
tccctgcctgtccttgtcacccctgcctaacctgagggtgggtgacctggttccatggcccaccacaaccctgctgtctgtgtgacctgcactgaccaccrccgtgtgcctcagtttcctcatctgtgcagtgatgtggaggccagggcatgtgcagcctccccagggtgccctatcttggtttggggggccttgccctac

SEQ ID NO: 63924 - DNA, 201 bp, Homo sapiens
ggcgccaggaatctctggtgccatctcttggctgcctctggatggcttcatgcaccggcagctcccgtggtgacaaaaggggcctggcagctcccacctcrcctcctgccagcctagccacctgcgtcaagagtactggagtcctagcccggatgctggccgtccctggccccgtgccaccctgaccagtcatgctggtgg

SEQ ID NO: 63925 - DNA, 201 bp, Homo sapiens
cccgtcaggggaggtgtgggccgggacaggcaggccacacctgtgctgtgggtccatgagttgcctctctcccccggcacccgggcctcctcgcacaggcsggggagaggttcgtgtttcctccgcctccctgccaggtccctgtggagcctctgcctgggagagccctttcccctttgtttgagaggggctggggagggg

SEQ ID NO: 63926 - DNA, 201 bp, Homo sapiens
cacctgtgagcagaggaggggctggtccccactgccgcccacaaagagttgggctgagtactgaggtttcccaaggtctccatcgtggaccctgtgggccygtcaggggaggtgtgggccgggacaggcaggccacacctgtgctgtgggtccatgagttgcctctctcccccggcacccgggcctcctcgcacaggcggg

SEQ ID NO: 63927 - DNA, 201 bp, Homo sapiens
ttcagtggctgcatcagcaacgtcttcgtgcagcggtgagcctggtgggcgctgggggacaaggtcccagctggccttccgcagctgctgaccgcctgccygccctgcacaggctcctgggcccacagcgcgtatttgatctgcagcagaacctgggcagcgtcaatgtgagcacgggctgtgcacccgccctgcaagccc

SEQ ID NO: 63928 - DNA, 201 bp, Homo sapiens
cctgctggcctttttagggcccacctgggggcccacctgtgagcagaggaggggctggtccccactgccgcccacaaagagttgggctgagtactgaggtytcccaaggtctccatcgtggaccctgtgggcccgtcaggggaggtgtgggccgggacaggcaggccacacctgtgctgtgggtccatgagttgcctctct

SEQ ID NO: 63929 - DNA, 201 bp, Homo sapiens
tgggcactggcgggtcagggtcccgaggaggtgtggtgggtggccctggggtgtggcatgaccctcggaggcctgctggcctttttagggcccacctgggkgcccacctgtgagcagaggaggggctggtccccactgccgcccacaaagagttgggctgagtactgaggtttcccaaggtctccatcgtggaccctgtgg

SEQ ID NO: 63930 - DNA, 201 bp, Homo sapiens
caattcccccagctctgcacagcgcttgaatgctctctgtacacaagcacttctctttcacaagcttcgtcatgcgctctgcaccctgtcctgtgattacrtcccaaccacaatcctgtaaacacattgtcttgtggtccatttcatagggactaatgaagtatttatttaaacaacccccagtggttggaaatctaggtt

SEQ ID NO: 63931 - DNA, 201 bp, Homo sapiens
caccagcccaagcgcttctccttgccacttgggaagaaaaggagctgggtgggcaagaggagcctcggggagcatctgtggagagcccaggagcccggatrctgaccctctccagatctccgacactgggcaccacctaagcctgtctgcaccccctctggcatgggggcccacctgaaaccccccaggtgtgaacccagt

SEQ ID NO: 63932 - DNA, 201 bp, Homo sapiens
agcccagcagctcctggccaacagcactgcactagaagaggccatgctccaggaacagcagaggctgggccttggtgagtgctgggctccgatgggggccyttaggcctgctgggcatctgagctcccagggaccctcagcccccagccacatgcacacgtggggtttgtgggtcaccgcagcatggtttggggtgggaga

SEQ ID NO: 63933 - DNA, 201 bp, Homo sapiens
tcccgagtcaccctgcccagcatgctggggcgcccccattccgcctgtttcccctggggttcctggcccctggagctcactagggctccccagtctaggcytgaggcaagcaagtggtaagaatgggggtacggggtagggggaccgcagttaaataagattaaggtgacacgtggaagcgtaggtgcccggcctcggggt

SEQ ID NO: 63934 - DNA, 201 bp, Homo sapiens
agcagccatagaacgcgtattcatgagtggggttggcggcgttccaataaaactttatttacaaaagcaagcgaggagtccatagactagtttgctaatcsctggtgtaaactgacaatttatcttttcgctactgggccatagtaagcactcagtaattacctgtggctgtacagtattcactttcaatgtgttcattac

SEQ ID NO: 63935 - DNA, 201 bp, Homo sapiens
acagcaaatacaaaaattagctgggtgtagtgatgtgtgcctgtagttcgagctactccggaggctgaggtggaaggattgcttgagcctggaaggccgargctgcagtgagccatgatcacaccacagcactccagcctgggcaacagagtgagaccttgtttcaaaaaagaaaactgggcatggcacatgtatacatat

SEQ ID NO: 63936 - DNA, 201 bp, Homo sapiens
gctgggctgggctgggctgctgctgccaggactctgagctgcctgcaggaccctggtcccagccagcctctgggggcctccccgctgcaggctctgggccygcgggagagtgaccaggcctcaccccctaggattatgtactcgtggtccctgagaacgtctacagctttggctacctccgggaggagcccctggataaat

SEQ ID NO: 63937 - DNA, 201 bp, Homo sapiens
gagaaagggaggattttcatttggtcactttatttttggcttatttctttttatgcaaattatgcctattcacactggaaaaccttcggaaatataggtcrgcataaagccaaagaaaaaagttagcccaggcaacatggtaaaaccctgtctctacagcaaatacaaaaattagctgggtgtagtgatgtgtgcctgtag

SEQ ID NO: 63938 - DNA, 201 bp, Homo sapiens; identical to SEQ ID NO: 12681

SEQ ID NO: 63939 - DNA, 201 bp, Homo sapiens
tacgaccctgaggtggaccggcgccgcgccagccagagcctggatggcacctatcagggtgggggtgtctgtatcgactgccaggtgggctgggctagagkgctgggaatgggctggccccgaggtggggcagggacctccccagactcaacggccattgcactcccagcaccacaccgccggcgtcaactgtgagcgctg

SEQ ID NO: 63940 - DNA, 201 bp, Homo sapiens
agacagagatcgagacagatggagacaagcagaaacggagaaacagatagacaaagagatagagacagagacagaaatagagatggagacaagcagaaacrgagaaacagagatagacaaagagatagagacagagacagaaatagagagagagatggagacaagcagaaacggagaaacagagagatagacaagagatag

SEQ ID NO: 63941 - DNA, 201 bp, Homo sapiens
gaccaggatgcctaggagtcctgcctgctaagcgaaatctgagccttggggggtgcaaatggacccctttcccttctggctcagggaggttttgggcttaygctcgagtcctggccgaagtggaaagggcataactcagttttggagaacgcaggtctccatcctgacctgcaggcaagggggactctactgacccctgag

SEQ ID NO: 63942 - DNA, 201 bp, Homo sapiens
cagatagacaaagagatagagacagagacagaaatagagatggagacaagcagaaacggagaaacagagatagacaaagagatagagacagagacagaaakagagagagagatggagacaagcagaaacggagaaacagagagatagacaagagatagagaaatagagacagagagttgaagacagaaacagacagagaaa

SEQ ID NO: 63943 - DNA, 201 bp, Homo sapiens
gacaaagagatagagacagagacagaaatagagatggagacaagcagaaacggagaaacagagatagacaaagagatagagacagagacagaaatagagakagagatggagacaagcagaaacggagaaacagagagatagacaagagatagagaaatagagacagagagttgaagacagaaacagacagagaaagagata

SEQ ID NO: 63944 - DNA, 201 bp, Homo sapiens
aaacggagaaacagagatagacaaagagatagagacagagacagaaatagagagagagatggagacaagcagaaacggagaaacagagagatagacaagaratagagaaatagagacagagagttgaagacagaaacagacagagaaagagatacagagatagagacagaaacagagacagacagatggagacagagaggc

SEQ ID NO: 63945 - DNA, 201 bp, Homo sapiens
tcccctggggttcctggcccctggagctcactagggctccccagtctaggcctgaggcaagcaagtggtaagaatgggggtacggggtagggggaccgcarttaaataagattaaggtgacacgtggaagcgtaggtgcccggcctcggggtggacgctgcagccgtgtgccactgcatgtttaccccgggcgatgccttt

SEQ ID NO: 63946 - DNA, 201 bp, Homo sapiens
ttgcctgcttgtcatggggctgggcccgcctgcacagggcaccagcccaagcgcttctccttgccacttgggaagaaaaggagctgggtgggcaagaggakcctcggggagcatctgtggagagcccaggagcccggatgctgaccctctccagatctccgacactgggcaccacctaagcctgtctgcaccccctctggc

SEQ ID NO: 63947 - DNA, 201 bp, Homo sapiens
ggcaagaccttgggcggtgaggaccagggctcccaccctgagaggcttggagcagaggacgatgtgcctcacccagtttctgagggacccctgtggctgckgactgttcccagcaagcccaggagagatggtgggggccaggtggtgggaggtgacatggggcacatgtccagggaccagctgtggcctgagaggctgggt

SEQ ID NO: 63948 - DNA, 201 bp, Homo sapiens
gtgtggccggcgcctgctggtttataaaagccaattgcaccacactgtaagcaagttcctaaccgaatcgcagggcaacaaaaaggcacaaccccaaggcytgccccatacctgcatccagaagaaaagccgcttggaccctgccttgaacttcagcacgtagaccctcccgctggggcactgcggcacccgcttgaactc

SEQ ID NO: 63949 - DNA, 201 bp, Homo sapiens
tatttttcttcccagcggtgggcttgctgtggaaacccccggcttttccactccacgtccctctgggagaggtgtctgtgtggggcacgtttccggacccytgataggttgtgtggccgccgtgcttattcacccagctgggggccagtggagatgctcccggctgccgccccgcccctgctgtggggcttatctacgttt

SEQ ID NO: 63950 - DNA, 201 bp, Homo sapiens
gggatgactgtaggtcttgtgcagctctgggggaccccactctcccccttggggccctaggcttccaggcctacctggccaacagcacccagctgttcccrggcgtacctgctgtggggagaaactctccggaggagtgggcactggcgggtcagggtcccgaggaggtgtggtgggtggccctggggtgtggcatgaccc

SEQ ID NO: 63951 - DNA, 201 bp, Homo sapiens
gcaatctcggctcactgcaagctccacctcccaggttcgtgccattctcctgcctcatcctcctgagtagctgggactacaggcacctgccaccacacccrgctaattttttgtatttttctttagtagagatggggtttcaccttgttagccagatggtctcgatctcctgacctcgtgatccacccgccttggcttccc

SEQ ID NO: 63952 - DNA, 201 bp, Homo sapiens
gtctgggcagctggtgcccccaagggctgaagctatgaggggtctgtggtcttttcatgggggaccccacagcagtctcagtccggctcagtccagtgggrtgactgtaggtcttgtgcagctctgggggaccccactctcccccttggggccctaggcttccaggcctacctggccaacagcacccagctgttcccaggc

SEQ ID NO: 63953 - DNA, 201 bp, Homo sapiens
gcacgggtgacttgtctcctggagccctaaggcggtggccatgctcctggcatggtgcctggcctggaaggctttgaagagccccaagtctgtggagggcytgccccgtgagtggtgcctggggctgcgtggcctgtgagctgggcacacacagcaagtggcagaggggccaggggccaggcagcggtgggtcagagtcct

SEQ ID NO: 63954 - DNA, 201 bp, Homo sapiens
tccctgctgggcagggcatgtctccctgccccccacccacagggaggtagacgatgacctcagagcctggcagccggtgaataggcctgtgccccgccccmaccccggaaggctgcgcttggctcccacagtccccgcaacgccaagccctccgagaagggtgggatttggacctgggatgtctggagtcctggaaccttg

SEQ ID NO: 63955 - DNA, 201 bp, Homo sapiens
cagtgctgctgtgcccattctccgtggtggaaaagagcccaggagcagaagcggggtgggggctggggaggtccccacacccattgtcagatatcttctgygctggtcaccctggggggtgtcatgctgtcttcccacctgctttgtgagtccctgatccctgaggggtgagcagctgctcagtagctgttggcttcctcc

SEQ ID NO: 63956 - DNA, 201 bp, Homo sapiens
tctagcgggtccttccctgtccaggcacaggggccactggcccccacctggggctctctggaatgcttgtggtcaggcccacagggggctgctgaggcccrggtgtggggctgggtatagggtctgtccctgaagaggctcatacccctccctgctgggcagggcatgtctccctgccccccacccacagggaggtagacg

SEQ ID NO: 63957 - DNA, 201 bp, Homo sapiens
agggctgtaggccttgggggggattggggcacaccctgcaggaagggcacccaggagggcacagtggtcagcgtggctggaaccaaggggctggcaagacyttgggcggtgaggaccagggctcccaccctgagaggcttggagcagaggacgatgtgcctcacccagtttctgagggacccctgtggctgcggactgttc

SEQ ID NO: 63958 - DNA, 201 bp, Homo sapiens
tgatcagtgtcttcaagtcaatatttgtgcaagtgctctcagctgggaaaaatgtgactggcctgctgaaggggagggaggaggacagatcgggccgaggrgagcgcagcctccatccaggcactcagggaacagcgggggcggctcccagggggctcagtcgggacctttagtctccttcggagcctttggtgggagggg

SEQ ID NO: 63959 - DNA, 201 bp, Homo sapiens; identical to SEQ ID NO: 12692

SEQ ID NO: 63960 - DNA, 201 bp, Homo sapiens
accttcatgccctcatgaaaggcattttatcctgatgcccctctctgcagctcttcccactgccctgtgcccaggaaggggaagtgtccgctccagggccrcacaacccctgaagcctggagccggcctgggccctgggtcctgggccccgtactcctggggctcttgcccaccccctgtgaggcagtggtcaccgggcag

SEQ ID NO: 63961 - DNA, 201 bp, Homo sapiens
gacagtggtggggcaggtggaggaggctgggcctgagagcagccagtgcctggagtgggggccccagggctgacccagaggcctgcatcccagccggctcygccgctgccccagtcccagtgtgtgacacatcggtcttcacccctgtctgagcctctgtccctgccattgtcccgagggtgttagagatagaggaggtct

SEQ ID NO: 63962 - DNA, 201 bp, Homo sapiens
ttgtgtggacaaacagcagatctggtttcctgggggggcgggggagcagccaggacccagctctgccccctctcctcatccctgccccggctcccagcackacccctcccctgccaggatgcaggccaggattctgctgggagcctcctctcttccccactcacccatgcaggacaggcccccagcagatggcaggcccgg

SEQ ID NO: 63963 - DNA, 201 bp, Homo sapiens
actttctcaaactcagattgaggcctctggggcctcaatcaaccccaagcctgggagggcgcctttgtgtggacaaacagcagatctggtttcctgggggrgcgggggagcagccaggacccagctctgccccctctcctcatccctgccccggctcccagcactacccctcccctgccaggatgcaggccaggattctgc

SEQ ID NO: 63964 - DNA, 201 bp, Homo sapiens
ggctatggggcctggggctgggcagtgtgttctcaaggctgcaggccaggggctctcagggaccctctgtaggagatgcacattagctgggcatcccagawgggggtcggggtgaaccctgctgggcagctggagcaggcagagggcagggggaggttgtggccctcacagccccaggtgggcatcaggggatccctggcc

SEQ ID NO: 63965 - DNA, 201 bp, Homo sapiens
cagccccggctttcacggcttccccagctgtgtccgtgagtgcctagggaggaagtggtggggaggcaggtgcagtctccactgcgtgcccacagctatcyttgtctgcagcctgccactgctctgctgaaggctccctgcacgcagcctgtgacccccggagtgggcagtgcagctgccggccccgtgtgacggggctgc

SEQ ID NO: 63966 - DNA, 201 bp, Homo sapiens
agtaacaaaaactgaagcgtgctcacaaccctcctttcatgcgtaagttaagacatttgatacattctttctaccttcttcccaacacctgacattgtttytaaagaaactataattttaatcccagcactttgggacgccgaggcaggcggatcacgtggtcaggagatggagaccgtcctggctaacatagtgaaaccc

SEQ ID NO: 63967 - DNA, 201 bp, Homo sapiens
gggtgggggagctgcccctcaggactaggtgctgcgtaacctaccaccctccccccacccctccaccccctgccccctcccaccctcctcccacccccctmccaccctcctatgatgtggaatgagacaggggctgggtggggcactgacgtttgggaagggcctgtgggtctctagctgcccaccaaccagccttcttcc

SEQ ID NO: 63968 - DNA, 201 bp, Homo sapiens
tgcaatctcggcttactgcagcctctgcctcccaggatcaagcgattcttctgtctcagcttcccaagtagctgggactataggcacccgccaccacaccstgataattgtgtattttcagtagagatggggtttcgccgtgttggccaggctggtctcgaactcctgacttcaggtgatcctcccacctcagcctcccaa

SEQ ID NO: 63969 - DNA, 201 bp, Homo sapiens; identical to SEQ ID NO: 12696

SEQ ID NO: 63970 - DNA, 201 bp, Homo sapiens
cagctgtatgttgagcgcctaacacacgctgggccgttttcctgggaatgggaacacagggtgggaccccagcccggcctcaggagcacctgttccggggraggcagctgggaaacacgcaaaccagtactcagcgtggtgcccggagggtgtaacaccctagggtggcagtgcaggcatggggctggacagaagccactc

SEQ ID NO: 63971 - DNA, 201 bp, Homo sapiens
gggcagccaacaccccacatctgctgtgccctgtgtgcctgctttcgggggcagccgagggcactgcagagcatccacctcccgggagcccctcacaggaygggcagcagccctggtgctggcaccggcacattcctgggcctcacccagagtcctcagtaaggtagggccgggctcattctgcggagaagcaaccccagg

SEQ ID NO: 63972 - DNA, 201 bp, Homo sapiens
gcccgcccagctcccccaacctttcaggacacaacagacaacttccctgctgccccagccctgaccttcactccagtcaagcagggaccaaggcccaggayggggatggcagggtgggggcagccaacaccccacatctgctgtgccctgtgtgcctgctttcgggggcagccgagggcactgcagagcatccacctcccg

SEQ ID NO: 63973 - DNA, 201 bp, Homo sapiens
gatggtcgtcgaggggggtcactcgcactcaaagcgtgcaagggagagcggtggggggcagtgcagtccaacgggccaggccccttcagccagtgagctgyggtctctgtcacgcggcctcttggcctgtgggagcctcagtggcaaggcccggagacgtcaaggggcccgggcaccgcggggacccaggcttttctggtg

SEQ ID NO: 63974 - DNA, 201 bp, Homo sapiens
ccatcttaggagctgctgacctgtcagagggactagggggttggacctttggacctgcctggtggcagggaccactgtctggccaccaggcctggctggaygtgagggctgtggggacactggggtgtgttcctgcctccaccctggccagtccctgcctgggccgcaggtaggcctctccctagcttgctccatctgcag

SEQ ID NO: 63975 - DNA, 201 bp, Homo sapiens
accggcaggtggtgccccacgagcggcagccagggacggagatgctccgtgcagacctgcggcacgtgcctgaggctgtgcccgaggctttccccgagctrtactggcaggccccaccctcctacctgggggaccgggtaagcagggcatcaggtctgggggaggcactttgaggatggccaggacgcctgagagggttgg

SEQ ID NO: 63976 - DNA, 201 bp, Homo sapiens
aagagggcccccagcctgcaaggctgagccccgcttgctccctgcagcccagtccctgggggctcagtgggcccctggctgtgggctggtcagcatgggastgagcagagcctggggaggggtgcccggtgtgaggtgggggcaggggccccatcttaggagctgctgacctgtcagagggactagggggttggacctttg

SEQ ID NO: 63977 - DNA, 201 bp, Homo sapiens
agtgtgggtgtgcgtgttcatgtcctttcacgggcgtgtgggtgtgttagtgcacgtgtagtgggtgcatcttcacgtgcgtttgtgtgcttgttcagacrtgtgtcacacactgcgtgtggaatgtacacgggtaccccacgcggtgcacgtttgcgtgcatgtccatgagcaggtgctgtgtggtgggatggcacgtcc

SEQ ID NO: 63978 - DNA, 201 bp, Homo sapiens
tcaggctgacacacggggagaaagtaggcagagccaaggtggggctggggcaggggcttggggtttcgggggcctgggaaggagcagctttcctctgccckgggcagggctgccctgacgtgcaccgggccacagcagtgctactgccccagtgcctgggctggtggagtctccgaggcagactcagcttcaagagggccc

SEQ ID NO: 63979 - DNA, 201 bp, Homo sapiens
gctgtgaggagtgtaactgctcagggcccggcatccaggagctcacagaccctacctgtgacacagacagcggccagtgcaagtgagagcccagagcggcrtcagcgcggcccctggtggccttaaggacagcatttcctctagccagagggtcctggcacccaccctgctcccatttgtgctccctgggtgcagcagcgc

SEQ ID NO: 63980 - DNA, 201 bp, Homo sapiens
cacagacacatgggctgtccctgggtggaggtcaggctgacacacggggagaaagtaggcagagccaaggtggggctggggcaggggcttggggtttcggrggcctgggaaggagcagctttcctctgcccggggcagggctgccctgacgtgcaccgggccacagcagtgctactgccccagtgcctgggctggtggagt

SEQ ID NO: 63981 - DNA, 201 bp, Homo sapiens
tgagtagctgggactacaggcacctgccaccacacccggctaattttttgtatttttctttagtagagatggggtttcaccttgttagccagatggtctcratctcctgacctcgtgatccacccgccttggcttcccaaagtgctgggattacaggcgtgagccactgcgcccggcctatgttttagatttctttatgac

SEQ ID NO: 63982 - DNA, 201 bp, Homo sapiens
ggggagatgtccgcagctgagggttagggggaggggctgcagtcagggaaggcttctctgaggaggtgtacaaagcgtcctgtgaagactgagccaggctstcccccagccccgaggcacagacacatgggctgtccctgggtggaggtcaggctgacacacggggagaaagtaggcagagccaaggtggggctggggcag

SEQ ID NO: 63983 - DNA, 201 bp, Homo sapiens
gaccttgtttcaaaaaagaaaactgggcatggcacatgtatacatatgtaactaacctgcacaatgtgcacatgtaccctaaaacttaaagtataataaawaaaaaatagaaaaaaaaaaaaaaaagaaaattggttgggcacagtggctcacgcctgtaatcccagcacttcaggaggccaaggcaggtggatcacctga

SEQ ID NO: 63984 - DNA, 201 bp, Homo sapiens
tgagaggggctggggaggggctcaccctcccttggagcctccaggcttgtgacagggcctggagacaacttccctcctttgcccccaggtagggggagccyagggctcccctcagaggctatggcgggtgggagcacttggctgcagcaggggctgagccctggcttgcatgagtgtgaaggcggggtgctgcttgggcac

SEQ ID NO: 63985 - DNA, 201 bp, Homo sapiens
cctggcacgatattgtgtcatttttagctgcactttgactactctgtaagcttgaatcttcttgacttttcgagtgctttcttttttttttttttgatggwgtttcactctagttgcccaggctggagtgcaatgctgcaatctcagctcactgcaacctctgccccccgagttcaagtgattctcctgcctcagcttacc

SEQ ID NO: 63986 - DNA, 201 bp, Homo sapiens
gtctggtcaaacttacaaaaccctttagtcctgatacctgtttttcttttcttttttttttgtttttttgtttttgtttgagacggagtctcgctctgtcrcccagactggagtgcagtggcacgatctcggctcactgcaagctctgccttccaggttcacgccattctcctgcctcagcctcctgagtagctgggacta

SEQ ID NO: 63987 - DNA, 201 bp, Homo sapiens
tttatttatttattttgacacagagtctcactctgtcacccaggctggcgtccagttgcacgatctcggctcactgcaaccaccacctcctaggttcaagygattctcctgcctcagcctcccgagtagctgggactgattataggcgcccaccaccatacttgggtaatttttgtatttttagtagagatggggttttac

SEQ ID NO: 63988 - DNA, 201 bp, Homo sapiens
tctgtggagagcccaggagcccggatgctgaccctctccagatctccgacactgggcaccacctaagcctgtctgcaccccctctggcatgggggcccacytgaaaccccccaggtgtgaacccagtggcagcctttgggtcgggcctcggggagtgggcaggcgtgaggcatgtcacctgcacgggtgacttgtctcctg

SEQ ID NO: 63989 - DNA, 201 bp, Homo sapiens
ccagcagacacagggtgggggcagagtgtgggctctttacccagcccctgggccacattctcttgtccactgcgctgcccgcctgcctgccagttgctccyggggcagctgtctgccgggaagcagtgagcccggtgattaaccctgctggtgctggcagctccggctgacacagcgcattctcagggccggcccccgctc

SEQ ID NO: 63990 - DNA, 201 bp, Homo sapiens
taagtgtgggtgcctgtgtcacgtaagtgggtttgtgtgtcacgtgggtgcatgtgttgcgtgtcgcatgtgggcgcgtgtcgcataagtgggtgcgcgtrtcgctatcgcgtgtctcaagtgtgggtgtgcgtgttcatgtcctttcacgggcgtgtgggtgtgttagtgcacgtgtagtgggtgcatcttcacgtgcgt

SEQ ID NO: 63991 - DNA, 201 bp, Homo sapiens
tgagggctgggcagggcagtgaccagcctgtgccacaggagggacattttggtttcgatggctgcgggggctgccgcccgtgtgcttgtggaccggccgcygagggctccgagtgccacccccagagcggacagtgccactgccgaccagggaccatgggaccccagtgccgcgagtgtgcccctggctactgggggctcc

SEQ ID NO: 63992 - DNA, 201 bp, Homo sapiens
tgaaggcccaggcctcaggctggcagtggtcagggagagtgacccgacgctccatgcccacccagcccaggatcgtggccaggctgaacctgacctccccygaccttttctggctcgtcttccgatacgtcaaccggggggccatgagtgtgagcgggcgggtctctgtgcgagaggagggcaggtcggccgcctgtgcca

SEQ ID NO: 63993 - DNA, 201 bp, Homo sapiens
agatgggcaggacccctggcttccaggttggtctgggacagtcttgagggctgggcagggcagtgaccagcctgtgccacaggagggacattttggtttcratggctgcgggggctgccgcccgtgtgcttgtggaccggccgccgagggctccgagtgccacccccagagcggacagtgccactgccgaccagggaccat

SEQ ID NO: 63994 - DNA, 201 bp, Homo sapiens
gacctcccccgaccttttctggctcgtcttccgatacgtcaaccggggggccatgagtgtgagcgggcgggtctctgtgcgagaggagggcaggtcggccrcctgtgccaactgtgagtggggtccctgggccacagcccctgccccaccagcccagcccaccccaccccaccccaccccactcccaagccctgccacctt

SEQ ID NO: 63995 - DNA, 201 bp, Homo sapiens
cccccgaccttttctggctcgtcttccgatacgtcaaccggggggccatgagtgtgagcgggcgggtctctgtgcgagaggagggcaggtcggccgcctgygccaactgtgagtggggtccctgggccacagcccctgccccaccagcccagcccaccccaccccaccccaccccactcccaagccctgccaccttcctct

SEQ ID NO: 63996 - DNA, 201 bp, Homo sapiens
ggtcggccgcctgtgccaactgtgagtggggtccctgggccacagcccctgccccaccagcccagcccaccccaccccaccccaccccactcccaagcccygccaccttcctctggctcatgtgggtggtaggaccagcctatccccaaccctgtagggggtgcagcctggggtggccccaagggctgggctcaggagtct

SEQ ID NO: 63997 - DNA, 201 bp, Homo sapiens
tgtggcgccaggaatctctggtgccatctcttggctgcctctggatggcttcatgcaccggcagctcccgtggtgacaaaaggggcctggcagctcccacytcgcctcctgccagcctagccacctgcgtcaagagtactggagtcctagcccggatgctggccgtccctggccccgtgccaccctgaccagtcatgctgg

SEQ ID NO: 63998 - DNA, 201 bp, Homo sapiens
gggacgccgaggcaggcggatcacgtggtcaggagatggagaccgtcctggctaacatagtgaaaccccgtctctactaaaaatacaaaaattagccgggygtggcagcgtgcacctgtagtcccagctgctggggaggctgaggcaggagaatggtgtgaacccgggaggcagagcttgcagtgagcccagatcgtgcca

SEQ ID NO: 63999 - DNA, 201 bp, Homo sapiens
cccaaggtggacgggtcgaccagaaagcagggtcaggagaatgttctagagcctggcagggcagcattgctgccccatctgcgggcctgggcccaggactycagcttgcgggccatgcagaaggtttcagggaccagcaggtggtccacagtctctgacgatgatgttgattctgagcagctgcctccatgtcaggagctg

SEQ ID NO: 64000 - DNA, 201 bp, Homo sapiens
ggcgccacgggccactgacggcccctccccaccctgctcccaggtgtgcgcccggattctttgggaacccactggtgctgggcagctcctgccagccatgygactgcagcggcaacggtgaccccaacttgctcttcagcgactgcgaccccctgacgggcgcctgccgtggctgcctgcgccacaccactgggccccgct

SEQ ID NO: 64001 - DNA, 201 bp, Homo sapiens
cgaggggaggcacacagcaggagcgggcaagggctgggctggcccaggactctgggcatcgagggggctgggtgccccggtgccctgtccgagcagtgcgrtcagggtgctggcccggacgcctggggctaggaggggcttttcctgccccgggaattggcacaacgcccttcttcctgcagggcgggggctgagtcacag

SEQ ID NO: 64002 - DNA, 201 bp, Homo sapiens
aaggggaagtgtccgctccagggccacacaacccctgaagcctggagccggcctgggccctgggtcctgggccccgtactcctggggctcttgcccacccsctgtgaggcagtggtcaccgggcagaggcctcctctgggaaccgtggccctcccagggcaagctgggtagtggggactggagggtgcagtggctgagagg

SEQ ID NO: 64003 - DNA, 201 bp, Homo sapiens
cctttgttctgggatctggagcggatgccctgggacgggggtgggggcggctggcactgggcatcgggaaggcttcctgctcctggaaggctgaggagggyggggtgggctgcatcacggttcggatctcatacccctggtgtgcggtggggcaggggctggcgcaggggaggggagactagtccctgtggtgtccaccca

SEQ ID NO: 64004 - DNA, 201 bp, Homo sapiens
agcactacccctcccctgccaggatgcaggccaggattctgctgggagcctcctctcttccccactcacccatgcaggacaggcccccagcagatggcagkcccgggacagaagcggctgccaggctgtgtgtgtgagccattactcctcacggtggccccaggcaggtgcagccttatccccactctttggatggggaca

SEQ ID NO: 64005 - DNA, 201 bp, Homo sapiens
gccagcagcctttgttctgggatctggagcggatgccctgggacgggggtgggggcggctggcactgggcatcgggaaggcttcctgctcctggaaggctraggagggcggggtgggctgcatcacggttcggatctcatacccctggtgtgcggtggggcaggggctggcgcaggggaggggagactagtccctgtggtg

SEQ ID NO: 64006 - DNA, 201 bp, Homo sapiens
gcaggaatgcagaggaggctggcgcaagtggacattcctgggatacctgtgccgaggtggcggccactgagggttaggtggggtcgggtgcctgctctccrgtccccagctctgggctctccttggccttggaggcccctgcacaagcaggaggctgcagctgggtgcctccaagcgaagagtgaaacccccaaggtgggc

SEQ ID NO: 64007 - DNA, 201 bp, Homo sapiens
gagttcaaggccagcctggctaacatggtgaaaccccgtctctactagctgggcatggtggcgggcacctgtaatcccagctactcaggaggctgaggcargaaaatcgcttgaacccgggaggcggagcttgctgtgagccgagattgcaccactgcacccccgcctgggcaacagagcgaaactccatctcaaaaagaa

SEQ ID NO: 64008 - DNA, 201 bp, Homo sapiens
ggacttgtctcggggcagcagggtgactgtggaggaggaagggggccccggcccttctcggctatctgaccctcccgttccctctgcagggccagtactgygacatctgcacggctgccaacagcaacaaggcacaccccgcgagcaatgccatcgatggcacggagcgctggtggcagagtccaccgctgtcccgcggcc

SEQ ID NO: 64009 - DNA, 201 bp, Homo sapiens
ccccactctttggatggggacattgaggctcagcagttactgtgacttggcctcttcccaggactcggaagcagcagccaggaggcccaggcccacctgcygctgtccacacgtccactctggggccggtccccacaggcctccggaacagcttaattctgtctctctggagaccctaatccagaaggctgtgggcaagat

SEQ ID NO: 64010 - DNA, 201 bp, Homo sapiens
cccaccccaccttccccgtggaagtcctcatcaacgccggccgcgtgtggcagggtgagtgtctggtgtggggggtggagaggctaccacacacgatgagrctggaatgccggcgccacagcgtggcctgtgctacctgctatgagcgacaggcaacatgactctgtcctgccatcagttctcaaactagctgcccttgca

SEQ ID NO: 64011 - DNA, 201 bp, Homo sapiens
cctccttcatctgagagccgcgggtctgctgaccgccctggccgcggattgggcgtgtgagaagtccttgccggccggtctggagtggagctgcggttggrgcaaggcaggcaggcacaggaggtgcccaggcgatgaagccgcagctccatctgagggggctcactaaggctatggggcctggggctgggcagtgtgttc

SEQ ID NO: 64012 - DNA, 201 bp, Homo sapiens
gtggcttccctctgtcagcctcaagctgtctttaaaatgggcacagcgtgctggcccgcctcacctgagactgtgagcttggcccgaggagcctgggaagyggccacagtttcagtggcagctgtgggctgtggtgctccatgcctcagagccagcttggatgagaaaccagccggcctcgcccagctcatgtctagcaat

SEQ ID NO: 64013 - DNA, 201 bp, Homo sapiens
tggagccccccagccagaacagggtccagcgggggttagctgtgggaacctgggtgcctcctggctgcccccttatctggtcaactcagaggggccgggtytcaggacggagggcctgtgactgtctccttacctgctgccacacctcaccacagagggcctggctgagtgtccccagctgagattttgccgttctggcag

SEQ ID NO: 64014 - DNA, 201 bp, Homo sapiens
agcccaaggtggacgggtcgaccagaaagcagggtcaggagaatgttctagagcctggcagggcagcattgctgccccatctgcgggcctgggcccaggayttcagcttgcgggccatgcagaaggtttcagggaccagcaggtggtccacagtctctgacgatgatgttgattctgagcagctgcctccatgtcaggagc

SEQ ID NO: 64015 - DNA, 201 bp, Homo sapiens
aaaagtgtaagaaaatgagtttgtggagagggaaggtttgccaggaggggcgtactggggtctgcagggcatctgagactcccctgcctgtccccaccctscagattgtgactgcagcgcggcagggacccagggcaacgcctgccggaaggacccaagggtgggacgctgtctgtgcaaacccaacttccaaggcaccca

SEQ ID NO: 64016 - DNA, 201 bp, Homo sapiens
ggagcgcctcgccgccagcctggacggggctcggaccccactgctgcagaggatgcagaccttctccccggcgggcagcaagctgcgtctagtggaggccrccgaggcccacgcacagcagctgggccagctggcactcaatctgtccaggtgggtggccaggagaggaggggccctgggcccaccctggggatgcagaca

SEQ ID NO: 64017 - DNA, 201 bp, Homo sapiens
ggcctccgatatcccaaaccacagcgctggcgttcctccagacctcatcccgctgagacaacattcccagttctggagtgggagccacaaggcctcacccrcaggcccggccctagcaggagcccagcctccagccctccttcttgctcagcccccgcttcctcttgggggcttctcccgagggtacagcacccacttgga

SEQ ID NO: 64018 - DNA, 201 bp, Homo sapiens
aggccaggaaggccggactatccgttggccccatccttctggcagcaggaacctgcagaccctcggaggctggaggcaggtggcagccctgggggaaggcrggctccaggcctgggggaggggtctggctatggctcagggtcttcctgggctctgcctccattcctttgaggccagccccccagggtctgcaactccggg

SEQ ID NO: 64019 - DNA, 201 bp, Homo sapiens
tgtgcagccacacgtgtgtgcccacagttcgtggatatggagggatgggtgctgctgagcactgaccggcaggtggtgccccacgagcggcagccagggayggagatgctccgtgcagacctgcggcacgtgcctgaggctgtgcccgaggctttccccgagctgtactggcaggccccaccctcctacctgggggaccgg

SEQ ID NO: 64020 - DNA, 201 bp, Homo sapiens
ctgtgagctgggcacacacagcaagtggcagaggggccaggggccaggcagcggtgggtcagagtccttcattcctggttagtgtcaacccggagcctggwctctgtgctttccaacaaccacatgtcccagaggccatcaggagcccagcagtggcccagctggggtcacagccagggaggaaaaagcaccactccttcc

SEQ ID NO: 64021 - DNA, 201 bp, Homo sapiens
tgccgtggctgcctgcgccacaccactgggccccgctgcgagatctgtgcccccggcttctacggcaacgccctgctgcccggcaactgcacccgtaggcrtcgggctgggagggatgcaccctggggagggttgcgcggggaggagggaggcctgctgggcgtaccccgtaagtaggctgtgtgcctgatgctggggccc

SEQ ID NO: 64022 - DNA, 201 bp, Homo sapiens
aagtctgtggagggcctgccccgtgagtggtgcctggggctgcgtggcctgtgagctgggcacacacagcaagtggcagaggggccaggggccaggcagcrgtgggtcagagtccttcattcctggttagtgtcaacccggagcctggactctgtgctttccaacaaccacatgtcccagaggccatcaggagcccagcag

SEQ ID NO: 64023 - DNA, 201 bp, Homo sapiens
aggtgtgaacccagtggcagcctttgggtcgggcctcggggagtgggcaggcgtgaggcatgtcacctgcacgggtgacttgtctcctggagccctaaggyggtggccatgctcctggcatggtgcctggcctggaaggctttgaagagccccaagtctgtggagggcctgccccgtgagtggtgcctggggctgcgtggc

SEQ ID NO: 64024 - DNA, 201 bp, Homo sapiens
ccgacactgggcaccacctaagcctgtctgcaccccctctggcatgggggcccacctgaaaccccccaggtgtgaacccagtggcagcctttgggtcgggyctcggggagtgggcaggcgtgaggcatgtcacctgcacgggtgacttgtctcctggagccctaaggcggtggccatgctcctggcatggtgcctggcctg

SEQ ID NO: 64025 - DNA, 201 bp, Homo sapiens
taggtggttagatcccagggaggtcccgggccccctccctgggagttcccagggccccctactccttccctcctaaaggctggcagggtggaggctccccyacacccagctacacaggcccaggccggggcaggggcatccaggtgggatcctggactctggactttcggtcgccacgcagaccaccccacagagctccat

SEQ ID NO: 64026 - DNA, 201 bp, Homo sapiens
ctcggggcgggaagctgggcactggcgagttcttcccgcctctcctcctttgagaaactagggggctgggctgggggaggggagatggcccagtctccacrgcaaccccagggtggctgcagagccagtgggcgcagtgcccgatgtgcctgggtggggcagggaagccgggactgacactcggacccacgagcctgggct

SEQ ID NO: 64027 - DNA, 201 bp, Homo sapiens
cgtcagacccctcgacagcctccccaggaaatgtgccggttagatgttcgcgctcacagatatcccgtagtgcacactgagacatgggactcaggagagayttggctccctgagcctgcctaacaggacctgccagcccagcctgggggtcggcagggggtgccatgtcagagagagctggccagggagcagggtgggcca

SEQ ID NO: 64028 - DNA, 201 bp, Homo sapiens
aggaggtgtggtgggtggccctggggtgtggcatgaccctcggaggcctgctggcctttttagggcccacctgggggcccacctgtgagcagaggaggggytggtccccactgccgcccacaaagagttgggctgagtactgaggtttcccaaggtctccatcgtggaccctgtgggcccgtcaggggaggtgtgggccgg

SEQ ID NO: 64029 - DNA, 201 bp, Homo sapiens
tgagggggcccagctgccccgaggccaaggctgcgctgaacatgcccagggcctgcaagaagagccaggcgagggctgagctccaacccgggctgcacccyagagccacactgctcagctgccagctctgcgggtcaggcacatgaagcactggccatggtgaaggtggggcagggcctcctcctcccccctgcccactcc

SEQ ID NO: 64030 - DNA, 201 bp, Homo sapiens
aagtaggtgctacaggccccacgtgtgagcccttcgggggccagtgtccctgccatgcccatgtcattggccgtgactgctcccgctgtgccaccggatastggggcttccccaactgcaggcgtgagtaccccagtccttgggcgcccagtggcagggagttggtgccagagcccaaggtggacgggtcgaccagaaagc

SEQ ID NO: 64031 - DNA, 201 bp, Homo sapiens
aggctgcgctgaacatgcccagggcctgcaagaagagccaggcgagggctgagctccaacccgggctgcaccccagagccacactgctcagctgccagctstgcgggtcaggcacatgaagcactggccatggtgaaggtggggcagggcctcctcctcccccctgcccactccctgagcacacagtggaggacaccctgg

SEQ ID NO: 64032 - DNA, 201 bp, Homo sapiens
gagccacactgctcagctgccagctctgcgggtcaggcacatgaagcactggccatggtgaaggtggggcagggcctcctcctcccccctgcccactccckgagcacacagtggaggacaccctgggcccggcctctacctgctggaactggggcgaggtcagggtattctggatctcatccgcggtctgcggcagcgact

SEQ ID NO: 64033 - DNA, 201 bp, Homo sapiens
agctgccagctctgcgggtcaggcacatgaagcactggccatggtgaaggtggggcagggcctcctcctcccccctgcccactccctgagcacacagtggrggacaccctgggcccggcctctacctgctggaactggggcgaggtcagggtattctggatctcatccgcggtctgcggcagcgactccccagatggcaag

SEQ ID NO: 64034 - DNA, 201 bp, Homo sapiens
tgggcgcggggctcgggctagttgctgaggcagctgctggagcagaaggggctggggtggcacgggtggaagaggtggtggatgacggggtgaccgctgcmgactggctccgggagctgcgaagagagagggcaccgctggagcggacacgccccacacggcagggcctactcgcagggtccagggtgctgggccaggatt

SEQ ID NO: 64035 - DNA, 201 bp, Homo sapiens
aaagagcctggcccctccccaggccagaggagcaggaattcccaacaccaaagccaggaagaagcggggcggtggggacccacaggcctggaggagcggcrtggggcgggtggacacttgcggctgtgttctggaagcaaggtcatttctgttccatcccattacacaattcatgtgcttagattagaagattcagtccag

SEQ ID NO: 64036 - DNA, 201 bp, Homo sapiens
aagccaggaagaagcggggcggtggggacccacaggcctggaggagcggcatggggcgggtggacacttgcggctgtgttctggaagcaaggtcatttctrttccatcccattacacaattcatgtgcttagattagaagattcagtccagatcccacccaaagggacaagcatttctgaagggccaagcacacgggtctg

SEQ ID NO: 64037 - DNA, 201 bp, Homo sapiens
catgcgtaagttaagacatttgatacattctttctaccttcttcccaacacctgacattgtttctaaagaaactataattttaatcccagcactttgggasgccgaggcaggcggatcacgtggtcaggagatggagaccgtcctggctaacatagtgaaaccccgtctctactaaaaatacaaaaattagccgggtgtgg

SEQ ID NO: 64038 - DNA, 201 bp, Homo sapiens
gtgggtgggaggtgagggtgtgcaacgcactgcaagcgcccagttcctcggaggacggcgcgtggctcagtccaggctcatgtcctcctcttcgtccttcktgtccttcgtgtcgccctctttctgctcgggcttggcgttgttctgcatggctttggcaaacgcttccacatctagaacacgttaaagacacaaggtggt

SEQ ID NO: 64039 - DNA, 201 bp, Homo sapiens
tggcctccccgcaggtggggcgcgccatgactttccatggccacggcttccttcgcctggcgctctcgaacgtggcaccgctcactggcaacgtctactcyggcttcggcttccacagcgcccaggacagtgccctgctctactaccgggcgtccccggtgagacctcacacccgtgcccattccccaccccgcggtggcc

SEQ ID NO: 64040 - DNA, 201 bp, Homo sapiens
cagagccagcagaagtttaaaggaaacagagaccgggcctcaaagcattcccagcagaagctgcccgagagcccgggtggcgcacgttacccagtcctccraggccggctggtccgatgagctgcatgagctggctgtggctcatgtttcccagcaggctctgcaggccaccctcacctggaaaacactgcagctcaggcg

SEQ ID NO: 64041 - DNA, 201 bp, Homo sapiens
cagagtgaccaccctcaccctggtctcggctagtgctggcccgggtgcaggagcagctgagcagcctctgggaggagaaccaggcactggccacacaaacscgcgaccggctggcccagcacgaggccggcctcatggacctgcgagaggctttgaaccgggcagtggacgccacacgggaggcccaggagctcaacagcc

SEQ ID NO: 64042 - DNA, 201 bp, Homo sapiens
tggctcatgtttcccagcaggctctgcaggccaccctcacctggaaaacactgcagctcaggcgggcctgccccagccagatccacgcgggccccaccgcrctgcctgcgcctctgctgagcaccgcactcggctgcccctgaaccctacagggggcaccacttgaagtgaggcgacggtgggatgcagacccgtcctacc

SEQ ID NO: 64043 - DNA, 201 bp, Homo sapiens
gcagttctttgcctgtgagtctctgccgccgtggggcctggggggagaggcaggggggtccctgggcaggccctccgtgaccaggcttctgaaggtctccraatacccagccctgccctcacacccggctgctgcggtcatgactgtcagacgaggacccgaaggctcatggggatttattggctcctgtccctggcgtcg

SEQ ID NO: 64044 - DNA, 201 bp, Homo sapiens
gctctagccacaggcaaacaagcgcattcccaaaggggaaccagcttgcggacacacaggctccccgacactacgcagacagagccagcagaagtttaaasgaaacagagaccgggcctcaaagcattcccagcagaagctgcccgagagcccgggtggcgcacgttacccagtcctccgaggccggctggtccgatgagc

SEQ ID NO: 64045 - DNA, 201 bp, Homo sapiens
tctgcagggtgcgactgtaccccatgtgggacagaggcctgcgacccccacagcgggcactgcctgtgcaaggcgggcgtgactgggcggcgctgtgaccrctgccaggtagggctgtggggtaagcagggctgggtgggtggggcctagggactagagttggggcctggggagaatctgataggtggggctgaggggcag

SEQ ID NO: 64046 - DNA, 201 bp, Homo sapiens
tgtgaccggtgccgccctggctaccatggtttccccaactgccaaggtgagcagagggtcagggcaggaaggggttctgccacccacatggcgccagggcytgaccccattgtccctctgcagcatgcacctgcgaccctcggggagccctggaccagctctgtggggcgggaggtttgtgccgctgccgccccggctaca

SEQ ID NO: 64047 - DNA, 201 bp, Homo sapiens
ggtatcgccagcccggcaccacttttcctatcaatttcttgaccatgtggatttttgaaaaatggaacaccagttcaggcccttgcttataggtacttggrgctggtgtgacgacagagcagcttctttgttgatcacctgtgctgacgggcagtttatttcccaattcctctcattgagggtatggccctcccagatgtt

SEQ ID NO: 64048 - DNA, 201 bp, Homo sapiens
ttctggcgtgccctgggattgggatggttttgggagagcttttgctatacaccccagggtatcgccagcccggcaccacttttcctatcaatttcttgacyatgtggatttttgaaaaatggaacaccagttcaggcccttgcttataggtacttggggctggtgtgacgacagagcagcttctttgttgatcacctgtgc

SEQ ID NO: 64049 - DNA, 201 bp, Homo sapiens
acggagaaacagagatagacaaagagatagagacagagacagaaatagagagagagatggagacaagcagaaacggagaaacagagagatagacaagagayagagaaatagagacagagagttgaagacagaaacagacagagaaagagatacagagatagagacagaaacagagacagacagatggagacagagaggcag

SEQ ID NO: 64050 - DNA, 201 bp, Homo sapiens
gcacattcctgggcctcacccagagtcctcagtaaggtagggccgggctcattctgcggagaagcaaccccagggcacgtccgtcctttcctccctccctkcgttggttctttcagccagcagctgtatgttgagcgcctaacacacgctgggccgttttcctgggaatgggaacacagggtgggaccccagcccggcctc

SEQ ID NO: 64051 - DNA, 201 bp, Homo sapiens
gggcccgtctgcacaggctgaacgcctccatcgctgacctgcaggtactgagcgtcctggccttccctccccaacccgggccagtgcaggccttcaccttycgcctcccacagagccagctccggagccccctgggcccccaccatgagacggcacagcagctggaggtgctggagcagcagagcacaagcctcgggcagg

SEQ ID NO: 64052 - DNA, 201 bp, Homo sapiens
tccagcgccctcccctcctgccattccccgcagcctccaagagggactgtctggagcggttcgggccacagacgctggagcgcatcacacgggacgacgcrgccatctgcaccaccgagtactcacgcatcgtgcccctggagaacggagaggtgggccggggaggggcagggcggtacgggggctggagaacggagaggt

SEQ ID NO: 64053 - DNA, 201 bp, Homo sapiens
ttttttatgtggaaatgtttagtttttcatcaatagtgtaaaccaggggtcaacaaactgtcggaaaaggcccagacggtaaatgtcatagactgagggcygtgtggtccctgtggggaaactcctcagctctaccgttaccagctgtagcttgcaagcagccatagaacgcgtattcatgagtggggttggcggcgttcc

SEQ ID NO: 64054 - DNA, 201 bp, Homo sapiens
aggatgtgggtgtccaccatagctctgactgtccactctgccccaggactgccagcacaacaccgaaggggcccactgtgagcgctgccaggctggcttcrtgagcagcagggacgaccccagcaccccctgtgtcagctgcccctgccccctctcagtgccttccaacaagtaagccagcctcctcccgggacgaggccc

SEQ ID NO: 64055 - DNA, 201 bp, Homo sapiens
aggccgggggagagagcagggaaaggggcctttcagatggcaacggggtttctgagacgtgctggaaacaacattcccagagtagttaaaaagtcaacgcygaactgctctcaaatgtaacaaagaacaactaagagtttgaaaaacaaagaagactgagtgaagccgccaggcacagagctccaggctctccagggccac

SEQ ID NO: 64056 - DNA, 201 bp, Homo sapiens
gggctggggtggcacgggtggaagaggtggtggatgacggggtgaccgctgccgactggctccgggagctgcgaagagagagggcaccgctggagcggacrcgccccacacggcagggcctactcgcagggtccagggtgctgggccaggattccccactgcccctcccttaacaccgtggcacctgcgtggcaggagcga

SEQ ID NO: 64057 - DNA, 201 bp, Homo sapiens
ctgcccctgaaccctacagggggcaccacttgaagtgaggcgacggtgggatgcagacccgtcctaccccgtgaaggtgggagtggggagtgacccagggmgctcacagggtctctaacttttagaatcttctatttccacttccaaacaacctgtgctgagggggcgagtcatccacagtagactctggcctcccaggaa

SEQ ID NO: 64058 - DNA, 201 bp, Homo sapiens
cactcggctgcccctgaaccctacagggggcaccacttgaagtgaggcgacggtgggatgcagacccgtcctaccccgtgaaggtgggagtggggagtgayccagggagctcacagggtctctaacttttagaatcttctatttccacttccaaacaacctgtgctgagggggcgagtcatccacagtagactctggcctc

SEQ ID NO: 64059 - DNA, 201 bp, Homo sapiens
tagactctggcctcccaggaaaccctgagctcacgtgacacatgtgacagttaccgcctagcgcagagagttcgtggccgctgcttccgctggcccccagygccccaggcatcggggggttgttcagatactcgttgactttccggcaatgctcctcatcctggtctgtcttgggttcctgcaagaggaagggcatgtaag

SEQ ID NO: 64060 - DNA, 201 bp, Homo sapiens
agcaccccaggcgcgcacactaggcagatgccttggaaggtgagcgtgcgagggtcagcaggccccatgccccccacccagctccaggcgacagcacacgytaccttgctggccgcctgctggcccggctggtacgttcatcgtggccaggatgctctggaggtcgctcagctggatgggctgggtcgggctggctgctgt

SEQ ID NO: 64061 - DNA, 201 bp, Homo sapiens
ggggggttgttcagatactcgttgactttccggcaatgctcctcatcctggtctgtcttgggttcctgcaagaggaagggcatgtaagggcaggagctggygccagctcacccagggccaccacagccatcctctgacctggcttccaggtgagggacctgagacgcagaggcgcgtgtgcctggccacacaatgctgagg

SEQ ID NO: 64062 - DNA, 201 bp, Homo sapiens
ctgcagctggtgccccagcccctctgtacctcgggggcctgcctggtgagtgcggccttgatcaagggtgggggagctgcccctcaggactaggtgctgcrtaacctaccaccctccccccacccctccaccccctgccccctcccaccctcctcccacccccctaccaccctcctatgatgtggaatgagacaggggctg

SEQ ID NO: 64063 - DNA, 201 bp, Homo sapiens
gatctcggctcactgcaagctctgccttccaggttcacgccattctcctgcctcagcctcctgagtagctgggactacaggtgcccgccaccacgcccggmtaatttttttgtacttttagtagagatggggtttcaccgtgttaaagcaggatggtctcgatctcctgacctcatgatccacccgtcttggcctcccaaa

SEQ ID NO: 64064 - DNA, 201 bp, Homo sapiens
ttgtttctaatccagaatgtgaccacttttagattgttccaggaacattggacaggaatgtgtgttctctatggagtaccgatttggcatgttaaagcagrcttgtggccaggtgcgatggctcacgcctgtaatcccagcactttgggaggctgaggtgggcaggtcacctgaggtcgggagttcgagacgagcctgacc

SEQ ID NO: 64065 - DNA, 201 bp, Homo sapiens
agggaggcctgctgggcgtaccccgtaagtaggctgtgtgcctgatgctggggcccagccaggacaagtcggagccagccttctgggttcatggtcaaccytttctcccccgctatgatccggtcctcccgccccagcgatcaggccctcccgccccagcgatcaggccccttcaccatcaggcctcccccggaccatcac

SEQ ID NO: 64066 - DNA, 201 bp, Homo sapiens
agtggcaaggcccggagacgtcaaggggcccgggcaccgcggggacccaggcttttctggtgatccagcgccctcccctcctgccattccccgcagcctcyaagagggactgtctggagcggttcgggccacagacgctggagcgcatcacacgggacgacgcggccatctgcaccaccgagtactcacgcatcgtgcccc

SEQ ID NO: 64067 - DNA, 201 bp, Homo sapiens
aacgggccaggccccttcagccagtgagctgtggtctctgtcacgcggcctcttggcctgtgggagcctcagtggcaaggcccggagacgtcaaggggccygggcaccgcggggacccaggcttttctggtgatccagcgccctcccctcctgccattccccgcagcctccaagagggactgtctggagcggttcgggcca

SEQ ID NO: 64068 - DNA, 201 bp, Homo sapiens
gggggtcactcgcactcaaagcgtgcaagggagagcggtggggggcagtgcagtccaacgggccaggccccttcagccagtgagctgtggtctctgtcacrcggcctcttggcctgtgggagcctcagtggcaaggcccggagacgtcaaggggcccgggcaccgcggggacccaggcttttctggtgatccagcgccctc

SEQ ID NO: 64069 - DNA, 201 bp, Homo sapiens
tgagaccttgtttcaaaaaagaaaactgggcatggcacatgtatacatatgtaactaacctgcacaatgtgcacatgtaccctaaaacttaaagtataatwaaaaaaaaatagaaaaaaaaaaaaaaaagaaaattggttgggcacagtggctcacgcctgtaatcccagcacttcaggaggccaaggcaggtggatcacc

SEQ ID NO: 64070 - DNA, 201 bp, Homo sapiens
tttgtttctaatccagaatgtgaccacttttagattgttccaggaacattggacaggaatgtgtgttctctatggagtaccgatttggcatgttaaagcaracttgtggccaggtgcgatggctcacgcctgtaatcccagcactttgggaggctgaggtgggcaggtcacctgaggtcgggagttcgagacgagcctgac

SEQ ID NO: 64071 - DNA, 201 bp, Homo sapiens
agatcaagactccgtctcaaaaaaaaaaaaaaaaaaaaaaaagaaactataatttgttttgcagcttgttttgagttttgatttgtttgtattttctcttygtgttaatgcttgcagctaactaggaatctacgtaagaaataactaatgaagcgttttgatagttggcctgactttgttgcacatcactgttttcccaaa

SEQ ID NO: 64072 - DNA, 201 bp, Homo sapiens; identical to SEQ ID NO: 12704

SEQ ID NO: 64073 - DNA, 201 bp, Homo sapiens
aaaaagaaactataatttgttttgcagcttgttttgagttttgatttgtttgtattttctctttgtgttaatgcttgcagctaactaggaatctacgtaasaaataactaatgaagcgttttgatagttggcctgactttgttgcacatcactgttttcccaaacacgcctctcccttgttggaatttttttttttttttg

SEQ ID NO: 64074 - DNA, 201 bp, Homo sapiens
cacatcactgttttcccaaacacgcctctcccttgttggaatttttttttttttttgagacggagtctcaccctgtcgcccaggctggagtgcagtggtgygatctcggctcattgcaacctccgcctcccaggatcaagcgattctcctgccccagcctcccaagtagctgggattacaggggtgcaccactacgcccag

SEQ ID NO: 64075 - DNA, 201 bp, Homo sapiens
agccacaggctcggggacgctgagtctgggcgagcgcttgctgccggacagctggagaaacagcagcggggggccgtgtccatgtggcaagccaagccatsgaggggatcacaggccccttcagggaagggactgagcacctgccacctgcctccaggatgggcctgatcccccctcctgtgtaccccacaggctgcagtg

SEQ ID NO: 64076 - DNA, 201 bp, Homo sapiens
tcaggctggtctcgaactcctgacctcaagggatctgcccgcctcagcctcccaaagttccgggattacaggcgtaagcctctgcgcccagcctgtatcasctatttcttataagttgtgtgtttttctcctgatgggtcatttgccccttattttgggggggagcttttttccgtgtcctgattttgtaaattttgaggt

SEQ ID NO: 64077 - DNA, 201 bp, Homo sapiens
cctgcgcctggagctggaggaggctgccacacctgagggtcacgccgtgcgctttggcttcaaccccctcgagttcgagaacttcagctggaggggctacrcgcagatggcacctgtccaggtgggcgctgtgctccccctcccaggctcagcctagaagtggagccaggcgtggctggcagggaggggtgggcaggcccc

SEQ ID NO: 64078 - DNA, 201 bp, Homo sapiens
gcatgtccatgagcaggtgctgtgtggtgggatggcacgtccgttgctgcggagggagcagggaggtgcgtgttttcaggccgtccatgtggatgagaggyacctgtgctggtcctcagctcctgtgggaccgtgggttctggctgggcctgggacacccttggccttccgggttggtcactgggaaatgaccgaggcatg

SEQ ID NO: 64079 - DNA, 201 bp, Homo sapiens
gtggagggcgtgccaacagctgcgctcccctctctctagcctgtaactgctacggccatgccaccgactgttactacgaccctgaggtggaccggcgccgygccagccagagcctggatggcacctatcagggtgggggtgtctgtatcgactgccaggtgggctgggctagagggctgggaatgggctggccccgaggtg

SEQ ID NO: 64080 - DNA, 201 bp, Homo sapiens
gcgccgcgccagccagagcctggatggcacctatcagggtgggggtgtctgtatcgactgccaggtgggctgggctagagggctgggaatgggctggcccygaggtggggcagggacctccccagactcaacggccattgcactcccagcaccacaccgccggcgtcaactgtgagcgctgcctgcccggcttctaccgct

SEQ ID NO: 64081 - DNA, 201 bp, Homo sapiens
tgccaggtgggctgggctagagggctgggaatgggctggccccgaggtggggcagggacctccccagactcaacggccattgcactcccagcaccacaccrccggcgtcaactgtgagcgctgcctgcccggcttctaccgctctcccaaccaccctctcgactcgccccacgtctgccgccgtgagtgggctcagctggg

SEQ ID NO: 64082 - DNA, 201 bp, Homo sapiens
tattgtattcaattttctacctcatcttttttttttgagatggagtttcactctgtcgtccaggctggagtgcagttgcacgatctcggctcacttcaacytctgcctcctgggttcaagcgattctcctgcctcagtctcccgagtagctgggattacaggcacctgccaccacgcctggccaattttttgtatttttag

SEQ ID NO: 64083 - DNA, 201 bp, Homo sapiens
gtttccctcctgtccttttcgtggtgtgcagttctggttttgctgcatcgtggttagacttggcacactgatagtttctgccttttgtctttggaatttgrgattttctttgtttctaacctagaatgtgacgacttttattttttaattttatttatttatttatttatttatttatttatttatttattttgacacaga

SEQ ID NO: 64084 - DNA, 201 bp, Homo sapiens
tttttgtttttgtttgagacggagtctcgctctgtcgcccagactggagtgcagtggcacgatctcggctcactgcaagctctgccttccaggttcacgcyattctcctgcctcagcctcctgagtagctgggactacaggtgcccgccaccacgcccggctaatttttttgtacttttagtagagatggggtttcaccgt

SEQ ID NO: 64085 - DNA, 201 bp, Homo sapiens
cggagcctttggtgggaggggctgtgttgccagctccccgagaacagcctgtgtccctgcccctgtccacctctagcgggtccttccctgtccaggcacargggccactggcccccacctggggctctctggaatgcttgtggtcaggcccacagggggctgctgaggcccaggtgtggggctgggtatagggtctgtccc

SEQ ID NO: 64086 - DNA, 201 bp, Homo sapiens
cagggcgcaggaaccccagctccctccagtcctccagccccaccgctcggccagccaccctcctctgaagtacccagctggggtcctcaccaggggcccakaagccctcgcctacccagctctagccacaggcaaacaagcgcattcccaaaggggaaccagcttgcggacacacaggctccccgacactacgcagacaga

SEQ ID NO: 64087 - DNA, 201 bp, Homo sapiens
ctgtccacatggctacggctgccgcaccctggtggtgtgtgagggccaggccctgctggacgtgacccacagcgagctcactgtgaccgtgcgtgtgcccragggccggtggctctggctggtgagtcccagctgatgtcctgctcagggaccagctgtccttatacttgtcattaccactgtggtacacttgggctgggt

SEQ ID NO: 64088 - DNA, 201 bp, Homo sapiens
tcaggagttcaaggccagcctggctaacatggtgaaaccccgtctctactagctgggcatggtggcgggcacctgtaatcccagctactcaggaggctgargcaggaaaatcgcttgaacccgggaggcggagcttgctgtgagccgagattgcaccactgcacccccgcctgggcaacagagcgaaactccatctcaaaa

SEQ ID NO: 64089 - DNA, 201 bp, Homo sapiens
gccacacctgagggtcacgccgtgcgctttggcttcaaccccctcgagttcgagaacttcagctggaggggctacgcgcagatggcacctgtccaggtggrcgctgtgctccccctcccaggctcagcctagaagtggagccaggcgtggctggcagggaggggtgggcaggccccttgaaggcccaggcctcaggctggc

SEQ ID NO: 64090 - DNA, 201 bp, Homo sapiens
cgttcccagaaaagcctgggtctcgcctctgtctcgtgcgttgggaagccccgttgtgctccatggcacgtggcgaattgagggcttgccccaggatgccsctggcagcacatgtggccctgtgtgtttgtctggttcctggctcggccaagcctggggtcccgcacatggagttgaccggtacctagaggtgtcccgcat

SEQ ID NO: 64091 - DNA, 201 bp, Homo sapiens
atcgaggggatcacaggccccttcagggaagggactgagcacctgccacctgcctccaggatgggcctgatcccccctcctgtgtaccccacaggctgcartgcacctgccagcacaacacctgcgggggcacctgcgaccgctgctgccccggcttcaatcagcagccgtggaagcctgcgactgccaacagtgccaacg

SEQ ID NO: 64092 - DNA, 201 bp, Homo sapiens
cccccgggagtgccagctgggctcctggcctgggtcccgctgcgcccagccgtggaggggttctctctccaagggtggggcctcaggaagaggctccagcrctggtcactggtgactcagggggcagtttccgagttccagacgtgaccttccccagggggtccttctagggggttcttgcgtatctccttgcatcctccg

SEQ ID NO: 64093 - DNA, 201 bp, Homo sapiens
gccccctggaggcgggcctgttcttcccaggcagcgggggagttatcactttaggtctgtgggtgctggcatcccaggccccagcagggcagggcaggggkctccaggaggttctggggaggggccccccctttcttctccatcacaacccctccccgcagacctcccaggagctacactgcctgatgtgggcctggaact

SEQ ID NO: 64094 - DNA, 201 bp, Homo sapiens
agacagagatgtgggagacaccaggaggtctcatgaatgctgctgcctcctcacgcccccgaaagctgctgtttggcttggagtggcctcccctgagcagycagggcccagggctgggctgggctgggctgctgctgccaggactctgagctgcctgcaggaccctggtcccagccagcctctgggggcctccccgctgca

SEQ ID NO: 64095 - DNA, 201 bp, Homo sapiens
aacagcagccaggtgctggcccacctccagccggccgaggccaggagttcctgaccagcctctgacccagcggtgaccatgctccacgggttcccagtgcmtcgtgcctgcaggatccctgagggtctgacttgtgagcttgcagggtggggcccctcgtcctctcaatcgctgatgccacctgcccccgtacaccctcag

SEQ ID NO: 64096 - DNA, 201 bp, Homo sapiens
ctgctaccgtgagcacctgccaggggcatccaaacagacaccactgcctgctggactccgggagccctgcagggggtggaggggttccccgggatggaccrtgttatcctgcctgcatctccgattgtgctgagagaccaagggtggcagggggtgtagggtgctagggttctgagcagacctggccaacatgcgtgtctc

SEQ ID NO: 64097 - DNA, 201 bp, Homo sapiens
cccaagctgctaccgtgagcacctgccaggggcatccaaacagacaccactgcctgctggactccgggagccctgcagggggtggaggggttccccgggayggaccatgttatcctgcctgcatctccgattgtgctgagagaccaagggtggcagggggtgtagggtgctagggttctgagcagacctggccaacatgcg

SEQ ID NO: 64098 - DNA, 201 bp, Homo sapiens
agggtgctagggttctgagcagacctggccaacatgcgtgtctcttcccctcagcgacgccctcgtcctccaatgacaccagggagcaggtgctgccagcyggccagattgtgagtaagtgtccttgaggcccccaggtccccggcctgccctggagccatgggggcggcttcacagaaagttcctggagaaagggaggat

SEQ ID NO: 64099 - DNA, 201 bp, Homo sapiens
ccgcttgaactcacagtcgtcagggaagatgatcaagtcctggcaagccaggggaagagagagtcagtggcgcagatggcatcactgtgcccagtctcagkagagcgtactgagccctgggtctaaccgggtggggtgcgcaaggggcagctaagccgccagacccctcgctggcagggtctccacaaggcagagaagcca

SEQ ID NO: 64100 - DNA, 201 bp, Homo sapiens
cagtgttccagccctggagtggccgatgaccgctgtgaccctgacacaggccagtgcaggtgccgagtgggcttcgagggggccacatgtgatcgctgtgyccccggctactttcacttccctctctgccagtgtgagtggtgcctctccacgtgggcgtgggtaggggaggcccgtgggcctggcctaccgtgacacccg

SEQ ID NO: 64101 - DNA, 201 bp, Homo sapiens
ccgtgagtgcctagggaggaagtggtggggaggcaggtgcagtctccactgcgtgcccacagctatccttgtctgcagcctgccactgctctgctgaaggstccctgcacgcagcctgtgacccccggagtgggcagtgcagctgccggccccgtgtgacggggctgcggtgtgacacgtgtgtgcccggtgcctacaact

SEQ ID NO: 64102 - DNA, 201 bp, Homo sapiens
atgaggccggccgctgcctatgccagcctgagtttgccggacctcattgtgaccggtgccgccctggctaccatggtttccccaactgccaaggtgagcaragggtcagggcaggaaggggttctgccacccacatggcgccagggcctgaccccattgtccctctgcagcatgcacctgcgaccctcggggagccctgga

SEQ ID NO: 64103 - DNA, 201 bp, Homo sapiens
cctgccactgctctgctgaaggctccctgcacgcagcctgtgacccccggagtgggcagtgcagctgccggccccgtgtgacggggctgcggtgtgacacrtgtgtgcccggtgcctacaacttcccctactgcgaaggtgagcaggcaggtggctgtgtgcaccaggtgccgggcctgtgtgtgggtctgtgctgttcac

SEQ ID NO: 64104 - DNA, 201 bp, Homo sapiens
aggctggcagggtggaggctcccctacacccagctacacaggcccaggccggggcaggggcatccaggtgggatcctggactctggactttcggtcgccaygcagaccaccccacagagctccatgaggcccccccatttctgagcaccccaggtttgcctgcttgtcatggggctgggcccgcctgcacagggcaccagc

SEQ ID NO: 64105 - DNA, 201 bp, Homo sapiens
gtcccagggctgggggaggatctgagaccccttccccagggccaggagtgcccctacttctctcgggctgccactgacccctgcccccgacccacctcctytggggctccatcaccctggagctgggtgggcaggggctctggatcttggattgtccctggagggcagccagagcctggtgggacagaggctcctccacgg

SEQ ID NO: 64106 - DNA, 201 bp, Homo sapiens
ggcaggtgcagccttatccccactctttggatggggacattgaggctcagcagttactgtgacttggcctcttcccaggactcggaagcagcagccaggaggcccaggcccacctgccgctgtccacacgtccactctggggccggtccccacaggcctccggaacagcttaattctgtctctctggagaccctaatccag

SEQ ID NO: 64107 - DNA, 201 bp, Homo sapiens
ctgtgacttggcctcttcccaggactcggaagcagcagccaggaggcccaggcccacctgccgctgtccacacgtccactctggggccggtccccacaggcctccggaacagcttaattctgtctctctggagaccctaatccagaaggctgtgggcaagatctggaggtggggcggggtctggccgcctggatcccggcc

SEQ ID NO: 64108 - DNA, 201 bp, Homo sapiens
ccttctagggggttcttgcgtatctccttgcatcctccggaagcttctggaactgagcggccacatcactggcctcaggctccttcttccgagaaccacaccccaggccccaggccccaggcccagggaagggtgagcgcgttcatgactgcccaggcacatggccagcgggtcctggcttgagctcccccaccccctggc

SEQ ID NO: 64109 - DNA, 201 bp, Homo sapiens
tcttctccaggactttttatggtctttttgccattggtgttctgcagatttattgtgatgtgttgaggattgggatttttttcttgctcaggactcacgctttttttttttttttttttttttgagatggagtctcactctgttgcccagactggcgtgcagtggcacgatctcggctcactgcaagctccgcctcccggg

SEQ ID NO: 64110 - DNA, 201 bp, Homo sapiens
cagaaagcctaccagggaggtgccagggctgcagatagcacagacagccccagccgtcgggagcctggcaagcttggaagtgctttgggtagaaatggagktataggtgggagggctgtaggccttgggggggattggggcacaccctgcaggaagggcacccaggagggcacagtggtcagcgtggctggaaccaagggg

SEQ ID NO: 64111 - DNA, 201 bp, Homo sapiens
gactcacgctttttttttttttttttttttttgagatggagtctcactctgttgcccagactggcgtgcagtggcacgatctcggctcactgcaagctccrcctcccgggttcatgccattctcccacctcagcctcctgagtagctgggactacaggcacccaccaccacgcctggctatttttttttgtatttttagta

SEQ ID NO: 64112 - DNA, 201 bp, Homo sapiens
ctacaggcacccaccaccacgcctggctatttttttttgtatttttagtagaaacggggtttcaccatgttagccaagatggtctcgatctcctgacctcrtgatccacctgcctcggcctcccaaagtgctgggattacaggtgtgagccactgcgcctggccatgtgttcattattaattcaagaccatccttggccat

SEQ ID NO: 64113 - DNA, 201 bp, Homo sapiens
gagatggggttttaccatgttggccaggctgatctcgaactcctgacctcagttgatccacccacctcagcctcctaaagtgctaggattacaggcatgarccactgcgcctggcagtttctgccttttgtttttggaatttgagattttctttgtttctaatccagaatgtgaccacttttagattgttccaggaacatt

SEQ ID NO: 64114 - DNA, 201 bp, Homo sapiens
tctgtggtcttttcatgggggaccccacagcagtctcagtccggctcagtccagtgggatgactgtaggtcttgtgcagctctgggggaccccactctccyccttggggccctaggcttccaggcctacctggccaacagcacccagctgttcccaggcgtacctgctgtggggagaaactctccggaggagtgggcactg

SEQ ID NO: 64115 - DNA, 201 bp, Homo sapiens
tagtggaggccgccgaggcccacgcacagcagctgggccagctggcactcaatctgtccaggtgggtggccaggagaggaggggccctgggcccaccctgrggatgcagacagggccttgggagggccagctggtctgggaaggctcctaggggctgaggccgttgtcctcaaagaagccaggccttcctcagctccacgg

SEQ ID NO: 64116 - DNA, 201 bp, Homo sapiens
tctgctcgggcttggcgttgttctgcatggctttggcaaacgcttccacatctagaacacgttaaagacacaaggtggtgtctaacccttgcccagaactkgggatcaaagcgatgggatcaagggcagaagggctgtgacctttaccccctcagccccacttctgcagatccagggggacaggaatggaccctgcccctg

SEQ ID NO: 64117 - DNA, 201 bp, Homo sapiens
agccggtgagtctgaggaccaaggtgtgggggatttgggggcacactggtcaggaccctcccctgccccacttcacctcctcccttggcccccagggcacyggccagtgcttctgcaagccccacgtgtgcggccaggcctgcgcgtcctgcaaggatggcttctttggactggatcaggctgactattttggctgccgca

SEQ ID NO: 64118 - DNA, 201 bp, Homo sapiens
gaccctcccctgccccacttcacctcctcccttggcccccagggcaccggccagtgcttctgcaagccccacgtgtgcggccaggcctgcgcgtcctgcamggatggcttctttggactggatcaggctgactattttggctgccgcagtgagtgcccactcgctcgtcccagaccacagccctgcctcccctcggtttat

SEQ ID NO: 64119 - DNA, 201 bp, Homo sapiens
gagtgcccactcgctcgtcccagaccacagccctgcctcccctcggtttatgctggggaacccaaggcccggagggacaagtgcagcctgggcagcatgargcccgggtgatggatggctgccccttggtgccagcctgtgccagggtgtgggagagggggtgcagctcccacccagatgcgtggcttcctctcccctgtc

SEQ ID NO: 64120 - DNA, 201 bp, Homo sapiens
tatgctggggaacccaaggcccggagggacaagtgcagcctgggcagcatgaggcccgggtgatggatggctgccccttggtgccagcctgtgccagggtrtgggagagggggtgcagctcccacccagatgcgtggcttcctctcccctgtcctacacctgggcagacggcactaacagatcccagcgccctcaccctcg

SEQ ID NO: 64121 - DNA, 201 bp, Homo sapiens
tgccggtgccgccccaacacccagggccccacctgcagcgagtgggtaccccttccccactgggtggtggggagcggggcaggcagcttgtcctccgggcmtctccgtgtccctcaccatgggcccacgtgaggcctcaccctccctggagatccggggccgctgtgcagggctaggtaggatggccaagctgcacctgac

SEQ ID NO: 64122 - DNA, 201 bp, Homo sapiens
ggaccccacggagcaatgggtgttgcaggaccttggcctgggggctgggggtcctgtggcggtggcaggttataggagcagggcgctgcctcaggcaatgsagcccagcacccaggcagggcgcccctgcctcctgcctcctgcctcctgcctcctgcctcctgcctcctgcctcctgcctcctgcctcctgcctcctgcc

SEQ ID NO: 64123 - DNA, 201 bp, Homo sapiens
ccacagcaccctgtgccggggcactgcccgggatacccaggaccacctggctgtcttccacctggactcggaggccagcgtgaggctcacagccgagcagkcacgcttcttcctggtaaggacccctcaggtccccaccccaaggggtcagcttctttcagaagatttgaaacatgcatgagaggggagaggacagttggg

SEQ ID NO: 64124 - DNA, 201 bp, Homo sapiens
attttattttattcttttttgagacagagtatcacactcttgcccaggctggagtgcagtggtgcaatctcggctcactgcaagctccacctcccaggttygtgccattctcctgcctcatcctcctgagtagctgggactacaggcacctgccaccacacccggctaattttttgtatttttctttagtagagatggggt

SEQ ID NO: 64125 - DNA, 201 bp, Homo sapiens
ttctggaattgggatgcgtcttttgcttgatggcatatcacagtctagttggtagggtttttccctttcatgacgggacatacaagcatggcatctttccyagtgagtggggtcttagacttagattgtatttgatatgacgtcttttttttttttttttttgagatggagtttcgctctttttacccaggctggaatgtg

SEQ ID NO: 64126 - DNA, 201 bp, Homo sapiens
ctctgcagggccagtactgtgacatctgcacggctgccaacagcaacaaggcacaccccgcgagcaatgccatcgatggcacggagcgctggtggcagagyccaccgctgtcccgcggcctggagtacaacgaggtcaacgtcaccctggacctgggccaggtagggacccttctttgcgtgctgcagcccccatctctgt

SEQ ID NO: 64127 - DNA, 201 bp, Homo sapiens
cccccgtcacactgccacatcccctagggctgcattctgggcctctgagaggggcgggactgggaagaggggtcagtaaaccctgtacccgccccacagcytgtgactgcggtgcccgcctctgtgacgagctcacgggccagtgcatctgcccgccacgcaccatcccgcccgactgcctactgtgccagccccagacct

SEQ ID NO: 64128 - DNA, 201 bp, Homo sapiens
cctgatacctgtttttcttttcttttttttttgtttttttgtttttgtttgagacggagtctcgctctgtcgcccagactggagtgcagtggcacgatctyggctcactgcaagctctgccttccaggttcacgccattctcctgcctcagcctcctgagtagctgggactacaggtgcccgccaccacgcccggctaatt

SEQ ID NO: 64129 - DNA, 201 bp, Homo sapiens
acagaggcaggggagggcctgctggagccgtggtcctgtgggggaggagggcacaggcaggccaggccccaggggtagaggctcagggtcccgagtcaccytgcccagcatgctggggcgcccccattccgcctgtttcccctggggttcctggcccctggagctcactagggctccccagtctaggcctgaggcaagcaa

SEQ ID NO: 64130 - DNA, 201 bp, Homo sapiens
ggtcacctgaggtcgggagttcgagacgagcctgaccaacatggagaaaccccgtctctactaaaaatacaaaataagctgtgcatggtggcgcatgcctrtaatcccagctactcgggaggctgaggcgggagaatggctcgaacccgggaggtagggtttgcagtgagctgagatggcgccactgcactccagcctggg

SEQ ID NO: 64131 - DNA, 201 bp, Homo sapiens
gtgggagacaccaggaggtctcatgaatgctgctgcctcctcacgcccccgaaagctgctgtttggcttggagtggcctcccctgagcagccagggcccabggctgggctgggctgggctgctgctgccaggactctgagctgcctgcaggaccctggtcccagccagcctctgggggcctccccgctgcaggctctgggc

SEQ ID NO: 64132 - DNA, 201 bp, Homo sapiens
cccccggggctcagcggggagcgctgcgacacctgcagccagcagcatcaggtgcctgttccaggcgggcctgtgggccacagcatccactgtgaaggtgygtcctcaacaccccacttccccacacctgatggagtaggaatccaagtcccacacagcctggtgaccccagtgttaacgtcgacctcccagagtggtccc

SEQ ID NO: 64133 - DNA, 201 bp, Homo sapiens
ggcagcattgctgccccatctgcgggcctgggcccaggacttcagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcaca

SEQ ID NO: 64134 - DNA, 201 bp, Homo sapiens
gcagcattgctgccccatctgcgggcctgggcccaggacttcagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcacac

SEQ ID NO: 64135 - DNA, 201 bp, Homo sapiens
aggtggacgtccagcttcaagtggcagtgccacagccaggccgctatgccctagtggtggagtacgccaatgaggatgcccgccaggaggtgggcgtggcygtgcacaccccacagcgggccccccagcaggggctgctctccctgcacccctgcctgtacaggtgagtgggagccggtggggctggagtaagggcacgcc

SEQ ID NO: 64136 - DNA, 201 bp, Homo sapiens
cagcattgctgccccatctgcgggcctgggcccaggacttcagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcacact

SEQ ID NO: 64137 - DNA, 201 bp, Homo sapiens
gggcatccacccatgtgcagccacacgtgtgtgcccacagttcgtggatatggagggatgggtgctgctgagcactgaccggcaggtggtgccccacgagyggcagccagggacggagatgctccgtgcagacctgcggcacgtgcctgaggctgtgcccgaggctttccccgagctgtactggcaggccccaccctccta

SEQ ID NO: 64138 - DNA, 201 bp, Homo sapiens
gtgtgcacacttgcgtgcagagcccgccctcagggtcgtggatcaggtggctgtgagcaggatgaggggctaagtccactcaaattccaggagctggagcrcctcgccgccagcctggacggggctcggaccccactgctgcagaggatgcagaccttctccccggcgggcagcaagctgcgtctagtggaggccgccgag

SEQ ID NO: 64139 - DNA, 201 bp, Homo sapiens
ggcagccagagcctggtgggacagaggctcctccacggccctcccctggcgagccacctccttttaccctcccctccactcccagactgggcagctccctyctgtggattcaggacaggacgtgtttgggggtggggtgccgtctgacctgttgcagggaggaggactacgtcacgggcgggtgcccgaaagatgcccagt

SEQ ID NO: 64140 - DNA, 201 bp, Homo sapiens
gagcccgccctcagggtcgtggatcaggtggctgtgagcaggatgaggggctaagtccactcaaattccaggagctggagcgcctcgccgccagcctggayggggctcggaccccactgctgcagaggatgcagaccttctccccggcgggcagcaagctgcgtctagtggaggccgccgaggcccacgcacagcagctgg

SEQ ID NO: 64141 - DNA, 201 bp, Homo sapiens
caatctcggctcactgcaagctccacctcccaggttcgtgccattctcctgcctcatcctcctgagtagctgggactacaggcacctgccaccacacccgrctaattttttgtatttttctttagtagagatggggtttcaccttgttagccagatggtctcgatctcctgacctcgtgatccacccgccttggcttccca

SEQ ID NO: 64142 - DNA, 201 bp, Homo sapiens
gggtctgtgctgttcacacgctgcctgccttcctgtgaggctgttcacgtgcatcttgctgtgtgtactgcgactgcgtccccacgctctgtgttcgcacyttgttcacatgccgtgcaggggtgtccgcgtactgcccgtgtctgcgtgctgtgcatccgcgcctgtcgtgtctcgtatgggtgcatgtgttgcgttctg

SEQ ID NO: 64143 - DNA, 201 bp, Homo sapiens
ctaagccgccagacccctcgctggcagggtctccacaaggcagagaagccagggtcagagacagcccatgaaaggcaaggccgggggagagagcagggaarggggcctttcagatggcaacggggtttctgagacgtgctggaaacaacattcccagagtagttaaaaagtcaacgctgaactgctctcaaatgtaacaaa

SEQ ID NO: 64144 - DNA, 201 bp, Homo sapiens
cacggagcgctggtggcagagtccaccgctgtcccgcggcctggagtacaacgaggtcaacgtcaccctggacctgggccaggtagggacccttctttgcrtgctgcagcccccatctctgtgtctgtgcccgtcgggcctaccttgggccacaggaccagaaggcgaggtctccaccgtgagcgagacctggggcctggg

SEQ ID NO: 64145 - DNA, 201 bp, Homo sapiens
ttcagcccggagttcgtggagccccgggtcagctgcatcagcagccacggcgcctttggccccaacaggtaatggcaggtaatggggctgggaggggcgcrgccgagggcccggcggcagggccggctctgactcacccactgtgctctcaccagtgccgcctgtctgccctcgcgcttcccaaagccgccccagcccatc

SEQ ID NO: 64146 - DNA, 201 bp, Homo sapiens
ttcccaaagccgccccagcccatcatcctcagggactgccaggtgatcccgctgccgcccggcctcccgctgacccacgcgcaggatctcactccagccaygtccccagctggaccccgacctcggccccccaccgctgtggaccctgatgcagagcccaccctgctgcgtgagccccaggtgagggccatagtctctaga

SEQ ID NO: 64147 - DNA, 201 bp, Homo sapiens
cagctggaccccgacctcggccccccaccgctgtggaccctgatgcagagcccaccctgctgcgtgagccccaggtgagggccatagtctctagagggacrggggtgtcagggcaggactccgggtcccaacccagggcaggttgtccagggggcggcaggggctcatagctcagcctgctcactagggcctatccctgca

SEQ ID NO: 64148 - DNA, 201 bp, Homo sapiens
cctgctgcgtgagccccaggtgagggccatagtctctagagggacgggggtgtcagggcaggactccgggtcccaacccagggcaggttgtccagggggcrgcaggggctcatagctcagcctgctcactagggcctatccctgcaggccaccgtggtcttcaccacccatgtgcccacgctgggccgctatgccttcctg

SEQ ID NO: 64149 - DNA, 201 bp, Homo sapiens
gcccgccacgcaccatcccgcccgactgcctactgtgccagccccagacctttggctgccaccccctggtcggctgtgaggagtgtaactgctcagggccyggcatccaggagctcacagaccctacctgtgacacagacagcggccagtgcaagtgagagcccagagcggcgtcagcgcggcccctggtggccttaagga

SEQ ID NO: 64150 - DNA, 201 bp, Homo sapiens
agacccaacgtgactgggcgccgctgtgatacctgctctccgggcttccatggctacccccgctgccgcccctgtgactgtcacgaggcgggcactgcgcytggcgtgtgtgaccccctcacagggcagtgctactgtaaggtgagtgagggctgggcccagatctggcctctccctccggcctcatcagctgaaagtgtc

SEQ ID NO: 64151 - DNA, 201 bp, Homo sapiens
ggggtgcctacgaggtctcactttggtgtgagtgacctggggtggagggggctcagctcccgcccctgccacaggtgcagacccaacgtgactgggcgccrctgtgatacctgctctccgggcttccatggctacccccgctgccgcccctgtgactgtcacgaggcgggcactgcgcctggcgtgtgtgaccccctcaca

SEQ ID NO: 64152 - DNA, 201 bp, Homo sapiens
tccttttagagttctttgttattcttggtgcttaccctctgtcagacttcagagtaacaaccgtcttctcccctctcacagctcatctggtttttctttgtttttttttttttgtttgtttgttttttgagacagtcttgctctgtcgcccaggctggggtgcagtggtgcaatctcggcttactgcagcctctgcctccc

SEQ ID NO: 64153 - DNA, 201 bp, Homo sapiens
gtcacgaggcgggcactgcgcctggcgtgtgtgaccccctcacagggcagtgctactgtaaggtgagtgagggctgggcccagatctggcctctccctccrgcctcatcagctgaaagtgtccttacgggcctttcggggcagctggggcttcctagaagcttttgggagagtcatccccattggcaggtgggtaccagga

SEQ ID NO: 64154 - DNA, 201 bp, Homo sapiens
aatcagaccctccccataccaggatcacatcccccctcccctacccatgatcaggcccccaccttcaccatcagaccctccccccaacccatgaccagcgccccccccacctcacgatcacatcccctctccccccacaatcagtcccccctcatggttagacaccaccaccaatgccccaccactggcagcggacaccag

SEQ ID NO: 64155 - DNA, 201 bp, Homo sapiens
ggcccccaccttcaccatcagaccctccccccaacccatgaccagcgccccccccacctcacgatcacatcccctctccccccacaatcagtcccccctcrtggttagacaccaccaccaatgccccaccactggcagcggacaccagccgtcagagcagggcaggccatggcagggagtctgcaggtccctcgggcccag

SEQ ID NO: 64156 - DNA, 201 bp, Homo sapiens
aggggctccctgggggggtgagagggcccagggctgcagtcacggaccccttctgcagggtgcgactgtaccccatgtgggacagaggcctgcgacccccrcagcgggcactgcctgtgcaaggcgggcgtgactgggcggcgctgtgaccgctgccaggtagggctgtggggtaagcagggctgggtgggtggggcctag

SEQ ID NO: 64157 - DNA, 201 bp, Homo sapiens
cgccacccctcgtctctgtgcccacccgccacccctcgtctgtgcccactcgccatccctcgtctctccgtgcccactcgccacccctcgtctctgtgcccactcgccacccctcgtctctgtgcccactcgccacccgtctctccatgcccactcgccacccctcgtctctccgtgcccactcgccacccctcatctctc

SEQ ID NO: 64158 - DNA, 201 bp, Homo sapiens
gccacccctcgtctctgtgcccacccgccacccctcgtctgtgcccactcgccatccctcgtctctccgtgcccactcgccacccctcgtctctgtgcccactcgccacccctcgtctctgtgcccactcgccacccgtctctccatgcccactcgccacccctcgtctctccgtgcccactcgccacccctcatctctcc

SEQ ID NO: 64159 - DNA, 201 bp, Homo sapiens
tgcagacccaacgtgactgggcgccgctgtgatacctgctctccgggcttccatggctacccccgctgccgcccctgtgactgtcacgaggcgggcactgygcctggcgtgtgtgaccccctcacagggcagtgctactgtaaggtgagtgagggctgggcccagatctggcctctccctccggcctcatcagctgaaagt

SEQ ID NO: 64160 - DNA, 201 bp, Homo sapiens
cgttgttaggtcaaataactaactgtctctgggaccctacagcagctccccacgctagcacctgtccagccgaaactccctttgggcaaagaaactaagcrttggcaggtaaaagaaaagactttattaataatcagtgggtgggaggtgagggtgtgcaacgcactgcaagcgcccagttcctcggaggacggcgcgtgg

SEQ ID NO: 64161 - DNA, 201 bp, Homo sapiens
gaagattcagtccagatcccacccaaagggacaagcatttctgaagggccaagcacacgggtctgcactccatgagctggcagcaggcaggcagccatgtrgggccaggggacccagggcgcaggaaccccagctccctccagtcctccagccccaccgctcggccagccaccctcctctgaagtacccagctggggtcct

SEQ ID NO: 64162 - DNA, 201 bp, Homo sapiens
ggggaggtagagactgccacatcttggagcccaccccttgagtcctggtagctccaggcttacccggctcctgcccctgcccaggctgcaactgcgagtcygacttcacggatggcacctgcgaggacctgacgggtcgatgctactgccggcccaacttctctggggagcggtgtgacgtgtgtgccgagggcttcacgg

SEQ ID NO: 64163 - DNA, 201 bp, Homo sapiens
gggactggggtgtctggaatgagtctgggtccccaggccggccggctgacctggctgccgtccccaggatgggctatgccaggtgtccctgcagcagggcygtgtgagcctacagctcctgaggactgaagtgaaaactcaagcgggcttcgccgatggtgccccccattacgtcgccttctacagcaatgccacggggtg

SEQ ID NO: 64164 - DNA, 201 bp, Homo sapiens
cccctctggcatgggggcccacctgaaaccccccaggtgtgaacccagtggcagcctttgggtcgggcctcggggagtgggcaggcgtgaggcatgtcacytgcacgggtgacttgtctcctggagccctaaggcggtggccatgctcctggcatggtgcctggcctggaaggctttgaagagccccaagtctgtggaggg

SEQ ID NO: 64165 - DNA, 201 bp, Homo sapiens
cccacccccttggccctggtggagggggaaggagcctccccaggcttctgggctcaccgttctctccttaagcccagcacagtcctctgagataggaggtytcaagcccacacttcagatgggggatctgagccctggaaagctgctgacacctgcttggagccccccagccagaacagggtccagcgggggttagctgtg

SEQ ID NO: 64166 - DNA, 201 bp, Homo sapiens
cgctgcttctgctttggggccacggagcgctgccggagctcgtcctacacccgccaggaggtgcgcctgcaggactgagggcattgccttctcggggaggkcttaggtgggactggatgcaagatggggccctgtgatgtgtgggcatccacccatgtgcagccacacgtgtgtgcccacagttcgtggatatggagggat

SEQ ID NO: 64167 - DNA, 201 bp, Homo sapiens
caggaggtgcgcctgcaggactgagggcattgccttctcggggagggcttaggtgggactggatgcaagatggggccctgtgatgtgtgggcatccacccrtgtgcagccacacgtgtgtgcccacagttcgtggatatggagggatgggtgctgctgagcactgaccggcaggtggtgccccacgagcggcagccaggga

SEQ ID NO: 64168 - DNA, 201 bp, Homo sapiens
gctgacgggctctgagcctgtggccagagtctggccaggtcacctctgtctgtcctgcctccaggtgtcatcctacggtgggaccctccgttatgaactgyactcagagacccagcggggagatgtctttgtccccatggagagcaggccggatgtggtgctgcaggtgagggagctgagatgatgtggcagggtggttgg

SEQ ID NO: 64169 - DNA, 201 bp, Homo sapiens
tgcccctctccctgctcacctccccaaccccctgtgtgtagcccggctgggacagcccccccgccctccatacgctcagctcctgccccagctgcctcctycccagtccgtgcaccagcagacacagggtgggggcagagtgtgggctctttacccagcccctgggccacattctcttgtccactgcgctgcccgcctgcc

SEQ ID NO: 64170 - DNA, 201 bp, Homo sapiens
tcatcagataagagagttaaatagataaggggcccctcttccctgggaccctcggcgctcccccagaccccaggccctcccttgccaccccgaccctcgcytaccagcagcgtgggctagtgggctcttcctccacaggccgtggggacccgagaccaggcgagccaattgctggccggcaccgaggccacactgggccat

SEQ ID NO: 64171 - DNA, 201 bp, Homo sapiens
gggagatgtctttgtccccatggagagcaggccggatgtggtgctgcaggtgagggagctgagatgatgtggcagggtggttgggtgggcgtggcgcagtrgcaccgtggtccaggcccgtgccaaccctcacctccccatgtgccttcccagggcaaccagatgagcatcacattcctggagccggcataccccacgcct

SEQ ID NO: 64172 - DNA, 201 bp, Homo sapiens
gggccagcctgtagtcaacgcccctctcctctgcctcagctgtgtggcttccctctgtcagcctcaagctgtctttaaaatgggcacagcgtgctggcccscctcacctgagactgtgagcttggcccgaggagcctgggaagtggccacagtttcagtggcagctgtgggctgtggtgctccatgcctcagagccagctt

SEQ ID NO: 64173 - DNA, 201 bp, Homo sapiens
atgggggtccgtgagggtgcccaggccctgtcccggtagggaatgagcgcaagtatccaggcccagcacagggctctgtgctgggggtgcccagaccactrctgacgggctctgagcctgtggccagagtctggccaggtcacctctgtctgtcctgcctccaggtgtcatcctacggtgggaccctccgttatgaactgc

SEQ ID NO: 64174 - DNA, 201 bp, Homo sapiens
ccaccttagggagagtctaggggccctgagggcctgtgtaacctgagctgtctcctccctggtacctctgccttcccggaaggagaggctggggcaggggygagtagctggagatttgctgggtgggggcagagggccctggagcaagacgttatggggatgaatggaggagcctgggctgggcccgccccctctgcctgc

SEQ ID NO: 64175 - DNA, 201 bp, Homo sapiens
gttggggggtctgttctaggctccctgttctgtcccattgagtgtggccccactgaggtgccatcctggacccacaggggaacttccggcatacggagackcgcaacactgtgtcccgcgaggagctcatgatggtgctggccagcctggagcagctgcagatccgtgccctcttctcacagatctcctcggctgtctccc

SEQ ID NO: 64176 - DNA, 201 bp, Homo sapiens
gagaggctaccacacacgatgaggctggaatgccggcgccacagcgtggcctgtgctacctgctatgagcgacaggcaacatgactctgtcctgccatcarttctcaaactagctgcccttgcagcccgcagcccctacccgcccgctcccgttcccagaaaagcctgggtctcgcctctgtctcgtgcgttgggaagccc

SEQ ID NO: 64177 - DNA, 201 bp, Homo sapiens
gggagtgggtgctcctccccaatagggcaggcctggtcacgtgtcccccaaaattccctggcctgagaatgggggaggggcgggtcagtgatgggcagtargcgtctgtccccaaggaagggggtgaggatggtcgtcgaggggggtcactcgcactcaaagcgtgcaagggagagcggtggggggcagtgcagtccaacg

SEQ ID NO: 64178 - DNA, 201 bp, Homo sapiens
gccggtggggagggggcgcagctccgccctacccgggacaggctggaacctgttggcctctggatggggtgggaggggccagccacctgaggctcccactrgcccctctcggaggagtctagggactcgaggagacctccaaagtaggggagggccagctgcgaagttttgactggggctgggaacacgtggctcccagga

SEQ ID NO: 64179 - DNA, 201 bp, Homo sapiens
gcgcattctcagggccggcccccgctcccctcctggccagtgccgggggacagcggaggcctggcagcttggcctgatctggccgctaggaggcttaaagkgctctccccacccccacctctccccctgccccgccactcgcaatcccacccctccaaccacccgaccctccagggatcccaagaagccctcagggtctca

SEQ ID NO: 64180 - DNA, 201 bp, Homo sapiens
gacacccgctccgctctgcagtgtgtggctgcagccctgcaggaaccttgcccgagggctgcgatgaggccggccgctgcctatgccagcctgagtttgcyggacctcattgtgaccggtgccgccctggctaccatggtttccccaactgccaaggtgagcagagggtcagggcaggaaggggttctgccacccacatgg

SEQ ID NO: 64181 - DNA, 201 bp, Homo sapiens
gccctgctgcccggcaactgcacccgtaggcgtcgggctgggagggatgcaccctggggagggttgcgcggggaggagggaggcctgctgggcgtaccccrtaagtaggctgtgtgcctgatgctggggcccagccaggacaagtcggagccagccttctgggttcatggtcaaccctttctcccccgctatgatccggtc

SEQ ID NO: 64182 - DNA, 201 bp, Homo sapiens
ctagggcagtggggcagggcctgagtgctgaccccaggatatgcgagggtgggcgccacgggccactgacggcccctccccaccctgctcccaggtgtgcrcccggattctttgggaacccactggtgctgggcagctcctgccagccatgcgactgcagcggcaacggtgaccccaacttgctcttcagcgactgcgacc

SEQ ID NO: 64183 - DNA, 201 bp, Homo sapiens
gaggtggggcctccaggaaggagagggaagaggaaggcgtggccagcagacagagatgtgggagacaccaggaggtctcatgaatgctgctgcctcctcaygcccccgaaagctgctgtttggcttggagtggcctcccctgagcagccagggcccagggctgggctgggctgggctgctgctgccaggactctgagctgc

SEQ ID NO: 64184 - DNA, 201 bp, Homo sapiens
ccccgccctccatacgctcagctcctgccccagctgcctccttcccagtccgtgcaccagcagacacagggtgggggcagagtgtgggctctttacccagmccctgggccacattctcttgtccactgcgctgcccgcctgcctgccagttgctcccggggcagctgtctgccgggaagcagtgagcccggtgattaaccc

SEQ ID NO: 64185 - DNA, 201 bp, Homo sapiens
ggccactgacggcccctccccaccctgctcccaggtgtgcgcccggattctttgggaacccactggtgctgggcagctcctgccagccatgcgactgcagyggcaacggtgaccccaacttgctcttcagcgactgcgaccccctgacgggcgcctgccgtggctgcctgcgccacaccactgggccccgctgcgagatct

SEQ ID NO: 64186 - DNA, 201 bp, Homo sapiens
ctgagctggcccacgcgaacagttcagaaccagccttgctgcccgctcccagcttctctatttcatggacagggatggaggttcttaccagccggctccayggaagggcatcccagcagccctgagaaagggactgtggcctccgatatcccaaaccacagcgctggcgttcctccagacctcatcccgctgagacaacat

SEQ ID NO: 64187 - DNA, 201 bp, Homo sapiens
cagggcgcaggcagaggggatgaagccccgtgggcgtccatgaggctggaagcggctgactgtggggcctggggagttgcccttgcagtgcgggaaagccracccggatgaggggaggcctttgtcctgaggaggggcctttgcagagctgcaggtgttcccatccatgtgggacccccagccagatgtcccaaggtcggt

SEQ ID NO: 64188 - DNA, 201 bp, Homo sapiens
cagagctgggagcagagcacccacgcacaccccgaatggctatggaagctgcagggcgccagggacactgggagtccctgctctcatggcaaagcagggaygggggacttaaaagccaccaacaggaaaatcggggaaaaaagggagatggtggtaacagttggacactatttcttggcaaaaccgtggaaaaacacgttc

SEQ ID NO: 64189 - DNA, 201 bp, Homo sapiens
tcacttttttaaaatagcttcttgagttattatttttagtctgtcttcattcccaacaaaaaggcttaaagcagtggttctcagccagtggtgactttgakgcacaggaagcattcgatgatgtctggagacatttttggttgtgacgattgatggatgtaactgatccagtgggtagaggctagggatgctgggaacctc

SEQ ID NO: 64190 - DNA, 201 bp, Homo sapiens
ggaagaggtggtggatgacggggtgaccgctgccgactggctccgggagctgcgaagagagagggcaccgctggagcggacacgccccacacggcagggcytactcgcagggtccagggtgctgggccaggattccccactgcccctcccttaacaccgtggcacctgcgtggcaggagcgatgaggctcacctggaggag

SEQ ID NO: 64191 - DNA, 201 bp, Homo sapiens
ctgacctgcaggcaagggggactctactgacccctgaggtgccctgtcctaggccccacccggtcagtgcacacctgctccccagtcccgcctccacaaargccctgtgagaccctgtcctccaccgcctctttccttgtgtccattccctgagcctggggaagttgcgtcagagccacaggctcggggacgctgagtctg

SEQ ID NO: 64192 - DNA, 201 bp, Homo sapiens
ggctctgtgacagtggcgctggccacatgtggttggtgagcactcactgtgctgtggaagagacccccacagtgggcagctggggccagacacagaaagcytaccagggaggtgccagggctgcagatagcacagacagccccagccgtcgggagcctggcaagcttggaagtgctttgggtagaaatggaggtataggtg

SEQ ID NO: 64193 - DNA, 201 bp, Homo sapiens
caggctggtcttgaactcctgacctcaggtgatctgcccatctcagcctcccaaagtgctgggattacagacgtgagccactgtggccggcctcaaatgtyttaatgagtaactatttcattaaattgacaggaaataacaaatggcaagttataaccaataattttaggtaactaacaagtgataaataacaagtcatca

SEQ ID NO: 64194 - DNA, 201 bp, Homo sapiens
tgaggcgttggtttaaggtacgctctttcaagaggctatggctggagtttcctcttggtcacgctgacgtcttcggtttttatctcatgaaggagacagcscagccccacgatcgtccttgcctctgtcagttctggctggctcctgcccttgtatcatttctccttttctgctgaaacatttcctttcctgactttcaca

SEQ ID NO: 64195 - DNA, 201 bp, Homo sapiens
caccgctggagcggacacgccccacacggcagggcctactcgcagggtccagggtgctgggccaggattccccactgcccctcccttaacaccgtggcacytgcgtggcaggagcgatgaggctcacctggaggaggagctgctccctggaggcccactgctccccagtaagctggccaggccaggtccagtcagggcccc

SEQ ID NO: 64196 - DNA, 201 bp, Homo sapiens
aatcccagcacttcaggaggccaaggcaggtggatcacctgaggtcaggagttcaaggccagcctggctaacatggtgaaaccccgtctctactagctggrcatggtggcgggcacctgtaatcccagctactcaggaggctgaggcaggaaaatcgcttgaacccgggaggcggagcttgctgtgagccgagattgcacc

SEQ ID NO: 64197 - DNA, 201 bp, Homo sapiens
agttctttgttattcttggtgcttaccctctgtcagacttcagagtaacaaccgtcttctcccctctcacagctcatctggtttttctttgtttttttttktttgtttgtttgttttttgagacagtcttgctctgtcgcccaggctggggtgcagtggtgcaatctcggcttactgcagcctctgcctcccaggatcaag

SEQ ID NO: 64198 - DNA, 201 bp, Homo sapiens
gcctccacttcctgtcaccctactcacctctcttcctgcccctgcttttcgcaggctgctggccaactcatgggcctgcctgtcccctgctgcctgtctgyctgcccctcgtctgcctgcccctcatccgcctgcctgcccctcatccgcctgcccctccatgcacacaccctccatacccctttcccacctaccccagcc

SEQ ID NO: 64199 - DNA, 201 bp, Homo sapiens
ctgactgtccactctgccccaggactgccagcacaacaccgaaggggcccactgtgagcgctgccaggctggcttcgtgagcagcagggacgaccccagcrccccctgtgtcagctgcccctgccccctctcagtgccttccaacaagtaagccagcctcctcccgggacgaggccctgatggtgccaggctcccttcacc

SEQ ID NO: 64200 - DNA, 201 bp, Homo sapiens
cccacccctccactgaccccacccccactggccccacctcttccactggctgcacctcctccactggccccacaccttcactggccccctcttcctccacyggccccaccccttcactgaccctgcctccactggccccacccctccacaggccccgcctcctccactggccccctcttcctccactggccccaccccttc

SEQ ID NO: 64201 - DNA, 201 bp, Homo sapiens
acctggaggcgggacttggcgggcaggcacgggcacggctggttgtgagcgcaggaggctggagagccaggccgagggcgtctgcgcttacccactccttygaccctcccttccgctgcagcatcatcctggacgtcaaccaggaccgcctcacccagagggccatcgaggcctccaacgcctacagccgcatcctgcagg

SEQ ID NO: 64202 - DNA, 201 bp, Homo sapiens
actgccaacagtgccaacgagtgccagtgtgagtgcctcctcccacacacgtgtgtcctgcccacaccctggcccatgagagggccccggtgcccgggccygtggagggcgtgccaacagctgcgctcccctctctctagcctgtaactgctacggccatgccaccgactgttactacgaccctgaggtggaccggcgccg

SEQ ID NO: 64203 - DNA, 201 bp, Homo sapiens
ccatggccacggcttccttcgcctggcgctctcgaacgtggcaccgctcactggcaacgtctactccggcttcggcttccacagcgcccaggacagtgccytgctctactaccgggcgtccccggtgagacctcacacccgtgcccattccccaccccgcggtggccgtcggagcagttgggactggggtgtctggaatga

SEQ ID NO: 64204 - DNA, 201 bp, Homo sapiens
tgacggcccctccccaccctgctcccaggtgtgcgcccggattctttgggaacccactggtgctgggcagctcctgccagccatgcgactgcagcggcaayggtgaccccaacttgctcttcagcgactgcgaccccctgacgggcgcctgccgtggctgcctgcgccacaccactgggccccgctgcgagatctgtgccc

SEQ ID NO: 64205 - DNA, 201 bp, Homo sapiens
atgcaagatggggccctgtgatgtgtgggcatccacccatgtgcagccacacgtgtgtgcccacagttcgtggatatggagggatgggtgctgctgagcaytgaccggcaggtggtgccccacgagcggcagccagggacggagatgctccgtgcagacctgcggcacgtgcctgaggctgtgcccgaggctttccccgag

SEQ ID NO: 64206 - DNA, 201 bp, Homo sapiens
aatagataaggggcccctcttccctgggaccctcggcgctcccccagaccccaggccctcccttgccaccccgaccctcgcctaccagcagcgtgggctartgggctcttcctccacaggccgtggggacccgagaccaggcgagccaattgctggccggcaccgaggccacactgggccatgcgaagacgctgttggcgg

SEQ ID NO: 64207 - DNA, 201 bp, Homo sapiens
ccctcttccctgggaccctcggcgctcccccagaccccaggccctcccttgccaccccgaccctcgcctaccagcagcgtgggctagtgggctcttcctcyacaggccgtggggacccgagaccaggcgagccaattgctggccggcaccgaggccacactgggccatgcgaagacgctgttggcggccatccgggctgtg

SEQ ID NO: 64208 - DNA, 201 bp, Homo sapiens
ccctgggaccctcggcgctcccccagaccccaggccctcccttgccaccccgaccctcgcctaccagcagcgtgggctagtgggctcttcctccacaggcygtggggacccgagaccaggcgagccaattgctggccggcaccgaggccacactgggccatgcgaagacgctgttggcggccatccgggctgtggaccgca

SEQ ID NO: 64209 - DNA, 201 bp, Homo sapiens
cccagtcccgcctccacaaaggccctgtgagaccctgtcctccaccgcctctttccttgtgtccattccctgagcctggggaagttgcgtcagagccacargctcggggacgctgagtctgggcgagcgcttgctgccggacagctggagaaacagcagcggggggccgtgtccatgtggcaagccaagccatcgagggga

SEQ ID NO: 64210 - DNA, 201 bp, Homo sapiens
ggctggggtcttgggcttggaagccagcaggcagaggtgcactagtacgggcggccccaggctctgacgaacccctgccccacagagctcatgtcccagaygggccacctggggctggccaatgcctcggctccatcaggtgagcagctgctccggacactggccgaggtggagcggctgctctgggagatgcgggcccgg

SEQ ID NO: 64211 - DNA, 201 bp, Homo sapiens
ccaagccatcgaggggatcacaggccccttcagggaagggactgagcacctgccacctgcctccaggatgggcctgatcccccctcctgtgtaccccacargctgcagtgcacctgccagcacaacacctgcgggggcacctgcgaccgctgctgccccggcttcaatcagcagccgtggaagcctgcgactgccaacagt

SEQ ID NO: 64212 - DNA, 201 bp, Homo sapiens
gagagctcattgcccaggcccggggggctgccagtaaggtgggtgagagtcccaggggaaggtggacatcagggagggtggtggtggacgctgatggaccrtgccccgcaggtcaaggtgcccatgaagttcaacgggcgctcaggggtgcagctgcgcaccccacgggatcttgccgaccttgctgcctacactgccctc

SEQ ID NO: 64213 - DNA, 201 bp, Homo sapiens
tcgagcaggagctgcggctcgtgtcctacagcggggtgctcttcttcctgaagcagcaggtgcgccaggcacacccgtcctgccatccccacttgcactgrccctgccccacactaaccctgccctgtttctgcagagccagttcctgtgcttggccgtgcaagaaggcagcctcgtgctgttgtatgactttggggctgg

SEQ ID NO: 64214 - DNA, 201 bp, Homo sapiens
aagcagcaggtgcgccaggcacacccgtcctgccatccccacttgcactgaccctgccccacactaaccctgccctgtttctgcagagccagttcctgtgyttggccgtgcaagaaggcagcctcgtgctgttgtatgactttggggctggcctgaaaaaggccgtcccactgcagcccccaccgcccctgacctcggcca

SEQ ID NO: 64215 - DNA, 201 bp, Homo sapiens
agcccctgctgtggccaggcctgcgagggaccactacctcccggacctgcaccacctgcgcctggagctggaggaggctgccacacctgagggtcacgccrtgcgctttggcttcaaccccctcgagttcgagaacttcagctggaggggctacgcgcagatggcacctgtccaggtgggcgctgtgctccccctcccagg

SEQ ID NO: 64216 - DNA, 201 bp, Homo sapiens
tccctgggcaggccctccgtgaccaggcttctgaaggtctccgaatacccagccctgccctcacacccggctgctgcggtcatgactgtcagacgaggacycgaaggctcatggggatttattggctcctgtccctggcgtcgggcacagccaagtccaggggctgtggcgccaggaatctctggtgccatctcttggctg

SEQ ID NO: 64217 - DNA, 201 bp, Homo sapiens
cccgtgccaccctgaccagtcatgctggtgggagtgggtgctcctccccaatagggcaggcctggtcacgtgtcccccaaaattccctggcctgagaatgkgggaggggcgggtcagtgatgggcagtaggcgtctgtccccaaggaagggggtgaggatggtcgtcgaggggggtcactcgcactcaaagcgtgcaaggg

SEQ ID NO: 64218 - DNA, 201 bp, Homo sapiens
caggccccttcagccagtgagctgtggtctctgtcacgcggcctcttggcctgtgggagcctcagtggcaaggcccggagacgtcaaggggcccgggcacygcggggacccaggcttttctggtgatccagcgccctcccctcctgccattccccgcagcctccaagagggactgtctggagcggttcgggccacagacgc

SEQ ID NO: 64219 - DNA, 201 bp, Homo sapiens
gcctgccactgctctgctgaaggctccctgcacgcagcctgtgacccccggagtgggcagtgcagctgccggccccgtgtgacggggctgcggtgtgacaygtgtgtgcccggtgcctacaacttcccctactgcgaaggtgagcaggcaggtggctgtgtgcaccaggtgccgggcctgtgtgtgggtctgtgctgttca

SEQ ID NO: 64220 - DNA, 201 bp, Homo sapiens
aaggggcagagagagggcactgggcatcgttagaaccagggccagcatgtctgtctgcctggaaatttcacaccgcaatcggttgcccgcagcccagcctrgagcctccgtactctgggagaggacctcggccccaggtagcatgcaccgcagccctgaggtggcatctcaggccgtgtggccgggtgtggccggcgcctg

SEQ ID NO: 64221 - DNA, 201 bp, Homo sapiens
ttgggcaaagaaactaagcgttggcaggtaaaagaaaagactttattaataatcagtgggtgggaggtgagggtgtgcaacgcactgcaagcgcccagttsctcggaggacggcgcgtggctcagtccaggctcatgtcctcctcttcgtccttcttgtccttcgtgtcgccctctttctgctcgggcttggcgttgttct

SEQ ID NO: 64222 - DNA, 201 bp, Homo sapiens; identical to SEQ ID NO: 12674

SEQ ID NO: 64223 - DNA, 201 bp, Homo sapiens
ttacaacttcagtggctgcatcagcaacgtcttcgtgcagcggtgagcctggtgggcgctgggggacaaggtcccagctggccttccgcagctgctgaccrcctgcccgccctgcacaggctcctgggcccacagcgcgtatttgatctgcagcagaacctgggcagcgtcaatgtgagcacgggctgtgcacccgccctg

SEQ ID NO: 64224 - DNA, 201 bp, Homo sapiens
gtcagatcagcaccaccaagcgcttcgagcaggagctgcggctcgtgtcctacagcggggtgctcttcttcctgaagcagcaggtgcgccaggcacacccrtcctgccatccccacttgcactgaccctgccccacactaaccctgccctgtttctgcagagccagttcctgtgcttggccgtgcaagaaggcagcctcgt

SEQ ID NO: 64225 - DNA, 201 bp, Homo sapiens
cggtgtacagcgtggagcaggacaatgatctggagctggccgacgcctactacctggggggcgtgccgcccgaccagctgcccccgaggtaagcactgtgygcagctggggctccgaggccaggctgttggggcggtaggctgggcttggaggtggcgccctgacccgcatccccgcttccccacagcctgcgacggctct

SEQ ID NO: 64226 - DNA, 201 bp, Homo sapiens
actgtgcgcagctggggctccgaggccaggctgttggggcggtaggctgggcttggaggtggcgccctgacccgcatccccgcttccccacagcctgcgayggctcttccccaccggaggctcagtccgtggctgcgtcaaaggcatcaaggccctgggcaagtatgtggacctcaagcggctgaacacgacaggcgtgag

SEQ ID NO: 64227 - DNA, 201 bp, Homo sapiens
ccggaggctcagtccgtggctgcgtcaaaggcatcaaggccctgggcaagtatgtggacctcaagcggctgaacacgacaggcgtgagcgccggctgcacygccgacctgctggtgagcagccctccccgggctgggggtggcatctgtggacatgcaggggcacccgcgggcactcagggatggcctccccgcaggtggg

SEQ ID NO: 64228 - DNA, 201 bp, Homo sapiens
ggctgaacacgacaggcgtgagcgccggctgcaccgccgacctgctggtgagcagccctccccgggctgggggtggcatctgtggacatgcaggggcaccmgcgggcactcagggatggcctccccgcaggtggggcgcgccatgactttccatggccacggcttccttcgcctggcgctctcgaacgtggcaccgctcac

SEQ ID NO: 64229 - DNA, 201 bp, Homo sapiens
ccgggcctggggcctagaggactgcaggccaccgcccggaaggtgggcaccccaggggtgagcaggcagagctggggtggctggaagggtggcccctgtgygggcggcccctgcattcaccatccacgcccccaggcctcccgccgcagccgtcagcccgcccggcatcctgcctgcatgctgcccccacacctcaggacc

SEQ ID NO: 64230 - DNA, 201 bp, Homo sapiens
cctgtgtgggcggcccctgcattcaccatccacgcccccaggcctcccgccgcagccgtcagcccgcccggcatcctgcctgcatgctgcccccacacctsaggaccacccgagactcctaccagtttgggggttccctgtccagtcacctggagtttgtgggcatcctggcccgacataggaactggtaaggccaggccc

SEQ ID NO: 64231 - DNA, 201 bp, Homo sapiens
cagcagaacctgggcagcgtcaatgtgagcacgggctgtgcacccgccctgcaagcccagaccccgggcctggggcctagaggactgcaggccaccgcccrgaaggtgggcaccccaggggtgagcaggcagagctggggtggctggaagggtggcccctgtgtgggcggcccctgcattcaccatccacgcccccaggcc

SEQ ID NO: 64232 - DNA, 201 bp, Homo sapiens
gagaagcaagtaagcctggcagaggtggcgtgccagggcagggtttgcctccccattctggtgacctcgggggcatagcctgaccctcccttcctacccckccaggtcctgctgcgggcggatgacggagcaggggagttctccacgtcagtgacccgcccctcagtgctgtgtgatggccagtggcaccggctagcgggt

SEQ ID NO: 64233 - DNA, 201 bp, Homo sapiens
acccccacccttctgcagagcgggagccaggcgggactctgggtggggtggcttcttttggggctggagagaggctgggctgaggaccacctggcctcagragtccccctttctcccagtgatgaaaagcgggaatgtgctccggctggaggtggacgcgcagagcaaccacaccgtgggccccttgctggcggctgcagc

SEQ ID NO: 64234 - DNA, 201 bp, Homo sapiens
ccccaccctcctacctgggggaccgggtaagcagggcatcaggtctgggggaggcactttgaggatggccaggacgcctgagagggttgggagccaggagyggggtctgtccagggagggggagctccatgggggtccgtgagggtgcccaggccctgtcccggtagggaatgagcgcaagtatccaggcccagcacaggg

SEQ ID NO: 64235 - DNA, 201 bp, Homo sapiens
cactcgccatccctcgtctctccgtgcccactcgccacccctcgtctctgtgcccactcgccacccctcgtctctgtgcccactcgccacccgtctctccrtgcccactcgccacccctcgtctctccgtgcccactcgccacccctcatctctccgtgcccactcgccacccctcatctctctgtgcccactcgccaccc

SEQ ID NO: 64236 - DNA, 201 bp, Homo sapiens
tgtgcaaacccaacttccaaggcacccattgtgagctctgcgcgccagggttctacggccccggctgccagcgtgagtcccctctccccgctcaacctctrcctgcgctcgaggtggacacctgaggcctggtgcctctgaccaagcatgtgggccaccctttcctgcagcctgccagtgttccagccctggagtggccga

SEQ ID NO: 64237 - DNA, 201 bp, Homo sapiens; identical to SEQ ID NO: 12691

SEQ ID NO: 64238 - DNA, 201 bp, Homo sapiens
cttggcctgtgggagcctcagtggcaaggcccggagacgtcaaggggcccgggcaccgcggggacccaggcttttctggtgatccagcgccctcccctccygccattccccgcagcctccaagagggactgtctggagcggttcgggccacagacgctggagcgcatcacacgggacgacgcggccatctgcaccaccgag

SEQ ID NO: 64239 - DNA, 201 bp, Homo sapiens
gacgacgcggccatctgcaccaccgagtactcacgcatcgtgcccctggagaacggagaggtgggccggggaggggcagggcggtacgggggctggagaayggagaggtgggtaggggaggggcagtgccgagcggggctggagaagggaaaggtgggcccgggaggggcagtgctgagcaggggctagggccacactggc

SEQ ID NO: 64240 - DNA, 201 bp, Homo sapiens
gagaggctgggtgcctgtcctggcatggagggggcgtctggtggaggcatttaggatgggtttggattgcactgagcagcggggtgtgagggtctcacacratccatagggggttggatgtccctgttgctggcccaacagaaagacttggggacatgaagccaggatggtccccgctggcccctgctgagcctgccctct

SEQ ID NO: 64241 - DNA, 201 bp, Homo sapiens
gacagcacacgctaccttgctggccgcctgctggcccggctggtacgttcatcgtggccaggatgctctggaggtcgctcagctggatgggctgggtcggkctggctgctgtgctggctccattcccggaactgggcgcggggctcgggctagttgctgaggcagctgctggagcagaaggggctggggtggcacgggtgg

SEQ ID NO: 64242 - DNA, 201 bp, Homo sapiens
ggtgccatgtcagagagagctggccagggagcagggtgggccaggcggagaggggcaggacgagaaggctcagaagctggctgagcagactggtgtcaggrtgttggaggcactgcaggaggtgagggccgggcaggtgaggcagctgtggcctttcgccaggtgctctaggggccacccaggtgcgctcaggttccgggc

SEQ ID NO: 64243 - DNA, 201 bp, Homo sapiens
acagccgtgtggccagacaggtggccccgggagacgtcagacccctcgacagcctccccaggaaatgtgccggttagatgttcgcgctcacagatatcccrtagtgcacactgagacatgggactcaggagagacttggctccctgagcctgcctaacaggacctgccagcccagcctgggggtcggcagggggtgccatg

SEQ ID NO: 64244 - DNA, 201 bp, Homo sapiens
tggctcgatctcggcttaccataacctctgcctcccgggttcaagcgattctcctgcctcagcctcctgagtagctgggattacaggcacacgccaccacrcccagctaattttgtatttttagtacagatggggtttctccatgttggtcaggctggtcttgaactcctgacctcaggtgatctgcccatctcagcctcc

SEQ ID NO: 64245 - DNA, 201 bp, Homo sapiens
caggtactgagcgtcctggccttccctccccaacccgggccagtgcaggccttcaccttccgcctcccacagagccagctccggagccccctgggcccccrccatgagacggcacagcagctggaggtgctggagcagcagagcacaagcctcgggcaggacgcacggcggctaggcggccaggcaggagccccaagaccc

SEQ ID NO: 64246 - DNA, 201 bp, Homo sapiens
ttccccactgggtggtggggagcggggcaggcagcttgtcctccgggcatctccgtgtccctcaccatgggcccacgtgaggcctcaccctccctggagayccggggccgctgtgcagggctaggtaggatggccaagctgcacctgaccagcccctgctgtggccaggcctgcgagggaccactacctcccggacctgca

SEQ ID NO: 64247 - DNA, 201 bp, Homo sapiens
cagatgggcaggacccctggcttccaggttggtctgggacagtcttgagggctgggcagggcagtgaccagcctgtgccacaggagggacattttggtttygatggctgcgggggctgccgcccgtgtgcttgtggaccggccgccgagggctccgagtgccacccccagagcggacagtgccactgccgaccagggacca

SEQ ID NO: 64248 - DNA, 201 bp, Homo sapiens
gcctccctggctctggcgtctgtgtggtgagtaggggctggtggggccaggggggcagcattcactgaaggcacagtcaagtgtgccagggaagaccaggrgctgcacttccaggtcaactgaggtctggggaagggtgttgcccagtgggggaccatctggccttgggcacagagtctgaggcaggggtggtgggagctg

SEQ ID NO: 64249 - DNA, 201 bp, Homo sapiens
ctcggggagggcttaggtgggactggatgcaagatggggccctgtgatgtgtgggcatccacccatgtgcagccacacgtgtgtgcccacagttcgtggayatggagggatgggtgctgctgagcactgaccggcaggtggtgccccacgagcggcagccagggacggagatgctccgtgcagacctgcggcacgtgcctg

SEQ ID NO: 64250 - DNA, 201 bp, Homo sapiens
gggacgctgagtctgggcgagcgcttgctgccggacagctggagaaacagcagcggggggccgtgtccatgtggcaagccaagccatcgaggggatcacargccccttcagggaagggactgagcacctgccacctgcctccaggatgggcctgatcccccctcctgtgtaccccacaggctgcagtgcacctgccagcac

SEQ ID NO: 64251 - DNA, 201 bp, Homo sapiens
cccctgtcaccaccccatccacggccaactccctcccaggcccgtgggcagctttgtgtgcacacttgcgtgcagagcccgccctcagggtcgtggatcargtggctgtgagcaggatgaggggctaagtccactcaaattccaggagctggagcgcctcgccgccagcctggacggggctcggaccccactgctgcagag

SEQ ID NO: 64252 - DNA, 201 bp, Homo sapiens
ccctgcagcagggccgtgtgagcctacagctcctgaggactgaagtgaaaactcaagcgggcttcgccgatggtgccccccattacgtcgccttctacagyaatgccacggggtgagcctggccgctgggccctcatcgtgaaggtctggagggacgcccgcctgcacttgcctggacctctgtctcctctgaggtggggg

SEQ ID NO: 64253 - DNA, 201 bp, Homo sapiens
ggtcacaccctgcatcttgggccccctggaggcgggcctgttcttcccaggcagcgggggagttatcactttaggtctgtgggtgctggcatcccaggccycagcagggcagggcagggggctccaggaggttctggggaggggccccccctttcttctccatcacaacccctccccgcagacctcccaggagctacactg

SEQ ID NO: 64254 - DNA, 201 bp, Homo sapiens
ccacaaagagttgggctgagtactgaggtttcccaaggtctccatcgtggaccctgtgggcccgtcaggggaggtgtgggccgggacaggcaggccacacytgtgctgtgggtccatgagttgcctctctcccccggcacccgggcctcctcgcacaggcgggggagaggttcgtgtttcctccgcctccctgccaggtcc

SEQ ID NO: 64255 - DNA, 201 bp, Homo sapiens
tttgtatttttagtagagatggggttttaccatgttggccaggctgatctcgaactcctgacctcagttgatccacccacctcagcctcctaaagtgctargattacaggcatgagccactgcgcctggcagtttctgccttttgtttttggaatttgagattttctttgtttctaatccagaatgtgaccacttttagat

SEQ ID NO: 64256 - DNA, 201 bp, Homo sapiens
ggagctggcttgggcacccaggtccctcatggacctcagctcatctgggaaggccggaaggggtcccagtgctgctgtgcccattctccgtggtggaaaasagcccaggagcagaagcggggtgggggctggggaggtccccacacccattgtcagatatcttctgcgctggtcaccctggggggtgtcatgctgtcttcc

SEQ ID NO: 64257 - DNA, 201 bp, Homo sapiens
tggtccaggcccgtgccaaccctcacctccccatgtgccttcccagggcaaccagatgagcatcacattcctggagccggcataccccacgcctggccacrttcaccgtgggcagctgcagctggtggaggtgaggggagctggcttgggcacccaggtccctcatggacctcagctcatctgggaaggccggaaggggtc

SEQ ID NO: 64258 - DNA, 201 bp, Homo sapiens
acagacagagaaagagatacagagatagagacagaaacagagacagacagatggagacagagaggcagagagtcagagggagagagtcaggagagggaggrgtgggagggggacgcttccctctgccccagggaccctggctagccaaggcacacaccagggcgcaggcagaggggatgaagccccgtgggcgtccatgag

SEQ ID NO: 64259 - DNA, 201 bp, Homo sapiens
acagttcgtggatatggagggatgggtgctgctgagcactgaccggcaggtggtgccccacgagcggcagccagggacggagatgctccgtgcagacctgyggcacgtgcctgaggctgtgcccgaggctttccccgagctgtactggcaggccccaccctcctacctgggggaccgggtaagcagggcatcaggtctggg

SEQ ID NO: 64260 - DNA, 201 bp, Homo sapiens
cctgtacccgccccacagcctgtgactgcggtgcccgcctctgtgacgagctcacgggccagtgcatctgcccgccacgcaccatcccgcccgactgcctrctgtgccagccccagacctttggctgccaccccctggtcggctgtgaggagtgtaactgctcagggcccggcatccaggagctcacagaccctacctgtg

SEQ ID NO: 64261 - DNA, 201 bp, Homo sapiens
gggcgggtccccagccctcatgtccccccagggggcctggctgtagccctcatccccatggccctggctggggaggtagagactgccacatcttggagccyaccccttgagtcctggtagctccaggcttacccggctcctgcccctgcccaggctgcaactgcgagtccgacttcacggatggcacctgcgaggacctga

SEQ ID NO: 64262 - DNA, 201 bp, Homo sapiens
gtggcccaccacgaaatgggccacatccagtatttcatgcagtacaaagacttacctgtggccttgagggagggtgccaaccccggcttccatgaggccaytggggacgtgctagccctctcagtgtctacgcccaagcacctgcacagtctcaacctgctgagcagtgagggtggcagcgacggtgagagagaagcggga

SEQ ID NO: 64263 - DNA, 201 bp, Homo sapiens
tcgatcagtggcgctggagggtatttgatggaagcatcaccaaggagaactataaccaggagtggtggagcctcaggttctggaacactcccacgggatgygggctgggggatctctgcgagtgtctgcatgtgcctgggtgtctggatgggccagggtaggggagtgtgtgtgtgtgtgtacactattgtgtctgtgcat

SEQ ID NO: 64264 - DNA, 201 bp, Homo sapiens
aacggctggaggtgggtcaggcatctctccaggctagctcgggcgccctcccagcgtggaatctgaggtgggcagatttacctggcagccagcatcccccrcagcaactactgacgcagccagttctcaaggctaggtccaaaactggcccagagtcacttctgccatgttttattggctagaacaagtcacaagttcacc

SEQ ID NO: 64265 - DNA, 201 bp, Homo sapiens
acatgttcccagtggcctcttggctcacatgttgggtgcttggggtgagatggctggaacggctggaggtgggtcaggcatctctccaggctagctcgggygccctcccagcgtggaatctgaggtgggcagatttacctggcagccagcatcccccacagcaactactgacgcagccagttctcaaggctaggtccaaaa

SEQ ID NO: 64266 - DNA, 201 bp, Homo sapiens
cctgctgctctgctacgggcaccctctgctggtccccagccaggaggcatcccaacaggtgacagtcacccatgggacaagcagccaggcaacaaccagcrgccagacaaccacccaccaggcgacggcccaccagacatcagcccagagcccaagtgggaccatgcaggggaggggcagggtgccaggggtgggagaggc

SEQ ID NO: 64267 - DNA, 201 bp, Homo sapiens
gcttgcagtgagccgagatggcaccactgcactccagcctgggcgacagagcgagactccatcaaaaaaaaaaaaaaaaaaaactcaatttcagattttgrtgaacatttactcaatgcctgagcaattcttctttccttaaaaatcagtctctgggaggcctaggtgggaggatcacttgaagccaggagttggagacta

SEQ ID NO: 64268 - DNA, 201 bp, Homo sapiens
cactccagcctgggcgacagagcgagactccatcaaaaaaaaaaaaaaaaaaaactcaatttcagattttgatgaacatttactcaatgcctgagcaattmttctttccttaaaaatcagtctctgggaggcctaggtgggaggatcacttgaagccaggagttggagactagcctgggcaacatagcaagatcccatctc

SEQ ID NO: 64269 - DNA, 201 bp, Homo sapiens
ccgcgccgctggggactttggagcggaggaggaagcgcggcggggcgggggcgggggtgtgtcgggttttataacccgcagggcggccgcggcgcaggagaaggggcagagccgagcaccgcgcaccgcgtcatgggggccgcctcgggccgccgggggccggggctgctgctgccgctgccgctgctgttgctgctgccg

SEQ ID NO: 64270 - DNA, 201 bp, Homo sapiens
aaaggtagatccctggaggaggcaggtaatgtggtgttgggagagcctggctgtgtcccctctgtaggctatgtagatgcaggggactcgtggaggtctaygtacgagacaccatccctggagcaagacctggagcggctcttccaggagctgcagccactctacctcaacctgcatgcctacgtgcgccgggccctgcac

SEQ ID NO: 64271 - DNA, 201 bp, Homo sapiens
cccgcgccgctggggactttggagcggaggaggaagcgcggcggggcgggggcgggggtgtgtcgggttttataacccgcagggcggccgcggcgcaggagaaggggcagagccgagcaccgcgcaccgcgtcatgggggccgcctcgggccgccgggggccggggctgctgctgccgctgccgctgctgttgctgctgcc

SEQ ID NO: 64272 - DNA, 201 bp, Homo sapiens
ggcccgcgccgctggggactttggagcggaggaggaagcgcggcggggcgggggcgggggtgtgtcgggttttataacccgcagggcggccgcggcgcaggagaaggggcagagccgagcaccgcgcaccgcgtcatgggggccgcctcgggccgccgggggccggggctgctgctgccgctgccgctgctgttgctgctg

SEQ ID NO: 64273 - DNA, 201 bp, Homo sapiens
caaataaacaaaaatcaatctctagtaacagaataatttgtacataaataagtggtgctcaagtcgttttttaaaagattgaaagcctctgtttgtctccyctacaaaaggggctacacttcctctttaccctcattccctgcctatttggctgagcacaaattatgccactgagccacacactgttactgttccttggca

SEQ ID NO: 64274 - DNA, 201 bp, Homo sapiens
gatacctcccagctccctctcaacccaccctttccagggttggagaacttgaggcataaacttgcttccatgaggaatctccacccagaaatgggtctttytggcccccagcccagctcccacattagaacaatgacaaatagaaggggaaatggaaaataaacaggagaaacggttttcccaggacagggtttggcctac

SEQ ID NO: 64275 - DNA, 201 bp, Homo sapiens
tgaagtacggcacccaggccaggaagtttgatgtgaaccagttgcagaacaccactatcaagcggatcataaagaaggttcaggacctagaacgggcagcrctgcctgcccaggagctggaggaggtgtgtggctcgcaaggtacagggagaggggaatcctggggcagtgagcccaacacagggtctggcctggccttca

SEQ ID NO: 64276 - DNA, 201 bp, Homo sapiens; identical to SEQ ID NO: 13035

SEQ ID NO: 64277 - DNA, 201 bp, Homo sapiens
cgcgcactgcatcgccgatacggagacagatacatcaacctcaggggacccatccctgctcatctgctgggtaaggacctggcctcgcctccacatgagtyccacggaagtgtgggtcccgaggtaggggtgggggatgtccagggtaagggaaggtgggttgtgaccctcacatctcacatgtgtggggcatcatactgt

SEQ ID NO: 64278 - DNA, 201 bp, Homo sapiens; identical to SEQ ID NO: 12855

SEQ ID NO: 64279 - DNA, 201 bp, Homo sapiens
atggttcccagttttgcaactgcactgccaagactgcgtggttggatggcatgcatgtggtccttggcaaagtgaaagaaggcatgaatattgcggaggcyatggagcgctttgggtccaggaatggcaagaccagcaagaagatcaccattgccgactgtggacaactctactaagtttgacttgtgttttatcttaacc

SEQ ID NO: 64280 - DNA, 201 bp, Homo sapiens
tctcctctccctcatcatctcccctcaccttcgaggatccccataagaccctgcctggggatttctatcttgccctctgtctcctaactcttgctcatagygctcaccccatttcctgtcctgtgtgcctggcgattccccacctgtgtcctccaggcccggtgcttctgatttttagcctactgtttaatctggctgtcg

SEQ ID NO: 64281 - DNA, 201 bp, Homo sapiens
taggtgctttgaaaagaaaaaggcaggccaggtgcggtggctcacgcctataatcccagctacttgggaagctgagacaagagactcacttgaacccaggrtggggaggttacagtgagctgagatcacgccactgaacttcagcctgggcaacagggcaagactctgaaaaaaaaaaaaaaagaaagaagaaaagaagga

SEQ ID NO: 64282 - DNA, 201 bp, Homo sapiens
ggatggggaggttacagtgagctgagatcacgccactgaacttcagcctgggcaacagggcaagactctgaaaaaaaaaaaaaaagaaagaagaaaagaargaaaggaagaaaggagggagggagggagggagggagggagggagggaaggaaggaaggaaggaaggaaggaaggaaggaaggaaggaaggaaaagaaaga

SEQ ID NO: 64283 - DNA, 201 bp, Homo sapiens
tctgccttttccctgccaggttgaaataccagggcttgtgccccgctattcctcactcagaggaagactttgatccaggtgccaagttccacttttctgcwggtgtgccctacatacggtaaaggtctgggccctgttagcagtgccagtcctaggagttgaggggcatgggaactggggtgaggatttgcaggaaggccc

SEQ ID NO: 64284 - DNA, 201 bp, Homo sapiens
ctaggagttgaggggcatgggaactggggtgaggatttgcaggaaggccctaggtccaaatgtcaccctgtacccgtgcccatctcttcctgttgggctgygcagccttctgaggcctctgacctagaatcctttgagcttttgcatcaggtccagtgtagagggcagagctgatgagaatattctagaccatccctgctg

SEQ ID NO: 64285 - DNA, 201 bp, Homo sapiens
cacagggtctggcctggccttcacgctgcttcctcttcctcgttgtatcaagtcatggcatctgccatgcgatgtgcacctcagaactgctgagagggcakcgctccccagctccctggctccccacctgccagcccatggggcctgggggtagtgcaggccccagagagaccaagtgcaaaggagtacagctcattgcct

SEQ ID NO: 64286 - DNA, 201 bp, Homo sapiens
attgccccacctcccactgcgccgccgggcctctgccagggtcaaggggcttcccccctctggcagcagacgccatggtgccgaggtggcctccacaaccrccctgtgcgccaataggacaagactgtcctccctcccccacacttgtcactttgagggacacgtggatgagacaggaaaacacaggggagtgtggagacc

SEQ ID NO: 64287 - DNA, 201 bp, Homo sapiens
gcgacggcccaccagacatcagcccagagcccaagtgggaccatgcaggggaggggcagggtgccaggggtgggagaggcggggccgggtagggacagggsagggtacaagggagtgcgagagggataatggcttctggtgagaccacaaacctggagaggggaggcagaggtttgtctgtttccctgcactctgtcccac

SEQ ID NO: 64288 - DNA, 201 bp, Homo sapiens
caggctggagtgcagtggtgcaatcatggctcactgcagccctgacctcctgggctcaagcgatcctcctgcctcagcacctgagtagctgggactacagwtgcgcaccagaacacctggctcatttttgtattttttgtggggacagggtctcactttgttgcccaggccggtctcgaactcctgggctcaagcaatcct

SEQ ID NO: 64289 - DNA, 201 bp, Homo sapiens
ggcccggggaaaggcaggcagcccaggcgcagggaagctggttcccaggcctgcctctaccctaccccagcactggttggaggctgggtctgttccagggytagggggtataggaggcctattagtccaccttctctggcagctttgacaaatagtcacttctataccttggaatggaggaagaaggcccaagtggtggtg

SEQ ID NO: 64290 - DNA, 201 bp, Homo sapiens
tgcaggctctggtgaaggccgttgaagacttcaacgtggaggcctcctcaccgaccctgcctgcctgtgtctcagatctcaccaacatcctggcttcctckcgaagctacgccatgctcctgtttgcctgggagggctggcacaacgctgcgggcatcccgctgaaaccgctgtacgaggatttcactgccctcagcaatg

SEQ ID NO: 64291 - DNA, 201 bp, Homo sapiens
ggacccaggtacggcccttgcagctcccctctcggcggtgccctagtgttcccacattgccctgctgcactccggaccatgcagttgtgtagggtctgtgsagacagcaggtaaacccaaaggtgttgccctccaactggggctggacggtgcagatacccccacgccctgcttctcttggcaagtggacttccggaatct

SEQ ID NO: 64292 - DNA, 201 bp, Homo sapiens
ccgtgatgttcaggaagctggtgggagcagtaaggactggtgcaggctctggtgaaggccgttgaagacttcaacgtggaggcctcctcaccgaccctgcytgcctgtgtctcagatctcaccaacatcctggcttcctcgcgaagctacgccatgctcctgtttgcctgggagggctggcacaacgctgcgggcatcccg

SEQ ID NO: 64293 - DNA, 201 bp, Homo sapiens; identical to SEQ ID NO: 12811

SEQ ID NO: 64294 - DNA, 201 bp, Homo sapiens
gaatattcagagttgtacaaccatcactactaatgtcagaacatttcactacccctaaaagaaaccccataccacagattccgatgccgccgggagccctrccatgccatgtcacatatattatagtatatctatgcccagccatggtcaacccaccgtgttctttgacatcaccatcaacagcaagcccttgggccacgt

SEQ ID NO: 64295 - DNA, 201 bp, Homo sapiens
tcaaggcattcaaacccctaccagatctgacgaatgtgatggccacgtcccggaaatatgaagacctgttatgggcatgggagggctggcgagacaaggcrgggagagccatcctccagttttacccgaaatacgtggaactcatcaaccaggctgcccggctcaatggtgagtccctgctgccaacatcactggcacttg

SEQ ID NO: 64296 - DNA, 201 bp, Homo sapiens
gcatcaccaaggagaactataaccaggagtggtggagcctcaggttctggaacactcccacgggatgcgggctgggggatctctgcgagtgtctgcatgtscctgggtgtctggatgggccagggtaggggagtgtgtgtgtgtgtgtacactattgtgtctgtgcatatgatgtgtgtggtgtaagtgatggggaaaacg

SEQ ID NO: 64297 - DNA, 201 bp, Homo sapiens
tgcgagtgtctgcatgtgcctgggtgtctggatgggccagggtaggggagtgtgtgtgtgtgtgtacactattgtgtctgtgcatatgatgtgtgtggtgyaagtgatggggaaaacggggtgattgtgcacagaggcccagcacgcaggagaatggggtgcccagtatagccccaagtgcagggaccctccctcaagtca

SEQ ID NO: 64298 - DNA, 201 bp, Homo sapiens
tgtacactattgtgtctgtgcatatgatgtgtgtggtgtaagtgatggggaaaacggggtgattgtgcacagaggcccagcacgcaggagaatggggtgcycagtatagccccaagtgcagggaccctccctcaagtcaaaaatgccacccccagcctggttctccccaaactcatcttccaacatatattcccactcgac

SEQ ID NO: 64299 - DNA, 201 bp, Homo sapiens
ttcttggggtgaataagtttgtcgctgttgggccgcatgagatgcagaatcgcccactctcacccctgacagaaacagttgtttccttcagggagcctccrtcttgggagataaagcatgtgtacatgggaacccactggccacacattctctagaaagtacacaatgtcccagtgcctctagagcaagcactttgtacag

SEQ ID NO: 64300 - DNA, 201 bp, Homo sapiens
atttcgggccgggcgcggtggctcacgcctgtaatcccagcactttgggagggggaggcgggcggatcacgaggtcagatcaagaccatcctggctaacayggtgaaaccccatctctagtaaaaatacaaaaattagccgggtgtggtggcgagcacctgtagtcccagtactcaggaggctgaggcaggagaatggcat

SEQ ID NO: 64301 - DNA, 201 bp, Homo sapiens
cagctcgagccaggtgagagctcatgtgcaggctgagtgagaggcgagggctgggactggcatggggcccgggggtgctgggtgagagcacagagttgggytcccctcgctcttggggtcagcgtgcccaggaaatgccctttcttgttttccacgaggggggcttctctgccccactgagagccggcacctacttcatac

SEQ ID NO: 64302 - DNA, 201 bp, Homo sapiens
gagcccctctcccagcatgtgactgataaggaaattgagtcacacagcccctgaaagcgccagactagaacctgagcctctgattcctctcacttccctcmcctaccctgccacttcctactggatagaagtagacagctcttgactgtcctcttttctccccactggctggtccttcttaccccggcccgtttgaaagag

SEQ ID NO: 64303 - DNA, 201 bp, Homo sapiens
ctgtttcttctaggggccttggttcctccacaggcattggatatgatgccttctgaggtcctttgcaggagctagggatcaggctgggccacccactggtyctggcctggggcagggcctcctgctctgccatccctctgctgtgtccctggtctcctggctctccactatcttactgtcagccccagcggtcaggcagct

SEQ ID NO: 64304 - DNA, 201 bp, Homo sapiens
ttttaaagtatacaactgagtggcttttagaatattcagagttgtacaaccatcactactaatgtcagaacatttcactacccctaaaagaaaccccataycacagattccgatgccgccgggagccctgccatgccatgtcacatatattatagtatatctatgcccagccatggtcaacccaccgtgttctttgacatc

SEQ ID NO: 64305 - DNA, 201 bp, Homo sapiens
cctctcacttccctcacctaccctgccacttcctactggatagaagtagacagctcttgactgtcctcttttctccccactggctggtccttcttaccccrgcccgtttgaaagagctcacccccgacacaaggacccgcacacagatacctcccagctccctctcaacccaccctttccagggttggagaacttgaggca

SEQ ID NO: 64306 - DNA, 201 bp, Homo sapiens
agtgggccttctggctggcatggggcgacacaaatgccccctgccaccatcagagagatcccaggccccagggtcttattgccacagtttctgcagtccaytggggggcggaagtggccaggggcatgtgggccggggtccaggagcagactccagcctgagtcccctgtgcccatggtacccactctgcccaccaggaag

SEQ ID NO: 64307 - DNA, 201 bp, Homo sapiens
ccttgagcagagcttcattaagcttatattctagcggaatttcttcctcatgtcagactgcagtctttcctacattaatcagagcccatttcctcttgtgyagccttctgtgttcagagacactgcttaggctgggcgcagtggctcatgcatgtaatcccagcactttgggaagtcgaggcaggcggatcacctgagggc

SEQ ID NO: 64308 - DNA, 201 bp, Homo sapiens
tcccctgtgcccatggtacccactctgcccaccaggaaggtgctgcaggctggctcctccaggccctggcaggaggtgctgaaggacatggtcggcttagrtgccctggatgcccagccgctgctcaagtacttccagccagtcacccagtggctgcaggagcagaaccagcagaacggcgaggtcctgggctggcccgag

SEQ ID NO: 64309 - DNA, 201 bp, Homo sapiens
ttccttctagcgtgccttacatcaggtaacgggaaaggcaggagggcacattgtgaggggcagtacccacagctttgtgtttcaactgcggccactgcccrgtccacaagctctgtcagtcagggcagacccgggggagccggccgcacggtgcaggtgcctgggcccactcacactgccaaggctgatgggttttttctt

SEQ ID NO: 64310 - DNA, 201 bp, Homo sapiens
gaggaagcgcggcggggcgggggcgggggtgtgtcgggttttataacccgcagggcggccgcggcgcaggagaaggggcagagccgagcaccgcgcaccgsgtcatgggggccgcctcgggccgccgggggccggggctgctgctgccgctgccgctgctgttgctgctgccgccgcagcccgccctggcgttggaccccg

SEQ ID NO: 64311 - DNA, 201 bp, Homo sapiens
tctgtcctcctgttacccgaaacgaaacccactttgatgctggagctaagtttcatgttccaaatgtgacaccatacatcaggtattagcgcccccacccyacccacccccagtactgtcacaccctcaatccacttctcctcctgtgatcctagctgcctcatccccagggcttgtccccatgctcctccagacctcaaa

SEQ ID NO: 64312 - DNA, 201 bp, Homo sapiens
actcctgaacatctgcacaaaatcggcctgctggaccgtgtcaccaatgacacgggtatgggagggctgagaggcccccacccagcctcacctaaaccccrctccaccccacagcaggacctcacttgccccactcagctctgcccttctttctgcctcccggccccaggtcaggcagggttcgggatcctcctagagcct

SEQ ID NO: 64313 - DNA, 201 bp, Homo sapiens
taaccatccttttccagaaccaagtatcaggggatctgtcctcctgttacccgaaacgaaacccactttgatgctggagctaagtttcatgttccaaatgygacaccatacatcaggtattagcgcccccaccccacccacccccagtactgtcacaccctcaatccacttctcctcctgtgatcctagctgcctcatccc

SEQ ID NO: 64314 - DNA, 201 bp, Homo sapiens
tatacagtcacttttatgtggtttcgccaattttattccagctctgaaattctctgagctccccttacaagcagaggtgagctaagggctggagctcaagscattcaaacccctaccagatctgacgaatgtgatggccacgtcccggaaatatgaagacctgttatgggcatgggagggctggcgagacaaggcggggag

SEQ ID NO: 64315 - DNA, 201 bp, Homo sapiens
acagggtctggcctggccttcacgctgcttcctcttcctcgttgtatcaagtcatggcatctgccatgcgatgtgcacctcagaactgctgagagggcagygctccccagctccctggctccccacctgccagcccatggggcctgggggtagtgcaggccccagagagaccaagtgcaaaggagtacagctcattgcctc

SEQ ID NO: 64316 - DNA, 201 bp, Homo sapiens
tttgaaagagctcacccccgacacaaggacccgcacacagatacctcccagctccctctcaacccaccctttccagggttggagaacttgaggcataaacwtgcttccatgaggaatctccacccagaaatgggtctttctggcccccagcccagctcccacattagaacaatgacaaatagaaggggaaatggaaaataa

SEQ ID NO: 64317 - DNA, 201 bp, Homo sapiens
cttgtccttcctccattgcagtctgcttcattcattgtgtctgcagtttagcacaagctctggaaccaaccatatgaatttgagtcccacttccaccatcygctggctgtgtgactatgagcaaattcctcaaccgttctgtacctctctttcctcatctgtaaaatgggagcgttgatcacagtacttacctcatgggtt

SEQ ID NO: 64318 - DNA, 201 bp, Homo sapiens
ataacatcagggtctccctggagaaataggtatgatggggagggccctgcacagccctggggttgattgcacagcccataagagagaaaaagcccaaacaygtgaacataagaggtcaagttagaagaacctagagagataacctggcttccagagacccagatatatcacatccatccatccatccatccatccatccac

SEQ ID NO: 64319 - DNA, 201 bp, Homo sapiens
gcagaaagcaggcatggtggctcatacctataacctcaaaactttggaaaagccaagatgggaggatcccttaaacctaggagtttgagaccagagtgggyaacatggttagatcctgtatctacaaaaaatgaacaaaatttggccaggcatggtggcacgcacttgtagtcccaactactcaggaggctgaggtaggag

SEQ ID NO: 64320 - DNA, 201 bp, Homo sapiens
tggagggtgcccgcctcacctctccacaccccacccagtccctaccttgtgtgccctctcctaattgcaaactcataacatcagggtctccctggagaaayaggtatgatggggagggccctgcacagccctggggttgattgcacagcccataagagagaaaaagcccaaacatgtgaacataagaggtcaagttagaag

SEQ ID NO: 64321 - DNA, 201 bp, Homo sapiens
aaagacatgggggccttgtggcactccaagtatgagtcggataccctggagcaagacctggagcggctattccaggagctgcggccactctacctgaaccygcacacctacgtgcgcagggccctccaccgccactatgggcccgagctcatcgacctgagggggcccatccctgcccacctcctgggtaaaggccctgct

SEQ ID NO: 64322 - DNA, 201 bp, Homo sapiens
ccgcacacctacgtgcgcagggccctccaccgccactatgggcccgagctcatcgacctgagggggcccatccctgcccacctcctgggtaaaggccctgmtggtggccgaggtgagtgccagataagggcagagactgtctccagcctcctcttagcccctctcctcctcttccagagaacacgttggctcagtcctggg

SEQ ID NO: 64323 - DNA, 201 bp, Homo sapiens
atcaccaggaaaaatcaggaggagatgatgtgataccacctccaccccagcctctcctctctttgctctttttagggatttgggaccatggggcaccacayctcctgcccccatcccaagcaagaggaacaagggaagccccagtgtacatgtcaaagagggctgcaagctctgggcctcctggaagccctaatcttcctc

SEQ ID NO: 64324 - DNA, 201 bp, Homo sapiens
caccacacctcctgcccccatcccaagcaagaggaacaagggaagccccagtgtacatgtcaaagagggctgcaagctctgggcctcctggaagccctaawcttcctccaggcaagaatctcttgcttcttgtcctttgtaaatctcacctccttgcttttagagatccaggtttctgccctctccctctcagcaaatctt

SEQ ID NO: 64325 - DNA, 201 bp, Homo sapiens
tacgtgcgcagggccctccaccgccactatgggcccgagctcatcgacctgagggggcccatccctgcccacctcctgggtaaaggccctgctggtggccraggtgagtgccagataagggcagagactgtctccagcctcctcttagcccctctcctcctcttccagagaacacgttggctcagtcctgggtcaacatct

SEQ ID NO: 64326 - DNA, 201 bp, Homo sapiens
cagctcccctctcggcggtgccctagtgttcccacattgccctgctgcactccggaccatgcagttgtgtagggtctgtggagacagcaggtaaacccaamggtgttgccctccaactggggctggacggtgcagatacccccacgccctgcttctcttggcaagtggacttccggaatctccagctgcagcccccacttc

SEQ ID NO: 64327 - DNA, 201 bp, Homo sapiens
agacccggtcctgcccttcctgaagaagatcccagaggatgtcacaaagatcatgaaagtccaggttagtgcttggcctgtctgtccctgcccctccccaytggcatccttggacaaacagggcagcgccccccacaccccctcttctcccatagcactggaagccagagaaaatgttggaagaggctgagacattcttca

SEQ ID NO: 64328 - DNA, 201 bp, Homo sapiens
acagaagcaacagctgaagctcacagaggtcacaaaccagcccgaggtcacacagcaaacgagcaggtgacagagctgggagctcctccccttgtcctctyactcccacccttgacttcaggagcaggtctccctggtgggcttggcagagtcttgacctcgtgcctctctaaggtcaccctcataggccatctgaggcac

SEQ ID NO: 64329 - DNA, 201 bp, Homo sapiens
agaatcactggaacctgggagccggaggctgcagtgagccaagatcgcaccattgcactccagctgggagacacagcaagactccgtctcaaaagaaaaamaaaaaaaagaacaactgccaaggcctgtctgggctccaacccgaccacccaatccctcaaggagtctgaatggggaaactccctttctccatgctccttg

SEQ ID NO: 64330 - DNA, 201 bp, Homo sapiens; identical to SEQ ID NO: 12958

SEQ ID NO: 64331 - DNA, 201 bp, Homo sapiens
gttgccagggggtgctcctggctctgcaacaggctcttactttttttgtttgttttttgagacagggcctcgctctgtcactcaggctggagtatagtggyatgatcacggctcactgcagccctgacctcccagcctcaaccaatcctccttcctcagcctcctgagtagctgggactataggtgtgcgccactatactg

SEQ ID NO: 64332 - DNA, 201 bp, Homo sapiens
gaagtaccagggcctctgccccccagtgcccaggactcaaggtgactttgacccaggggccaagttccacattccttctagcgtgccttacatcaggtaaygggaaaggcaggagggcacattgtgaggggcagtacccacagctttgtgtttcaactgcggccactgcccggtccacaagctctgtcagtcagggcagac

SEQ ID NO: 64333 - DNA, 201 bp, Homo sapiens
tcggccatgttgagctacttcaagccgctgctggactggctccgcacggagaacgagctgcatggggagaagctgggctggccgcagtacaactggacgcygaactccggtaccgccacccaccccacctccagccttgggtcttaaccccctccccaggctgggcagccatgcggctgacctcggagcctggccctgccc

SEQ ID NO: 64334 - DNA, 201 bp, Homo sapiens
gttgtcgttgtttgtttgtgtttgtttgtttgttttgaggtggagtctcactctgtcacccaggctggagtgcggcgaggcaatctcggctcactgcaacytctgcctcctgggttcaagcaattctcctgtctcagcctcctgagtagctgggactgcaggcgcccaccaccatgcccgactaatttttgtattttttta

SEQ ID NO: 64335 - DNA, 201 bp, Homo sapiens
gttgggagagcctggctgtgtcccctctgtaggctatgtagatgcaggggactcgtggaggtctatgtacgagacaccatccctggagcaagacctggagmggctcttccaggagctgcagccactctacctcaacctgcatgcctacgtgcgccgggccctgcaccgtcactacggggcccagcacatcaacctggaggg

SEQ ID NO: 64336 - DNA, 201 bp, Homo sapiens
tgtatgaaccgatctggcagaacttcacggacccgcagctgcgcaggatcatcggagctgtgcgcaccctgggctctgccaacctgcccctggctaagcgkcagcaggtgggctgagggctgaggcagagctcgggggcggcctcctagtgccccatcgtgggggtcgggggagagcagcccatcagggagggaggaaccc

SEQ ID NO: 64337 - DNA, 201 bp, Homo sapiens
agagagagaaaaggttgagaaagactgggaagtcaccaaagccagagaatgggagggatctgccctcactgcagggtggtgccaagctgggacttgacccwgaccctgactttcaggactcctgtcccccactccacaggctgcctccactggcaggggactcagaagtgatccggtcacactaagtgacacttagtgatc

SEQ ID NO: 64338 - DNA, 201 bp, Homo sapiens
cgcagggcggccgcggcgcaggagaaggggcagagccgagcaccgcgcaccgcgtcatgggggccgcctcgggccgccgggggccggggctgctgctgccsctgccgctgctgttgctgctgccgccgcagcccgccctggcgttggaccccgggctgcagcccggcaacttttctgctgacgaggccggggcgcagctct

SEQ ID NO: 64339 - DNA, 201 bp, Homo sapiens
aaacagaattcttgattaacaaagaatgatggaattaaacatttggactttttttttaaaacaacagttttatcaagatatagttcatataccataaaatycccccttttaaagtatacaactgagtggcttttagaatattcagagttgtacaaccatcactactaatgtcagaacatttcactacccctaaaagaaacc

SEQ ID NO: 64340 - DNA, 201 bp, Homo sapiens
gacactaaaatgtaggattggagatcggttaaggtgggaggcagggttgctggggcaagttacagtcacaggctggggtcagacagaactgggttcaaacyccgtctccattactttgtttccttgagaaaattcctcaatttctgtgagcttccatttcctgacctgtgaaccccatttcacaggatgcacgatggctaa

SEQ ID NO: 64341 - DNA, 201 bp, Homo sapiens
acatttaaaacctcttcagactttaagctggggagaatcctccagccttgactggcagatttctaccagggaattcgtgatgctttggataagatcatgtrggactggcttccctgcccagaccaccctagtagatccacacggcccatttggccacaccttgcctctacttgcatataccccagggatggagacctcact

SEQ ID NO: 64342 - DNA, 201 bp, Homo sapiens
ggttacacagatgcagaatacagaaggtcaatagtagcttaatgctacatcacagcttaacactacatcatccacctcacttcatctcaccccatcgtatygtgtcactgtgctcaccatcacaagaacagggaggatagcacaggaagatattctgacagagaaagagagagaccacatttacataacttttattacagt

SEQ ID NO: 64343 - DNA, 201 bp, Homo sapiens
tgaaagagctcacccccgacacaaggacccgcacacagatacctcccagctccctctcaacccaccctttccagggttggagaacttgaggcataaacttkcttccatgaggaatctccacccagaaatgggtctttctggcccccagcccagctcccacattagaacaatgacaaatagaaggggaaatggaaaataaac

SEQ ID NO: 64344 - DNA, 201 bp, Homo sapiens
aaacttgcttccatgaggaatctccacccagaaatgggtctttctggcccccagcccagctcccacattagaacaatgacaaatagaaggggaaatggaarataaacaggagaaacggttttcccaggacagggtttggcctacaagttgtggatgtgggtacccatgccaagtgtgaggggaggctggccgggtgtggtg

SEQ ID NO: 64345 - DNA, 201 bp, Homo sapiens
tcaggtgccaatctgccctgtgccctggccctgccctgttctgtccatccgtcactctcaccctcgccctctctacgccccaggatcaagcagtgcacacrggtcacgatggaccagctctccacagtgcaccatgagatgggccatatacagtactacctgcagtacaaggatctgcccgtctccctgcgtcggggggcc

SEQ ID NO: 64346 - DNA, 201 bp, Homo sapiens
aatattcagagttgtacaaccatcactactaatgtcagaacatttcactacccctaaaagaaaccccataccacagattccgatgccgccgggagccctgycatgccatgtcacatatattatagtatatctatgcccagccatggtcaacccaccgtgttctttgacatcaccatcaacagcaagcccttgggccacgtc

SEQ ID NO: 64347 - DNA, 201 bp, Homo sapiens
cctccagaggcttctctgagtccttcttttccttccttttcatatcctggttctggtcttcccaggagctttcccaggcctgacccccatctggtcacatscctgcctcccttccccacacttttcctgtttccaggaggccttgggccttccttccacctcaagaccctcactgccctagtcttcccacaatccccaggc

SEQ ID NO: 64348 - DNA, 201 bp, Homo sapiens
aatgtcagaacatttcactacccctaaaagaaaccccataccacagattccgatgccgccgggagccctgccatgccatgtcacatatattatagtatatmtatgcccagccatggtcaacccaccgtgttctttgacatcaccatcaacagcaagcccttgggccacgtctccttcaagctgtttgcagacaagtttcca

SEQ ID NO: 64349 - DNA, 201 bp, Homo sapiens
ggaggttgcatgggctcctggggaggctgggagtcagtgtctgtcagagaatagggaaaacttgaggggaaagggcattatagccagtaactacagagaasgggtaccccggctgcaactgagctggtgggagggtggccaaaagaggagaccaggtctctctgaattaagaatctgagccccaaactcaggtgttcaggg

SEQ ID NO: 64350 - DNA, 201 bp, Homo sapiens
tgtataggaaaaaatatagtgtatatagggcttggtactttcttcaatttcaggcatccattgagagtcttggaatgtacccactgaggataagggggggytgctgtacatactttgcaaatatcttctctcatcccatgggttgtcttttcattttctttctttttttttttgagacggagttttgctcttgttgcccag

SEQ ID NO: 64351 - DNA, 201 bp, Homo sapiens
aatgacaaatagaaggggaaatggaaaataaacaggagaaacggttttcccaggacagggtttggcctacaagttgtggatgtgggtacccatgccaagtktgaggggaggctggccgggtgtggtggctcatgcctctaatcccagcactttgggaggccaaggtgagtagatcacttgaggccgggagtttgagaccag

SEQ ID NO: 64352 - DNA, 201 bp, Homo sapiens
ctcagacaatgctaagagctggggtgggggagctcaccctgatagctgtgggcagagttggggggccttggctctgctgtgcgcatgtgacttagcacacrtcacatgtgatgtgcagaagggcctggggcccagtggcacaaggccctcaaccaactccgccccgggccacggcctcgctctgctccaggtactttgtca

SEQ ID NO: 64353 - DNA, 201 bp, Homo sapiens
gggcctggcacagccagaaatgacagtggcagcatcttgcagccccaggacatgtggccctcggaggagtgtgggtgggactgatgtgtgagatttctggycctaagccaggcctgcagcccttgagggccccagggtacaggtgccggccccagggtgccactcagcgatgcatgaagaagcaggcacagccaggcaggg

SEQ ID NO: 64354 - DNA, 201 bp, Homo sapiens
ggctggagtgcagtggcacaatctcggctcaccacaatctctgcctcccgggttcaagcgattctcctgcctcagcctcccgagtagctgggattacaggmatgaaccaccacgcctggctaatttttgtatttttagtagagatggggtttctccatattggccagcctggtctcgaactcccgacctcaggcgatctac

SEQ ID NO: 64355 - DNA, 201 bp, Homo sapiens
aaacaagcactgtggccctgcctcaggattgagtggctggggcctggcacagccagaaatgacagtggcagcatcttgcagccccaggacatgtggccctmggaggagtgtgggtgggactgatgtgtgagatttctggccctaagccaggcctgcagcccttgagggccccagggtacaggtgccggccccagggtgcca

SEQ ID NO: 64356 - DNA, 201 bp, Homo sapiens
cccaggctgggcagccatgcggctgacctcggagcctggccctgccccgcacccttgccctgccctgccctgccctgcccatgctgtctccttgcttcccrctcagctcgctcagaagggcccctcccagacagcggccgcgtcagcttcctgggcctggacctggatgcgcagcaggcccgcgtgggccagtggctgctg

SEQ ID NO: 64357 - DNA, 201 bp, Homo sapiens
ccggcttccatgaggccattggggacgtgctggcgctctcggtctccactcctgaacatctgcacaaaatcggcctgctggaccgtgtcaccaatgacacsggtatgggagggctgagaggcccccacccagcctcacctaaaccccgctccaccccacagcaggacctcacttgccccactcagctctgcccttctttct

SEQ ID NO: 64358 - DNA, 201 bp, Homo sapiens
agccgagatggcgccactgcactccagcctgggcaacagagtgagaccctgtctcagaaaaaaaaaaaaaaaaaaaaaggagaggagagagactcaagcaygcccctcacaggactgctgaggccctgcaggtgtctgcagcatgtggccccaggccggggactctgtaagccactgctggagagccactcccatcctttc

SEQ ID NO: 64359 - DNA, 201 bp, Homo sapiens
cctccatgccttcgtccgccgcgcactgcatcgccgatacggagacagatacatcaacctcaggggacccatccctgctcatctgctgggtaaggacctgrcctcgcctccacatgagtcccacggaagtgtgggtcccgaggtaggggtgggggatgtccagggtaagggaaggtgggttgtgaccctcacatctcacat

SEQ ID NO: 64360 - DNA, 201 bp, Homo sapiens
ctttataatgaatgcatcgtctcctgagaaagctagtttcataacaaccccagatcagccaagtccagatcagccctctcacttgagacaggaagaggacycggggcaactgggtgccggagctggactgaaaactcccatctcccagctgccttccaggaacttccccaccacacgtccttgcacaaccagtcaactgtc

SEQ ID NO: 64361 - DNA, 201 bp, Homo sapiens
tggatcgggaccgaggagtgctgagagaccaggtttcaggggcctggagtgtgtgaaacatgagcatgtgtgtgcttgcatgtgtgtgcctctgtgtgtgwgtgtgtgcttgcaagttcacgcctgtgtgtgtgtgtttgcaggcttctcagagttacagcttctcgggtaggtcctggttgttcctgctgctgccacttg

SEQ ID NO: 64362 - DNA, 201 bp, Homo sapiens
tcacgcaggctggcaagaacatagctcactgcagcctcccatcccagcctcctgagtagctgagactacaggcgcgcaccctcacacccgactaatttttwaattttttgtagggatgggggtctcactatgttgcccaggctggcacatgatccatttttgaccatattcatgtacacttacagtcctgctgaggggcat

SEQ ID NO: 64363 - DNA, 201 bp, Homo sapiens
gaccaagctaggaggcagcatgcagcggccaccctctcagtggcagctttttggctttttgtagcaccagcctctccctggggactcaccacagtgctggrtggggtgtgcatcgggagacagaggtgaagacaacaaggaggttgtgagtgctgggaaactgaacgaaggagcacattcaagagggagagaagaggagag

SEQ ID NO: 64364 - DNA, 201 bp, Homo sapiens
gacctggctccacacccctcctccagggctggaacgccacgcacatgttccgggtggcagaggagttcttcacctccctggagctctcccccatgcctccygagttctgggaagggtcgatgctggagaagccggccgacgggcgggaagtggtgtgccacgcctcggcttgggacttctacaacaggaaagacttcaggt

SEQ ID NO: 64365 - DNA, 201 bp, Homo sapiens
cagggagttgacccgagatggggaccccagccctgtccccaggccagccagagtgggctccccctgacctggctccacacccctcctccagggctggaackccacgcacatgttccgggtggcagaggagttcttcacctccctggagctctcccccatgcctcccgagttctgggaagggtcgatgctggagaagccggc

SEQ ID NO: 64366 - DNA, 201 bp, Homo sapiens
gtagatccctggaggaggcaggtaatgtggtgttgggagagcctggctgtgtcccctctgtaggctatgtagatgcaggggactcgtggaggtctatgtaygagacaccatccctggagcaagacctggagcggctcttccaggagctgcagccactctacctcaacctgcatgcctacgtgcgccgggccctgcaccgtc

SEQ ID NO: 64367 - DNA, 201 bp, Homo sapiens
actcctgacctcaagtgatccacctgcctcagcctcccaaagtgctgggattacagacatgagccattgtgcccagccttaaatgtactcttttaaattgaaaaaagaaaataagctgtgatccatttttgagttaatttttatacatggcataaagacctgcattttaagtcccttttggattgctctgctacttgtcct

SEQ ID NO: 64368 - DNA, 201 bp, Homo sapiens
tccctccagtttagccctcccccgggatccccacggcagcacgcagtctgtccccggaacccccagtttgggcagaactccctctgcttgcagggctggaygcccaggaggatgtttaaggaggctgatgatttcttcacctccctggggctgctgcccgtgcctcctgagttctggaacaagtcgatgctggagaagcca

SEQ ID NO: 64369 - DNA, 201 bp, Homo sapiens
tcttgaattatccccccttttcccagcctgttttgaaagctctttgtttaccagacaaaggtcatcaatcatatgaccccctttgccttttttttttttttaagatggagtctcgctcttgttgcccaggctagagtgcagtggtgtgatctcggctcactgtaacctccacctcctggctttcaagcgattctcctgcct

SEQ ID NO: 64370 - DNA, 201 bp, Homo sapiens
taaatggttccgagtcatctaccaatgaagacttcttgaattatccccccttttcccagcctgttttgaaagctctttgtttaccagacaaaggtcatcaatcatatgaccccctttgccttttttttttttttaagatggagtctcgctcttgttgcccaggctagagtgcagtggtgtgatctcggctcactgtaacct

SEQ ID NO: 64371 - DNA, 201 bp, Homo sapiens
cacttttatgtggtttcgccaattttattccagctctgaaattctctgagctccccttacaagcagaggtgagctaagggctggagctcaaggcattcaamcccctaccagatctgacgaatgtgatggccacgtcccggaaatatgaagacctgttatgggcatgggagggctggcgagacaaggcggggagagccatcc

SEQ ID NO: 64372 - DNA, 201 bp, Homo sapiens
ggagggcagatgtcccaggggctggtcactggagcattcctcccctctgactccccagtacaacgccctgctaagcaacatgagcaggatctactccaccrccaaggtctgcctccccaacaagactgccacctgctggtccctggacccaggtacggcccttgcagctcccctctcggcggtgccctagtgttcccacat

SEQ ID NO: 64373 - DNA, 201 bp, Homo sapiens
ctctgaaattctctgagctccccttacaagcagaggtgagctaagggctggagctcaaggcattcaaacccctaccagatctgacgaatgtgatggccacrtcccggaaatatgaagacctgttatgggcatgggagggctggcgagacaaggcggggagagccatcctccagttttacccgaaatacgtggaactcatca

SEQ ID NO: 64374 - DNA, 201 bp, Homo sapiens
aaggaagcattctggagtaggaagccaaattcaaatacacttctccctaggctggtttatgagcttctttggaagagttgagaagggctgggcgtggtggytcaagcctgtaatcccagcactttgggaggctgaggtgggcgcatcgcttgagcccaggagttcaagaccagcctggccaacatggcaaaacctcgtctc

SEQ ID NO: 64375 - DNA, 201 bp, Homo sapiens
ttggagatggggtggggagttactttctgttaaaggaagcattctggagtaggaagccaaattcaaatacacttctccctaggctggtttatgagcttctytggaagagttgagaagggctgggcgtggtggctcaagcctgtaatcccagcactttgggaggctgaggtgggcgcatcgcttgagcccaggagttcaaga

SEQ ID NO: 64376 - DNA, 201 bp, Homo sapiens
gctatgtagatgcaggggactcgtggaggtctatgtacgagacaccatccctggagcaagacctggagcggctcttccaggagctgcagccactctacctsaacctgcatgcctacgtgcgccgggccctgcaccgtcactacggggcccagcacatcaacctggaggggcccattcctgctcacctgctgggtaagggca

SEQ ID NO: 64377 - DNA, 201 bp, Homo sapiens; identical to SEQ ID NO: 12808

SEQ ID NO: 64378 - DNA, 201 bp, Homo sapiens
tctgagtttcccactcctggtctccactccccagcctgccctcacgtttctcaaccaggtacttcctcagtctggtgctccagttccagttccacgaaacmctgtgcaaagcctcgggccacatgggtccactgcaccagtgtgacatctacaactccaagattgccgggaagctcctggggtgagtgccctctccttcat

SEQ ID NO: 64379 - DNA, 201 bp, Homo sapiens
aagcccaggtaagcacagaatggctttctgagcattgatttttcttggagatggggtggggagttactttctgttaaaggaagcattctggagtaggaagycaaattcaaatacacttctccctaggctggtttatgagcttctttggaagagttgagaagggctgggcgtggtggctcaagcctgtaatcccagcacttt

SEQ ID NO: 64380 - DNA, 201 bp, Homo sapiens; identical to SEQ ID NO: 12809

SEQ ID NO: 64381 - DNA, 201 bp, Homo sapiens
gcagcccatcagggagggaggaaccctgggatccacatgggccctgacagaagggaaagcccaggtaagcacagaatggctttctgagcattgatttttcytggagatggggtggggagttactttctgttaaaggaagcattctggagtaggaagccaaattcaaatacacttctccctaggctggtttatgagcttctt

SEQ ID NO: 64382 - DNA, 201 bp, Homo sapiens
gcccaggctggaggggggtgggcgctgggagtggggagccccccacttgcatctggtgccacattcactgcagatctatgtcgggcaagtcaccatggatrggggaagaagttaataatcttgtccaggagaccacggcacccatcacaacattgtgtgatcttagagggcgaggaagaggctgtgagtgggagctgggga

SEQ ID NO: 64383 - DNA, 201 bp, Homo sapiens; identical to SEQ ID NO: 12810

SEQ ID NO: 64384 - DNA, 201 bp, Homo sapiens
cggcctcctagtgccccatcgtgggggtcgggggagagcagcccatcagggagggaggaaccctgggatccacatgggccctgacagaagggaaagcccargtaagcacagaatggctttctgagcattgatttttcttggagatggggtggggagttactttctgttaaaggaagcattctggagtaggaagccaaattc

SEQ ID NO: 64385 - DNA, 201 bp, Homo sapiens
tgtgagcagggcctcggaagatgacagggtttgacagatgggaagtgggggatgagaggacagacgcagtgttcaggccaagggaactggaacaaagaagracctgagaatgtaaatctacttcaaccctggaccctcctttgccaagggctgcaatctcagatgccctgaatgtgtgaagtaggcggtgaggacagtaag

SEQ ID NO: 64386 - DNA, 201 bp, Homo sapiens
tctgtctctctctctggctctctccctggctctctccctcttctctctcatgttctctccatcactcatcgctctaaccctctctcactggtttgcacttyagacttcatctgatgtcagccgaagcttcacctcacttggctaggaaagagccttgagtccaaatctgtttctgagccttccattcatcctgagtttctt

SEQ ID NO: 64387 - DNA, 201 bp, Homo sapiens
gctatgctaaagcaggtccgcaccagcccaggggcagggaggccccgccgggatgggagggaccctctgattcaggagttccctccagtttagccctcccscgggatccccacggcagcacgcagtctgtccccggaacccccagtttgggcagaactccctctgcttgcagggctggacgcccaggaggatgtttaagga

SEQ ID NO: 64388 - DNA, 201 bp, Homo sapiens
acgcagtctgtccccggaacccccagtttgggcagaactccctctgcttgcagggctggacgcccaggaggatgtttaaggaggctgatgatttcttcacytccctggggctgctgcccgtgcctcctgagttctggaacaagtcgatgctggagaagccaaccgacgggcgggaggtggtctgccacgcctcggcctggg

SEQ ID NO: 64389 - DNA, 201 bp, Homo sapiens
gctctgtccaaggacgagctgcgggaggtgatggatggaacccccaggcctttaggcacatgctccctggtcctaggggtctggtaggggagacagagtgcctggggcaggagggaggcagggagtggaggaagggcaggatcagaacttcctctggagaaggagaggagtagaggtgggggtaccgatctctcctggctg

SEQ ID NO: 64390 - DNA, 201 bp, Homo sapiens
acactattgtgtctgtgcatatgatgtgtgtggtgtaagtgatggggaaaacggggtgattgtgcacagaggcccagcacgcaggagaatggggtgcccaktatagccccaagtgcagggaccctccctcaagtcaaaaatgccacccccagcctggttctccccaaactcatcttccaacatatattcccactcgacagg

SEQ ID NO: 64391 - DNA, 201 bp, Homo sapiens
ggagtatgcggacttttggggacagaaccacagcttctgtgaaaaccaatccataaacagaattcttgattaacaaagaatgatggaattaaacatttggrctttttttttaaaacaacagttttatcaagatatagttcatataccataaaatccccccttttaaagtatacaactgagtggcttttagaatattcagag

SEQ ID NO: 64392 - DNA, 201 bp, Homo sapiens
gggccctgacagaagggaaagcccaggtaagcacagaatggctttctgagcattgatttttcttggagatggggtggggagttactttctgttaaaggaarcattctggagtaggaagccaaattcaaatacacttctccctaggctggtttatgagcttctttggaagagttgagaagggctgggcgtggtggctcaagc

SEQ ID NO: 64393 - DNA, 201 bp, Homo sapiens
ggaggccctggtgggctgaggaccaagaaagggtggtgagcttgggaggtgggaaaggggcacttagtggcccatgggcagaggtgtggggcagagcaatyggaaggaagggagccacccagaccatcccaggaggcaggtcacagggcccaaaaggtacagcacccccacccctccaccatcacaggcacaccagggcca

SEQ ID NO: 64394 - DNA, 201 bp, Homo sapiens
tagctaggtccatctcccaatatctgtcccccttagtccacagcttttgccccccaatccaggtgccgtgcgtgtctctgtgtgtccgtgtctgtgtgtgygttgtacacaggcttggctgttacaggcccattctgtaaggcaggatgtggggctgaggtattttaggattgaaagagggtggaagtttatgattacata

SEQ ID NO: 64395 - DNA, 201 bp, Homo sapiens
ctccaaccactctgctctggagatggccttgttcaacacacacacacctgctgcctggcccgttgccctggggagcgagcataggacaaacagcacctttycaggctcagtgggggatggggaggacaggaaggagggaactgtaggagaatacttgggaaattagtgctctagaaacaagcctggggaaagaacgggaag

SEQ ID NO: 64396 - DNA, 201 bp, Homo sapiens
ctgtagctaattagaaattgtagagtggcaacccccaagccaattttccagctagctgcagatccacgggcctcgagccagtggaagagccgacttacagmtgagaggctgaggtccgagcctttggcctgagctacatacctcacccccacgcccccaggcttcacagacacgggggcctactggcgctcctggtacaac

SEQ ID NO: 64397 - DNA, 201 bp, Homo sapiens
gctctggccctgggtccagtgggggagccatcagcctagctcatgcccaaggaaacaagcactgtggccctgcctcaggattgagtggctggggcctggcrcagccagaaatgacagtggcagcatcttgcagccccaggacatgtggccctcggaggagtgtgggtgggactgatgtgtgagatttctggccctaagcca

SEQ ID NO: 64398 - DNA, 201 bp, Homo sapiens
tgggaagccgaggcaggaggtctgcttgagctcaggggttcgagaccatcctgggcaacatagcgagaccccatttcataaaaaataaataagtaaatgasaacaaggaaggactgacgagagacggtagaaccttctggtttgggcagctctgcagctgccattcatcctggccataagaattcttggggtgaataagtt

SEQ ID NO: 64399 - DNA, 201 bp, Homo sapiens
ggtggtcacacctgtaatcccagcactttgggaggtcaaggcgggtggatcacctgaggccaggagttcgagaccagcctggccaacatggcgaaaccccrtctctactaaaaatacaaaaataaattagccaggggtgatggcgggcgcctgtaatcccagctactcaggaggctgaggcaggagaatctcttgaacccg

SEQ ID NO: 64400 - DNA, 201 bp, Homo sapiens
gatggcgggcgcctgtaatcccagctactcaggaggctgaggcaggagaatctcttgaacccgggaggcggaggttgcagtgagctgagattgtgccactrcaggccagcctgtgcaaaagagtgagacgctgtctcaaaaaaaaaaaagaaaaaaagaagttacttgtttctactgcggcttcatgccccagggcagctc

SEQ ID NO: 64401 - DNA, 201 bp, Homo sapiens
ccaggatcaagcagtgcacacgggtcacgatggaccagctctccacagtgcaccatgagatgggccatatacagtactacctgcagtacaaggatctgccygtctccctgcgtcggggggccaaccccggcttccatgaggccattggggacgtgctggcgctctcggtctccactcctgaacatctgcacaaaatcggcc

SEQ ID NO: 64402 - DNA, 201 bp, Homo sapiens
ccttctcctttcctgcctgaaactccctcttccaggaagtcttccccagttcctcaggatggggaagggttgccgggtggaaatgccttttctacaaaagytaaatccatctgtttgcaacctctaggccctaagacaatttaaccatccttttccagaaccaagtatcaggggatctgtcctcctgttacccgaaacgaa

SEQ ID NO: 64403 - DNA, 201 bp, Homo sapiens
tgcatggagctggcctctccctgggggcacatgctgtgacacagggaggcacacgaggatgttgggtgctctgtacagatccactctcacccctgacaggytcagaagctgccttccttggaggatggcgttttagttacctattgctgtgcaaccaagcaccccagagcttagccttacgaaacaaccagttgattttgc

SEQ ID NO: 64404 - DNA, 201 bp, Homo sapiens
ttcccccagcatcctagagagggtgtgctcagacctgagggcccctccccttccagaggaagccagacacaaggctctgtgaggtcacactgcgggctccrctcttattggccaggggacggtagctgcaggactctgctctcctgcggccatgggccagggttgggctactgcaggacttcccagcctcctcttcctgct

SEQ ID NO: 64405 - DNA, 201 bp, Homo sapiens; identical to SEQ ID NO: 12830

SEQ ID NO: 64406 - DNA, 201 bp, Homo sapiens
aagtgatccggtcacactaagtgacacttagtgatcagaagtgccccggtgccactgagtggccttgtccaagctacatccactctgtgggctcctccttstagcagcgaggggagggcagatgtcccaggggctggtcactggagcattcctcccctctgactccccagtacaacgccctgctaagcaacatgagcagga

SEQ ID NO: 64407 - DNA, 201 bp, Homo sapiens; identical to SEQ ID NO: 12807

SEQ ID NO: 64408 - DNA, 201 bp, Homo sapiens
gcagctccctcctcattcctgtctttcaggtgccaatctgccctgtgccctggccctgccctgttctgtccatccgtcactctcaccctcgccctctctaygccccaggatcaagcagtgcacacgggtcacgatggaccagctctccacagtgcaccatgagatgggccatatacagtactacctgcagtacaaggatct

SEQ ID NO: 64409 - DNA, 201 bp, Homo sapiens
tggcctcttggctcacatgttgggtgcttggggtgagatggctggaacggctggaggtgggtcaggcatctctccaggctagctcgggcgccctcccagcrtggaatctgaggtgggcagatttacctggcagccagcatcccccacagcaactactgacgcagccagttctcaaggctaggtccaaaactggcccagagt

SEQ ID NO: 64410 - DNA, 201 bp, Homo sapiens
tgccacgcctcggcctgggacttctacaacggcaaggacttccggtacatccagctagggctcaggtctcgttcctgagccccacgggcaagggaaatgarccaagcaaagggtccactactgtcccccagctggagccagcagggcaggatggggacagggccagagtttgggactgagtgtctagagaggtgttggctt

SEQ ID NO: 64411 - DNA, 201 bp, Homo sapiens
acaccctgaagtacggcacccaggccaggaagtttgatgtgaaccagttgcagaacaccactatcaagcggatcataaagaaggttcaggacctagaacgkgcagcactgcctgcccaggagctggaggaggtgtgtggctcgcaaggtacagggagaggggaatcctggggcagtgagcccaacacagggtctggcctgg

SEQ ID NO: 64412 - DNA, 201 bp, Homo sapiens
ggctgcgcggccgcacggtgggcaggctcgggtgttccggcaaactgccgggtccccatcttcaaaagagaggaggccctttctccagcttcctctgcggragcccgacccagccccatcccgccacccccgggctgcacctcggcccctccccggcccgcgcccctgcccggggcgggccaggaacctcggcccgcgccg

SEQ ID NO: 64413 - DNA, 201 bp, Homo sapiens
tatccccccacaccaatgctgcagctctctggatggatgcaccctgacctcccctgtgttagaggagaggtgggcgtgttgaatcatggaggcagacttcycctttgccgttctcgtgatagtgactgagttctcaggatctggttgtttaaaagtgtgtagcgcctcccccttctctctctctcctgccaccatgtgaag

SEQ ID NO: 64414 - DNA, 201 bp, Homo sapiens
tgactgccctcaccctcttcccagaggatgaggtcaatttcctgatgcatattgccctggagaagatcgccttcatcccctttggctacctgatggacctstttcgctggaaggtctttgacggcaccatctggaaggacatctacaatcaggagtggtggaacctcaggtgggttgggcaccatcttccaccagatgggc

SEQ ID NO: 64415 - DNA, 201 bp, Homo sapiens
ttgtcctagtgttcttgtcaaaaacaattgaacataattgtatgggttcatttctggactctcaattctattccattgttgagcatatttttaagggctgkttttctctcctgtggtaactggtgacctgtacttcctggaagagagatgaaaagattcccaagccaactgagttacctcacgtgggtcaggtctctgtgg

SEQ ID NO: 64416 - DNA, 201 bp, Homo sapiens
gactgccctcaccctcttcccagaggatgaggtcaatttcctgatgcatattgccctggagaagatcgccttcatcccctttggctacctgatggacctgyttcgctggaaggtctttgacggcaccatctggaaggacatctacaatcaggagtggtggaacctcaggtgggttgggcaccatcttccaccagatgggcc

SEQ ID NO: 64417 - DNA, 201 bp, Homo sapiens
tctctttcctacctttcaaggttattgtaaataccaaattagattgtttatacacaagaatttagcactaaagcactatacaaatgtaagctatttatttytatttatccttctccttcatgaataagaccctaaaaatagaagatatttttaatttttactcactgggctcaaggttgcagtgtctgtattattgcaaat

SEQ ID NO: 64418 - DNA, 201 bp, Homo sapiens
tggaaatccaattgccccagcaccatttgttaaaaatattttctttcccatttaattgtcctagtgttcttgtcaaaaacaattgaacataattgtatggrttcatttctggactctcaattctattccattgttgagcatatttttaagggctgtttttctctcctgtggtaactggtgacctgtacttcctggaagaga

SEQ ID NO: 64419 - DNA, 201 bp, Homo sapiens
cccaggccggtctcgaactcctgggctcaagcaatcctcccacatcagcctctcaaagtgctgggattacaggtgtgagccaccacacctggcctacttcsttccattttatagacattttacaacaagactcggagacaatcagcaactttcccacagtcgcacatctcagaggggcaaaaacagaccttcaggttatca

SEQ ID NO: 64420 - DNA, 201 bp, Homo sapiens
ctggctcttcttatattattcctgcaaaaggctgtgtgctcaccccccggagtgtgaatacgagtgtgggtcatttcctctttcctctgcacccttccttygatgaggttttgccctgtgctaggcaccatgctaaactctgagaaaaccacagagaacaaggcagacgccatccctgccctccagtaacatacaatttag

SEQ ID NO: 64421 - DNA, 201 bp, Homo sapiens
cctccatcattcaaagaatacagcccctggtgagcttagatccaggtctaactggttccaagatcagcactccaaccttggagatgtggagctcacccacygacttgatcattttcctgttgaatttcaacggatttcaataggtccatttccctaattggtcaaggtcatcttgagctttattcctgtctcctagaggat

SEQ ID NO: 64422 - DNA, 201 bp, Homo sapiens
ggggagacagggtctggagttttccctgaccaagaagctcattcagatggagtttgggttgttactgccagctggagcatactgcaagcagaacagaagcrtaagtcaggagctgaagacagatctcagcagcccttggaaatcctcccccaccccccaggaccacagggtcctcactggacctggcagcatgggtgggaa

SEQ ID NO: 64423 - DNA, 201 bp, Homo sapiens
cgagccggaggccgctaggctcccaggccccggccgaggctgcgcggccgcacggtgggcaggctcgggtgttccggcaaactgccgggtccccatcttcwaaagagaggaggccctttctccagcttcctctgcgggagcccgacccagccccatcccgccacccccgggctgcacctcggcccctccccggcccgcgcc

SEQ ID NO: 64424 - DNA, 201 bp, Homo sapiens; identical to SEQ ID NO: 12936

SEQ ID NO: 64425 - DNA, 201 bp, Homo sapiens
cagccccatcccgccacccccgggctgcacctcggcccctccccggcccgcgcccctgcccggggcgggccaggaacctcggcccgcgccgctggggactytggagcggaggaggaagcgcggcggggcgggggcgggggtgtgtcgggttttataacccgcagggcggccgcggcgcaggagaaggggcagagccgagca

SEQ ID NO: 64426 - DNA, 201 bp, Homo sapiens
ggtgccaggggtgggagaggcggggccgggtagggacagggcagggtacaagggagtgcgagagggataatggcttctggtgagaccacaaacctggagargggaggcagaggtttgtctgtttccctgcactctgtcccacagacctggtgactgatgaggctgaggccagcaagtttgtggaggaatatgaccggacat

SEQ ID NO: 64427 - DNA, 201 bp, Homo sapiens; identical to SEQ ID NO: 13014

SEQ ID NO: 64428 - DNA, 201 bp, Homo sapiens
gaaaaacagtcactgactcaagacactgagatattcagcccactgcccaatgcctgcttcctgggcatagccatggaaccctgccaggctgctaaaggacagtggatgctgctgggcctctgccttgtcctgatgctgtgctcaatcagcctggccatctggattttcacacagtaaagcaggaagcctccaagggtaaga

SEQ ID NO: 64429 - DNA, 201 bp, Homo sapiens
tgagggggaaggatcacctgagcccaggaggtcaaggctacagtgagctgtgattgcactactgcaccccagcctgcgtgacagagtgagacctccccccmaaaaaaagagagagagaaaaggttgagaaagactgggaagtcaccaaagccagagaatgggagggatctgccctcactgcagggtggtgccaagctggga

SEQ ID NO: 64430 - DNA, 201 bp, Homo sapiens
gaacatttactcaatgcctgagcaattcttctttccttaaaaatcagtctctgggaggcctaggtgggaggatcacttgaagccaggagttggagactagsctgggcaacatagcaagatcccatctctattcaaacaaacaaataaacaaaaatcaatctctagtaacagaataatttgtacataaataagtggtgctca

SEQ ID NO: 64431 - DNA, 201 bp, Homo sapiens
tgtgaacataagaggtcaagttagaagaacctagagagataacctggcttccagagacccagatatatcacatccatccatccatccatccatccatccayccatccatcatcccatccacctgctcagaagtggtcccagcctatggagggagggcctcatcaatccctggccataacccaagggtggctcaagccccag

SEQ ID NO: 64432 - DNA, 201 bp, Homo sapiens
aaataagtggtgctcaagtcgttttttaaaagattgaaagcctctgtttgtctcctctacaaaaggggctacacttcctctttaccctcattccctgcctrtttggctgagcacaaattatgccactgagccacacactgttactgttccttggcactttgatctgttgcctcatctttttctcaacagccttgcaaaatt

SEQ ID NO: 64433 - DNA, 201 bp, Homo sapiens
tgagcttattcccattttacagatgggatttgatattaactctgaggttcagaaaggccacagagctaataccaagctggctccttcctaagggcctttamgacacttgggggtcttctcttctctgcccctgcctggatatgtgttgcttgaccgcaggcatccagggagggtgagtactgcatccaggacgttatcagc

SEQ ID NO: 64434 - DNA, 201 bp, Homo sapiens
gcccagagtcacttctgccatgttttattggctagaacaagtcacaagttcacccagattcaagagaagagaaaaaagtccctcccacttgggagaagtgrcaaagaccatctgtcacagctgaagaagtgtctcttacaaggagaacagacacggggagcctgaaacaaaacccgatgggattccctgggctgtgcaggc

SEQ ID NO: 64435 - DNA, 201 bp, Homo sapiens
ctagctgcagatccacgggcctcgagccagtggaagagccgacttacagctgagaggctgaggtccgagcctttggcctgagctacatacctcacccccaygcccccaggcttcacagacacgggggcctactggcgctcctggtacaactcccccaccttcgaggacgatctggaacacctctaccaacagctagagccc

SEQ ID NO: 64436 - DNA, 201 bp, Homo sapiens
ccaagaaagggtggtgagcttgggaggtgggaaaggggcacttagtggcccatgggcagaggtgtggggcagagcaatcggaaggaagggagccacccagwccatcccaggaggcaggtcacagggcccaaaaggtacagcacccccacccctccaccatcacaggcacaccagggccaagccgctaggaccctgggtctg

SEQ ID NO: 64437 - DNA, 201 bp, Homo sapiens
acacatcacatgtgatgtgcagaagggcctggggcccagtggcacaaggccctcaaccaactccgccccgggccacggcctcgctctgctccaggtacttygtcagcttcatcatccagttccagttccacgaggcactgtgccaggcagctggccacacgggccccctgcacaagtgtgacatctaccagtccaaggagg

SEQ ID NO: 64438 - DNA, 201 bp, Homo sapiens
gcagtggctgcacctgcacagggattagctgccagcagccaccctgctggcgtcccagcacacacctcctcactccctgcattggagggagtgtcattttragggacatttttatgacttttatgtgtatgtttatgtagaaatttggaaaatacagaaaactgtaaagaaaataaaagccctttatatcaacgtcaagag

SEQ ID NO: 64439 - DNA, 201 bp, Homo sapiens
gcccaggctggagtgctggagtgcagtggcctgatctcggctcactgcaacctccacctcccaagttcaagcgattctcctgcctcagcctcccgagtagytgggctactacttcaggcgcacgccgccatgcccagctaatttcttttgtattttagtagagatggagtttcaccatgttgcccaggctggtcttgaact

SEQ ID NO: 64440 - DNA, 201 bp, Homo sapiens
ggcaggatgtggggctgaggtattttaggattgaaagagggtggaagtttatgattacataggacaatggaatttataaacatgtcctctaaatggttccragtcatctaccaatgaagacttcttgaattatccccccttttcccagcctgttttgaaagctctttgtttaccagacaaaggtcatcaatcatatgaccc

SEQ ID NO: 64441 - DNA, 201 bp, Homo sapiens
tccggtaccgccacccaccccacctccagccttgggtcttaaccccctccccaggctgggcagccatgcggctgacctcggagcctggccctgccccgcayccttgccctgccctgccctgccctgcccatgctgtctccttgcttcccgctcagctcgctcagaagggcccctcccagacagcggccgcgtcagcttcct

SEQ ID NO: 64442 - DNA, 201 bp, Homo sapiens
ggctccccagccacccgggcccctctgtcaaaccctcagccctgagtctcttctgggctttgctgatgtcttcaccctagctaggtccatctcccaatatstgtcccccttagtccacagcttttgccccccaatccaggtgccgtgcgtgtctctgtgtgtccgtgtctgtgtgtgtgttgtacacaggcttggctgtta

SEQ ID NO: 64443 - DNA, 201 bp, Homo sapiens
accctccacctcatttgctcacagtagcctctaatctttgtgctatctctcagttccctttgggttccatgtttgccttattctcctccatgcctagctgkatttcagagttaagtttatgattatgagataaaaactaaataacaattgcaaaaaaataaaataaaaagaaagaagaggctgggagcggtggctcactcc

SEQ ID NO: 64444 - DNA, 201 bp, Homo sapiens
ctttattaattacctccttcctccaaactcacctctcccacacccccttgttccccccaccccagcccctctgcactgacatcacctttggcctttgcctraggtgcatgccccatttgaatgcttgccctccaagatcaggctcaaaattgctcaccaaaccctctgcagcactacaagcccacccagatgctcagtgaa

SEQ ID NO: 64445 - DNA, 201 bp, Homo sapiens
tggagtggagaagcctggagccctggcttcagcacaccttatactcccattgtgagcccaagggacctagcataaagttcaaccacctgcccctaaggacygggtgtgccgtgaaacacagctgacatttgtgcagcactacaggtggtgtgcggagcacctcccatgctcatgatgtttctaatcctcccaaaccctccc

SEQ ID NO: 64446 - DNA, 201 bp, Homo sapiens
tcctctaaaggggtaatccactgaaaattctcgaagtcaaagtggagggtttgtgttcacatagctccacgttgtgcagctacagacatttgggctcaaasaggccagggcacttggcaaaaataccccgggagacatctcagagacccctgggaaactggctcttcctctatttgcctttgctaggagtggtgagaacct

SEQ ID NO: 64447 - DNA, 201 bp, Homo sapiens
ccgcgtcctccagaggcttctctgagtccttcttttccttccttttcatatcctggttctggtcttcccaggagctttcccaggcctgacccccatctggkcacatccctgcctcccttccccacacttttcctgtttccaggaggccttgggccttccttccacctcaagaccctcactgccctagtcttcccacaatcc

SEQ ID NO: 64448 - DNA, 201 bp, Homo sapiens
aggtggtcatgtctctggggcaggggccctgcctgggtgtttctgtagctcccagccccctcccaccaggcctgtaggtggcccctgtctctgggggcacygtgatgttcaggaagctggtgggagcagtaaggactggtgcaggctctggtgaaggccgttgaagacttcaacgtggaggcctcctcaccgaccctgcct

SEQ ID NO: 64449 - DNA, 201 bp, Homo sapiens
acatacctcacccccacgcccccaggcttcacagacacgggggcctactggcgctcctggtacaactcccccaccttcgaggacgatctggaacacctctrccaacagctagagcccctctacctgaacctccatgccttcgtccgccgcgcactgcatcgccgatacggagacagatacatcaacctcaggggacccatc

SEQ ID NO: 64450 - DNA, 201 bp, Homo sapiens
tccctccccatgtcgcctcttcctcatcctctctccctatgtcacctctccctcatcctctccctcatcctctctatactctccctcatcctccctccctrtgtcgcttctgcctcatcctctctccccatgtctcctctccctcatcatctcccctcaccttcgaggatccccataagaccctgcctggggatttctatc

SEQ ID NO: 64451 - DNA, 201 bp, Homo sapiens
agtgactccaagccattcactgcaagggatggttacacagatgcagaatacagaaggtcaatagtagcttaatgctacatcacagcttaacactacatcawccacctcacttcatctcaccccatcgtatcgtgtcactgtgctcaccatcacaagaacagggaggatagcacaggaagatattctgacagagaaagagag

SEQ ID NO: 64452 - DNA, 201 bp, Homo sapiens
caacaagactgccacctgctggtccctggacccaggtacggcccttgcagctcccctctcggcggtgccctagtgttcccacattgccctgctgcactccrgaccatgcagttgtgtagggtctgtggagacagcaggtaaacccaaaggtgttgccctccaactggggctggacggtgcagatacccccacgccctgctt

SEQ ID NO: 64453 - DNA, 201 bp, Homo sapiens
ccaatgctcagatggagaactgcgccatcatttactgcaacgacggcttctgcgaactcttcggctactcccgagtggaggtgatgcagcaaccctgcacstgcgacttcctcacaggccccaacacaccaagcagcgccgtgtcccgcctagcgcaggccctgctgggggctgaggagtgcaaggtggacatcctctact

SEQ ID NO: 64454 - DNA, 201 bp, Homo sapiens
cctcaccgaccctgcctgcctgtgtctcagatctcaccaacatcctggcttcctcgcgaagctacgccatgctcctgtttgcctgggagggctggcacaaygctgcgggcatcccgctgaaaccgctgtacgaggatttcactgccctcagcaatgaagcctacaagcaggacggtgagcaggcctctccctgtccaggaa

SEQ ID NO: 64455 - DNA, 201 bp, Homo sapiens
cttattctcctccatgcctagctggatttcagagttaagtttatgattatgagataaaaactaaataacaattgcaaaaaaataaaataaaaagaaagaasaggctgggagcggtggctcactcctctaatcccagcactttgggaggccgaggtgggcctaccaaaggtcaggagatcgagaccaccctggctaacacgg

SEQ ID NO: 64456 - DNA, 201 bp, Homo sapiens
cctgtgtctcagatctcaccaacatcctggcttcctcgcgaagctacgccatgctcctgtttgcctgggagggctggcacaacgctgcgggcatcccgctraaaccgctgtacgaggatttcactgccctcagcaatgaagcctacaagcaggacggtgagcaggcctctccctgtccaggaaccacgccaggtgtcctct

SEQ ID NO: 64457 - DNA, 201 bp, Homo sapiens
agatggggaccccagccctgtccccaggccagccagagtgggctccccctgacctggctccacacccctcctccagggctggaacgccacgcacatgttcygggtggcagaggagttcttcacctccctggagctctcccccatgcctcccgagttctgggaagggtcgatgctggagaagccggccgacgggcgggaagt

SEQ ID NO: 64458 - DNA, 201 bp, Homo sapiens
gagggctggcacaacgctgcgggcatcccgctgaaaccgctgtacgaggatttcactgccctcagcaatgaagcctacaagcaggacggtgagcaggcctytccctgtccaggaaccacgccaggtgtcctctctcagctgtctccccagagtcccagcccagagtcaggcagagcagctggtatgacaattccagcaggc

SEQ ID NO: 64459 - DNA, 201 bp, Homo sapiens
tgttagccaggatggtctcaatctcctgacctcgtgatttgcctgcctcggcctcccagagtgctgggattacaggcgtgagccaccgcgcccagcctgcrttttctttcttacggttcttatcaaccctctcagcgttgccatgaagatgaaatgagatgatgtacaaagtcctagtagagtgtcttctctttataatga

SEQ ID NO: 64460 - DNA, 201 bp, Homo sapiens
ccaagccaattttccagctagctgcagatccacgggcctcgagccagtggaagagccgacttacagctgagaggctgaggtccgagcctttggcctgagcyacatacctcacccccacgcccccaggcttcacagacacgggggcctactggcgctcctggtacaactcccccaccttcgaggacgatctggaacacctct

SEQ ID NO: 64461 - DNA, 201 bp, Homo sapiens
ggcgctcctggtacaactcccccaccttcgaggacgatctggaacacctctaccaacagctagagcccctctacctgaacctccatgccttcgtccgccgygcactgcatcgccgatacggagacagatacatcaacctcaggggacccatccctgctcatctgctgggtaaggacctggcctcgcctccacatgagtccc

SEQ ID NO: 64462 - DNA, 201 bp, Homo sapiens
atctgtactaaaaatacaaaagttagctgggcgtggtggtagatgcctgtagtcccagctacttgggaggctgaggcatgagaatcgcttgagcccagccwgggcaatacagcaagaccccgtctctacaaataaaatacaaaaaattagttggatgtggtggtgcatgcctgtagtcctagctgctagggaggctgagat

SEQ ID NO: 64463 - DNA, 201 bp, Homo sapiens
gcgctcctggtacaactcccccaccttcgaggacgatctggaacacctctaccaacagctagagcccctctacctgaacctccatgccttcgtccgccgckcactgcatcgccgatacggagacagatacatcaacctcaggggacccatccctgctcatctgctgggtaaggacctggcctcgcctccacatgagtccca

SEQ ID NO: 64464 - DNA, 201 bp, Homo sapiens
tagatgcctgcctctgcctccttgggtgagtggggagaggcaggggatacctggaaggtagcagaggaagaggaggcggtaacagcaggaagaggggccascccagtgttttctactggtggccctgaaggctgagcccatccccgtgccatgcctgccaatgccgctcttgggagaccagctctcacctacgctagccac

SEQ ID NO: 64465 - DNA, 201 bp, Homo sapiens
acggagacagatacatcaacctcaggggacccatccctgctcatctgctgggtaaggacctggcctcgcctccacatgagtcccacggaagtgtgggtccygaggtaggggtgggggatgtccagggtaagggaaggtgggttgtgaccctcacatctcacatgtgtggggcatcatactgtttgcttcacatgcaggaga

SEQ ID NO: 64466 - DNA, 201 bp, Homo sapiens
gactgatgtgtgagatttctggccctaagccaggcctgcagcccttgagggccccagggtacaggtgccggccccagggtgccactcagcgatgcatgaaraagcaggcacagccaggcagggagccaagctgtccccttccttccttatctaggagacatgtgggcccagagctgggaaaacatctacgacatggtggtg

SEQ ID NO: 64467 - DNA, 201 bp, Homo sapiens
agtcatctaccaatgaagacttcttgaattatccccccttttcccagcctgttttgaaagctctttgtttaccagacaaaggtcatcaatcatatgacccyctttgccttttttttttttttaagatggagtctcgctcttgttgcccaggctagagtgcagtggtgtgatctcggctcactgtaacctccacctcctggc

SEQ ID NO: 64468 - DNA, 201 bp, Homo sapiens
tttgctaaacaacaaggaagggctgggtgcggtggctcacacctgtaatctcagcactttgggaagccgaggcaggaggtctgcttgagctcaggggttcragaccatcctgggcaacatagcgagaccccatttcataaaaaataaataagtaaatgagaacaaggaaggactgacgagagacggtagaaccttctggtt

SEQ ID NO: 64469 - DNA, 201 bp, Homo sapiens
ggtcatcaatcatatgaccccctttgccttttttttttttttaagatggagtctcgctcttgttgcccaggctagagtgcagtggtgtgatctcggctcaytgtaacctccacctcctggctttcaagcgattctcctgcctcagccttccgagtagctgggattacaggcgcccaccaccatgcctggctaaatttttgt

SEQ ID NO: 64470 - DNA, 201 bp, Homo sapiens
caagcgattctcctgcctcagcctcccgagtagctgggctactacttcaggcgcacgccgccatgcccagctaatttcttttgtattttagtagagatggrgtttcaccatgttgcccaggctggtcttgaactcctgagctcaggcaatccgcccgcctcagcctctcaaagtgctaggattacaggcgtgagccaccgc

SEQ ID NO: 64471 - DNA, 201 bp, Homo sapiens
cttactctgttgtccaggctcactgcagcttcaaccttctgggctcaagcaatcctcccacctcaagctccacagtagctgggagcacaggcatgaaccaycacactcagataattttttttaagtttttagtagaggccaagcacggtggctcacgcctgtaatcccagtacttgggaggccaaggcgatcggatcactt

SEQ ID NO: 64472 - DNA, 201 bp, Homo sapiens
agtagagatggagtttcaccatgttgcccaggctggtcttgaactcctgagctcaggcaatccgcccgcctcagcctctcaaagtgctaggattacaggcrtgagccaccgcgcccggcccaatagtatcattctttagatgcctgcctctgcctccttgggtgagtggggagaggcaggggatacctggaaggtagcaga

SEQ ID NO: 64473 - DNA, 201 bp, Homo sapiens
ttacaggcgtgagccaccgcgcccggcccaatagtatcattctttagatgcctgcctctgcctccttgggtgagtggggagaggcaggggatacctggaargtagcagaggaagaggaggcggtaacagcaggaagaggggccaccccagtgttttctactggtggccctgaaggctgagcccatccccgtgccatgcctg

SEQ ID NO: 64474 - DNA, 201 bp, Homo sapiens
ctggaaggtagcagaggaagaggaggcggtaacagcaggaagaggggccaccccagtgttttctactggtggccctgaaggctgagcccatccccgtgccrtgcctgccaatgccgctcttgggagaccagctctcacctacgctagccacaggtggtggctgccagacagtttctctgatccccacagccctccccaccc

SEQ ID NO: 64475 - DNA, 201 bp, Homo sapiens
ctgccaccaagagtccttatgatctttccctcccagccgctggatcctggctcccatggactttttgcctcccacctcccaccccaggtcggaagttcctkattgccaatgctcagatggagaactgcgccatcatttactgcaacgacggcttctgcgaactcttcggctactcccgagtggaggtgatgcagcaaccct

SEQ ID NO: 64476 - DNA, 201 bp, Homo sapiens
tatgcccagggcttctcactgtcctctcccaacaccctctcccccactccactattcctaggatcaagcagtgcaccaccgtgaacttggaggacctggtrgtggcccaccacgaaatgggccacatccagtatttcatgcagtacaaagacttacctgtggccttgagggagggtgccaaccccggcttccatgaggcca

SEQ ID NO: 64477 - DNA, 201 bp, Homo sapiens
ctatgacttggtggtgcccttcccttcagccccctcgatggacaccacagaggctatgctaaagcaggtccgcaccagcccaggggcagggaggccccgcygggatgggagggaccctctgattcaggagttccctccagtttagccctcccccgggatccccacggcagcacgcagtctgtccccggaacccccagtttg

SEQ ID NO: 64478 - DNA, 201 bp, Homo sapiens
cagacttcagctgttcctttgaaggtttgataatctgaccctggttccagctctgggccagccccaggctccaccttaccctgctctgtcctagtacctamccctacccagccttaacccctggctcattcatgacctggcttgaatcaacagcactgctgctgtgggaccctgtctgtaccaggcctgatgcagcttcag

SEQ ID NO: 64479 - DNA, 201 bp, Homo sapiens
ccgaccccggaccctcgccccgacagtcagccgcggggcccgagcgccgggctgcgcgcacggcctacgctcccagcatgcacgagttggatggatgaggstggctgctcccaggccgcgcccgccttcgccgaaggtgctgggcttggctctggggcccccgcgctctcgggcagctgccttctcacctccggacgctgt

SEQ ID NO: 64480 - DNA, 201 bp, Homo sapiens
aacgccacgcacatgttccgggtggcagaggagttcttcacctccctggagctctcccccatgcctcccgagttctgggaagggtcgatgctggagaagcyggccgacgggcgggaagtggtgtgccacgcctcggcttgggacttctacaacaggaaagacttcaggttcagacatgggaagagcacgttctggggttcc

SEQ ID NO: 64481 - DNA, 201 bp, Homo sapiens
atgaagaagcaggcacagccaggcagggagccaagctgtccccttccttccttatctaggagacatgtgggcccagagctgggaaaacatctacgacatgrtggtgcctttcccagacaagcccaacctcgatgtcaccagtactatgctgcagcaggtaagctctgggctcaagcctggggtggtgggggtcgggggtgg

SEQ ID NO: 64482 - DNA, 201 bp, Homo sapiens
gccccagctagccctccccagcctcctggacagccaggcgcctcctgccccagccagttctagcctctcctctctaatgatgtcccccgctgtgacccacygccttctcctttcctgcctgaaactccctcttccaggaagtcttccccagttcctcaggatggggaagggttgccgggtggaaatgccttttctacaaaa

SEQ ID NO: 64483 - DNA, 201 bp, Homo sapiens
aaaaaaaaaaaactcaatttcagattttgatgaacatttactcaatgcctgagcaattcttctttccttaaaaatcagtctctgggaggcctaggtgggargatcacttgaagccaggagttggagactagcctgggcaacatagcaagatcccatctctattcaaacaaacaaataaacaaaaatcaatctctagtaaca

SEQ ID NO: 64484 - DNA, 201 bp, Homo sapiens
ctctctaatgatgtcccccgctgtgacccaccgccttctcctttcctgcctgaaactccctcttccaggaagtcttccccagttcctcaggatggggaagsgttgccgggtggaaatgccttttctacaaaagctaaatccatctgtttgcaacctctaggccctaagacaatttaaccatccttttccagaaccaagtat

SEQ ID NO: 64485 - DNA, 201 bp, Homo sapiens
agtttcatgttccaaatgtgacaccatacatcaggtattagcgcccccaccccacccacccccagtactgtcacaccctcaatccacttctcctcctgtgwtcctagctgcctcatccccagggcttgtccccatgctcctccagacctcaaaggcctggagttagagtggcccactctcctgagcctgtcttgggtctcc

SEQ ID NO: 64486 - DNA, 201 bp, Homo sapiens
cgtcggggggccaaccccggcttccatgaggccattggggacgtgctggcgctctcggtctccactcctgaacatctgcacaaaatcggcctgctggaccrtgtcaccaatgacacgggtatgggagggctgagaggcccccacccagcctcacctaaaccccgctccaccccacagcaggacctcacttgccccactcag

SEQ ID NO: 64487 - DNA, 201 bp, Homo sapiens
caggtattagcgcccccaccccacccacccccagtactgtcacaccctcaatccacttctcctcctgtgatcctagctgcctcatccccagggcttgtccycatgctcctccagacctcaaaggcctggagttagagtggcccactctcctgagcctgtcttgggtctcccttctcccccaagatagcttctggtccagcc

SEQ ID NO: 64488 - DNA, 201 bp, Homo sapiens
tgtgttcagagacactgcttaggctgggcgcagtggctcatgcatgtaatcccagcactttgggaagtcgaggcaggcggatcacctgagggcaggagttygaaaccagcctggccaacatagtgaaaccccgtctctaccaaaaatacaaaaattagccgggcgtgatggcaggcacttgtaatcccagctacttgagag

SEQ ID NO: 64489 - DNA, 201 bp, Homo sapiens
gcctcagcacctgagtagctgggactacagatgcgcaccagaacacctggctcatttttgtattttttgtggggacagggtctcactttgttgcccaggcyggtctcgaactcctgggctcaagcaatcctcccacatcagcctctcaaagtgctgggattacaggtgtgagccaccacacctggcctacttcgttccatt

SEQ ID NO: 64490 - DNA, 201 bp, Homo sapiens
cccaagttcgaacctccccttccagccactgcctgccccctcatccgcgtcctccagaggcttctctgagtccttcttttccttccttttcatatcctggytctggtcttcccaggagctttcccaggcctgacccccatctggtcacatccctgcctcccttccccacacttttcctgtttccaggaggccttgggcctt

SEQ ID NO: 64491 - DNA, 201 bp, Homo sapiens
ctgcaggtactttgtgagttttgtcctgcagttccagttccatgaagccctgtgcaaggaggcaggctatgagggcccactgcaccagtgtgacatctacyggtccaccaaggcaggggccaagctccggtgtgtggtgggaagccgggggaagtgggaggcagagaggagcggctggcaaagggtgtggcaggaggtgtc

SEQ ID NO: 64492 - DNA, 201 bp, Homo sapiens
gggaccccagccctgtccccaggccagccagagtgggctccccctgacctggctccacacccctcctccagggctggaacgccacgcacatgttccgggtkgcagaggagttcttcacctccctggagctctcccccatgcctcccgagttctgggaagggtcgatgctggagaagccggccgacgggcgggaagtggtgt

SEQ ID NO: 64493 - DNA, 201 bp, Homo sapiens; identical to SEQ ID NO: 12827

SEQ ID NO: 64494 - DNA, 201 bp, Homo sapiens
aagcaagccctggccagaggtcctaaagatgctgactggggagtctgaggtgtctacaaatgtcttcatgacctacttcaaacccctactgacctggctgstgacagaacatgcagcaaggggacatcttaggctggccagacttcagctgttcctttgaaggtttgataatctgaccctggttccagctctgggccagcc

SEQ ID NO: 64495 - DNA, 201 bp, Homo sapiens
tcctccagggctggaacgccacgcacatgttccgggtggcagaggagttcttcacctccctggagctctcccccatgcctcccgagttctgggaagggtcsatgctggagaagccggccgacgggcgggaagtggtgtgccacgcctcggcttgggacttctacaacaggaaagacttcaggttcagacatgggaagagca

SEQ ID NO: 64496 - DNA, 201 bp, Homo sapiens
caccagcccaggggcagggaggccccgccgggatgggagggaccctctgattcaggagttccctccagtttagccctcccccgggatccccacggcagcaygcagtctgtccccggaacccccagtttgggcagaactccctctgcttgcagggctggacgcccaggaggatgtttaaggaggctgatgatttcttcacct

SEQ ID NO: 64497 - DNA, 201 bp, Homo sapiens
ggcaaagagagaagcctgtactcagccaagggtgcagagatgttatatatgattgctcttcagggaaccgggcctccagctcacaccccagctgctcaacyacctcctctctgaattgactgtcccttctttggaactctaggcctgaccccactccctggccctcccagcccacgattcccctgacccgactccctttcc

SEQ ID NO: 64498 - DNA, 201 bp, Homo sapiens
cctacccctgcctcaggaacccaagcatccacccctctcccccaacttcccccacgctaaaaaaaacagagggagcccactcctatgcctccccctgccaycccccaggaactcagttgttcagtgcccacttcctcagggattgagacctctgatccagacccctgatctcccacccccatcccctatggctcttcctag

SEQ ID NO: 64499 - DNA, 201 bp, Homo sapiens
aattctggcttccttcaaccagtttccagctgttctatccccttccattctctcagtgggtgaaatcgaagagactgaggacaataaagaacaaggaaccraactgccggacgtggtggcatgcacctgtaatcctaccactttgcaaggccaaggtgagaggatcgcttgaacccaggagttccagagcaacctgggcaa

SEQ ID NO: 64500 - DNA, 201 bp, Homo sapiens
ccaaaagaaatggaggcaataggttttgaggggcatggggacggggttcagcctccagggtcctacacacaaatcagtcagtggcccagaagacccccctmggaatcggagcagggaggatggggagtgtgaggggtatccttgatgcttgtgtgtccccaactttccaaatccccgcccccgcgatggagaagaaaccga

SEQ ID NO: 64501 - DNA, 201 bp, Homo sapiens
gaacaaggaaccgaactgccggacgtggtggcatgcacctgtaatcctaccactttgcaaggccaaggtgagaggatcgcttgaacccaggagttccagarcaacctgggcaacatagtgagatcctgtctctattttttaaaaaagaatgaaacataggaataagatgtgggtgaaggactcacatgccggcttggtccc

SEQ ID NO: 64502 - DNA, 201 bp, Homo sapiens
agagctctgaggatgtgtcttggaacttggagggctaggatttggggattgaagcccggctgatggtaggcagaacttggagacaatgtgagaaggactcrctgagctcaagggaagggtggaggaacagcacaggccttagtgggatactcagaacgtcatggccaggtgggatgtgggatgacagacagagaggacagg

SEQ ID NO: 64503 - DNA, 201 bp, Homo sapiens
gtctcctaccagaccaaggtcaacctcctctctgccatcaagagcccctgccagagggagaccccagagggggctgaggccaagccctggtatgagcccawctatctgggaggggtcttccagctggagaagggtgaccgactcagcgctgagatcaatcggcccgactatctcgactttgccgagtctgggcaggtctac

SEQ ID NO: 64504 - DNA, 201 bp, Homo sapiens
aattcaaactggggcctccagaactcactggggcctacagctttgatccctgacatctggaatctggagaccagggagcctttggttctggccagaatgcygcaggacttgagaagacctcacctagaaattgacacaagtggaccttaggccttcctctctccagatgtttccagacttccttgagacacggagcccagc

SEQ ID NO: 64505 - DNA, 201 bp, Homo sapiens
ggctctgaggaatgggttacaggagacctctggggagatgtgaccacagcaatgggtaggagaatgtccagggctatggaagtcgagtatggggacccccmcttaacgaagacagggccatgtagagggccccagggagtgaaagagcctccaggacctccaggtatggaatacaggggacgtttaagaagatatggccac

SEQ ID NO: 64506 - DNA, 201 bp, Homo sapiens
taagtggggcatcggtttttcctcctccccagaacttcctggtgttttcaggcaccacaggctccttcctgccatccccatctctctctaatattctcccyttctttctccttcagcctcctcccttcagaccccatgagccttgaattaagctccttggaggagaagagttgactgtcgggtaggagacagagaggcctt

SEQ ID NO: 64507 - DNA, 201 bp, Homo sapiens
gaggaatgggttacaggagacctctggggagatgtgaccacagcaatgggtaggagaatgtccagggctatggaagtcgagtatggggacccccccttaaygaagacagggccatgtagagggccccagggagtgaaagagcctccaggacctccaggtatggaatacaggggacgtttaagaagatatggccacacactg

SEQ ID NO: 64508 - DNA, 201 bp, Homo sapiens
cccagaacttcctggtgttttcaggcaccacaggctccttcctgccatccccatctctctctaatattctccccttctttctccttcagcctcctcccttyagaccccatgagccttgaattaagctccttggaggagaagagttgactgtcgggtaggagacagagaggccttcaggcagctctagggggagaagtgcgg

SEQ ID NO: 64509 - DNA, 201 bp, Homo sapiens
tccactctcccacccaaggggaaatggagacgcaagagagggagagagatgggatgggtgaaagatgtgcgctgatagggagggatggagagaaaaaaacrtggagaaagacggggatgcagaaagagatgtggcaagagatggggaagagagagagagaaagatggagagacaggatgtctggcacatggaaggtgctca

SEQ ID NO: 64510 - DNA, 201 bp, Homo sapiens
gggaggtggaagttgcagtgagccaagatcatgccgtagcactccaacctgggcaacagagcgagacgccatctcaaaaaaaaaaaaaagtccaggcaagrctcagtggctcatgcctgtaatcccaacactttgcgaggctaaggtgcaaggattgcctgaggccaagagttgaaggctgcagtgagctatgatggtgcc

SEQ ID NO: 64511 - DNA, 201 bp, Homo sapiens
ggacctgagcgtccgggcccaggggctccgcacagcaggtgaggctctcctgccccatctccttgggctgcccgtgcttcgtgctttggactaccgcccarcagtgtcctgccctctgcctgggcctcggtccctcctgcacctgctgcctggatccccggcctgcctgggcctgggccttggtgggtttggttttggttt

SEQ ID NO: 64512 - DNA, 201 bp, Homo sapiens
caggacttgagaagacctcacctagaaattgacacaagtggaccttaggccttcctctctccagatgtttccagacttccttgagacacggagcccagccytccccatggagccagctccctctatttatgtttgcacttgtgattatttattatttatttattatttatttatttacagatgaatgtatttatttgggag

SEQ ID NO: 64513 - DNA, 201 bp, Homo sapiens
cctgggccttggtgggtttggttttggtttccttctctgtctctgactctccatctgtcagtctcattgtctctgtcacacattctctgtttctgccatgrttcctctctgttcccttcctgtctctctctgtctccctctgctcaccttggggtttctctgactgcatcttgtccccttctctgtcgatctctctctcgg

SEQ ID NO: 64514 - DNA, 201 bp, Homo sapiens
gggacctgagcgtccgggcccaggggctccgcacagcaggtgaggctctcctgccccatctccttgggctgcccgtgcttcgtgctttggactaccgcccmgcagtgtcctgccctctgcctgggcctcggtccctcctgcacctgctgcctggatccccggcctgcctgggcctgggccttggtgggtttggttttggtt

SEQ ID NO: 64515 - DNA, 201 bp, Homo sapiens
gcaaagagagaagcctgtactcagccaagggtgcagagatgttatatatgattgctcttcagggaaccgggcctccagctcacaccccagctgctcaaccrcctcctctctgaattgactgtcccttctttggaactctaggcctgaccccactccctggccctcccagcccacgattcccctgacccgactccctttccc

SEQ ID NO: 64516 - DNA, 201 bp, Homo sapiens
cctgcccaagaaagaaaccaaattcatacaacctccgaaactgagattgaaaccaagattggcccatctcaaggagcatccttcgcatatctcacatgcaygtgacactgagcctcagcccagtcttacccttccttcctctgtgtctctcatgtctccccatcacccttcttgccttcccttttttgtctttcaatgtcc

SEQ ID NO: 64517 - DNA, 201 bp, Homo sapiens
gtggtaaactggtttcaagattagccctagaaacagggttgggttggggtagaggagaagttttatttagggggttattaattgggatgtgtttagatttraggttagggttacagttggggttgagtttgagttgtgatttgggttgaggttaaatttgggttagggttgatgttggtattaaatcccaattcaggtttt

SEQ ID NO: 64518 - DNA, 201 bp, Homo sapiens
ttccggctgttgcagctggccagcagtccggagagagctggagaggagccgcattctcaggtacctgaatcacacagccaagggacttccagagattcggstgtctaggcttcaaatcaccctgtcctaactctgcaacctgaaccagccacttaacctatctatccaatggggataggaatgtccaccacacatagggca

SEQ ID NO: 64519 - DNA, 201 bp, Homo sapiens
gagatggggaagagagagagagaaagatggagagacaggatgtctggcacatggaaggtgctcactaagtgtgtatggagtgaatgaatgaatgaatgaaygaacaagcagatatataaataagatatggagacagatgtggggtgtgagaagagagatgggggaagaaacaagtgatatgaataaagatggtgagacaga

SEQ ID NO: 64520 - DNA, 201 bp, Homo sapiens
aacgaagacagggccatgtagagggccccagggagtgaaagagcctccaggacctccaggtatggaatacaggggacgtttaagaagatatggccacacamtggggccctgagaagtgagagcttcatgaaaaaaatcagggaccccagagttccttggaagccaagactgaaaccagcattatgagtctccgggtcagaa

SEQ ID NO: 64521 - DNA, 201 bp, Homo sapiens
agctgttctatccccttccattctctcagtgggtgaaatcgaagagactgaggacaataaagaacaaggaaccgaactgccggacgtggtggcatgcaccygtaatcctaccactttgcaaggccaaggtgagaggatcgcttgaacccaggagttccagagcaacctgggcaacatagtgagatcctgtctctatttttt

SEQ ID NO: 64522 - DNA, 201 bp, Homo sapiens
aagtgagagcttcatgaaaaaaatcagggaccccagagttccttggaagccaagactgaaaccagcattatgagtctccgggtcagaatgaaagaagaagrcctgccccagtggggtctgtgaattcccgggggtgatttcactccccggggctgtcccaggcttgtccctgctacccccacccagcctttcctgaggcct

SEQ ID NO: 64523 - DNA, 201 bp, Homo sapiens
ccctccctggatgaaggctcttctggagagagtcaaagacaaataagggtggggcgcagtggctcatgcctgttatcccaacactttgggaggctgaggtrggaggaccacttgagcccactagttcaagaccagcctgtgcaacatagcaagaccttgtttctagaaaaaaaattaaagattagtcaggtgtagtggtgc

SEQ ID NO: 64524 - DNA, 201 bp, Homo sapiens
tctccgggtcagaatgaaagaagaaggcctgccccagtggggtctgtgaattcccgggggtgatttcactccccggggctgtcccaggcttgtccctgctmcccccacccagcctttcctgaggcctcaagcctgccaccaagcccccagctccttctccccgcagggacccaaacacaggcctcaggactcaacacagct

SEQ ID NO: 64525 - DNA, 201 bp, Homo sapiens
gggtgacagaacgagaccctgtctcaaaaaaataataattccaaaaacaaatatggagacggaaattgagcccccctagactgggagcccccactgagttyggaaattaggctttacctccagccctggggtgccaggcaggagaaaaccatgtggtaggctgagggggtagggtgacccattggggtgacctagataggg

SEQ ID NO: 64526 - DNA, 201 bp, Homo sapiens
ccaaaaacaaatatggagacggaaattgagcccccctagactgggagcccccactgagttcggaaattaggctttacctccagccctggggtgccaggcargagaaaaccatgtggtaggctgagggggtagggtgacccattggggtgacctagatagggccttgggtcaccctctgcctcctccagcctgtggctgaaa

SEQ ID NO: 64527 - DNA, 201 bp, Homo sapiens
tccgggtcagaatgaaagaagaaggcctgccccagtggggtctgtgaattcccgggggtgatttcactccccggggctgtcccaggcttgtccctgctacmcccacccagcctttcctgaggcctcaagcctgccaccaagcccccagctccttctccccgcagggacccaaacacaggcctcaggactcaacacagcttt

SEQ ID NO: 64528 - DNA, 201 bp, Homo sapiens
ccgggggtgatttcactccccggggctgtcccaggcttgtccctgctacccccacccagcctttcctgaggcctcaagcctgccaccaagcccccagctcyttctccccgcagggacccaaacacaggcctcaggactcaacacagcttttccctccaaccccgttttctctccctcaaggactcagctttctgaagcccc

SEQ ID NO: 64529 - DNA, 201 bp, Homo sapiens
ggagacggaaattgagcccccctagactgggagcccccactgagttcggaaattaggctttacctccagccctggggtgccaggcaggagaaaaccatgtrgtaggctgagggggtagggtgacccattggggtgacctagatagggccttgggtcaccctctgcctcctccagcctgtggctgaaagtcagccatgaagt

SEQ ID NO: 64530 - DNA, 201 bp, Homo sapiens
tgagttcggaaattaggctttacctccagccctggggtgccaggcaggagaaaaccatgtggtaggctgagggggtagggtgacccattggggtgacctakatagggccttgggtcaccctctgcctcctccagcctgtggctgaaagtcagccatgaagtaatgggggacactgttactcatcccagaagcacccacact

SEQ ID NO: 64531 - DNA, 201 bp, Homo sapiens
gatttcactccccggggctgtcccaggcttgtccctgctacccccacccagcctttcctgaggcctcaagcctgccaccaagcccccagctccttctcccsgcagggacccaaacacaggcctcaggactcaacacagcttttccctccaaccccgttttctctccctcaaggactcagctttctgaagcccctcccagtt

SEQ ID NO: 64532 - DNA, 201 bp, Homo sapiens
ctagatagggccttgggtcaccctctgcctcctccagcctgtggctgaaagtcagccatgaagtaatgggggacactgttactcatcccagaagcacccayacttactcacttttgggaagggggacctaaagtgtgaaaaaaaggtgaggattttccgtctcaccctaaatgggacaccctaagtggggcatcggttttt

SEQ ID NO: 64533 - DNA, 201 bp, Homo sapiens
acagcttttccctccaaccccgttttctctccctcaaggactcagctttctgaagcccctcccagttctagttctatctttttcctgcatcctgtctggargttagaaggaaacagaccacagacctggtccccaaaagaaatggaggcaataggttttgaggggcatggggacggggttcagcctccagggtcctacaca

SEQ ID NO: 64534 - DNA, 201 bp, Homo sapiens
gagggacagagggctcaaagggagcaagagctgtggggagaacaaaaggataagggctcagagagcttcagggatatgtgatggactcaccaggtgaggcygccagactgctgcaggggaagcaaaggagaagctgagaagatgaaggaaaagtcagggtctggaggggcgggggtcagggagctcctgggagatatggcc

SEQ ID NO: 64535 - DNA, 201 bp, Homo sapiens
ttactcatcccagaagcacccacacttactcacttttgggaagggggacctaaagtgtgaaaaaaaggtgaggattttccgtctcaccctaaatgggacaycctaagtggggcatcggtttttcctcctccccagaacttcctggtgttttcaggcaccacaggctccttcctgccatccccatctctctctaatattctc

SEQ ID NO: 64536 - DNA, 201 bp, Homo sapiens
tccaccaaggaagttttccgctggttgaatgattctttccccgccctcctctcgccccagggacatataaaggcagttgttggcacacccagccagcagaygctccctcagcaaggacagcagaggaccagctaagagggagagaagcaactacagaccccccctgaaaacaaccctcagacgccacatcccctgacaagc

SEQ ID NO: 64537 - DNA, 201 bp, Homo sapiens
tcttctgcctgctgcactttggagtgatcggcccccagagggaagaggtgagtgcctggccagccttcatccactctcccacccaaggggaaatggagacrcaagagagggagagagatgggatgggtgaaagatgtgcgctgatagggagggatggagagaaaaaaacgtggagaaagacggggatgcagaaagagatgt

SEQ ID NO: 64538 - DNA, 201 bp, Homo sapiens
agggacatataaaggcagttgttggcacacccagccagcagacgctccctcagcaaggacagcagaggaccagctaagagggagagaagcaactacagacsccccctgaaaacaaccctcagacgccacatcccctgacaagctgccaggcaggttctcttcctctcacatactgacccacggctccaccctctctcccct

SEQ ID NO: 64539 - DNA, 201 bp, Homo sapiens
acctcagggctaagagcgcaggccagacaggcagccagctgttcctcctttaagggtgactccctcgatgttaaccattctccttctccccaacagttccycagggacctctctctaatcagccctctggcccaggcagtcagtaagtgtctccaaacctctttcctaattctgggtttgggtttgggggtagggttagta

SEQ ID NO: 64540 - DNA, 201 bp, Homo sapiens
aggatggatggaggtgaaagtaggggggtattttctaggaagtttaagggtctcagctttttcttttctctctcctcttcaggatcatcttctcgaacccygagtgacaagcctgtagcccatgttgtaggtaagagctctgaggatgtgtcttggaacttggagggctaggatttggggattgaagcccggctgatggta

SEQ ID NO: 64541 - DNA, 201 bp, Homo sapiens
tactttgggatcattgccctgtgaggaggacgaacatccaaccttcccaaacgcctcccctgccccaatccctttattaccccctccttcagacaccctcmacctcttctggctcaaaaagagaattgggggcttagggtcggaacccaagcttagaactttaagcaacaagaccaccacttcgaaacctgggattcagga

SEQ ID NO: 64542 - DNA, 201 bp, Homo sapiens
catccactctcccacccaaggggaaatggagacgcaagagagggagagagatgggatgggtgaaagatgtgcgctgatagggagggatggagagaaaaaawcgtggagaaagacggggatgcagaaagagatgtggcaagagatggggaagagagagagagaaagatggagagacaggatgtctggcacatggaaggtgct

SEQ ID NO: 64543 - DNA, 201 bp, Homo sapiens
ggagagagatgggggagataaggagagaagaagatagggtgtctggcacacagaagacactcagggaaagagctgttgaatgcctggaaggtgaatacacrgatgaatggagagagaaaaccagacacctcagggctaagagcgcaggccagacaggcagccagctgttcctcctttaagggtgactccctcgatgttaac

SEQ ID NO: 64544 - DNA, 201 bp, Homo sapiens
gagcgattctgtcttaaaagaaaaaaaaaaaaaaaaaaggctgggtgcggtgtctcacgcctgtaatcccagcactttgggaggccgacgcaagtggatcrcctgaggtcaggagttcgagaccagcctggccaagatggtgtactttctctactaaaagtacaaaaattagccaggcatggtggcatgcacctataatcc

SEQ ID NO: 64545 - DNA, 201 bp, Homo sapiens
gggtgtctggcacacagaagacactcagggaaagagctgttgaatgcctggaaggtgaatacacagatgaatggagagagaaaaccagacacctcagggcyaagagcgcaggccagacaggcagccagctgttcctcctttaagggtgactccctcgatgttaaccattctccttctccccaacagttccccagggacctc

SEQ ID NO: 64546 - DNA, 201 bp, Homo sapiens
acgtttaagaagatatggccacacactggggccctgagaagtgagagcttcatgaaaaaaatcagggaccccagagttccttggaagccaagactgaaacmagcattatgagtctccgggtcagaatgaaagaagaaggcctgccccagtggggtctgtgaattcccgggggtgatttcactccccggggctgtcccaggc

SEQ ID NO: 64547 - DNA, 201 bp, Homo sapiens
cctgggcaacatagtgagatcctgtctctattttttaaaaaagaatgaaacataggaataagatgtgggtgaaggactcacatgccggcttggtcccactsgtctttgtggtgaaggaggggagaggtgagaggtgggtaatccggaaagagaaaagcaccccctccctggatgaaggctcttctggagagagtcaaagac

SEQ ID NO: 64548 - DNA, 201 bp, Homo sapiens
agccaaaccttgagccctagagcccccctcaactctgttctcccctaggggctccctggtgttggcctcacaccttcagctgcccagactgcccgtcagcmccccaagatgcatcttgcccacagcaccctcaaacctgctgctcacctcattggtaaacatccacctgacctcccagacatgtccccaccagctctcctc

SEQ ID NO: 64549 - DNA, 201 bp, Homo sapiens
gggacctctctctaatcagccctctggcccaggcagtcagtaagtgtctccaaacctctttcctaattctgggtttgggtttgggggtagggttagtaccrgtatggaagcagtgggggaaatttaaagttttggtcttgggggaggatggatggaggtgaaagtaggggggtattttctaggaagtttaagggtctcagc

SEQ ID NO: 64550 - DNA, 201 bp, Homo sapiens
gttctgtggaagccacctgaagtcaggaagagatggagggcatccttcaggagtgagatgagacctcatcatacttgactgtccagcatcatctctgagtraggggaccaaaaaatttatcttccaaactaggacactttcaagagtggaagggggatccattaatattttcacctggacaagaggcaaacaccagaatgt

SEQ ID NO: 64551 - DNA, 201 bp, Homo sapiens
gtcgagtatggggacccccccttaacgaagacagggccatgtagagggccccagggagtgaaagagcctccaggacctccaggtatggaatacaggggacrtttaagaagatatggccacacactggggccctgagaagtgagagcttcatgaaaaaaatcagggaccccagagttccttggaagccaagactgaaaccag

SEQ ID NO: 64552 - DNA, 201 bp, Homo sapiens
ggggagagaagtggtctgccccatgcaacagtgggctttaccccgggtcaccaccagccccagctccaacccctctaacactctccaagtaaaatcacatsagtagcagtaataatatttgaggtgacaagttggtattatctcaaacttaggaaaagtgaataaagtcatctttagaaactgctttttttaaaccttgta

SEQ ID NO: 64553 - DNA, 201 bp, Homo sapiens
tctcgaaccccgagtgacaagcctgtagcccatgttgtaggtaagagctctgaggatgtgtcttggaacttggagggctaggatttggggattgaagcccrgctgatggtaggcagaacttggagacaatgtgagaaggactcgctgagctcaagggaagggtggaggaacagcacaggccttagtgggatactcagaacg

SEQ ID NO: 64554 - DNA, 201 bp, Homo sapiens
actttaagcaacaagaccaccacttcgaaacctgggattcaggaatgtgtggcctgcacagtgaagtgctggcaaccactaagaattcaaactggggcctycagaactcactggggcctacagctttgatccctgacatctggaatctggagaccagggagcctttggttctggccagaatgctgcaggacttgagaagac

SEQ ID NO: 64555 - DNA, 201 bp, Homo sapiens
attttttgtgttagacaaaaactagaaacaaaccaaatccccatcaacagaatatattagaatatattgatacaatagaatattacatcataatttttttwaaaaacattactgatacatacaaccacgtatatgaatctcacaaacataatgctgactgaaagaagtcaaacagaaatgagtacattctgtgtgatttca

SEQ ID NO: 64556 - DNA, 201 bp, Homo sapiens
aaagggcaacacagagaaaaagaaaggagcaggggctaaaagggaaacccacactgacacaagagataataaggttaaaagaatgagaagaaggttgggcscagtggctcacgcccataatcccagcactttgggaggccaaggctggtgggtcacctgtggtcaggaattcaagaccaacctggccaacatggtgagacc

SEQ ID NO: 64557 - DNA, 201 bp, Homo sapiens
cccgggccccagccccgacctagaacccgcccgctgcctgccacgctgccactgccgcttcctctataaagggacctgagcgtccgggcccaggggctccrcacagcaggtgaggctctcctgccccatctccttgggctgcccgtgcttcgtgctttggactaccgcccagcagtgtcctgccctctgcctgggcctcgg

SEQ ID NO: 64558 - DNA, 201 bp, Homo sapiens
caagtggaccttaggccttcctctctccagatgtttccagacttccttgagacacggagcccagccctccccatggagccagctccctctatttatgtttkcacttgtgattatttattatttatttattatttatttatttacagatgaatgtatttatttgggagaccggggtatcctgggggacccaatgtaggagct

SEQ ID NO: 64559 - DNA, 201 bp, Homo sapiens
tctattttttaaaaaagaatgaaacataggaataagatgtgggtgaaggactcacatgccggcttggtcccactggtctttgtggtgaaggaggggagagrtgagaggtgggtaatccggaaagagaaaagcaccccctccctggatgaaggctcttctggagagagtcaaagacaaataagggtggggcgcagtggctca

SEQ ID NO: 64560 - DNA, 201 bp, Homo sapiens
gaagcaactacagaccccccctgaaaacaaccctcagacgccacatcccctgacaagctgccaggcaggttctcttcctctcacatactgacccacggctycaccctctctcccctggaaaggacaccatgagcactgaaagcatgatccgggacgtggagctggccgaggaggcgctccccaagaagacaggggggcccc

SEQ ID NO: 64561 - DNA, 201 bp, Homo sapiens
caagaagacaggggggccccagggctccaggcggtgcttgttcctcagcctcttctccttcctgatcgtggcaggcgccaccacgctcttctgcctgctgmactttggagtgatcggcccccagagggaagaggtgagtgcctggccagccttcatccactctcccacccaaggggaaatggagacgcaagagagggagag

SEQ ID NO: 64562 - DNA, 201 bp, Homo sapiens
aggccgccagactgctgcaggggaagcaaaggagaagctgagaagatgaaggaaaagtcagggtctggaggggcgggggtcagggagctcctgggagatayggccacatgtagcggctctgaggaatgggttacaggagacctctggggagatgtgaccacagcaatgggtaggagaatgtccagggctatggaagtcgag

SEQ ID NO: 64563 - DNA, 201 bp, Homo sapiens
tgtttctgccatgattcctctctgttcccttcctgtctctctctgtctccctctgctcaccttggggtttctctgactgcatcttgtccccttctctgtcratctctctctcgggggtcggggggtgctgtctcccagggcgggaggtctgtcttccgccgcgtgccccgccccgctcactgtctctctctctctctctct

SEQ ID NO: 64564 - DNA, 201 bp, Homo sapiens
agaagtgagagcttcatgaaaaaaatcagggaccccagagttccttggaagccaagactgaaaccagcattatgagtctccgggtcagaatgaaagaagarggcctgccccagtggggtctgtgaattcccgggggtgatttcactccccggggctgtcccaggcttgtccctgctacccccacccagcctttcctgaggc

SEQ ID NO: 64565 - DNA, 201 bp, Homo sapiens
ggctttaccccgggtcaccaccagccccagctccaacccctctaacactctccaagtaaaatcacatcagtagcagtaataatatttgaggtgacaagttrgtattatctcaaacttaggaaaagtgaataaagtcatctttagaaactgctttttttaaaccttgtaacttgcaagctaagtgaaaatgggctcatgtat

SEQ ID NO: 64566 - DNA, 201 bp, Homo sapiens
cccaggagtttgaggttacagtaagctatgatcatgccactgtacccccgtctgggtgacagaacgagaccctgtctcaaaaaaataataattccaaaaamaaatatggagacggaaattgagcccccctagactgggagcccccactgagttcggaaattaggctttacctccagccctggggtgccaggcaggagaaaa

SEQ ID NO: 64567 - DNA, 201 bp, Homo sapiens
ggacgtttaagaagatatggccacacactggggccctgagaagtgagagcttcatgaaaaaaatcagggaccccagagttccttggaagccaagactgaamccagcattatgagtctccgggtcagaatgaaagaagaaggcctgccccagtggggtctgtgaattcccgggggtgatttcactccccggggctgtcccag

SEQ ID NO: 64568 - DNA, 201 bp, Homo sapiens
cgggtcagaatgaaagaagaaggcctgccccagtggggtctgtgaattcccgggggtgatttcactccccggggctgtcccaggcttgtccctgctacccscacccagcctttcctgaggcctcaagcctgccaccaagcccccagctccttctccccgcagggacccaaacacaggcctcaggactcaacacagcttttc

SEQ ID NO: 64569 - DNA, 201 bp, Homo sapiens
ctcaactctgttctcccctaggggctccctggtgttggcctcacaccttcagctgcccagactgcccgtcagcaccccaagatgcatcttgcccacagcamcctcaaacctgctgctcacctcattggtaaacatccacctgacctcccagacatgtccccaccagctctcctcctacccctgcctcaggaacccaagcat

SEQ ID NO: 64570 - DNA, 201 bp, Homo sapiens
caaaaggataagggctcagagagcttcagggatatgtgatggactcaccaggtgaggccgccagactgctgcaggggaagcaaaggagaagctgagaagaygaaggaaaagtcagggtctggaggggcgggggtcagggagctcctgggagatatggccacatgtagcggctctgaggaatgggttacaggagacctctgg

SEQ ID NO: 64571 - DNA, 201 bp, Homo sapiens
tgctggttctgctgcctggggcccaggtgaggcagcaggagaatgggggctgctggggtggctcagccaaaccttgagccctagagcccccctcaactctsttctcccctaggggctccctggtgttggcctcacaccttcagctgcccagactgcccgtcagcaccccaagatgcatcttgcccacagcaccctcaaacc

SEQ ID NO: 64572 - DNA, 201 bp, Homo sapiens
atcacctctgctcacctccctctttctctctctctctctctctccctccccctctctcccctgcaacacacacacacacacacacacacacacgcacgcaygcacgcaccacacactctgacgacctttaaaggcttcctgtggctggatgaaatctagaggctttacccttcttgcatggccctgcatgacctggcccct

SEQ ID NO: 64573 - DNA, 201 bp, Homo sapiens
aaatggaggcaataggttttgaggggcatggggacggggttcagcctccagggtcctacacacaaatcagtcagtggcccagaagacccccctcggaatcrgagcagggaggatggggagtgtgaggggtatccttgatgcttgtgtgtccccaactttccaaatccccgcccccgcgatggagaagaaaccgagacagaa

SEQ ID NO: 64574 - DNA, 201 bp, Homo sapiens
aaaccttgagccctagagcccccctcaactctgttctcccctaggggctccctggtgttggcctcacaccttcagctgcccagactgcccgtcagcacccyaagatgcatcttgcccacagcaccctcaaacctgctgctcacctcattggtaaacatccacctgacctcccagacatgtccccaccagctctcctcctac

SEQ ID NO: 64575 - DNA, 201 bp, Homo sapiens
aagcaggagaatcgcttgaacccaggaggcagaggttgcagtgagatgagatcagtcattgcactccagcctgggcaacgagcgaaaccgcctctcaaacwaacaaaaaaaaactttgggaggccaagatgggcagatcacttgaaaccaggagttcgagaccagcctgagcagcatagaccctgtctcaacaaaaatttt

SEQ ID NO: 64576 - DNA, 201 bp, Homo sapiens
ttcctgtctctctctgtctccctctgctcaccttggggtttctctgactgcatcttgtccccttctctgtcgatctctctctcgggggtcggggggtgctstctcccagggcgggaggtctgtcttccgccgcgtgccccgccccgctcactgtctctctctctctctctctttctctgcaggttctccccatgacaccac

SEQ ID NO: 64577 - DNA, 201 bp, Homo sapiens
agtgggctatgatggtgccactgcactccagcctaggccacagagcaagacaccatgtcaaaagaaaaaaaaatccaatcacctctgctcacctccctctttctctctctctctctctctccctccccctctctcccctgcaacacacacacacacacacacacacacacgcacgcatgcacgcaccacacactctgacga

SEQ ID NO: 64578 - DNA, 201 bp, Homo sapiens
cagcttttccctccaaccccgttttctctccctcaaggactcagctttctgaagcccctcccagttctagttctatctttttcctgcatcctgtctggaarttagaaggaaacagaccacagacctggtccccaaaagaaatggaggcaataggttttgaggggcatggggacggggttcagcctccagggtcctacacac

SEQ ID NO: 64579 - DNA, 201 bp, Homo sapiens
cagagcaagacaccatgtcaaaagaaaaaaaaatccaatcacctctgctcacctccctctttctctctctctctctctctccctccccctctctcccctgcaacacacacacacacacacacacacacacgcacgcatgcacgcaccacacactctgacgacctttaaaggcttcctgtggctggatgaaatctagaggct

SEQ ID NO: 64580 - DNA, 201 bp, Homo sapiens
agttctatctttttcctgcatcctgtctggaagttagaaggaaacagaccacagacctggtccccaaaagaaatggaggcaataggttttgaggggcatgrggacggggttcagcctccagggtcctacacacaaatcagtcagtggcccagaagacccccctcggaatcggagcagggaggatggggagtgtgaggggta

SEQ ID NO: 64581 - DNA, 201 bp, Homo sapiens
agagcaagacaccatgtcaaaagaaaaaaaaatccaatcacctctgctcacctccctctttctctctctctctctctctccctccccctctctcccctgcaacacacacacacacacacacacacacacgcacgcatgcacgcaccacacactctgacgacctttaaaggcttcctgtggctggatgaaatctagaggctt

SEQ ID NO: 64582 - DNA, 201 bp, Homo sapiens
aggatcatcttctcgaaccccgagtgacaagcctgtagcccatgttgtaggtaagagctctgaggatgtgtcttggaacttggagggctaggatttggggrttgaagcccggctgatggtaggcagaacttggagacaatgtgagaaggactcgctgagctcaagggaagggtggaggaacagcacaggccttagtgggat

SEQ ID NO: 64583 - DNA, 201 bp, Homo sapiens
gagcaagacaccatgtcaaaagaaaaaaaaatccaatcacctctgctcacctccctctttctctctctctctctctctccctccccctctctcccctgcamcacacacacacacacacacacacacacgcacgcatgcacgcaccacacactctgacgacctttaaaggcttcctgtggctggatgaaatctagaggcttt

SEQ ID NO: 64584 - DNA, 201 bp, Homo sapiens
caagacaccatgtcaaaagaaaaaaaaatccaatcacctctgctcacctccctctttctctctctctctctctctccctccccctctctcccctgcaacacacacacacacacacacacacacacgcacgcatgcacgcaccacacactctgacgacctttaaaggcttcctgtggctggatgaaatctagaggctttacc

SEQ ID NO: 64585 - DNA, 201 bp, Homo sapiens
aaatccaatcacctctgctcacctccctctttctctctctctctctctctccctccccctctctcccctgcaacacacacacacacacacacacacacacrcacgcatgcacgcaccacacactctgacgacctttaaaggcttcctgtggctggatgaaatctagaggctttacccttcttgcatggccctgcatgacct

SEQ ID NO: 64586 - DNA, 201 bp, Homo sapiens
ccaatcacctctgctcacctccctctttctctctctctctctctctccctccccctctctcccctgcaacacacacacacacacacacacacacacgcacrcatgcacgcaccacacactctgacgacctttaaaggcttcctgtggctggatgaaatctagaggctttacccttcttgcatggccctgcatgacctggcc

SEQ ID NO: 64587 - DNA, 201 bp, Homo sapiens
cctgtctctctctgtctccctctgctcaccttggggtttctctgactgcatcttgtccccttctctgtcgatctctctctcgggggtcggggggtgctgtytcccagggcgggaggtctgtcttccgccgcgtgccccgccccgctcactgtctctctctctctctctctttctctgcaggttctccccatgacaccacct

SEQ ID NO: 64588 - DNA, 201 bp, Homo sapiens
ctctctcgggggtcggggggtgctgtctcccagggcgggaggtctgtcttccgccgcgtgccccgccccgctcactgtctctctctctctctctctttctstgcaggttctccccatgacaccacctgaacgtctcttcctcccaagggtgtgtggcaccaccctacacctcctccttctggggctgctgctggttctgct

SEQ ID NO: 64589 - DNA, 201 bp, Homo sapiens
cccactcctatgcctccccctgccatcccccaggaactcagttgttcagtgcccacttcctcagggattgagacctctgatccagacccctgatctcccayccccatcccctatggctcttcctaggagaccccagcaagcagaactcactgctctggagagcaaacacggaccgtgccttcctccaggatggtttctcct

SEQ ID NO: 64590 - DNA, 201 bp, Homo sapiens; identical to SEQ ID NO: 13091

SEQ ID NO: 64591 - DNA, 201 bp, Homo sapiens; identical to SEQ ID NO: 13092

SEQ ID NO: 64592 - DNA, 201 bp, Homo sapiens; identical to SEQ ID NO: 13095

SEQ ID NO: 64593 - DNA, 201 bp, Homo sapiens
tcccattcttcctctttaatttaaatttctctctgtgtctcactgttaattgcaatacctttttttgtttgcttgttttgttttgttttgttttttggttkgtttgtttgaaatggagtctcactttgttgcccaggctggagggcagtggcacgatctcggctcactgcaacctccgcctcctgggttcaagcagttctc

SEQ ID NO: 64594 - DNA, 201 bp, Homo sapiens; identical to SEQ ID NO: 13096

SEQ ID NO: 64595 - DNA, 201 bp, Homo sapiens
gccccacacggaggcatctgcaccctcgatgaagcccaataaacctcttttctctgaaatgctgtctgcttgtgtgtgtgtgtctgggagtgagaacttcycagtctatctaaggaatggagggagggacagagggctcaaagggagcaagagctgtggggagaacaaaaggataagggctcagagagcttcagggatatg

SEQ ID NO: 64596 - DNA, 201 bp, Homo sapiens
agggatatgtgatggactcaccaggtgaggccgccagactgctgcaggggaagcaaaggagaagctgagaagatgaaggaaaagtcagggtctggaggggygggggtcagggagctcctgggagatatggccacatgtagcggctctgaggaatgggttacaggagacctctggggagatgtgaccacagcaatgggtagg

SEQ ID NO: 64597 - DNA, 201 bp, Homo sapiens
aggagaatgtccagggctatggaagtcgagtatggggacccccccttaacgaagacagggccatgtagagggccccagggagtgaaagagcctccaggacytccaggtatggaatacaggggacgtttaagaagatatggccacacactggggccctgagaagtgagagcttcatgaaaaaaatcagggaccccagagttc

SEQ ID NO: 64598 - DNA, 201 bp, Homo sapiens
gcccaggagtttgaggttacagtaagctatgatcatgccactgtacccccgtctgggtgacagaacgagaccctgtctcaaaaaaataataattccaaaamcaaatatggagacggaaattgagcccccctagactgggagcccccactgagttcggaaattaggctttacctccagccctggggtgccaggcaggagaaa

SEQ ID NO: 64599 - DNA, 201 bp, Homo sapiens
ctggaaaggacaccatgagcactgaaagcatgatccgggacgtggagctggccgaggaggcgctccccaagaagacaggggggccccagggctccaggcgktgcttgttcctcagcctcttctccttcctgatcgtggcaggcgccaccacgctcttctgcctgctgcactttggagtgatcggcccccagagggaagagg

SEQ ID NO: 64600 - DNA, 201 bp, Homo sapiens
  misc_feature (1)...(201): n = A,T,C or G, or insertion/deletion polymorphism (see Tables 1-2)
cgccgcgtgccccgccccgctcactgtctctctctctctctctctttctctgcaggttctccccatgacaccacctgaacgtctcttcctcccaagggtgngtggcaccaccctacacctcctccttctggggctgctgctggttctgctgcctggggcccaggtgaggcagcaggagaatgggggctgctggggtggctc

SEQ ID NO: 64601 - DNA, 201 bp, Homo sapiens
gggagatatggccacatgtagcggctctgaggaatgggttacaggagacctctggggagatgtgaccacagcaatgggtaggagaatgtccagggctatgraagtcgagtatggggacccccccttaacgaagacagggccatgtagagggccccagggagtgaaagagcctccaggacctccaggtatggaatacagggg

SEQ ID NO: 64602 - DNA, 201 bp, Homo sapiens
gtgagactccatctcttagaaaaaaaaaaccaggccgggtgcagtggcacatgtctgtaattccagcacttcgggaggctgaggcaggcggatcacttgargtcaggagttcaagaccagcctggccaacatggtgtactttctatactaaaagtacaaaaattagccaggcatggtgacatgcacctataatcccagcta

SEQ ID NO: 64603 - DNA, 201 bp, Homo sapiens
gagtctccgggtcagaatgaaagaagaaggcctgccccagtggggtctgtgaattcccgggggtgatttcactccccggggctgtcccaggcttgtccctrctacccccacccagcctttcctgaggcctcaagcctgccaccaagcccccagctccttctccccgcagggacccaaacacaggcctcaggactcaacaca

SEQ ID NO: 64604 - DNA, 201 bp, Homo sapiens
gctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagat

SEQ ID NO: 64605 - DNA, 201 bp, Homo sapiens
cattttttgtgttagacaaaaactagaaacaaaccaaatccccatcaacagaatatattagaatatattgatacaatagaatattacatcataattttttwaaaaaacattactgatacatacaaccacgtatatgaatctcacaaacataatgctgactgaaagaagtcaaacagaaatgagtacattctgtgtgatttc

SEQ ID NO: 64606 - DNA, 201 bp, Homo sapiens
caaaagaaatggaggcaataggttttgaggggcatggggacggggttcagcctccagggtcctacacacaaatcagtcagtggcccagaagacccccctcrgaatcggagcagggaggatggggagtgtgaggggtatccttgatgcttgtgtgtccccaactttccaaatccccgcccccgcgatggagaagaaaccgag

SEQ ID NO: 64607 - DNA, 201 bp, Homo sapiens
agggttagtaccggtatggaagcagtgggggaaatttaaagttttggtcttgggggaggatggatggaggtgaaagtaggggggtattttctaggaagttyaagggtctcagctttttcttttctctctcctcttcaggatcatcttctcgaaccccgagtgacaagcctgtagcccatgttgtaggtaagagctctgagg

SEQ ID NO: 64608 - DNA, 201 bp, Homo sapiens
attttctaggaagtttaagggtctcagctttttcttttctctctcctcttcaggatcatcttctcgaaccccgagtgacaagcctgtagcccatgttgtargtaagagctctgaggatgtgtcttggaacttggagggctaggatttggggattgaagcccggctgatggtaggcagaacttggagacaatgtgagaagga

SEQ ID NO: 64609 - DNA, 201 bp, Homo sapiens
agaggttgcagtgagccaagatcgtgccactgcactccagcctgtgcgacagtgagaaactgtctcaaaaaaaaaaaaaaaggaaaagaaattttctgacytatctcatctgatagtaggttataagaccctcattccagaagaggttctgccctatacctgggaggaaggaatgctgtacagagagaccaagaagaatat

SEQ ID NO: 64610 - DNA, 201 bp, Homo sapiens
gctcgagggccaggatgtggagagtgaaccgacatggccacactgactctcctctccctctctccctccctccagcaaaccctcaagctgaggggcagctycagtggctgaaccgccgggccaatgccctcctggccaatggcgtggagctgagagataaccagctggtggtgccatcagagggcctgtacctcatctact

SEQ ID NO: 64611 - DNA, 201 bp, Homo sapiens
ccccccagtcccagtctgtgaccattagatgatactccttttgttcaattacatttctgcacagctgttcattcttcatcaaatctaagcataaaaatagktttcccctgggtccttgggtcttcatttctgaaggctcccatgtcacctaaaactttgattaaataaatgtattatgcttttctcttgttaatctgtctt

SEQ ID NO: 64612 - DNA, 201 bp, Homo sapiens
attttccatttttgctttccaaaattcatctcctttataagccttaaaaatcagtatgggaaatactggggaatattgtcaggaaaagtaatataactatytgtcagagaaagaaactagggccagcatcatgcaacagcggggcataaggccctcccttccttacttcagcaggtgatgtgggcaaggcccttctccaca

SEQ ID NO: 64613 - DNA, 201 bp, Homo sapiens
taggagaacatagagaatataatttattaaacaaacttagagaataatcaaccacacactgtgagagaaaacccacttaaggaatgccctaactcagtggytcttgaacttgaggcatcagaatcctccggagggcttatgccacacagatagctgagccccaccggcagccttcctgattcaggaggtgtggggtggggc

SEQ ID NO: 64614 - DNA, 201 bp, Homo sapiens
atctctttcagtggctactgtgctttctggtgggcagggaaacaagctatcataactgcatccctgcagggccaaggctctctgagtcacattcttccagkgttcccatggtcctgatctctctgctctgggtgcttcaaagctggtctctatgcagtgagagtgaggaagctcctcaccaggtctccacaccaggacttc

SEQ ID NO: 64615 - DNA, 201 bp, Homo sapiens
acaacctggtgaaaccccatctgttttaaaaattacaaaaattagccagatgtggtggcatgcacctgtaatcccagctactcaggaggctgaggcaagaraattgcttgaacctgggaggtggaggttgcagtgagcagagatcatgccaatgcattccagccagggcgacagagcgagactccatctcaaaaaaaaaaa

SEQ ID NO: 64616 - DNA, 201 bp, Homo sapiens
aagttgtgaccttgtttctaacactgatctttggacacaaagggaggggaaggattaatagttaatcccagcaggaacccagcaaagaggaactctcaaarcacatacccttctgttacttcctactaaaaaaagaaggaaattattactaatatatgagctcatcccatggccctgaaccatgtgattttacctggacaa

SEQ ID NO: 64617 - DNA, 201 bp, Homo sapiens
aacccagcaaagaggaactctcaaagcacatacccttctgttacttcctactaaaaaaagaaggaaattattactaatatatgagctcatcccatggcccygaaccatgtgattttacctggacaacctcattttgagcttacgataaccttgtgatatagggatttttacccctatttttcagaggaggaaactggctta

SEQ ID NO: 64618 - DNA, 201 bp, Homo sapiens
ggaggaaactggcttaaaatttggggtcacttgcctgaaattatatagctggtaaatgacagagggaggtttgcatccggttcttccatatgtgacaatasctggtattccctaggtgctgaatacgtgtttgtttagtctcctttctgcctacatgctcacccaagcaggtgtcaggaagcggccctgtcagttcagggg

SEQ ID NO: 64619 - DNA, 201 bp, Homo sapiens
gaggaaactggcttaaaatttggggtcacttgcctgaaattatatagctggtaaatgacagagggaggtttgcatccggttcttccatatgtgacaatacytggtattccctaggtgctgaatacgtgtttgtttagtctcctttctgcctacatgctcacccaagcaggtgtcaggaagcggccctgtcagttcaggggc

SEQ ID NO: 64620 - DNA, 201 bp, Homo sapiens
tcctggaggggccccagttccgtgagtagcacagtgccaaccccatcagaatattaccacatgtgtcaatcacacaccttgtggtgaaagcgagctgaackcactgatacatgaagacatttctgactcctccctgaccttcagcctgctgggagagagactggaaggccagccatgctaggtgacaagcttctgagaggc

SEQ ID NO: 64621 - DNA, 201 bp, Homo sapiens
gcagacccatcaccaccccaccaatgcctgcccttccccccgcaggcctgccaccactgaacccccatccctgctgaccccccaggttgtttttttttttwaaaaaagcactgtgcctggcatagacagaaattcagtgaatgtctggtgaatgaaaggatggctgactggagggacagtgggctctaccctggctttgtc

SEQ ID NO: 64622 - DNA, 201 bp, Homo sapiens
catgaagacatttctgactcctccctgaccttcagcctgctgggagagagactggaaggccagccatgctaggtgacaagcttctgagaggcaaagttccyctccccaagatgtacccagccactattcctgtgtgtgtgtggcggggtggatagcacccttggagctgggcatctggatggtggttggggtgttaggggg

SEQ ID NO: 64623 - DNA, 201 bp, Homo sapiens
acggggtttcactgtgttagccaggatggtctcgatctcctgacctcgtgatccgcccatctcagcctcccaaagtgctgggattacaggtgtgagccacygcgcccggcataagacatctttttatgtcaataaatatagatctattttgtcacttttatttatttatttgtttttatttatttatttattttttagacg

SEQ ID NO: 64624 - DNA, 201 bp, Homo sapiens
ggagaccgcaccatggagccaggcggggcccgtctgcgtctgcagaggacagaagggctgggaggggagcgggagcgccaaccctgtggagatggtgagcygccctcgggggtgcagaaggcacaggcaagtgggggggaggcggggagagatgcgctatggagagaaggctccaactgcctgatgccaatccttcctgct

SEQ ID NO: 64625 - DNA, 201 bp, Homo sapiens
gagtgagccattgaggctggcccctaatttcaatatcgttgtatctcagcgaataggaaagctcgaggagaacagaagagatgggagaatggccggtcagyagagtagtcagaacacacacagaatttgtcagttaagtttgctctcttatttgggtgtatttcatgatgccctaaaacaattacaattgtaacattaaaa

SEQ ID NO: 64626 - DNA, 201 bp, Homo sapiens
gcaggacgccctatgtcaggtggaattatgtggccaagaactttgcccaggtgagaagatagggtagaagggtggacctgtgactcatggtggtggagagkggacatttctgggaggcctggggaggcagtgggagggtgatgccaagggaagagaaggccagtgctgggccagaggtcaatgccaccggcagctgccagc

SEQ ID NO: 64627 - DNA, 201 bp, Homo sapiens
cagctccttgcttatcccccacccccaccctatccatttctccactcaccaatcccaccacccttccccagcagccccctcacctctgccctctgcccttrcccttactaatccacccctctcattcctccccaggtgaggggatccaggcccccagtttctccagctacctctacttcctcttctgcccaacactcatct

SEQ ID NO: 64628 - DNA, 201 bp, Homo sapiens
tctctgtgccactggaagggagccatccagagggaggcctgcatcctgctcctgcagatcccagactgatggtgggaggcctcgcccccaggcctggaggyaaggctgctgagactgagaggtggagtcaagggggtacttggaaagcagggagggaggcagcatttgggaggcagccaagctgtatcctggggcatgtgg

SEQ ID NO: 64629 - DNA, 201 bp, Homo sapiens
caaaaactctagtgataagtcaatgctggcacttttggatcagatatgaacccttgatgtggcatccaaggctccttcccacacagccccagcctatctgsgggaagatatgtgcttccatgcctccaggcctttgcccatactggcccctcagcttgaaataccctttcctaattttcagccatggaatctagttgcttc

SEQ ID NO: 64630 - DNA, 201 bp, Homo sapiens
ggagtgtcccaactgaaggagacagaaggtcaaaatacttctgttcaaaactgtttcagaaaccagactatgtggtctgccctccccacactgattccctkcctgatgtggttctggggagacatctgtgtaagaaaagtggggaacattagtctcaggggggctgaggaccaaaaaatccagggtccctaagagagagag

SEQ ID NO: 64631 - DNA, 201 bp, Homo sapiens
ggaaggaacatggagctgtcatcactcaacaaaaaaccgaggccctcaatccaccttcaggccccgccccatgggcccctcaccgctggttggaaagagtrttggtgttggctggggtgtcaataaagctgtgcttggggtcgctggcttgtgtctctgtgtctgcctctcacaattctggaatccctggccctctcttta

SEQ ID NO: 64632 - DNA, 201 bp, Homo sapiens
ctcacatctgtcccctcctatcagggccattgccatggtctcagttcagaccatctgctccccctccacatcagcctcctaacccatctccctggcacccrgatctttcctttcccatctacccctaacactgctgcccaggtgaactttcctactgcaactaatcattccctaccctccttcaaaaactctagtgataag

SEQ ID NO: 64633 - DNA, 201 bp, Homo sapiens
agagctatgtcagagctgtggcctggccttatccttctgactgtttagccccagatagtgaatggagtagcttcccattccctgagtgccctgttcccagyaatgtcaccaggccccctgcttgcctatggcctcctcaccactggcaacagcaacttccccttctagtagccccaaccatgatactagatattggctggt

SEQ ID NO: 64634 - DNA, 201 bp, Homo sapiens
aattgattgatttttaaattagttaattttttaaaattaagtaattagttaattttttaaaattaagtaattaattaattttttaaaattaagtagttaattttttttaattaagtaattaattaattttaaaaagtatttatttattttgagacaaagtctcactctgttgcccaggctggagtacagtggtccagcgtc

SEQ ID NO: 64635 - DNA, 201 bp, Homo sapiens
tgcaaagatcggattcgaattaaggatggagatggaggggtttgaagcacaggtcccaaaggtcaccaaaagtcagccagtagatagagtcttcctgctartgcggctggaggccaggggtgaggagtgacaatcggaggtgaccaggctggaattcagacccagggaggggaagccttgctcctgctgtcactccctgat

SEQ ID NO: 64636 - DNA, 201 bp, Homo sapiens
aaagatcggattcgaattaaggatggagatggaggggtttgaagcacaggtcccaaaggtcaccaaaagtcagccagtagatagagtcttcctgctagtgyggctggaggccaggggtgaggagtgacaatcggaggtgaccaggctggaattcagacccagggaggggaagccttgctcctgctgtcactccctgatcct

SEQ ID NO: 64637 - DNA, 201 bp, Homo sapiens
agggaatctgccaaatcagggttatgatttaaacctgctcagaatcgttcacccatcctaccccaccctgctccagggaggagagcagaagctgagtcacygggtgggtgggacagaagtgaatcagccgtgaaaacatggggggcagcggggagatggggagggcaggaaatgcaaactgcgcatcccagaggctctggg

SEQ ID NO: 64638 - DNA, 201 bp, Homo sapiens
cacaggtcccaaaggtcaccaaaagtcagccagtagatagagtcttcctgctagtgcggctggaggccaggggtgaggagtgacaatcggaggtgaccagrctggaattcagacccagggaggggaagccttgctcctgctgtcactccctgatcctcgctgctgccccaggaagccagaaggagatcaactctgggcagg

SEQ ID NO: 64639 - DNA, 201 bp, Homo sapiens
agccagtagatagagtcttcctgctagtgcggctggaggccaggggtgaggagtgacaatcggaggtgaccaggctggaattcagacccagggaggggaarccttgctcctgctgtcactccctgatcctcgctgctgccccaggaagccagaaggagatcaactctgggcagggatcatggcttgttcatctttttacca

SEQ ID NO: 64640 - DNA, 201 bp, Homo sapiens
ggagggacagtgggctctaccctggctttgtcccgtaggctgtgaaggcacaattgctggagcaagcgcagggacaactgagggagctgctggatcgggcyatgcgggaggctatacaatcctacccatcacaagacaaacctctgcccccacctcccccaggttccttgagcaggtgagtctggggaatggctgcgcggg

SEQ ID NO: 64641 - DNA, 201 bp, Homo sapiens
ctgatcagaccctctgggtcctcagtgccccacctgcccttggggcaagaggacacaggttccccctttggttattggacatgtaccaacattgctcccawcaacctttccacctgaaacactctctaggatcccttccttccccagccttggttggccctttgtctgtcctcccagggccggccactctcaaatgcttct

SEQ ID NO: 64642 - DNA, 201 bp, Homo sapiens
tgtaccaacattgctcccaacaacctttccacctgaaacactctctaggatcccttccttccccagccttggttggccctttgtctgtcctcccagggccrgccactctcaaatgcttctcaatgacaccttgccctgaggcagatgtgtgtgtgtgtgcacacatgcacacccatacacactcctttccaagtcagttct

SEQ ID NO: 64643 - DNA, 201 bp, Homo sapiens
caacattgctcccaacaacctttccacctgaaacactctctaggatcccttccttccccagccttggttggccctttgtctgtcctcccagggccggccaytctcaaatgcttctcaatgacaccttgccctgaggcagatgtgtgtgtgtgtgcacacatgcacacccatacacactcctttccaagtcagttctattca

SEQ ID NO: 64644 - DNA, 201 bp, Homo sapiens
tccccattgccgctgcaggacgccctatgtcaggtggaattatgtggccaagaactttgcccaggtgagaagatagggtagaagggtggacctgtgactcwtggtggtggagaggggacatttctgggaggcctggggaggcagtgggagggtgatgccaagggaagagaaggccagtgctgggccagaggtcaatgccac

SEQ ID NO: 64645 - DNA, 201 bp, Homo sapiens
agtagagacggggtttcaccgtgttaaccaggatggtctcgatctcctgacctcatgatctgcctgcctcggcctcccaaagtgctgggattacaggtgtragccaccttgcccaacctatagtgtagctttaaaacagagaatgataacagtcctttcccagaacaaacttccttcatgtctgtggactagactaaggcc

SEQ ID NO: 64646 - DNA, 201 bp, Homo sapiens
actgcaggtgcacgccaccacacctcggtaattttataaattatttgtagagatgaggttctcattatgttgcccaggctggtctcaaactcctgggctcragcaatcctcccacctctgcttctcaaagttctgggattacaggcgtgagccattgcacccatcctcattttccatttttgctttccaaaattcatctcc

SEQ ID NO: 64647 - DNA, 201 bp, Homo sapiens
ataaagatgggaaataggtgactggtagactaccctgtctccttgcccggcctatgatgacactagggcaacccactttcctggtttacccaggactgtcytgataatcctacccatcctacacacccttgttgacatccatgcttaaaacccacttgttatctctgttatggaaagttcagagtatcctagaccccacca

SEQ ID NO: 64648 - DNA, 201 bp, Homo sapiens
ctacaggcgcccgccaccacgcccggctaatttttttggtatttttagtagagacggggtttcaccgtgttaaccaggatggtctcgatctcctgacctcrtgatctgcctgcctcggcctcccaaagtgctgggattacaggtgtgagccaccttgcccaacctatagtgtagctttaaaacagagaatgataacagtcc

SEQ ID NO: 64649 - DNA, 201 bp, Homo sapiens
aaggagaatgggttgtcgaacgtgtgggtaccaaatgaagctctggccacagcaggccctgcactggaagatagggtgcctgaaatgacagcagaagagayggtgttaaagagccagttccgctcctgcccagcttagctcccctagcccgcatccaggtcctacgtccagctccttgcttatcccccacccccaccctat

SEQ ID NO: 64650 - DNA, 201 bp, Homo sapiens
ctgagtagctgggactacaggcgcccgccaccacgcccggctaatttttttggtatttttagtagagacggggtttcaccgtgttaaccaggatggtctcratctcctgacctcatgatctgcctgcctcggcctcccaaagtgctgggattacaggtgtgagccaccttgcccaacctatagtgtagctttaaaacagag

SEQ ID NO: 64651 - DNA, 201 bp, Homo sapiens
gattacagacgtaagtgaccgtgcccagccagcatgctcttaaataagattgatgtcaccccttctgacctcagatcccatattctttccactgcgccacrctccccctggcttccttaaggtgggggctcttttttttttttttttttttgaccattgggaggtaaacatcttaaaagcaaattttattctggttacatt

SEQ ID NO: 64652 - DNA, 201 bp, Homo sapiens
agtggagacggggtttcaccatgttggccaggctggtctcgaacgcctgacctcaagtgatctgcccaccttggcctcccaaagtgctgggatgacaggcrtgagccactgcgcccagccaataatttatttatttttgagacagggtctcactcggttgtccaggctgaagtgcagtagcacaatcatggctcactgcag

SEQ ID NO: 64653 - DNA, 201 bp, Homo sapiens
catctgttttaaaaattacaaaaattagccagatgtggtggcatgcacctgtaatcccagctactcaggaggctgaggcaagagaattgcttgaacctggraggtggaggttgcagtgagcagagatcatgccaatgcattccagccagggcgacagagcgagactccatctcaaaaaaaaaaaaaaaaaaaaaaaaaaga

SEQ ID NO: 64654 - DNA, 201 bp, Homo sapiens
ttctcatccccagcctctaggtggtttgtggagaggacttggaaagggtttctaaggtgcaggtcccctatttgccctaggcatggttgtggaagaaaggmctttagctggaagttctggatcgctaggccccatgcctcatgtgtacagtgtctgagctagttcacacaaccctgaggaccctcccacactgactttcgg

SEQ ID NO: 64655 - DNA, 201 bp, Homo sapiens
aatccaaactgcagaaaataataaaaactgaaaaacatcaggcaagactagaatttaacaacagatgtacttttttttttttttttttgagacagagtctyggtccgttgcccaggctggagtgcagtggcgtgatcttggctcactgcaacctccgcctcctgggttcaagcgaatctccaacctcagcctcctgagtag

SEQ ID NO: 64656 - DNA, 201 bp, Homo sapiens
ttttccagagcttatataccttctaagctctatgtctatgtgtaggtgtgcattcatctaaagacataagtgattaacttcttttaatctataactaaggyctgagtcttgaagaccttcttctggagcctcagtaagtttacttaatctaaatgggtccaggtgctggggtgattacccttctcttatctcctgctaaat

SEQ ID NO: 64657 - DNA, 201 bp, Homo sapiens
ctttttttttttttttttttttcatactacttgaatctctaagtgctcctaattgtttaagttatcatatatctctttcagtggctactgtgctttctggkgggcagggaaacaagctatcataactgcatccctgcagggccaaggctctctgagtcacattcttccagtgttcccatggtcctgatctctctgctctgg

SEQ ID NO: 64658 - DNA, 201 bp, Homo sapiens
taagctctatgtctatgtgtaggtgtgcattcatctaaagacataagtgattaacttcttttaatctataactaaggtctgagtcttgaagaccttcttcyggagcctcagtaagtttacttaatctaaatgggtccaggtgctggggtgattacccttctcttatctcctgctaaatcacagaggtttggggagttcctt

SEQ ID NO: 64659 - DNA, 201 bp, Homo sapiens
gcccttaacaagagcccttaaagtcaccagctgcaggctgagcacagtggctcacacaggtaatcccagcactctgggacactgagacaggaggatcgttygagcccaggagttcaagaccagcctgagcaacgtagtgagatggggtctcacttcaaaaaactttttaaaattagccaggtgtggtggctaatgcctgtg

SEQ ID NO: 64660 - DNA, 201 bp, Homo sapiens
cttcaaaaaactttttaaaattagccaggtgtggtggctaatgcctgtggtcccagctgtgtggaaggctgaggtgagaagattacttgagtccgggaggkgaaggctgcagtgagccatgactatgtcactgtactccagcctgggcaacagactgagatcccatctcaaaaaaaaaaagtgagagacatgcaactcttt

SEQ ID NO: 64661 - DNA, 201 bp, Homo sapiens
cttgccctgaggcagatgtgtgtgtgtgtgcacacatgcacacccatacacactcctttccaagtcagttctattcaagtaacctccattgagcacctccygagtaccagtcctagtggccagagaaatgaggggggcagaccccactcctgtctgtgaggcactcccagtcttgtggggaagacagacatgtaaccaagt

SEQ ID NO: 64662 - DNA, 201 bp, Homo sapiens
tgcagtgagccatgactatgtcactgtactccagcctgggcaacagactgagatcccatctcaaaaaaaaaaagtgagagacatgcaactctttctttcaytcacttgaacacttaaagaccatttcaacgttattaattggcccaatttcaaatttttttttttttttttgagatggagtcttgccctgtttcccaggct

SEQ ID NO: 64663 - DNA, 201 bp, Homo sapiens
gcccagccatagtttttgaaacataatttttctctctccagtttcccatttttattaaaagacagatcatagtaggactggtttgctttattatacttggkttaattatttgtatacagtacagcaagaataattagtttcacataggccttttaaattggctttgatggaacttcgttccatagaaggaatctgagataa

SEQ ID NO: 64664 - DNA, 201 bp, Homo sapiens
ttgacaaggaaatctgttacctctgtagcacacaacaatttaacataacaatggctgggcacagtggctcatgcctgtaatcccagcactttgggaggccraggtgggtggatcacgaggtccggagttcaaaaccaacctggccaatatggtgaaaccccgtctctactaaaaatacaaaaattagctgagcatggtggt

SEQ ID NO: 64665 - DNA, 201 bp, Homo sapiens
ctgtagcacacaacaatttaacataacaatggctgggcacagtggctcatgcctgtaatcccagcactttgggaggccgaggtgggtggatcacgaggtcmggagttcaaaaccaacctggccaatatggtgaaaccccgtctctactaaaaatacaaaaattagctgagcatggtggtgcatgcctgtagtcctagctac

SEQ ID NO: 64666 - DNA, 201 bp, Homo sapiens
gaggtgggtggatcacgaggtccggagttcaaaaccaacctggccaatatggtgaaaccccgtctctactaaaaatacaaaaattagctgagcatggtggygcatgcctgtagtcctagctacttgagagactcaggcagaagaatcacttgaacctgggaggcagaggttgcagtaagccaagatcacgccactgcactc

SEQ ID NO: 64667 - DNA, 201 bp, Homo sapiens
tagtcctagctacttgagagactcaggcagaagaatcacttgaacctgggaggcagaggttgcagtaagccaagatcacgccactgcactccagcctgggygacagagcgagactccatctaaataaataaataaataacaattctaattattattgataatgtacactaagatatatcagaattatagcagtctctcata

SEQ ID NO: 64668 - DNA, 201 bp, Homo sapiens
attcctcctgttgactgtgcctttgatccctcctcacaggaaacactgagacgcacagagccccggacttggtacaatggacccgacacatggaggtgagkgatgtcagaggtcagaggtcaagtggacagatccttggtagcaggaagcaggagtgaggcttggtgataaagatgacttttttttttttttttttttgaa

SEQ ID NO: 64669 - DNA, 201 bp, Homo sapiens
atacataccaataacatatttatacaaatatagcccaaagaaagtcaaaccccattttatatttggcaatgcttcctgtatgatttttggtaccaaataarccaaatttcacctttatattagtgtactattaatgttaaacccaattatttatttatttatttattttcttttttgagacagagtctcactccgtcaccc

SEQ ID NO: 64670 - DNA, 201 bp, Homo sapiens
taatctttttaccaaaagtatattttacttttcttatacaccttgcacataaattgtttcttcaacagtgttaaatatatattatactgttaactcttagmaacctttacttttggtgaaaaccttggtaagtttgggattttaattatgtactaggtgtggcgcctaggacctagacaggagtacagataaggtctgact

SEQ ID NO: 64671 - DNA, 201 bp, Homo sapiens
aatcccagcactttaggaggctgaggcgggcagatcacctgaggttgggagtttgagaccagcctgaccaatatggagaaatcctgtctctactaaaaatwaaaaattagccaggcgtggtagcacatacctgtaatcctagctactcgggaggctgaagcaggagaattgcttgaacccgggaggcggaggttgtggtga

SEQ ID NO: 64672 - DNA, 201 bp, Homo sapiens
gtgagggcagctgctgagcacacaaagcatttcctgaccacaggatgcctctgggtctgcagaaccccaattcctcctgttgactgtgcctttgatccctsctcacaggaaacactgagacgcacagagccccggacttggtacaatggacccgacacatggaggtgagggatgtcagaggtcagaggtcaagtggacaga

SEQ ID NO: 64673 - DNA, 201 bp, Homo sapiens
tccttcaatcccacactgctctcggaggattttaaacagtttctggctgggtgcagtggctcacgcctgtaatcccagcactttgggaggccgaggcaggmggatcacttgaggtcagcaattcaagaccagtctggccaatatggtgaaaccctgtctctactgaaaaaaaaaaaattagccagtcgtggtggtgcaagc

SEQ ID NO: 64674 - DNA, 201 bp, Homo sapiens
acaattgacaaggaaatctgttacctctgtagcacacaacaatttaacataacaatggctgggcacagtggctcatgcctgtaatcccagcactttgggaggccgaggtgggtggatcacgaggtccggagttcaaaaccaacctggccaatatggtgaaaccccgtctctactaaaaatacaaaaattagctgagcatgg

SEQ ID NO: 64675 - DNA, 201 bp, Homo sapiens
ggttgtggtgagccaagattgcaccattgcactccagcctgggtgacagagcaaaactctgtctcaaaaaaaaaaaaaaaaagacaaggtcctaggagagraataaaaacaaaaccaaaaacatgaaagccttttaaatacaaacgtgcacacatgcacacatacgtatacacatcttggatgttatcttttaattaagct

SEQ ID NO: 64676 - DNA, 201 bp, Homo sapiens
tggctaattttttttttatatttttagtagagacggggtttcaccatattggccaggctggtcttgaactcctgacctcaagtgatctacccgcctcggcmtcccaaagtgctgggattacaggtgtgagccacggtgcccagcctgatgacttgttcctgagtgcaaagatcggattcgaattaaggatggagatggagg

SEQ ID NO: 64677 - DNA, 201 bp, Homo sapiens
tccagagcttatataccttctaagctctatgtctatgtgtaggtgtgcattcatctaaagacataagtgattaacttcttttaatctataactaaggtctragtcttgaagaccttcttctggagcctcagtaagtttacttaatctaaatgggtccaggtgctggggtgattacccttctcttatctcctgctaaatcac

SEQ ID NO: 64678 - DNA, 201 bp, Homo sapiens
aagccactggtggctgaacacagcaccatcccggtctctcctggctggcttgccacgttttgttcccaggtcaaactgaaggttgggctgctatttcttgmggcccagtaacgagatgcagatgaactggggaggaagagagtttttatttctgtaaccagttacagggagaaggcctggaaattatcaccaggccaatta

SEQ ID NO: 64679 - DNA, 201 bp, Homo sapiens
actcaccctttgagcgtgtctgcttctgatctctgttcttccccagtagtgaaagggacgtgcagttttgcacacgggacagccctcgggagggtccccargaaaaatctcacgggcagctgcttggaccctcctgaagactgtctcatcgcaagccactggtggctgaacacagcaccatcccggtctctcctggctggc

SEQ ID NO: 64680 - DNA, 201 bp, Homo sapiens
tggaggtttcacgtaaacaagaaactgtacctattattttgtaatttgattttactccctaacaatttattttagggatcttttcatgttagtccattggyttgaaggactgaagaatatggaggtgccagatttgttcacttagtcctttactaatggacacttaggttgttttcagtttttccccttaacaaaccatac

SEQ ID NO: 64681 - DNA, 201 bp, Homo sapiens
actaaggaaagtcagtctagttacctcatatcctaacatgtgttgtatatagagtactgagcccttaccaacaccatgaaatcagagagggctctcaaggycatttagaatcaaactcatgccatgactgagtctcctggagcaacgccctgtgccacagaggtgccgtcttgaacacctccagagatggggagctcacaa

SEQ ID NO: 64682 - DNA, 201 bp, Homo sapiens
ttccacagacaatctctgacatcccttgactttctgatttgtcctaaacatgtttctctttaaacaaccagttattttactttaggacaagaatttaccayacaagatcctttcttatataaattctcttttctttaatatctttttgcatatctagggggcatggctaatttcacatgtccctagccttatctagaatct

SEQ ID NO: 64683 - DNA, 201 bp, Homo sapiens
acagtggctcatgcctgtaatcccagcactttgggaggccgaggtgggtggatcacgaggtccggagttcaaaaccaacctggccaatatggtgaaacccygtctctactaaaaatacaaaaattagctgagcatggtggtgcatgcctgtagtcctagctacttgagagactcaggcagaagaatcacttgaacctggga

SEQ ID NO: 64684 - DNA, 201 bp, Homo sapiens
gctgtaaagcaggcaagttgtacagctaagagtcataaagcatttaggaggcctaatcacctttaaattgtataacatttcttgtataaatttcctttaayaaattctttcaggacttccacagacaatctctgacatcccttgactttctgatttgtcctaaacatgtttctctttaaacaaccagttattttactttag

SEQ ID NO: 64685 - DNA, 201 bp, Homo sapiens
gagaggacttggaaagggtttctaaggtgcaggtcccctatttgccctaggcatggttgtggaagaaaggcctttagctggaagttctggatcgctaggcyccatgcctcatgtgtacagtgtctgagctagttcacacaaccctgaggaccctcccacactgactttcgggcccctgtccctctagtgagctgatggagg

SEQ ID NO: 64686 - DNA, 201 bp, Homo sapiens
atcatggcttgttcatctttttaccacagcacttagcactgcggggtcctaccccaccagcagacccatcaccaccccaccaatgcctgcccttccccccrcaggcctgccaccactgaacccccatccctgctgaccccccaggttgtttttttttttaaaaaaagcactgtgcctggcatagacagaaattcagtgaat

SEQ ID NO: 64687 - DNA, 201 bp, Homo sapiens
tgcttaaagccacacagcaacttttcctccccttccattctgccacaggttaggttcctgatgaaaagctactccttcctgagagaggctgtgcctgggayccttcgtgccagacgaggtgaggccttcatcttgcccggttgtgaactcagtcctcttggctgactgaatgaagccagcaggtgcaggatcctgataaaa

SEQ ID NO: 64688 - DNA, 201 bp, Homo sapiens
tcctgggcttaagcaatcctcctgccttggcctcccaaagtgttgggattacaggagtgagccattgaggctggcccctaatttcaatatcgttgtatctsagcgaataggaaagctcgaggagaacagaagagatgggagaatggccggtcagcagagtagtcagaacacacacagaatttgtcagttaagtttgctctc

SEQ ID NO: 64689 - DNA, 201 bp, Homo sapiens
aaaaactctagtgataagtcaatgctggcacttttggatcagatatgaacccttgatgtggcatccaaggctccttcccacacagccccagcctatctggkggaagatatgtgcttccatgcctccaggcctttgcccatactggcccctcagcttgaaataccctttcctaattttcagccatggaatctagttgcttct

SEQ ID NO: 64690 - DNA, 201 bp, Homo sapiens
cccagctggaagatggaacagaaaagagctatgtcagagctgtggcctggccttatccttctgactgtttagccccagatagtgaatggagtagcttcccrttccctgagtgccctgttcccagtaatgtcaccaggccccctgcttgcctatggcctcctcaccactggcaacagcaacttccccttctagtagccccaa

SEQ ID NO: 64691 - DNA, 201 bp, Homo sapiens
ccctgagtgccctgttcccagtaatgtcaccaggccccctgcttgcctatggcctcctcaccactggcaacagcaacttccccttctagtagccccaaccrtgatactagatattggctggttggggtgagggcagctgctgagcacacaaagcatttcctgaccacaggatgcctctgggtctgcagaaccccaattcct

SEQ ID NO: 64692 - DNA, 201 bp, Homo sapiens
aaactctagtgataagtcaatgctggcacttttggatcagatatgaacccttgatgtggcatccaaggctccttcccacacagccccagcctatctggggraagatatgtgcttccatgcctccaggcctttgcccatactggcccctcagcttgaaataccctttcctaattttcagccatggaatctagttgcttcttg

SEQ ID NO: 64693 - DNA, 201 bp, Homo sapiens
taagtcaatgctggcacttttggatcagatatgaacccttgatgtggcatccaaggctccttcccacacagccccagcctatctgggggaagatatgtgcytccatgcctccaggcctttgcccatactggcccctcagcttgaaataccctttcctaattttcagccatggaatctagttgcttcttggaggcccatggt

SEQ ID NO: 64694 - DNA, 201 bp, Homo sapiens
accaacatctggcacaaagtgatgccaagtaaatgtacatgaacaaatggatgaataaatgaatgcatgaggccaggcacagtggctcacacctgtaatcmcaacactttgggaggccaaaggaggaggaccgcttgaggccaggagttcgagactagactggacaatatagtgagatctcatctctacaaaaaacttaaa

SEQ ID NO: 64695 - DNA, 201 bp, Homo sapiens
attacatttgccctggacacatggttggacatctttctgtctctgtctctgtgtgtgtctcacttcaattactctgtgaactcccaatggccctttgagaytcatctctatcaccaacatctggcacaaagtgatgccaagtaaatgtacatgaacaaatggatgaataaatgaatgcatgaggccaggcacagtggctca

SEQ ID NO: 64696 - DNA, 201 bp, Homo sapiens
gatgaataaatgaatgcatgaggccaggcacagtggctcacacctgtaatcacaacactttgggaggccaaaggaggaggaccgcttgaggccaggagttygagactagactggacaatatagtgagatctcatctctacaaaaaacttaaaaatagccaggcatggtggctcacacctgtaatcccagcactttgggagg

SEQ ID NO: 64697 - DNA, 201 bp, Homo sapiens
cacacctgtaatcccagcactttgggaggctaaggtgggtggatcacgaggtcaggagatcaagaccatcctggctaacacggtgaaaccccatctctacyaaaaatacaaaaaattagccgggcgtggtggcgggcgtctgtagtcccagctactcgggaggctgaggcaggagaatggcatgaacccaggaggcggagc

SEQ ID NO: 64698 - DNA, 201 bp, Homo sapiens
gactccgtctcaaaaaaataataataataaaaaaaattagctgggagtggtggctcatgtctgtagttccagttacttgggaggctgaggtgggaggatcrcttgagtccaggagtttgaggctgcagcgagctatgatcacaccactgcagtccagcctgtctcaaaaaaaaaaaaaaaaaggaatgcataaatttgtga

SEQ ID NO: 64699 - DNA, 201 bp, Homo sapiens
ccctgagaaataaatatgattatatcctcattttaaaatggcacctaagtcccaatgggatagtagcatgctttttttttttttttttttttttttttttytgagatggagtccagccttgttgcccaggctggagtagagtggcacgatcttggctcacctgcaacctctgcctcctgggttcaagcgattcttctgcct

SEQ ID NO: 64700 - DNA, 201 bp, Homo sapiens
cctgagaaataaatatgattatatcctcattttaaaatggcacctaagtcccaatgggatagtagcatgcttttttttttttttttttttttttttttttkgagatggagtccagccttgttgcccaggctggagtagagtggcacgatcttggctcacctgcaacctctgcctcctgggttcaagcgattcttctgcctc

SEQ ID NO: 64701 - DNA, 201 bp, Homo sapiens
aaaaaaaaaaaaaaaaagacaaggtcctaggagagaaataaaaacaaaaccaaaaacatgaaagccttttaaatacaaacgtgcacacatgcacacatacrtatacacatcttggatgttatcttttaattaagctgactctcaaccattgagcgtctagaagatatttttccttcccagtggcctctcagcaggaatgga

SEQ ID NO: 64702 - DNA, 201 bp, Homo sapiens
aagaatttttcttagtacagaacaaaatgaaaagtctcccatgtctatttctttctacacagacaccgcaaccatccgatttctcaatcctttccccaccwttcccccctttctattccacaaaactgccattgtcatcatggcccgttctcaatgagctgttgggtacacctcccagacggggtggtggccgggcagagg

SEQ ID NO: 64703 - DNA, 201 bp, Homo sapiens
gtggtgcaatctcagctcactgcaacctctgcctcctgggttcaagcaattctctgcctcagcctcccaagtagctgggattacagacgtccgccaccacrcctggctaatttttttagtagagatggggtttcaccatcttggccaggctggtctcaaactcctgaactcatgatccagccaccttggcctcccaaagtg

SEQ ID NO: 64704 - DNA, 201 bp, Homo sapiens
acgtccgccaccacacctggctaatttttttagtagagatggggtttcaccatcttggccaggctggtctcaaactcctgaactcatgatccagccacctyggcctcccaaagtgctgggattacaggcgtgagccactgcacccagccaatacctcctattttcaagtttacatgctatcaaagggaataagacagatac

SEQ ID NO: 64705 - DNA, 201 bp, Homo sapiens
ggaataagacagatacacaaataagtggagacaaattttggacaacacaagggggagtgcactcaggcaaaacagactcaaaaccaactcaaaacctgatygcaaccaaaatgcaaagcaggcgtatgagtgagccctattgcttccctgggtggtaccggacaaatggcttaacaagcccaataggaaaacaataggctc

SEQ ID NO: 64706 - DNA, 201 bp, Homo sapiens
ggccctaaaatttttggaatgacaagttggcactggctccaacttaaagtcaccagctgcattagcccttaacaagagcccttaaagtcaccagctgcagrctgagcacagtggctcacacaggtaatcccagcactctgggacactgagacaggaggatcgtttgagcccaggagttcaagaccagcctgagcaacgtag

SEQ ID NO: 64707 - DNA, 201 bp, Homo sapiens
tttttttttgagatggagtcttgccctgtttcccaggctggagtgcagtggcacgatcttggctcactgcagcctccaccttctgggttcaagcgattctyctgcctcagcctcctgagtagctgggattataggtgtgtgtcaccacacccagctaacttttttgtacttttagtagagacagggtttcaccatgttggc

SEQ ID NO: 64708 - DNA, 201 bp, Homo sapiens
tcttatttgggtgtatttcatgatgccctaaaacaattacaattgtaacattaaaaatcactggtcacagtgatttttgccgaggtgagaagttggggtaraagggtggacctgtgactcatggtggtggagaggggacgtttctgggaggcctggggaggcagtgggagggtggtgccaagggaagaggaggccagtgct

SEQ ID NO: 64709 - DNA, 201 bp, Homo sapiens
cagtgggagggtgatgccaagggaagagaaggccagtgctgggccagaggtcaatgccaccggcagctgccagcatccctctccagttatgtgtccccatsccccctccaggccctgggatgtgtgctctatgcctgcttcatcctgggccgcctctgtgttcctgtctttgccaacatgagccgagagcccttcagcacc

SEQ ID NO: 64710 - DNA, 201 bp, Homo sapiens
tttttttttttttttgaaacaaagtctcgctctgttgctcaggctggagtgcattggcacaatctcggctcactgcaacctctgcctcccaggttcaagcragtagctgaactacagatgagtgccaccaggtgtggctaattttttttttatatttttagtagagacggggtttcaccatattggccaggctggtcttga

SEQ ID NO: 64711 - DNA, 201 bp, Homo sapiens
cccaccttctccaggactggtggaactcaacgtccttctccaactactaccgcacttggaacgtggtggtccatgactggctgtacagctacgtgtatcasgatgggctgcgggtatgggccctgcagaccccttcagctctcacagttaataggggctctccttccttccctctccttccctcctgctacagtgtggcaa

SEQ ID NO: 64712 - DNA, 201 bp, Homo sapiens
ctccagatcagataacctatcgcactcccagaggccccctcctcctgaaaggactttagtctttggagctgtcacctgagctgagtgggacaagagctctrcagggcaggccacactgcgaaggaaggaggcaacacgggcaagggctgcctgctgcccgctggagaccgcaccatggagccaggcggggcccgtctgcgt

SEQ ID NO: 64713 - DNA, 201 bp, Homo sapiens
ggtgggttgagtcatagcaaggtcacagcagggacacacattccttttgggtccctgttggcccccctcctacatccgttgctcttctgccccagctctcyggcttcgtgcgcccccttctggcctctggtggaacagccaggtcttttcacccaaagcccaaagccccaaatagtcctttgaatttgttctccatttttt

SEQ ID NO: 64714 - DNA, 201 bp, Homo sapiens
acctcccagacggggtggtggccgggcagaggggctcctcacttcccagtaggggcggccgggcagaggcgcccctcacctcccggacggggcggctggcygggcggggggctgacccccccacctccctgccggactgggcggctggccgggcggggggctggaggtgggggctctttgtggaggagctcagggagactt

SEQ ID NO: 64715 - DNA, 201 bp, Homo sapiens
gaaggcaaacactgtgacaccgccatcacaggaggttgaccggaagactccgctctggcctcttatcctagcagccttcattcatcccagcatatgttagrctatacggccatccaacaaaaagaaaaagtatgggctctgaccagacagatcttacactctgcctgcctctcagaggtaacccagagcacagagaggtta

SEQ ID NO: 64716 - DNA, 201 bp, Homo sapiens; identical to SEQ ID NO: 13112

SEQ ID NO: 64717 - DNA, 201 bp, Homo sapiens
ccctccttgttccccaactcaccggccacagtcaggcaccagggcctggcttgggggtgatggactctcacgtcttggatgcatgggttgagtcaccaggmatgatctcattcacgacttattcttctctggctcaggcaactttctgggggctggtgacacctcgatcttggtcctgccatacctagaggtcgggacaga

SEQ ID NO: 64718 - DNA, 201 bp, Homo sapiens
gggggaactcagaggaactggggccaccaaggttggaaaagggtttggttcttgactttgtattccttccaatacagcaataaactttgtctccctttttattcattcattcattcattcattcattcattcatcatttgtggaaggctcacttggatttttgtagagttgtgtctgcagaggcaagactttgtggtagga

SEQ ID NO: 64719 - DNA, 201 bp, Homo sapiens
tgaggcccagtaacgagatgcagatgaactggggaggaagagagtttttatttctgtaaccagttacagggagaaggcctggaaattatcaccaggccaaytaaaaattataaagttttccagagcttatataccttctaagctctatgtctatgtgtaggtgtgcattcatctaaagacataagtgattaacttctttta

SEQ ID NO: 64720 - DNA, 201 bp, Homo sapiens
cccagcatatgttaggctatacggccatccaacaaaaagaaaaagtatgggctctgaccagacagatcttacactctgcctgcctctcagaggtaacccaragcacagagaggttaagcgatttgcttaaagccacacagcaacttttcctccccttccattctgccacaggttaggttcctgatgaaaagctactccttc

SEQ ID NO: 64721 - DNA, 201 bp, Homo sapiens
ggggaactcagaggaactggggccaccaaggttggaaaagggtttggttcttgactttgtattccttccaatacagcaataaactttgtctccctttttattcattcattcattcattcattcattcattcatcatttgtggaaggctcacttggatttttgtagagttgtgtctgcagaggcaagactttgtggtaggat

SEQ ID NO: 64722 - DNA, 201 bp, Homo sapiens
ttctgctcatggcatgccctagcacattttgagaggacacgtagcaggcctcctttcctttagtagattcaggagaggcatgcctcgtatagacctgaaaygaagcttttaatttcgtgaaccccagtttctacaactataaaagggacattaaaattaggagtgtcccaactgaaggagacagaaggtcaaaatacttct

SEQ ID NO: 64723 - DNA, 201 bp, Homo sapiens
tatgttaggctatacggccatccaacaaaaagaaaaagtatgggctctgaccagacagatcttacactctgcctgcctctcagaggtaacccagagcacaragaggttaagcgatttgcttaaagccacacagcaacttttcctccccttccattctgccacaggttaggttcctgatgaaaagctactccttcctgagag

SEQ ID NO: 64724 - DNA, 201 bp, Homo sapiens
cattacgagggatttggggaacctgcaggctggaaggcaaacactgtgacaccgccatcacaggaggttgaccggaagactccgctctggcctcttatccyagcagccttcattcatcccagcatatgttaggctatacggccatccaacaaaaagaaaaagtatgggctctgaccagacagatcttacactctgcctgcc

SEQ ID NO: 64725 - DNA, 201 bp, Homo sapiens
gggaactcagaggaactggggccaccaaggttggaaaagggtttggttcttgactttgtattccttccaatacagcaataaactttgtctccctttttattcattcattcattcattcattcattcattcatcatttgtggaaggctcacttggatttttgtagagttgtgtctgcagaggcaagactttgtggtaggatg

SEQ ID NO: 64726 - DNA, 201 bp, Homo sapiens
ggaactcagaggaactggggccaccaaggttggaaaagggtttggttcttgactttgtattccttccaatacagcaataaactttgtctccctttttattcattcattcattcattcattcattcattcatcatttgtggaaggctcacttggatttttgtagagttgtgtctgcagaggcaagactttgtggtaggatgg

SEQ ID NO: 64727 - DNA, 201 bp, Homo sapiens
ctggggagacatctgtgtaagaaaagtggggaacattagtctcaggggggctgaggaccaaaaaatccagggtccctaagagagagagatggggtatttctttttttttttttttttaacacttcaacagtgtgtataagacatctttttttttttttttgagatggagcctcgctgtgtcgctcaggctggagtgcagtg

SEQ ID NO: 64728 - DNA, 201 bp, Homo sapiens
tggggagacatctgtgtaagaaaagtggggaacattagtctcaggggggctgaggaccaaaaaatccagggtccctaagagagagagatggggtatttctttttttttttttttttaacacttcaacagtgtgtataagacatctttttttttttttttgagatggagcctcgctgtgtcgctcaggctggagtgcagtgg

SEQ ID NO: 64729 - DNA, 201 bp, Homo sapiens
ctgtgtaagaaaagtggggaacattagtctcaggggggctgaggaccaaaaaatccagggtccctaagagagagagatggggtatttcttttttttttttyttttaacacttcaacagtgtgtataagacatctttttttttttttttgagatggagcctcgctgtgtcgctcaggctggagtgcagtggcgcgatctcag

SEQ ID NO: 64730 - DNA, 201 bp, Homo sapiens
gagccaccgcgcccggcataagacatctttttatgtcaataaatatagatctattttgtcacttttatttatttatttgtttttatttatttatttatttwttagacggactctcgctctgtcgcccaggctggagtgcagtggcatgatctctgctcactgcaacctccacctcctgggttcaagcgattctcctccctc

SEQ ID NO: 64731 - DNA, 201 bp, Homo sapiens
caccatgctcagctaatttttgtatttttagtagagacgaggtttcaccatattggccaggctggtcttgaactcctgaccttatgatctgcccatctcarcctcccaaagtgctgggattacagacgtaagtgaccgtgcccagccagcatgctcttaaataagattgatgtcaccccttctgacctcagatcccatatt

SEQ ID NO: 64732 - DNA, 201 bp, Homo sapiens
tctcagcagtgcctattctctctttcaatacatatactaatttttttgttgttgaaagtgttgtttttttagttcccaaaagttgtttctttctttttccttttttttctttcttttcttcttcctctttttttttttttttttttttcatactacttgaatctctaagtgctcctaattgtttaagttatcatatatctc

SEQ ID NO: 64733 - DNA, 201 bp, Homo sapiens
tagaaatgggatttcactgtgttggccaggctggtcttgaactcctggactcaagtgatctgcctgcctcagcctctcaaaattctgggattacatgcatragtcaccgcgcccagcccaaaattatacattctttttatggtaaggaaattaacccaatgtcagggaattatctcctagttttatgtttagtcttcctac

SEQ ID NO: 64734 - DNA, 201 bp, Homo sapiens
tgcctcagcctttggagtagctgggaccacaggcgcccgccaccacgcccggctaatttttttttttttttgtattttcagtagagacggggtttcactgkgttagccaggatggtctcgatctcctgacctcgtgatccgcccatctcagcctcccaaagtgctgggattacaggtgtgagccaccgcgcccggcataag

SEQ ID NO: 64735 - DNA, 201 bp, Homo sapiens
caacctctgccttctgggttcaagcgattctcatgcctcagcttcctgaatagctgggactacaggtgcatgtcaccatgtccggctaatttttgtatttwtagtagagacgggttttcaccacattggccaggctggtcttgacctcctgacctcaggtgatccacccacctcagcctcccaaagtgttggaattacagg

SEQ ID NO: 64736 - DNA, 201 bp, Homo sapiens
agggaggtgggagagtgtctgctgtccctgttctgccaggagccagcccttctggaacactgggatagggtgcaggcagagggagcagtggggaggagccrgaacccagatgcttgcttacctcctttcccccactctgaccccaccttctccaggactggtggaactcaacgtccttctccaactactaccgcacttgga

SEQ ID NO: 64737 - DNA, 201 bp, Homo sapiens
tcacagggtaccagaagggagaggttcccactgcagtgccccagaagtaaccacatctcaggcctgggaggggtgggttgagtcatagcaaggtcacagcmgggacacacattccttttgggtccctgttggcccccctcctacatccgttgctcttctgccccagctctccggcttcgtgcgcccccttctggcctctgg

SEQ ID NO: 64738 - DNA, 201 bp, Homo sapiens
tctttcttttcttcttcctctttttttttttttttttttttcatactacttgaatctctaagtgctcctaattgtttaagttatcatatatctctttcagkggctactgtgctttctggtgggcagggaaacaagctatcataactgcatccctgcagggccaaggctctctgagtcacattcttccagtgttcccatggt

SEQ ID NO: 64739 - DNA, 201 bp, Homo sapiens
tgcctctgacagatggcacctctgttacccaggacttctggcactttcctatttcctatttccaggcccagcctgtcacccaggctttgttattccatttrtagagcacaggcagagtatatttagcatcattcttaagggccctaaaatttttggaatgacaagttggcactggctccaacttaaagtcaccagctgcat

SEQ ID NO: 64740 - DNA, 201 bp, Homo sapiens
tcctatttcctatttccaggcccagcctgtcacccaggctttgttattccatttatagagcacaggcagagtatatttagcatcattcttaagggccctaraatttttggaatgacaagttggcactggctccaacttaaagtcaccagctgcattagcccttaacaagagcccttaaagtcaccagctgcaggctgagca

SEQ ID NO: 64741 - DNA, 201 bp, Homo sapiens
acacacacagaatttgtcagttaagtttgctctcttatttgggtgtatttcatgatgccctaaaacaattacaattgtaacattaaaaatcactggtcacrgtgatttttgccgaggtgagaagttggggtagaagggtggacctgtgactcatggtggtggagaggggacgtttctgggaggcctggggaggcagtggga

SEQ ID NO: 64742 - DNA, 201 bp, Homo sapiens
aggctatacggccatccaacaaaaagaaaaagtatgggctctgaccagacagatcttacactctgcctgcctctcagaggtaacccagagcacagagaggktaagcgatttgcttaaagccacacagcaacttttcctccccttccattctgccacaggttaggttcctgatgaaaagctactccttcctgagagaggctg

SEQ ID NO: 64743 - DNA, 201 bp, Homo sapiens
caggcacctctaccacgccctcccagcccaattctgcgggtgtccaagacactgagatggtgcgtttggagctggtagggagcaggaggggtgggaagccytggagacttccatctgagactgctcccttgggcttggagacgtctccattgtctgtcctgggtgcttgcctggtgggccagaaggttggaatggggagct

SEQ ID NO: 64744 - DNA, 201 bp, Homo sapiens
atacatatactaatttttttgttgttgaaagtgttgtttttttagttcccaaaagttgtttctttctttttccttttttttctttcttttcttcttcctctttttttttttttttttttttcatactacttgaatctctaagtgctcctaattgtttaagttatcatatatctctttcagtggctactgtgctttctggtg

SEQ ID NO: 64745 - DNA, 201 bp, Homo sapiens
caaaaaaaaaaaaaaaaaaaaaaaaaagagagggaacccccgaggagacgctcaggtgtttttacatcctcagactcagatgtcccctctcattctcctgstggaagcctctggcctcactcctgacctgtgtgcctctctctccagtgccgctcctcccaggggcagcgccgaggtccctgctggtgtgtggatcggatg

SEQ ID NO: 64746 - DNA, 201 bp, Homo sapiens
tacatatactaatttttttgttgttgaaagtgttgtttttttagttcccaaaagttgtttctttctttttccttttttttctttcttttcttcttcctctttttttttttttttttttttcatactacttgaatctctaagtgctcctaattgtttaagttatcatatatctctttcagtggctactgtgctttctggtgg

SEQ ID NO: 64747 - DNA, 201 bp, Homo sapiens
agctgtgccctggggaaggctaatcagggaaggccttgctagttaccttccctcagtttcaacacgttctccttctgagtctctcctcacatctgtccccycctatcagggccattgccatggtctcagttcagaccatctgctccccctccacatcagcctcctaacccatctccctggcacccagatctttcctttccc

SEQ ID NO: 64748 - DNA, 201 bp, Homo sapiens
cctgctggaagcctctggcctcactcctgacctgtgtgcctctctctccagtgccgctcctcccaggggcagcgccgaggtccctgctggtgtgtggatcdgatgggcaagtccctgccagggtctccagatggcaatggaagctcctcctgccccactgggagtagcggctaaagctgggggatagaggggctgcagggc

SEQ ID NO: 64749 - DNA, 201 bp, Homo sapiens
acatatactaatttttttgttgttgaaagtgttgtttttttagttcccaaaagttgtttctttctttttccttttttttctttcttttcttcttcctctttttttttttttttttttttcatactacttgaatctctaagtgctcctaattgtttaagttatcatatatctctttcagtggctactgtgctttctggtggg

SEQ ID NO: 64750 - DNA, 201 bp, Homo sapiens
cctgtgggtccatgtgggccagcctgacctgcagcctcttgtccccaaccaccaggcatcttcatgctgctgctcatcttctttgccttcctccattgctrgctcaacgcctttgccgagatgctacgatttggagacaggatgttctaccgggtggggcctggacctaggccagttggaagctggagatagggagggtta

SEQ ID NO: 64751 - DNA, 201 bp, Homo sapiens
ttctttagcatacaccgaaccaagccctctttcttctcctcctttttttcctttttcttcttcaaaattattctttcttttctttcttactttttttttctttttttttttgagacaaaatcttgctctgtcatccaggctggagtataggagtgcgatctcagctcactgcaacctcccgctcaagagattctcatgcct

SEQ ID NO: 64752 - DNA, 201 bp, Homo sapiens
cctttcccccactctgaccccaccttctccaggactggtggaactcaacgtccttctccaactactaccgcacttggaacgtggtggtccatgactggctstacagctacgtgtatcaggatgggctgcgggtatgggccctgcagaccccttcagctctcacagttaataggggctctccttccttccctctccttccct

SEQ ID NO: 64753 - DNA, 201 bp, Homo sapiens
ccgttctacaacacaggcttcaaatgggcatttcagcaaagtccaatgaccttaatcttaatctgcatgcaggatttccttttttttctttctttcttccttttttttttttgacagagtcttgctctgtctcccaggctggagtgcagtggtgcaatcttgactcactgcaacctctgccttctgggttcaagcgattct

SEQ ID NO: 64754 - DNA, 201 bp, Homo sapiens
gagaaatgaggggggcagaccccactcctgtctgtgaggcactcccagtcttgtggggaagacagacatgtaaccaagtgcctgggtgggtcatttccccsacagagcaccccatccaactgtgaggatgagcctcagagagctgtatacccctgggggtctgtattttcatacctcccactattcccagaccaaactgag

SEQ ID NO: 64755 - DNA, 201 bp, Homo sapiens
gcctgggtgggtcatttcccccacagagcaccccatccaactgtgaggatgagcctcagagagctgtatacccctgggggtctgtattttcatacctcccmctattcccagaccaaactgagggttggggctgctatttctcatggcccaataacgagatgcagatgaactggggaggaagtgagtttttatttctgtaac

SEQ ID NO: 64756 - DNA, 201 bp, Homo sapiens
agacataagtgattaacttcttttaatctataactaaggtctgagtcttgaagaccttcttctggagcctcagtaagtttacttaatctaaatgggtccargtgctggggtgattacccttctcttatctcctgctaaataacggaggtttggggagtttcttcagacccccagcaaaacttgtttaatcatgctttgagg

SEQ ID NO: 64757 - DNA, 201 bp, Homo sapiens
taaccactcagtcagtactgaaacagttgttatggaggtctgcattagtgagacctgcttgtcacagtccccactgtcaatttacacgatttttatcatgyatggatatttatttatcatgagaatcgcagggagatggggagtcgtaatctttctggctacttcctgctgagagggggtcgtcgttatggggcaccaaaa

SEQ ID NO: 64758 - DNA, 201 bp, Homo sapiens
ccgcaagtccctgcttgagtaagtcggggtgatgacaagtaatgggaggaaaagaaagggctttggctaggggtcaaggtacctcatttctcatccccagsctctaggtggtttgtggagaggacttggaaagggtttctaaggtgcaggtcccctatttgccctaggcatggttgtggaagaaaggcctttagctggaag

SEQ ID NO: 64759 - DNA, 201 bp, Homo sapiens
tcttcttcctctttttttttttttttttttttcatactacttgaatctctaagtgctcctaattgtttaagttatcatatatctctttcagtggctactgkgctttctggtgggcagggaaacaagctatcataactgcatccctgcagggccaaggctctctgagtcacattcttccagtgttcccatggtcctgatctc

SEQ ID NO: 64760 - DNA, 201 bp, Homo sapiens
ggagctcagggagacttactcttcactcctttcctcaccctgccagctccttggtgcccgggcccgaggggtagccatgctgggtgtgttcctggtctccdcagtggcccatgagtatatcttctgcttcgtcctggggttcttctatcccgtcatgctgatactcttccttgtcattggaggtgagctggtctctgtgcc

SEQ ID NO: 64761 - DNA, 201 bp, Homo sapiens
ggggctctccttccttccctctccttccctcctgctacagtgtggcaactacaccactcacctaagggcctaagggccgttttgatttcatctgtcctcaytttctcattttacccaacccaatgggtagaaagtccttgcaatcttaactttcttccatctttatccttaattccaccctgtccacagggcattgtttcc

SEQ ID NO: 64762 - DNA, 201 bp, Homo sapiens
ccatgctgggtgtgttcctggtctccgcagtggcccatgagtatatcttctgcttcgtcctggggttcttctatcccgtcatgctgatactcttccttgtyattggaggtgagctggtctctgtgccactggaagggagccatccagagggaggcctgcatcctgctcctgcagatcccagactgatggtgggaggcctcg

SEQ ID NO: 64763 - DNA, 201 bp, Homo sapiens
actgcgaaggaaggaggcaacacgggcaagggctgcctgctgcccgctggagaccgcaccatggagccaggcggggcccgtctgcgtctgcagaggacagragggctgggaggggagcgggagcgccaaccctgtggagatggtgagccgccctcgggggtgcagaaggcacaggcaagtgggggggaggcggggagagat

SEQ ID NO: 64764 - DNA, 201 bp, Homo sapiens
tgtttttttttttaaaaaaagcactgtgcctggcatagacagaaattcagtgaatgtctggtgaatgaaaggatggctgactggagggacagtgggctctrccctggctttgtcccgtaggctgtgaaggcacaattgctggagcaagcgcagggacaactgagggagctgctggatcgggccatgcgggaggctatacaa

SEQ ID NO: 64765 - DNA, 201 bp, Homo sapiens
tgaccctgaacaaacatctcaattcaggacccaggagccatccctggggaaacagaaagttttcatcatccgcaagtccctgcttgagtaagtcggggtgrtgacaagtaatgggaggaaaagaaagggctttggctaggggtcaaggtacctcatttctcatccccagcctctaggtggtttgtggagaggacttggaaa

SEQ ID NO: 64766 - DNA, 201 bp, Homo sapiens
gagggcaggctagggcgtaggttaggggagaggggagaaagagtaggggaaagagggaatctgccaaatcagggttatgatttaaacctgctcagaatcgytcacccatcctaccccaccctgctccagggaggagagcagaagctgagtcactgggtgggtgggacagaagtgaatcagccgtgaaaacatggggggcag

SEQ ID NO: 64767 - DNA, 201 bp, Homo sapiens
cccaggagccatccctggggaaacagaaagttttcatcatccgcaagtccctgcttgagtaagtcggggtgatgacaagtaatgggaggaaaagaaagggmtttggctaggggtcaaggtacctcatttctcatccccagcctctaggtggtttgtggagaggacttggaaagggtttctaaggtgcaggtcccctatttg

SEQ ID NO: 64768 - DNA, 201 bp, Homo sapiens
aggcagtttggaactaaatggttgggtgctaaatgtagggaatgaaggagaaggtctggggaggggtgggcatcctgaggaagaaggatcagactcaggaytgcaggggaaatgtctcctgggttgtgagtggtagttagctgggagcttgtctttaggcacagaggaagaggatcccttcaggggttctgatatctgatt

SEQ ID NO: 64769 - DNA, 201 bp, Homo sapiens; identical to SEQ ID NO: 13117

SEQ ID NO: 64770 - DNA, 201 bp, Homo sapiens
cagcatatgttaggctatacggccatccaacaaaaagaaaaagtatgggctctgaccagacagatcttacactctgcctgcctctcagaggtaacccagarcacagagaggttaagcgatttgcttaaagccacacagcaacttttcctccccttccattctgccacaggttaggttcctgatgaaaagctactccttcct

SEQ ID NO: 64771 - DNA, 201 bp, Homo sapiens
actgtcttgataatcctacccatcctacacacccttgttgacatccatgcttaaaacccacttgttatctctgttatggaaagttcagagtatcctagacyccaccaccctagataatcctcccaggcctaagcaattaagggaactgaggagagagggccccagaacccgtgcccaggctgaacagagaacaacatgaaa

SEQ ID NO: 64772 - DNA, 201 bp, Homo sapiens
aaccactcagtcagtactgaaacagttgttatggaggtctgcattagtgagacctgcttgtcacagtccccactgtcaatttacacgatttttatcatgcrtggatatttatttatcatgagaatcgcagggagatggggagtcgtaatctttctggctacttcctgctgagagggggtcgtcgttatggggcaccaaaag

SEQ ID NO: 64773 - DNA, 201 bp, Homo sapiens
tattaatagctcaaaagaaaagtttccttgactctgcaaagcaaaacaaaggactagcaacattttaagcaaaaagtgaaaaagatcacttcaatctcctwttagttcagtacatgcagttaattcctgtcctgcttcatattaatgaatattttaactcttcaagagccctaaatgtttttcctccattgtgatgtcaca

SEQ ID NO: 64774 - DNA, 201 bp, Homo sapiens
cctctcatgctctgccatgcggagctcctcttccataacacacactccaccgttctacaacacaggcttcaaatgggcatttcagcaaagtccaatgaccytaatcttaatctgcatgcaggatttccttttttttctttctttcttccttttttttttttgacagagtcttgctctgtctcccaggctggagtgcagtgg

SEQ ID NO: 64775 - DNA, 201 bp, Homo sapiens
ctttggacacccttttattattagctttgtgcccacacagccctcccttcaggatcctcaggggtcagagggctgtggttcgggaagtacctagggtggcrgtaggtggtgaggctgctgcccggcaggactttcctcccctgctgagagccacctttcttcctgtctacagtctgcgagtgttgtcccctgtgtgtcccc

SEQ ID NO: 64776 - DNA, 201 bp, Homo sapiens
tatttatacaaatatagcccaaagaaagtcaaaccccattttatatttggcaatgcttcctgtatgatttttggtaccaaataagccaaatttcacctttwtattagtgtactattaatgttaaacccaattatttatttatttatttattttcttttttgagacagagtctcactccgtcacccaggctggagtacagtg

SEQ ID NO: 64777 - DNA, 201 bp, Homo sapiens
tgtgtcaatcacacaccttgtggtgaaagcgagctgaacgcactgatacatgaagacatttctgactcctccctgaccttcagcctgctgggagagagacyggaaggccagccatgctaggtgacaagcttctgagaggcaaagttcccctccccaagatgtacccagccactattcctgtgtgtgtgtggcggggtggat

SEQ ID NO: 64778 - DNA, 201 bp, Homo sapiens
agcgatccacccaccttgacattcccaaagtgctgggatcataggtgtgagccactgcacctggccttaaacctaagtcttaataaaaccttatacacatggtttacccaattttaatgtttgaccataaggtaagatttgtatagactttttcgaaccctttacaatttttgttaaagagcaggttagtgctctaagaga

SEQ ID NO: 64779 - DNA, 201 bp, Homo sapiens
gtaagtcggggtgatgacaagtaatgggaggaaaagaaagggctttggctaggggtcaaggtacctcatttctcatccccagcctctaggtggtttgtggrgaggacttggaaagggtttctaaggtgcaggtcccctatttgccctaggcatggttgtggaagaaaggcctttagctggaagttctggatcgctaggccc

SEQ ID NO: 64780 - DNA, 201 bp, Homo sapiens
ggaaaagaaagggctttggctaggggtcaaggtacctcatttctcatccccagcctctaggtggtttgtggagaggacttggaaagggtttctaaggtgcrggtcccctatttgccctaggcatggttgtggaagaaaggcctttagctggaagttctggatcgctaggccccatgcctcatgtgtacagtgtctgagcta

SEQ ID NO: 64781 - DNA, 201 bp, Homo sapiens
cactggaaggaacatggagctgtcatcactcaacaaaaaaccgaggccctcaatccaccttcaggccccgccccatgggcccctcaccgctggttggaaaragtgttggtgttggctggggtgtcaataaagctgtgcttggggtcgctggcttgtgtctctgtgtctgcctctcacaattctggaatccctggccctctc

SEQ ID NO: 64782 - DNA, 201 bp, Homo sapiens
ggcccggcaagcctttccgccctggcccttgacgcttccgactttggggggcacatttgtgtgggggagaaggggcaagtgcaggaagctgaggtgcagcsaggggacctggtgatacagcagaaggtgtctgcgctctcggccttcttttttgctccatttattttcccttgatggagtgtgcgtgcaggtgggaacttg

SEQ ID NO: 64783 - DNA, 201 bp, Homo sapiens
cctggtgatacagcagaaggtgtctgcgctctcggccttcttttttgctccatttattttcccttgatggagtgtgcgtgcaggtgggaacttgggggagkcagggggagaaatgggagggttttagggccatcccatgggctccagcaggcccagctcctacaaccctagacggccaagctggggaaaggacccaaatgt

SEQ ID NO: 64784 - DNA, 201 bp, Homo sapiens
ctgggagtagcggctaaagctgggggatagaggggctgcagggccactggaaggaacatggagctgtcatcactcaacaaaaaaccgaggccctcaatccmccttcaggccccgccccatgggcccctcaccgctggttggaaagagtgttggtgttggctggggtgtcaataaagctgtgcttggggtcgctggcttgtg

SEQ ID NO: 64785 - DNA, 201 bp, Homo sapiens
ccatcccatgggctccagcaggcccagctcctacaaccctagacggccaagctggggaaaggacccaaatgttgttctcagcttccacttggagaaaaggrgaggggaaccccagactctgaaattctgcacacactgagaaatgactcctttcctcctaataccggtgttcgaagcacctaaacaggaggcgtctagaac

SEQ ID NO: 64786 - DNA, 201 bp, Homo sapiens
atgggcaagtccctgccagggtctccagatggcaatggaagctcctcctgccccactgggagtagcggctaaagctgggggatagaggggctgcagggccmctggaaggaacatggagctgtcatcactcaacaaaaaaccgaggccctcaatccaccttcaggccccgccccatgggcccctcaccgctggttggaaaga

SEQ ID NO: 64787 - DNA, 201 bp, Homo sapiens
ccgaagaggccccaaatccagggttgtattagacttgagtagggactgagggcaggctagggcgtaggttaggggagaggggagaaagagtaggggaaagrgggaatctgccaaatcagggttatgatttaaacctgctcagaatcgttcacccatcctaccccaccctgctccagggaggagagcagaagctgagtcact

SEQ ID NO: 64788 - DNA, 201 bp, Homo sapiens
ctcctcccaggggcagcgccgaggtccctgctggtgtgtggatcggatgggcaagtccctgccagggtctccagatggcaatggaagctcctcctgccccmctgggagtagcggctaaagctgggggatagaggggctgcagggccactggaaggaacatggagctgtcatcactcaacaaaaaaccgaggccctcaatcc

SEQ ID NO: 64789 - DNA, 201 bp, Homo sapiens
cttaatctgccctcagcctatcttggttaagggttgaatccatgtgctcctgggaccactggggttgagctggcctgggtcacagggtaccagaagggagrggttcccactgcagtgccccagaagtaaccacatctcaggcctgggaggggtgggttgagtcatagcaaggtcacagcagggacacacattccttttggg

SEQ ID NO: 64790 - DNA, 201 bp, Homo sapiens
taaccacatctcaggcctgggaggggtgggttgagtcatagcaaggtcacagcagggacacacattccttttgggtccctgttggcccccctcctacatcygttgctcttctgccccagctctccggcttcgtgcgcccccttctggcctctggtggaacagccaggtcttttcacccaaagcccaaagccccaaatagtc

SEQ ID NO: 64791 - DNA, 201 bp, Homo sapiens
tctcattatgttgcccaggctggtctcaaactcctgggctcgagcaatcctcccacctctgcttctcaaagttctgggattacaggcgtgagccattgcayccatcctcattttccatttttgctttccaaaattcatctcctttataagccttaaaaatcagtatgggaaatactggggaatattgtcaggaaaagtaat

SEQ ID NO: 64792 - DNA, 201 bp, Homo sapiens
tccacatggctctgcctgatttctgacctctccttctcctattcctcctccagttgcagaggagaatcctaaggagagtaaaccccaagcaggcactgccsgcccacaggatgtgaaccgcagagaccaacagaggaatccaggcacctctaccacgccctcccagcccaattctgcgggtgtccaagacactgagatggt

SEQ ID NO: 64793 - DNA, 201 bp, Homo sapiens
tcatgcctctgcctcccgagtagctggcgttacaggtgtgccccactgcacctggctaattttttctatttttaatagaaatgggatttcactgtgttggmcaggctggtcttgaactcctggactcaagtgatctgcctgcctcagcctctcaaaattctgggattacatgcatgagtcaccgcgcccagcccaaaatta

SEQ ID NO: 64794 - DNA, 201 bp, Homo sapiens
gtaaaccccaagcaggcactgcccgcccacaggatgtgaaccgcagagaccaacagaggaatccaggcacctctaccacgccctcccagcccaattctgcrggtgtccaagacactgagatggtgcgtttggagctggtagggagcaggaggggtgggaagccctggagacttccatctgagactgctcccttgggcttgg

SEQ ID NO: 64795 - DNA, 201 bp, Homo sapiens
gtgcattagaactaccttcggggtttgttaatacagagtttctgattcattaagtctggggtcaagcctgagaatgtgcatttctaacaagtttccagggsaagcccttgctgctgatctagggaccacttctttagcatacaccgaaccaagccctctttcttctcctcctttttttcctttttcttcttcaaaattatt

SEQ ID NO: 64796 - DNA, 201 bp, Homo sapiens
ttcagtggctactgtgctttctggtgggcagggaaacaagctatcataactgcatccctgcagggccaaggctctctgagtcacattcttccagtgttccyatggtcctgatctctctgctctgggtgcttcaaagctggtctctatgcagtgagagtgaggaagctcctcaccaggtctccacaccaggacttcccccct

SEQ ID NO: 64797 - DNA, 201 bp, Homo sapiens
agctgggtatgagattcctgtgtaaggctggatgcagtgactcacacctgtaatcccagcactttgggaggccaaggtgggtggattacttgatgtcaggrgttcgagaccaacctggccaacatggtgaaaccccatctctactaaaaatacaaaaattagccaggtgtcatggcaggtgcctgtagtcccagctacttg

SEQ ID NO: 64798 - DNA, 201 bp, Homo sapiens
tattaatgtttcattcattaaaaatgacatgagcaaagatcattctgttttgggctgagttatagttttgtagcctctatgccaaattttgacaccttatrgtatttggcagagataagtatgaaattgcttgatcaataaatgcaaacaaaaatgtatgctggcaactcttaagacatttctagtattactttaccaata

SEQ ID NO: 64799 - DNA, 201 bp, Homo sapiens
gatttctctgttctgtaccaaaccattctttcaggtgaggtatgagattgatatactctctgaatcctttggatctccaaatatatatcttttgccctgayaggtgaaagttctctcagctgggtatgagattcctgtgtaaggctggatgcagtgactcacacctgtaatcccagcactttgggaggccaaggtgggtgg

SEQ ID NO: 64800 - DNA, 201 bp, Homo sapiens
cctctatgccaaattttgacaccttatagtatttggcagagataagtatgaaattgcttgatcaataaatgcaaacaaaaatgtatgctggcaactcttamgacatttctagtattactttaccaataatttttaaagctagcttatgtattaaagattttatttaagtcacataaacttgaaaaagcatttgactagtct

SEQ ID NO: 64801 - DNA, 201 bp, Homo sapiens
tcctgggttcaagcgattctcctccctcagactcccgagtagctgggactacaggcgcctgctaccacgcccagctaatttttgtatttttagtagagacrgggtttcaccatgttggtcaggctggtctcaaactcctgacctcatgatccacccgcctcggcctcccaaagtgctgggattacaggcatgagccatcac

SEQ ID NO: 64802 - DNA, 201 bp, Homo sapiens
cactgcaacctccacctcctgggttcaagcgattctcctccctcagactcccgagtagctgggactacaggcgcctgctaccacgcccagctaatttttgkatttttagtagagacggggtttcaccatgttggtcaggctggtctcaaactcctgacctcatgatccacccgcctcggcctcccaaagtgctgggattac

SEQ ID NO: 64803 - DNA, 201 bp, Homo sapiens
taaggtagggctagagcagctgtgccctggggaaggctaatcagggaaggccttgctagttaccttccctcagtttcaacacgttctccttctgagtctcycctcacatctgtcccctcctatcagggccattgccatggtctcagttcagaccatctgctccccctccacatcagcctcctaacccatctccctggcacc

SEQ ID NO: 64804 - DNA, 201 bp, Homo sapiens
aaacagttgttatggaggcctgtattagtgaaacctggcctgccacatcccctctccctatgttgggcttgggaagcaatgaaaaaaacagctccaaggawccacaggctcagcaacagcactgccttttggtaaaatttttgttgttagttatacaagtattaaaaggacaaaatctactgctaggtttgcataagaaaa

SEQ ID NO: 64805 - DNA, 201 bp, Homo sapiens
cctagcccgcatccaggtcctacgtccagctccttgcttatcccccacccccaccctatccatttctccactcaccaatcccaccacccttccccagcagscccctcacctctgccctctgcccttgcccttactaatccacccctctcattcctccccaggtgaggggatccaggcccccagtttctccagctacctcta

SEQ ID NO: 64806 - DNA, 201 bp, Homo sapiens
ctcatccccagcctctaggtggtttgtggagaggacttggaaagggtttctaaggtgcaggtcccctatttgccctaggcatggttgtggaagaaaggcckttagctggaagttctggatcgctaggccccatgcctcatgtgtacagtgtctgagctagttcacacaaccctgaggaccctcccacactgactttcgggc

SEQ ID NO: 64807 - DNA, 201 bp, Homo sapiens
caggaggcggagcttgcagtgagctgagatcgtgccactgcactccagactgggagagagagactccgtctcaaaaaaataataataataaaaaaaattakctgggagtggtggctcatgtctgtagttccagttacttgggaggctgaggtgggaggatcacttgagtccaggagtttgaggctgcagcgagctatgatc

SEQ ID NO: 64808 - DNA, 201 bp, Homo sapiens
ttatatcctcattttaaaatggcacctaagtcccaatgggatagtagcatgctttttttttttttttttttttttttttttttgagatggagtccagcctwgttgcccaggctggagtagagtggcacgatcttggctcacctgcaacctctgcctcctgggttcaagcgattcttctgcctcagccttttgagtagctgg

SEQ ID NO: 64809 - DNA, 201 bp, Homo sapiens; identical to SEQ ID NO: 13121

SEQ ID NO: 64810 - DNA, 201 bp, Homo sapiens
aaccaaaataataggaaactcaaagttgtctgagatccgtgaaaaaataagccactttttaaaaaaacatgcctttttttttctgtaacaccttttttaartcagatgttttctcatttatatggactctaaataaaatgaagatctctttttaaaaggataattttttagaagttttatggaaaaaaattttttttttag

SEQ ID NO: 64811 - DNA, 201 bp, Homo sapiens
aagttgtctgagatccgtgaaaaaataagccactttttaaaaaaacatgcctttttttttctgtaacaccttttttaaatcagatgttttctcatttatayggactctaaataaaatgaagatctctttttaaaaggataattttttagaagttttatggaaaaaaattttttttttagacaggtctggctctgtcactca

SEQ ID NO: 64812 - DNA, 201 bp, Homo sapiens
ctccacctctctggctcaagctagcctcccaactcagcctcccaagtggctgggactacaggcatgagccaccatgcccagctgattttggtatttttcayagagtcggggtcttgccatgttgcccaggctggtttcaaactcctgagctcaagtgatccgcaaaccttggcctcccaaagtgctgggattacgagtgtg

SEQ ID NO: 64813 - DNA, 201 bp, Homo sapiens
ccctgaggaccgttgccaatgcctccctcaccacgtgtgccatgtgctcttgaggacatcctgtcattggcttcccacaccatcattacatctggaacaarggacgcataaaaagtgagtggcccagcgtggctcagctggtaagtgaagggcatgggcttggacccaggacttccagctgctgcagcatgtgtcctgctc

SEQ ID NO: 64814 - DNA, 201 bp, Homo sapiens
ctagcctcccaactcagcctcccaagtggctgggactacaggcatgagccaccatgcccagctgattttggtatttttcacagagtcggggtcttgccatkttgcccaggctggtttcaaactcctgagctcaagtgatccgcaaaccttggcctcccaaagtgctgggattacgagtgtgggccactgtgctggcttatt

SEQ ID NO: 64815 - DNA, 201 bp, Homo sapiens
gccactgtgctggcttattatgtaaattctcaaaaatatattaaagtagggaggatagtataatgaaccttcttttactcattgctcaacttcagcagttrtcaaaccaccagtataccctccccatctaccctcaaaccagattatttagaagcaaatcctagtcattttatcatgctaaacagaaatgcttagcatgta

SEQ ID NO: 64816 - DNA, 201 bp, Homo sapiens
agccaagcaaaagtcctagaggctgctggtggcggaatctttaacctggagctttaggaaagaaataggccttggagcttcccctttgtgcagtttcatgstgccctctgtatctcttctcataacctcaatttatcattttttttttctttttttgagatggagtcttgctctgtcacccaagctggagtgcaatggcat

SEQ ID NO: 64817 - DNA, 201 bp, Homo sapiens
aaaagtcctagaggctgctggtggcggaatctttaacctggagctttaggaaagaaataggccttggagcttcccctttgtgcagtttcatgctgccctckgtatctcttctcataacctcaatttatcattttttttttctttttttgagatggagtcttgctctgtcacccaagctggagtgcaatggcatgatctctg

SEQ ID NO: 64818 - DNA, 201 bp, Homo sapiens
aagaaaagaaagaaagaaaaaaaattagtcaaatgcgtttgcttgaacccaggaggtggaggtacaccctgggcgacagagagagagaggtaaaaaacaayaacaacaccatgacccagagaaagaaagaaaaaaaatgaagttcccaaatggaaaaagcccctaaaattaccattttaaaacacagccctaatcagctct

SEQ ID NO: 64819 - DNA, 201 bp, Homo sapiens
atgtactaggcatctgagaaatgttggcaagtagtaataataaagacaatggtattggttggctattgctggacttaattaatgcttttgaaaaagacaaygaaaggctaaggacaattaattaaaagctaaatgtgaaaaccattgggcctccttggcagcatattaagaaactctcttctgtaatagaaggaattaaaa

SEQ ID NO: 64820 - DNA, 201 bp, Homo sapiens
tgagtttaagaagaaactgtttgctgggcacggtggctcacgcctgtaatcccagcactttgggaggctgaggcaggcggatggcctgaggttgggagttygaggccagcctggccaacatggtgacacgtcgtctctactaaaaatacaaaattagtccagcgcagtggtgtacgcctgtaatcccagctactcaggagg

SEQ ID NO: 64821 - DNA, 201 bp, Homo sapiens
tggggggctgaggcaggtggatcacctgaggtcaggagtttgagatcagcctggccaacatggcgaaacactgtctctactaaaaatacaaaaattagccmggtgtggtgacaggcatctataatcccagctactccggaggctgaagcaggagaattgcttgaacctaggaggttcaaacctgggaggttgcagtgagct

SEQ ID NO: 64822 - DNA, 201 bp, Homo sapiens
ggaggttgcagtgagctgagatcgcgccactgctctccagcctgggtgacagagtgagactccatctcaaaaaaaaaaaaaaaaaaaaaaaaaagaagaargaagaagaagaagaaactgttcatctgaaatccgacaactcattcttgaaggttagagctcagctttgaagtttcacttcacgagcttggctcagtgagg

SEQ ID NO: 64823 - DNA, 201 bp, Homo sapiens
acctgggaggtggagtttgcaatgagccgagatcacgccactgcactccagcctgggtgacagagcgagactctgtctcaaaaaaaaaaaaaaaaaaaaamaaaaaaaaaacagcaatcaaaaaacaaaaaaactagtgctttcctgttgaagacaatcaagaggcctctacccttaaagacaacactcactctccttcaa

SEQ ID NO: 64824 - DNA, 201 bp, Homo sapiens
ttctcaccaccaggcctttgtctttgctaaactgaggaaggaagattttatttcattagctaacaaagaacctcctatataggccgggcatggtggctcamgcctgtaatcctcacattttcagaggccaaggtgggtggattgcctgagctcaggagtttgagaccagcttgggcaacatggcaaaaccccatctctact

SEQ ID NO: 64825 - DNA, 201 bp, Homo sapiens
agaatgaatggactatataagccttgcaaacccaccagatgactgtcttgcaggaaggccaaagcaataaagaatagcctggtgagagcaatcagcacctytgagccatctgcagtggctctcctctgaaaggcagggctgatgttgttacataactgggcttattaatagcagtgggaataaagggtaccaaaataatag

SEQ ID NO: 64826 - DNA, 201 bp, Homo sapiens
ataagccttgcaaacccaccagatgactgtcttgcaggaaggccaaagcaataaagaatagcctggtgagagcaatcagcacctctgagccatctgcagtrgctctcctctgaaaggcagggctgatgttgttacataactgggcttattaatagcagtgggaataaagggtaccaaaataatagagaccaggtggtagtg

SEQ ID NO: 64827 - DNA, 201 bp, Homo sapiens
gccttgcaaacccaccagatgactgtcttgcaggaaggccaaagcaataaagaatagcctggtgagagcaatcagcacctctgagccatctgcagtggctytcctctgaaaggcagggctgatgttgttacataactgggcttattaatagcagtgggaataaagggtaccaaaataatagagaccaggtggtagtgctca

SEQ ID NO: 64828 - DNA, 201 bp, Homo sapiens
gcaaacccaccagatgactgtcttgcaggaaggccaaagcaataaagaatagcctggtgagagcaatcagcacctctgagccatctgcagtggctctcctytgaaaggcagggctgatgttgttacataactgggcttattaatagcagtgggaataaagggtaccaaaataatagagaccaggtggtagtgctcaaccat

SEQ ID NO: 64829 - DNA, 201 bp, Homo sapiens
agaggtaaaaaacaacaacaacaccatgacccagagaaagaaagaaaaaaaatgaagttcccaaatggaaaaagcccctaaaattaccattttaaaacacagccctaatcagctctggggatttgcaggaaactcatcgaagctattgataggaactattgttttggtgccagggttttcaattgggagttagatttaaaa

SEQ ID NO: 64830 - DNA, 201 bp, Homo sapiens
atacgttaggtgtatttaatgtgtttttgacttaagatatttttggctgggtgtggtggctcacgcctgtaatctcagcactttgggaggccgaggtaggyggatcacctgaggtcaggagttcgagaccagcctggccaatatgaaaccttgtctctactaaaaatagaaaaactagctgggtgcggtggtgcacacctg

SEQ ID NO: 64831 - DNA, 201 bp, Homo sapiens
caagggccgtccttcaagcctctagagacatacagatttggtgcagtatctatttactggtttttgtttgtttgtttgtttgttttgtttttttggtgcartgcccagttcagagtcaagaccctctcaatgaagagccaagcaaaagtcctagaggctgctggtggcggaatctttaacctggagctttaggaaagaaat

SEQ ID NO: 64832 - DNA, 201 bp, Homo sapiens
gctttagatacctaatagtcatttatttgacaaatgctttcttttatatccctatcaaaaaaagaggataaggctgggcacagtggctcatgcctataatyccagcactttaggaggctgaggtgggagaatcacttgaacccaggagttcgagaccagcctgggaaatatagcgagacctcatctctccattttttaaaa

SEQ ID NO: 64833 - DNA, 201 bp, Homo sapiens
agaggccaggcgcagtggctcatgcctgtaatcctagcattgggaggccaaggtggatggatggcttgagctcaagagttcaagaccaacctgggcaacayggtgaaactctgtctctacaaaaaatacaaaaattagccagttgtagtggcatgcgcctgtagtcccagctactcaggcagatgaggtggaaggttggct

SEQ ID NO: 64834 - DNA, 201 bp, Homo sapiens
ggcacgtgcattaagccgtctgggggagcggtagggatagacatgttgaaatggagagtggttgaatcttgaaaggaagtaaggaaaatgtatatgccacragggcaaggatgtatgataggcttgtatttattgtataactttattttattttattttattatttttagttttttgaaatagagtctctctctgtcaccc

SEQ ID NO: 64835 - DNA, 201 bp, Homo sapiens; identical to SEQ ID NO: 13132

SEQ ID NO: 64836 - DNA, 201 bp, Homo sapiens
tcagactgaaacaacttaaaacctgtaatgactaagacaatgaaaatgataggcttgtaagaaaaatacaatttgttattctttggcaaataaggaatcakgtctaaataagacggaggtcatggcttgatagagagatggctgaacctatagtagaaaaacactaggttccgccaaatggtaagggaaatgttgagtcac

SEQ ID NO: 64837 - DNA, 201 bp, Homo sapiens; identical to SEQ ID NO: 13135

SEQ ID NO: 64838 - DNA, 201 bp, Homo sapiens
gactgaaacaacttaaaacctgtaatgactaagacaatgaaaatgataggcttgtaagaaaaatacaatttgttattctttggcaaataaggaatcatgtstaaataagacggaggtcatggcttgatagagagatggctgaacctatagtagaaaaacactaggttccgccaaatggtaagggaaatgttgagtcacaat

SEQ ID NO: 64839 - DNA, 201 bp, Homo sapiens
atagaaagagacaagggagaaactgacaaactagggtgtttccgaaaaaaggctctcagtatcgggctcaagggcttgtgcccacatctgagcatgcaggraaatagatgtcccccactggctgcacatgtgagtgactgcggcacaaggctgtgatgtgaagagtcatgacaccatttcctcacacctccacgcaatgcc

SEQ ID NO: 64840 - DNA, 201 bp, Homo sapiens
ccgaaaaaaggctctcagtatcgggctcaagggcttgtgcccacatctgagcatgcagggaaatagatgtcccccactggctgcacatgtgagtgactgcrgcacaaggctgtgatgtgaagagtcatgacaccatttcctcacacctccacgcaatgccagatatgattcgacaacattcttcctgtcttataaaaagtg

SEQ ID NO: 64841 - DNA, 201 bp, Homo sapiens
tgtgaagagtcatgacaccatttcctcacacctccacgcaatgccagatatgattcgacaacattcttcctgtcttataaaaagtgtttatctagcccgtyggtttggcagatgaaatcaactaggcttttggcttgcttttactgagcatattcaaaaccatttcaggtcactatagtggtttgctcgggttgccataac

SEQ ID NO: 64842 - DNA, 201 bp, Homo sapiens
tctagcccgttggtttggcagatgaaatcaactaggcttttggcttgcttttactgagcatattcaaaaccatttcaggtcactatagtggtttgctcggrttgccataacaaagtaccacggactgagtggcttaaataacagaaatgtatttcctcacagttctggagatgggagtccaagatcaaggtgctggcaggg

SEQ ID NO: 64843 - DNA, 201 bp, Homo sapiens
agaaatgtatttcctcacagttctggagatgggagtccaagatcaaggtgctggcagggtcgatcgcattctgaggcctctctccttggcttatagatggygccttctcccttgtctgcacatggcctttcctccatgcatccgtgtcttaataccatcttcttagagggtcaccaggcattggatcagggccaccctaat

SEQ ID NO: 64844 - DNA, 201 bp, Homo sapiens
ggccaggcgcagtggctcatgcctgtaatcctagcattgggaggccaaggtggatggatggcttgagctcaagagttcaagaccaacctgggcaacatggkgaaactctgtctctacaaaaaatacaaaaattagccagttgtagtggcatgcgcctgtagtcccagctactcaggcagatgaggtggaaggttggcttga

SEQ ID NO: 64845 - DNA, 201 bp, Homo sapiens
gatagaccaggaggaagtaactccggcttagataatgctaccattttgaataaatcaaatggtcttcttttccccttcatggtagttgctgcttaagtttytctaacatgcctgcagtaagtttccattaagaataggaaattaggctcggtacagtggctcacgtctgtagtcttagcactttgggagaccgaggagtgt

SEQ ID NO: 64846 - DNA, 201 bp, Homo sapiens
aacctgggcaacatggtgaaactctgtctctacaaaaaatacaaaaattagccagttgtagtggcatgcgcctgtagtcccagctactcaggcagatgagrtggaaggttggcttgagcctgggaggtagaggttgcagtgacctgagattgcgccactgcactccagcctgggcaacagagccagaccctgtcaaaaaaa

SEQ ID NO: 64847 - DNA, 201 bp, Homo sapiens
tagaccaggaggaagtaactccggcttagataatgctaccattttgaataaatcaaatggtcttcttttccccttcatggtagttgctgcttaagtttctytaacatgcctgcagtaagtttccattaagaataggaaattaggctcggtacagtggctcacgtctgtagtcttagcactttgggagaccgaggagtgtgg

SEQ ID NO: 64848 - DNA, 201 bp, Homo sapiens
gggagcaagccaaaagtggatgtcagctacactacaatgccattcaggagtggacttgaaaagcagctttgaggggaaatcctcccagtgagcaggagcaytgggtggtgctcctggccatccactctgtgtagagagagaagtagcctgaggttggaagatactcatttgcatggactgtggtgactgttttgcccagtt

SEQ ID NO: 64849 - DNA, 201 bp, Homo sapiens
ggatgtcagctacactacaatgccattcaggagtggacttgaaaagcagctttgaggggaaatcctcccagtgagcaggagcactgggtggtgctcctggycatccactctgtgtagagagagaagtagcctgaggttggaagatactcatttgcatggactgtggtgactgttttgcccagttgataaggggtctaaaac

SEQ ID NO: 64850 - DNA, 201 bp, Homo sapiens
aaaatacaaaaattagccaagcatggagaaacctcgtctctatagaaagacacaaaaactagccatgcatgcctgtggtccagctactcgaaaggctgagrtgggaggattgcttgatcctgagaggtcaaggctgaagtgagccatggtgtggcactgcactccagccagggtgacagactaaaaccttgtctcaaaata

SEQ ID NO: 64851 - DNA, 201 bp, Homo sapiens
tgctgatcccaaacccttttgccctcagatcctcctgtccttccctggccctgctctgtattggctgtggggtgggggtggcggtggaactgacccctggsgtctgcatttctcaggctcccagggctgtggctgactttggccaatgggaggcaaggacgggagactgagagcttgggaggaagggagagaggtatgttt

SEQ ID NO: 64852 - DNA, 201 bp, Homo sapiens
ccaaatttagaatctatttagttaaaaccttcttagggcgggtggagtgcagttgctcattcctgtaatctcagcacactgggaggccaaggcaggaggaytgcttgagcccaggtgtttgagaccagcctgggcacatagtgagacccccatctctccaaaaaacaaacaaacaaacaaaaacaaaacaaaactagctgg

SEQ ID NO: 64853 - DNA, 201 bp, Homo sapiens
agaaaagaaaagaaaagaaagaaagaaaaaaaattagtcaaatgcgtttgcttgaacccaggaggtggaggtacaccctgggcgacagagagagagaggtraaaaacaacaacaacaccatgacccagagaaagaaagaaaaaaaatgaagttcccaaatggaaaaagcccctaaaattaccattttaaaacacagcccta

SEQ ID NO: 64854 - DNA, 201 bp, Homo sapiens
ggcttgtatttattgtataactttattttattttattttattatttttagttttttgaaatagagtctctctctgtcacccaggctggagtgcaatggcaygatcttggctcactgcaacctctgcctcccgggttcaagcgattctcctaccccagcctcccgagtagctgggactacaggcactcgccaccacgcccgg

SEQ ID NO: 64855 - DNA, 201 bp, Homo sapiens
agtctctctctgtcacccaggctggagtgcaatggcacgatcttggctcactgcaacctctgcctcccgggttcaagcgattctcctaccccagcctcccragtagctgggactacaggcactcgccaccacgcccggctaattttttgtatttttagtggagacggggtttcacggtgttagccaggatggtctcgatct

SEQ ID NO: 64856 - DNA, 201 bp, Homo sapiens
ccccaagttttagtgcgctgtgacggtgtcattgttattttaacactgggagacgttatattccaattggggtgaatctgactgtgtgtattttcttttcttttttttttttttaaagataaacttggttcttactgaaaactcaattatggttagacatagttcatgtaaaacctctcagattttaaagagaaggccaaa

SEQ ID NO: 64857 - DNA, 201 bp, Homo sapiens
gagaatgttttatgttgaaagtgcttggtgacgaaaaggcagcacctagatcccttatctcataaaaaatgcagcagattcttaatattagcaatctagtrtttagattgttacctgaagaaaggaaaaacaaactgtcccaaatgctgattctactgtttcggtgggaaaaaaaaatgtcttgcaggcaagtggcaaaca

SEQ ID NO: 64858 - DNA, 201 bp, Homo sapiens
atgcagcagattcttaatattagcaatctagtgtttagattgttacctgaagaaaggaaaaacaaactgtcccaaatgctgattctactgtttcggtgggraaaaaaaatgtcttgcaggcaagtggcaaacaacaaaacttttgaaaaagcaggcctggggggagtccagtacagtttcataatgggtatgaatagttat

SEQ ID NO: 64859 - DNA, 201 bp, Homo sapiens
acttaaaacctgtaatgactaagacaatgaaaatgataggcttgtaagaaaaatacaatttgttattctttggcaaataaggaatcatgtctaaataagayggaggtcatggcttgatagagagatggctgaacctatagtagaaaaacactaggttccgccaaatggtaagggaaatgttgagtcacaatgacacacatg

SEQ ID NO: 64860 - DNA, 201 bp, Homo sapiens
atgatcacagtactgcactccagcttgggcagccgactgagaccctgtctcgaaaaaaaaataaaaataaaaacttcttaggacagagtgattagaagctstgtagtagatacttagtaacaatgtgggttcctcgggcaggttatcctacgcagagagccaggtaccaatgggtgcgctgcaatccagacagtaattctg

SEQ ID NO: 64861 - DNA, 201 bp, Homo sapiens
aacctatagtagaaaaacactaggttccgccaaatggtaagggaaatgttgagtcacaatgacacacatgtcctagatttgtttcgtcaaagcgacttttrgttgtcatgatcttacttccggtggagatgaaatcttacagatgatcgcagagacattcattttatgttggaaatttataaaatcattttcttctagtta

SEQ ID NO: 64862 - DNA, 201 bp, Homo sapiens
gatcacagtactgcactccagcttgggcagccgactgagaccctgtctcgaaaaaaaaataaaaataaaaacttcttaggacagagtgattagaagctgtstagtagatacttagtaacaatgtgggttcctcgggcaggttatcctacgcagagagccaggtaccaatgggtgcgctgcaatccagacagtaattctgca

SEQ ID NO: 64863 - DNA, 201 bp, Homo sapiens
aggcaagtggatcacttgaggtcaagagtttgagactagcctggccaacatggtgagaacttgtctctactaaaaatacaaaaattaactgggcatggtgrtgtgcacctgtaattccagctacttgggaggctgaggcaggagaatcacttgaacctgggaggtggaggttgcagtgagctgagattgcaccactgcact

SEQ ID NO: 64864 - DNA, 201 bp, Homo sapiens
cctgcttcagcctctggagcagctgggatttcaggcgcctgccaccatgcccagctaattttttttttttttttttttttgagacggagtctcactctgtygctcaggctggagtgcagtggcgcaatctcggctcactgcaagctccacctcctggattcacgccattctcccgcctcagcctcccgagtagctgggact

SEQ ID NO: 64865 - DNA, 201 bp, Homo sapiens
taatatgctacagttgtatttgtcatgctggtgaaaagatgtggtctttcacctggatgctttctcattaagcattatttttctgtttagcttcctgtgtragcaaacattttctcagcttgatactcagtgcatcagcggcttgcagaagagactgcctaggcctgctctgtccagtacggtagccacaagtcacttgtg

SEQ ID NO: 64866 - DNA, 201 bp, Homo sapiens
atgtggtataagcatacaaaggaatattattgggtcataaaaagaatgaagtactgatacatgctacaacatagataaaccttggaaacattatgcagagygaaggaaggccagacaccaaaagccacatattgtatgattccatttagatgaaatgtccagaataggcaaatccctagaggcagaaagtagattagtggg

SEQ ID NO: 64867 - DNA, 201 bp, Homo sapiens
tttttcccatttttctttcatacttcagaaagacgagaatccaggacttgaatcgtatcttcccactttctgaggactactctggatcaggcttcggctcyggctccggctctggatcaggatctgggagtggcttcctaacggaaatggaacaggattaccaactagtagacgaaagtgatgctttccatgacaacctta

SEQ ID NO: 64868 - DNA, 201 bp, Homo sapiens
gtgggtgctgctgttatatgaatgggcacaaaatctgtctacattttgccttttaccaaatttagaatctatttagttaaaaccttcttagggcgggtggrgtgcagttgctcattcctgtaatctcagcacactgggaggccaaggcaggaggattgcttgagcccaggtgtttgagaccagcctgggcacatagtgaga

SEQ ID NO: 64869 - DNA, 201 bp, Homo sapiens
tcccagctactcgagaggctgaggcaggagaatcacttgaaccagggagatggaggttgcagtgagccaagatcatgccactgcactccagcctgggcgayagactgagactctgtctcaaaaaaaaaaaaaaaaaaaaaaaaaaaaagaaaaagaaaagaaaagaaaaaaaaaagaaattagtatattgtgattatgttg

SEQ ID NO: 64870 - DNA, 201 bp, Homo sapiens
aaaaaattagccgggcatggtggcacgtgcctgtaattccagctagtcgggaggctgaggcaggagaatagcttaaacccaggtggcggagggtgcagtgwgctgagatgtgccacagcactccagcctgggcaacagagccagactctatctcaaaataaggaaaaataaaaaagaaaagaaagaaagtccataaattga

SEQ ID NO: 64871 - DNA, 201 bp, Homo sapiens
ctatgttgcccagcctgtattgaactcctgggctcaagtgatcctcccacctcagtctcccaaagtgctgggatttcaggcatgagctaccacacccaacstaatttttatttttattttattaaaaaaaaaagtttttgcctacccgcctctcaccctctcactcatttttaagtataggtttttctacaatgccacatt

SEQ ID NO: 64872 - DNA, 201 bp, Homo sapiens
ctaccacacccaacctaatttttatttttattttattaaaaaaaaaagtttttgcctacccgcctctcaccctctcactcatttttaagtataggtttttytacaatgccacattgtcttttccataaaaagtactttcggccgggtgtggtggctcacacctgtaatcccagcactttgggagactgaggcgggtggatc

SEQ ID NO: 64873 - DNA, 201 bp, Homo sapiens
agctgggcgttgtggtgcccctgtattcccagctactcaagaggctggggtgggagaatggcttgagcccaggagttcaaggttgcagtgagctatgatcmcagtactgcactccagcttgggcagccgactgagaccctgtctcgaaaaaaaaataaaaataaaaacttcttaggacagagtgattagaagctgtgtagt

SEQ ID NO: 64874 - DNA, 201 bp, Homo sapiens
gattctcctgcttcagcctctggagcagctgggatttcaggcgcctgccaccatgcccagctaattttttttttttttttttttttgagacggagtctcastctgttgctcaggctggagtgcagtggcgcaatctcggctcactgcaagctccacctcctggattcacgccattctcccgcctcagcctcccgagtagct

SEQ ID NO: 64875 - DNA, 201 bp, Homo sapiens
ggaaaacatgcatatcgtagattgacttttagggaaagatgtgggtcctattgggttaatggcggaatcttttggtaagatcatgcccagccctgaggacygttgccaatgcctccctcaccacgtgtgccatgtgctcttgaggacatcctgtcattggcttcccacaccatcattacatctggaacaagggacgcataa

SEQ ID NO: 64876 - DNA, 201 bp, Homo sapiens
attttttttttttttttttttttgagacggagtctcactctgttgctcaggctggagtgcagtggcgcaatctcggctcactgcaagctccacctcctggrttcacgccattctcccgcctcagcctcccgagtagctgggactacaggcacccgccaccacgcccggctaatttttttgtatttttagtagagacggggt

SEQ ID NO: 64877 - DNA, 201 bp, Homo sapiens
cggatcacgagatcaggagttggagaccagcctgaccaacatggtgaaaccccatgtttactaaaaatacaaaaattagccgggtatggtggtacgcgccrggtgtggtggctcacacctgtaatctcagcactttgggagactgaggcaggtggattacaaggtcaggagttcaagaccagcctggccaagatggtgaaa

SEQ ID NO: 64878 - DNA, 201 bp, Homo sapiens
ggacatatacttagatatatgagaggaggtttattagggcaattggctcatgtgatggtggaggccatctgcaagctggagaaccaaggaagctggtagcrtagctcagtccaagtccaaaggccttggaccagggatccagggatatggcagatcttccgcacctggtctaccaactcacactctaatctcctgacgaaa

SEQ ID NO: 64879 - DNA, 201 bp, Homo sapiens
accaaagatgacatctgatatttcaaacagaaaccgacatttctcagtggaaaactttccgggccagtgcattttggggttggttactgtgcttggagacrcccctgagttggaggacacacttctggctgatgtgaggggcttctgaggagggccaaaatgtacactctttgtgttcttgcaccacggctattagactgt

SEQ ID NO: 64880 - DNA, 201 bp, Homo sapiens
gcatattcaaaaccatttcaggtcactatagtggtttgctcgggttgccataacaaagtaccacggactgagtggcttaaataacagaaatgtatttcctsacagttctggagatgggagtccaagatcaaggtgctggcagggtcgatcgcattctgaggcctctctccttggcttatagatggcgccttctcccttgtc

SEQ ID NO: 64881 - DNA, 201 bp, Homo sapiens
ttcctaaggatactgtatggccctaaaacacaagaactagaattctgtgataccacgggtactccacagtgtgttccttcccctttctgaacctgatttgwctcatctctatgaaaagatgtgggctttggggtcagatgtgggttggaatcctagcgcctgtgtggctgcaattttcttttgtgtaaaattgagataata

SEQ ID NO: 64882 - DNA, 201 bp, Homo sapiens
ggctgtggctgactttggccaatgggaggcaaggacgggagactgagagcttgggaggaagggagagaggtatgtttcttctccttactccctgcctgggrtggcaccttgggcaggactctgttttgcccatggcctcagctcccaccagatgcctctagtccctgggctcaggaaatagacaacctccttccactatcg

SEQ ID NO: 64883 - DNA, 201 bp, Homo sapiens
caaggccagaattaactttctactgcagctcatggatcagaggttttctttatttaaacaaacaaacaaaaaatcctttgaccgtagcccttgctataacrtttcccactgagttgagggagaaattgaaagtaaacttaggagctttttatagcttgtcaaaccatgcaagagtgggggaagcttatccatcttgtggaa

SEQ ID NO: 64884 - DNA, 201 bp, Homo sapiens; identical to SEQ ID NO: 13129

SEQ ID NO: 64885 - DNA, 201 bp, Homo sapiens
tcaagggcttgtgcccacatctgagcatgcagggaaatagatgtcccccactggctgcacatgtgagtgactgcggcacaaggctgtgatgtgaagagtcrtgacaccatttcctcacacctccacgcaatgccagatatgattcgacaacattcttcctgtcttataaaaagtgtttatctagcccgttggtttggcaga

SEQ ID NO: 64886 - DNA, 201 bp, Homo sapiens; identical to SEQ ID NO: 13131

SEQ ID NO: 64887 - DNA, 201 bp, Homo sapiens
aaacctagaaaatcactctcctcaaagccagggttaatcatcatgctccaaaccaggtacatttcacatcactttgggatcctggcaactttctcttttgttttttttttttttttgagacagggtctcctctgtcacccaggatggagtgcagtggtgtgatcatagctcactgcagcctcgaactcctcaagtgatctt

SEQ ID NO: 64888 - DNA, 201 bp, Homo sapiens
tgcagtggctctcctctgaaaggcagggctgatgttgttacataactgggcttattaatagcagtgggaataaagggtaccaaaataatagagaccaggtrgtagtgctcaaccatcagaagccaagaggtgcagttaccttttttttttttttttggaaatggagtctcactctgttgcccaggctggagtgcaatggcg

SEQ ID NO: 64889 - DNA, 201 bp, Homo sapiens
gaccacaggcacacagcaccatgcccatctaattaaaaaaatttttttttgtagagacaggggtctctgtacatttcccaggctggtcatgtactcctaarctcaagcagtcctcccacctcagcctcccaaagtgccggaattacagtcatgagccaccattcccagcgctggtgactttctccatcactggtgactttc

SEQ ID NO: 64890 - DNA, 201 bp, Homo sapiens
ttttgcccatggcctcagctcccaccagatgcctctagtccctgggctcaggaaatagacaacctccttccactatcgctgtagcccaaggagggaagtattttttttctttctttctttctttttttttttttttttacagagtctcactcttgttgcccaggctggagtgcagtggtgcgatctcagctcactgccacc

SEQ ID NO: 64891 - DNA, 201 bp, Homo sapiens
ccagatgcctctagtccctgggctcaggaaatagacaacctccttccactatcgctgtagcccaaggagggaagtattttttttctttctttctttctttytttttttttttttacagagtctcactcttgttgcccaggctggagtgcagtggtgcgatctcagctcactgccacctctgcctcccgggttcaagtgatt

SEQ ID NO: 64892 - DNA, 201 bp, Homo sapiens
cagatgcctctagtccctgggctcaggaaatagacaacctccttccactatcgctgtagcccaaggagggaagtattttttttctttctttctttcttttyttttttttttttacagagtctcactcttgttgcccaggctggagtgcagtggtgcgatctcagctcactgccacctctgcctcccgggttcaagtgattc

SEQ ID NO: 64893 - DNA, 201 bp, Homo sapiens
caccgcacgctgccatgggaaactaatattaatagatgtgtggctatggtgatgagaagggaggagctggagaaggagctacacggccctgccagggatgyccttgaaactatgccctcttccagggcatccctacgttgttcctcggtaaggagaccaaggacacaatgagagctgctcccttgggatcagaagcatcaa

SEQ ID NO: 64894 - DNA, 201 bp, Homo sapiens
tgtgtggctatggtgatgagaagggaggagctggagaaggagctacacggccctgccagggatgcccttgaaactatgccctcttccagggcatccctacrttgttcctcggtaaggagaccaaggacacaatgagagctgctcccttgggatcagaagcatcaagataatttcctgaccaggtgcgtggcatgtgcctgt

SEQ ID NO: 64895 - DNA, 201 bp, Homo sapiens
gatggctgaacctatagtagaaaaacactaggttccgccaaatggtaagggaaatgttgagtcacaatgacacacatgtcctagatttgtttcgtcaaagygacttttggttgtcatgatcttacttccggtggagatgaaatcttacagatgatcgcagagacattcattttatgttggaaatttataaaatcattttct

SEQ ID NO: 64896 - DNA, 201 bp, Homo sapiens
tagttatgctaatgctgaaaaaagagcaagtaatgtttctggaacgttattaatttatgtatttttaaaatataaaacattgtcaattgtagggaacaggyttcactgggatcttttagggaatatcttcagcttgatgaaataattcccgaatagccaagtggtctgacaagatcgagagtaatgaggcccatactttag

SEQ ID NO: 64897 - DNA, 201 bp, Homo sapiens
ctctggagacaaaattttaagaaggggagcaatcatgctcttgggaaaatacatatatatgtatttttagacagagtctccctctgtcgcccaggctggartacagcggcacagtctcggctcactgcaacctccacctggcgggttcaaggggttctcctgcctcagcctcccaagtagctgggattacaggtgcatgcc

SEQ ID NO: 64898 - DNA, 201 bp, Homo sapiens
ccacgcccggctaatttttttgtatttttagtagagacggggtttcaccttattagccaggatggtctcgatctcctgacctagtgatccgcccgccttgwcctcccaaaatgctgggattacaggcgtgagccactgcgcctggcctaattttttgtattattagtagagacgggctttcatcatcttggccaggctggt

SEQ ID NO: 64899 - DNA, 201 bp, Homo sapiens
caccatgttggccagtctggtctcaaactcctgaccgcaagtcatctgtctgcttcagcttcccaaagtgctgggattacaggcatgagccaccgcacgckgccatgggaaactaatattaatagatgtgtggctatggtgatgagaagggaggagctggagaaggagctacacggccctgccagggatgcccttgaaact

SEQ ID NO: 64900 - DNA, 201 bp, Homo sapiens
aattaccattttaaaacacagccctaatcagctctggggatttgcaggaaactcatcgaagctattgataggaactattgttttggtgccagggttttcarttgggagttagatttaaaaggaccaaagatgacatctgatatttcaaacagaaaccgacatttctcagtggaaaactttccgggccagtgcattttgggg

SEQ ID NO: 64901 - DNA, 201 bp, Homo sapiens
ctcttttgttttttttttttttttgagacagggtctcctctgtcacccaggatggagtgcagtggtgtgatcatagctcactgcagcctcgaactcctcargtgatcttcctgcctcagcctcccaagtagcgggaccacaggcacacagcaccatgcccatctaattaaaaaaatttttttttgtagagacaggggtctc

SEQ ID NO: 64902 - DNA, 201 bp, Homo sapiens
tagatgtgtggctatggtgatgagaagggaggagctggagaaggagctacacggccctgccagggatgcccttgaaactatgccctcttccagggcatccstacgttgttcctcggtaaggagaccaaggacacaatgagagctgctcccttgggatcagaagcatcaagataatttcctgaccaggtgcgtggcatgtgc

SEQ ID NO: 64903 - DNA, 201 bp, Homo sapiens
acaaaggaatattattgggtcataaaaagaatgaagtactgatacatgctacaacatagataaaccttggaaacattatgcagagcgaaggaaggccagayaccaaaagccacatattgtatgattccatttagatgaaatgtccagaataggcaaatccctagaggcagaaagtagattagtgggttacaggggctgggg

SEQ ID NO: 64904 - DNA, 201 bp, Homo sapiens
catgcccatctaattaaaaaaatttttttttgtagagacaggggtctctgtacatttcccaggctggtcatgtactcctaagctcaagcagtcctcccacstcagcctcccaaagtgccggaattacagtcatgagccaccattcccagcgctggtgactttctccatcactggtgactttctccatcactggtattcact

SEQ ID NO: 64905 - DNA, 201 bp, Homo sapiens
tcctgattggaccctggctgttgcagcttccaaggccacctctctttgtggctggtatccttttcccatgcatcttctccaggacttccattctgcagttmtctctctgaactcagtgtcttcttcccatcagtataggggtggactttagtatctcctatgtttaggcaacatctctcctttgactctgcgtcttctcca

SEQ ID NO: 64906 - DNA, 201 bp, Homo sapiens
aaaaaaaataaaaataaaaacttcttaggacagagtgattagaagctgtgtagtagatacttagtaacaatgtgggttcctcgggcaggttatcctacgcrgagagccaggtaccaatgggtgcgctgcaatccagacagtaattctgcaaactgccttgaagaaaaaggaccaatgttcgaactacttccaggtgaatcc

SEQ ID NO: 64907 - DNA, 201 bp, Homo sapiens
cccagctacaaaggaagctgaggtgggaggatggcttgagtccgggagggtgaggctgcagtgagccatgatcacgccactgcactccagcctgcacaacwgaaggaggccctttctgtaaaaaaaaaaatggttgaccactccttccttgaaatgcttttttcttgaggcttccatgccctgccttatcctgtttcttcc

SEQ ID NO: 64908 - DNA, 201 bp, Homo sapiens
tgaacctctgaatctacagaagagtcccatgctttaaggaccgatgctggccaggtgtggtggctcatgcttgtaatcccagtactttgggaggctgaggygggcagatcacttgaggtcaggagttcaagaccagcctggccaacacagtgaaaccctgtctctactaaaaatacaaaaattagctggttgtggtggcga

SEQ ID NO: 64909 - DNA, 201 bp, Homo sapiens
aggtcaggagtttgagatcagcctggccaatatggtgaaactccatctctactaaaaatacaaaaattagccaggcatggtggcgcacccctgttgtcccrgctactcgggaggctgaggcaggagaatcacttgaacctgggaggtggaggttgcagtgagccgagatggcaccactgcactccagcctgggcaacagag

SEQ ID NO: 64910 - DNA, 201 bp, Homo sapiens
caggatggagtgcagtggtgtgatcatagctcactgcagcctcgaactcctcaagtgatcttcctgcctcagcctcccaagtagcgggaccacaggcacamagcaccatgcccatctaattaaaaaaatttttttttgtagagacaggggtctctgtacatttcccaggctggtcatgtactcctaagctcaagcagtcct

SEQ ID NO: 64911 - DNA, 201 bp, Homo sapiens
gagtttgagatcagcctggccaatatggtgaaactccatctctactaaaaatacaaaaattagccaggcatggtggcgcacccctgttgtcccagctactygggaggctgaggcaggagaatcacttgaacctgggaggtggaggttgcagtgagccgagatggcaccactgcactccagcctgggcaacagagcaagact

SEQ ID NO: 64912 - DNA, 201 bp, Homo sapiens
tttttttttttacagagtctcactcttgttgcccaggctggagtgcagtggtgcgatctcagctcactgccacctctgcctcccgggttcaagtgattctyctgcctcagcctccagggtgtgccactatgcccagctaatttttgtatttttggtagagacggggttttgccatgttgaccaggctggtcttgaacttct

SEQ ID NO: 64913 - DNA, 201 bp, Homo sapiens
agtttgagatcagcctggccaacatggcgaaacactgtctctactaaaaatacaaaaattagccaggtgtggtgacaggcatctataatcccagctactcyggaggctgaagcaggagaattgcttgaacctaggaggttcaaacctgggaggttgcagtgagctgagatcatgtcactgcaatccagcctgggtgacaga

SEQ ID NO: 64914 - DNA, 201 bp, Homo sapiens
cacgccactgcactccagcctgcacaacagaaggaggccctttctgtaaaaaaaaaaatggttgaccactccttccttgaaatgcttttttcttgaggctyccatgccctgccttatcctgtttcttcctacttctctggttgtgctttttcctctgctcagtatttaacatgttggtgtgaccctggctctggcctgggc

SEQ ID NO: 64915 - DNA, 201 bp, Homo sapiens
cctgtttcttcctacttctctggttgtgctttttcctctgctcagtatttaacatgttggtgtgaccctggctctggcctgggcccccttctctatctacrtgctttctctcgacgacctccatcggttgcatgggtttaactaccaaatctgtgattctagctccgacaccccaggctaaagtagccacctggtcactcc

SEQ ID NO: 64916 - DNA, 201 bp, Homo sapiens
ctagattgcctgctgtctggctggcaatgaggactccatccttggccatagatgagcacaggcacaagatagcagtgcaattgttaaaactttcactggtratgaaccaagatggtataccagtggaagggagtgcactagggtgtgatgtactaggcatctgagaaatgttggcaagtagtaataataaagacaatggta

SEQ ID NO: 64917 - DNA, 201 bp, Homo sapiens; identical to SEQ ID NO: 13128

SEQ ID NO: 64918 - DNA, 201 bp, Homo sapiens; identical to SEQ ID NO: 13130

SEQ ID NO: 64919 - DNA, 201 bp, Homo sapiens
tgtcctggttggggctgagccatggtctcaatatagagcccgagtcgatggtgaacctggcgtttgtcaagaatgactcgtatgagaagggcccggattcmgtggtggtgcacgtgtacgtgaaggagatctgcagggacacctcaagagtacttttccgtgagcaggacttcacgctcatcttccagaccaggtgggtgg

SEQ ID NO: 64920 - DNA, 201 bp, Homo sapiens
tggtgacccccggggaaactccatcctggactggctcaggcttcgtgcggctacaggaaggtcagaccctggagttcctggtggcctctgtgccgaaggckatggactatgacctgctgctgcgcttagagccccaggttagaccctgttatctaatctggagctgaacctctgggtgtgggagcatctcctccatcatcc

SEQ ID NO: 64921 - DNA, 201 bp, Homo sapiens
gagcagggctcttgatggctctgggttgggcttgggtcctggtgcctgctgatcagctatgcccccctacccagacatttcgccctgctgccatgctggtsgaacgctcagcagactttggccgcacctggcatgtgtaccgatatttctcctatgactgtggggctgacttcccaggagtcccactagcacccccacggc

SEQ ID NO: 64922 - DNA, 201 bp, Homo sapiens
tctatgagctggttgtacgtggcaactgcttctgctacggacacgcctcagagtgtgcacccgccccaggggcaccagcccatgctgagggcatggtaagrggcttcagacggttgggatagggctaggggcaggggcggacatggctgagcagtgctgacaacctacctgccaacctctataggtgcacggagcttgcat

SEQ ID NO: 64923 - DNA, 201 bp, Homo sapiens
cacagcttcctcttaaccgtgggcagggctgcgatgtgaagcttgtgcccctgggcactttggggacccatcaaggccaggtggccggtgccaactgtgtragtgcagtgggaacattgacccaatggatcctgatgcctgtgacccccacacggggcaatgcctgcgctgtttacaccacacagagggtccacactgtgc

SEQ ID NO: 64924 - DNA, 201 bp, Homo sapiens
ccaacggcactttgctacttcttgccaccaggatgaatattcccagcagattgtgtgccactgccgggcaggctatacgggtgagtggatgggggcaggcrtgggatcagggtgagttggctgggctgagcactcacagcttcctcttaaccgtgggcagggctgcgatgtgaagcttgtgcccctgggcactttggggac

SEQ ID NO: 64925 - DNA, 201 bp, Homo sapiens
cacatgaggtggagccactggataggaactcagcggaactgactgagctactgtccccagtgctggctgccacactggcacaggcccctgccccggatgtscctggctgttccaggggaagctgctaccccgccacgggcgacctgctggtgggccgagctgacagactgactgcctcatccacttgtggcctgaatggcc

SEQ ID NO: 64926 - DNA, 201 bp, Homo sapiens
atctcgggctcaccacaaccgccacctcctgggttcaagcgattctcctgcctcagccttctgagtagctgggattacaggcacccgccaccacatccagmtaatttttgttatttttagtagagatgagttttcactacattggccaggctggtctcaaactcctgaccttgtaatctgcctgccttggcctcccaaagt

SEQ ID NO: 64927 - DNA, 201 bp, Homo sapiens
cctcctgagtagctgggagtacaggcacatgccaccatgcctggctaattttttgtattttagtagagatgggttttcaccgtgttgctcaggctggtctsgaactcctgagctcaggcaatctgcctgcttcggcctcccaaagtgctgggattacaggcgtgagccactgcgcccggccaacaattgcctcttgtaagc

SEQ ID NO: 64928 - DNA, 201 bp, Homo sapiens
ccgggccagaggccccacctgcaacgaggtatgggaccctcctgcagatccctggttagatggggccaggtgtctgtcttatctccagggcttagcctctkatagaggctctgaccctgccttgttcccaccccagttcacagggcagtgccactgccgtgccggctttggagggcggacttgttctgagtgccaagagct

SEQ ID NO: 64929 - DNA, 201 bp, Homo sapiens
cctcttatagaggctctgaccctgccttgttcccaccccagttcacagggcagtgccactgccgtgccggctttggagggcggacttgttctgagtgccargagctccactggggagaccctgggttgcagtgccatggtgagggagccagcggggccagggtagatggaggacttcccagaatgccccacagtgacccta

SEQ ID NO: 64930 - DNA, 201 bp, Homo sapiens
gctgaagcctctctaaacacccccctctccatcattgcaggcgtgaaattggggaggccactgagcacctgactcagctcgaggcagacctgacagatgtkcaagatgagaacttcaatgccaaccatgcactaagtggtctggagcgagataggcttgcacttaatctcacactgcggcagctcgaccagcatcttgact

SEQ ID NO: 64931 - DNA, 201 bp, Homo sapiens
tcagaccctggagttcctggtggcctctgtgccgaaggctatggactatgacctgctgctgcgcttagagccccaggttagaccctgttatctaatctggrgctgaacctctgggtgtgggagcatctcctccatcatcccgttttcccaggtccctgagcaatgggcagagttggaactgattgtgcagcgtccagggcc

SEQ ID NO: 64932 - DNA, 201 bp, Homo sapiens
gctatgcccccctacccagacatttcgccctgctgccatgctggtggaacgctcagcagactttggccgcacctggcatgtgtaccgatatttctcctatsactgtggggctgacttcccaggagtcccactagcacccccacggcactgggatgatgtagtctgtgagtcccgctactcagagattgagccatccactga

SEQ ID NO: 64933 - DNA, 201 bp, Homo sapiens; identical to SEQ ID NO: 13181

SEQ ID NO: 64934 - DNA, 201 bp, Homo sapiens
ccacctggcagacccagggctgattctttccacaatcttgccattaataggttgaggctgatgaacagctttgcataccaccgctgaactcccaaacctgyctcctgggctcagaggagaatttagcccctttggcaggagagaaagcagtgcctcccgggaatgacccagtctctccagccatggtccggagcagaaacc

SEQ ID NO: 64935 - DNA, 201 bp, Homo sapiens
cctccatccctggctgcattatctcccaggtgctcgatgtggtggagcgcctggtgacccccggggaaactccatcctggactggctcaggcttcgtgcgrctacaggaaggtcagaccctggagttcctggtggcctctgtgccgaaggctatggactatgacctgctgctgcgcttagagccccaggttagaccctgtt

SEQ ID NO: 64936 - DNA, 201 bp, Homo sapiens
gcctggtgacccccggggaaactccatcctggactggctcaggcttcgtgcggctacaggaaggtcagaccctggagttcctggtggcctctgtgccgaasgctatggactatgacctgctgctgcgcttagagccccaggttagaccctgttatctaatctggagctgaacctctgggtgtgggagcatctcctccatca

SEQ ID NO: 64937 - DNA, 201 bp, Homo sapiens
ccatcctgccttagtactggagcagggttgctgctgaagaggtagcgtgacatctagatacacttttcagtccctttctgcttgggacagcagctggggaraggactttctcttgaaatgaagaaggaccaagcagtacataggagcaggttcttgccaagggtgggagctggcaggaggcaggtggagtgccttagcccc

SEQ ID NO: 64938 - DNA, 201 bp, Homo sapiens
cactctgagcagggatgtgcctggtctgattaatgttttattacattttgggtagtatttgtttcatgtttcatgtttcttttttttttcttttcttttcyttttttttttttttttttttgagacggagtctcgctctgtcaccaggctggagtgcagtggtgcgatctcggctcactgtaatctcccacctcccgggtt

SEQ ID NO: 64939 - DNA, 201 bp, Homo sapiens
tggtattgggaaaggggaccttggggcatgactgccatgacccacatgcaagcagccgtgcagatcatccagcgcttcctcatgggtacatatctgcttgwtgcatgtctgttcacagccaagggcagggttaatagggtatgcaggacactatcatgatactccttccagaatgaggaatattcatcagggctgaccagg

SEQ ID NO: 64940 - DNA, 201 bp, Homo sapiens
gaggccatgggtggggcaaaagtgagcagggctgcccaccagtagctttgagtccttgacttccgattcctgtcccaggtatccctgcggtcaccatccasctggacctggaggctgagtttcatttcacacacctcattatgaccttcaaggtgcctgcatatctgggagcctgcccgaatcaccctgcttggctctcca

SEQ ID NO: 64941 - DNA, 201 bp, Homo sapiens; identical to SEQ ID NO: 13188

SEQ ID NO: 64942 - DNA, 201 bp, Homo sapiens
aggctgggattgggcacggggagagaaagctgagcctggggcaggaactagagagctggactgctgtctaaattgcaggaaattggggttaggggcttggratagaacttgaccagggatccagggtgggatcccttaggcttaggagaggactggcagtgagctagttgagatagggtgagtgaccctgtatctcttttt

SEQ ID NO: 64943 - DNA, 201 bp, Homo sapiens
tgcccatgcctccccaatgtccagggccctagctgtgaccgctgtgcccccaacttctggaacctcaccagtggccatggttgccagccttgtgcctgccwcccaagccgggccagaggccccacctgcaacgaggtatgggaccctcctgcagatccctggttagatggggccaggtgtctgtcttatctccagggctta

SEQ ID NO: 64944 - DNA, 201 bp, Homo sapiens
tgctgggtggtgatggggtctggaggtctgtttctggcccccagcaactcctttcgtgcagcctggccactggggcctgagccacgacctgctcggctgcygcccctgtgactgcgacgtgggtggtgctttggatccccagtaagtgttgtaaagggggcctgggaagggatggggaaagatcctgagcagaagagaagg

SEQ ID NO: 64945 - DNA, 201 bp, Homo sapiens
gcttgggaggctgaggtgggaggatatcttgaacccaggaggtcaaggctgcagtgagccaaggtcacgcactgtactccatccatcctgggcaacagagmccgcatctcaaataaacaaataaataaataaatcagaaaataaaaagaaaaaagatgagggattgaagaacaatttttgggatgggataaaagaacccaa

SEQ ID NO: 64946 - DNA, 201 bp, Homo sapiens
cactgccgccagcacatggttgggcgacgctgtgagcaggtgcaacctggctacttccggcccttcctggaccacctaatttgggaggctgaggacacccragggcaggtgtggggcctccccctaagcagagggctggatgtgggtggacacgtctatgactggagaggtggggttatgggcagtaccttgttgagggga

SEQ ID NO: 64947 - DNA, 201 bp, Homo sapiens
gagactggagcagctatgagtgggttggttggtgggcaggcttcccagggatgacacatttcttcttcctcctccctgcaggtgcattgctggtttccacrgggacccacggctgccatatgggggccagtgccggccctgtccctgtcctgaaggccctgggagccaacggcactttgctacttcttgccaccaggatga

SEQ ID NO: 64948 - DNA, 201 bp, Homo sapiens
tcggctcactgtaatctcccacctcccgggttcaagcaattctcatgtgtcagcatcccgagtagctgggactacaggtgcacgccaccacgcccagctakttttttgtatttttagtagagatggggtttcaccatgttggccaggatggcctcgatcttctgaccttgtgatctgcccgccttggcctcccaaagtgtt

SEQ ID NO: 64949 - DNA, 201 bp, Homo sapiens
tggcggggccagtgccacaggcccaaggagagggcccccaggactggaggacaccactagtaagaagaagcagaaggatcgagcaaaccaggagagcaagsatggagatcctaggaaaggtgggagtggcattcccagagtaattgtggccttctctgcctcccatcttattggtatacagattggggtttgggagatgac

SEQ ID NO: 64950 - DNA, 201 bp, Homo sapiens
gggtgatcagtaccagacggtgaaggccctagctgagcgcaaggcccaaggtgtgctggctgcacaggcaagggcagaacaactgcgggatgaggctcggracctgttgcaagccgctcaggacaagctgcagcggctacagggtaagaaatggggcaccagagacacaagactgcgggaaaccccccctaaactgacacc

SEQ ID NO: 64951 - DNA, 201 bp, Homo sapiens
cgtggccagtggggattccctagctgccggccatgtgtctgcaatgggcatgcagatgagtgcaacacccacacaggcgcttgcctgggctgccgtgatcwcacagggggtgagcactgtgaaaggtgagactggagcagctatgagtgggttggttggtgggcaggcttcccagggatgacacatttcttcttcctcctc

SEQ ID NO: 64952 - DNA, 201 bp, Homo sapiens
ggggcaggcgtgggatcagggtgagttggctgggctgagcactcacagcttcctcttaaccgtgggcagggctgcgatgtgaagcttgtgcccctgggcastttggggacccatcaaggccaggtggccggtgccaactgtgtgagtgcagtgggaacattgacccaatggatcctgatgcctgtgacccccacacggggc

SEQ ID NO: 64953 - DNA, 201 bp, Homo sapiens
tcacggattcagagtgagtgctccaccctttgagtctggcacagtccgtgtccggctagggactatttggggcctcagtaactattttgggtgcttcctarggcaggtgccaagcccagtttagctcgggtggcagtgtataggaggtctttcaaggtgaccttggcagctgagcccctgggtggacatggggcagcaagg

SEQ ID NO: 64954 - DNA, 201 bp, Homo sapiens
gattgcagagcgagtccggagcctggcagatgtggatgcgatcctggcacgtactgtaggagatgtgcgtcgtgccgagcagctactgcaggatgcacggygggcaaggtctgaccccatccctggcccctatccctgacacctggttttgatacctccaggttctgattcccccttctccccaggagctgggctgaggat

SEQ ID NO: 64955 - DNA, 201 bp, Homo sapiens; identical to SEQ ID NO: 13144

SEQ ID NO: 64956 - DNA, 201 bp, Homo sapiens
cctggctgttccaggggaagctgctaccccgccacgggcgacctgctggtgggccgagctgacagactgactgcctcatccacttgtggcctgaatggccsccagccctactgcatcgtcagtcacctgcaggtgtggctggggacagggtgtgacgccgagtcagggtggggctggcactgcctgaggcactgattctaa

SEQ ID NO: 64957 - DNA, 201 bp, Homo sapiens
tgggtgtagctaaagagcaagttgttgggtcttggcagtgatcactggcttctttccattaggctgtccgttccttgctggagaatttggccacaaagagytgccaagatagctgggccaggaagaaagcgccgcagccctgacccagacgctgttgccgaccccggggcactctggctgtcgaccaagcggctcaagatg

SEQ ID NO: 64958 - DNA, 201 bp, Homo sapiens
gcctgaggcactgattctaatccccatccaacccaggacgaaaagaagtgcttcctttgtgactcccggcgccccttctctgctagagacaacccacacasccatcgcatccagaatgtagtcaccagctttgcaccacagcggcgggcagcctggtggcagtcagagaatggtgaggccatgggtggggcaaaagtgagc

SEQ ID NO: 64959 - DNA, 201 bp, Homo sapiens
aggccaaccaggaacttcaagaacttatccagagtgtgaaggacttcctcaaccgtgagcctcccacgtgtcccaggccatgtggttgtcccctttggcawctcccggtgtctgtatctcccttggttcatacttgagcctcagggactacactggattagtgtttatgatcccttgactggctcctgagttattgcccat

SEQ ID NO: 64960 - DNA, 201 bp, Homo sapiens
agagggtccacactgtgcccactgcaagcctggcttccatgggcaggctgcccgacagagctgtcaccgtgagtatgagtgtgggagggcatggctgaattggggttctgcttcttggcctcctcttgactactgtgctcatcttggttggcacaggctgcacatgcaacctgctgggcacaaatccgcagcagtgcccat

SEQ ID NO: 64961 - DNA, 201 bp, Homo sapiens
gcatgtcagtgcaaccctcaaggttcactgagttctgagtgcaaccctcatggtggtcagtgcctgtgcaagcctggagtggttgggcgccgctgtgacckctgtgcccctggctactatggctttggccccacaggctgtcaaggtactcttctgccccttgttccctcctatgcttctctctccttcccattactgttc

SEQ ID NO: 64962 - DNA, 201 bp, Homo sapiens
gtgattgtgaccccatgggttctcaagacggtggtcgctgtgattcccatgatgaccctgcactgggactggtctccggccagtgtcgctgcaaagaacaygtggtgggcactcgctgccagcaatgccgtgatggcttctttgggctcagcatcagtgaccgtctgggctgccggcgtatgtgtctcctgccctaacttc

SEQ ID NO: 64963 - DNA, 201 bp, Homo sapiens
ccgttttcccaggtccctgagcaatgggcagagttggaactgattgtgcagcgtccagggcctgtgcctgcccacagcctgtgtgggcatttggtgcccarggatgatcgcatccaagggactctgcaaccacatgccaggtgagggcactggtggtagcactcacaatggcagggggttgtggggccagccctaagctcc

SEQ ID NO: 64964 - DNA, 201 bp, Homo sapiens
tagaggagggggctgatcctgatagcattgaaatggtggccacacgggtgctagagctctccatcccagcttcagctgagcagatccagcacctggcgggygcgattgcagagcgagtccggagcctggcagatgtggatgcgatcctggcacgtactgtaggagatgtgcgtcgtgccgagcagctactgcaggatgcac

SEQ ID NO: 64965 - DNA, 201 bp, Homo sapiens
gtggctcctctccagattggtggagtagcctggtcccaggccatgacttccttgacctggtgccccctcagtgaggctttcacctgtgtgggactgttatkgtgggtatctatgaggcttggccagaagtggttgctgctacttgcattatttattacctcttcagaatatcctgagagtgtccaggggtacttaagagat

SEQ ID NO: 64966 - DNA, 201 bp, Homo sapiens
cggctcgggtctctaaacagccccttacccgcctcgacgtccctggggcatgggggagggacgcgaccttcggctggggcctgggtgcaagaaggaggcgycggtggcaggtgtcattaaagatccagcccaccagtaccacatctgacctgtagaagggtatcctgccatccctccttcctcctttacacacttagggga

SEQ ID NO: 64967 - DNA, 201 bp, Homo sapiens; identical to SEQ ID NO: 13158

SEQ ID NO: 64968 - DNA, 201 bp, Homo sapiens
agtagctgggattacaggtgcatgccaccacgcaaggctaattttttttttttttttgagacaatgtctcactctgtcatccaggctagagtgtagtggcrtcttggctcactgcgggctctgcctcccgggttcaagtgattctgctgcctcagcctcccaagtagcctcagcctcccaagtagctgggattacaggtat

SEQ ID NO: 64969 - DNA, 201 bp, Homo sapiens
ggggctggctgtggcagaagaggcaaagcctcacctgagcctccatccctggctgcattatctcccaggtgctcgatgtggtggagcgcctggtgaccccyggggaaactccatcctggactggctcaggcttcgtgcggctacaggaaggtcagaccctggagttcctggtggcctctgtgccgaaggctatggactatg

SEQ ID NO: 64970 - DNA, 201 bp, Homo sapiens
gctacttgggaggctgaagcaggagaatcgaagattctgttactgtagaaaacagaagagctatgggggtccttgatgggaccatgatcctgcactggagrgcgggatgatggcccaggtgagaagaggccacccctgagttagggctgagaccatagggtcagaaaggagggtagacagagaggtttcagtcccctctac

SEQ ID NO: 64971 - DNA, 201 bp, Homo sapiens
acggcaaaaccccatctctacaaagatcagtcgggcatggttgcttgcacctgtagtcctagctactcaagaagctgaggtaggagaatcccttgagcccwggaggttgaggctgcagtgcgcattgctccactgcactctagcctgggcgacagtgagaccctgtctcaaaaaaaaatagaggttgggaactgtctctag

SEQ ID NO: 64972 - DNA, 201 bp, Homo sapiens
cacccccatttccccaccttccagggcggcactgaaggagtggaatggagtggtgtccgagagtgactctccggtgaagaggccagggaggaaggcggccygggtcctgggcagcgaaggggaagaggaggatgaagcccttagccctgctaaaggccaggtaggtccccatcaccctgcccatttttaccagaagaaact

SEQ ID NO: 64973 - DNA, 201 bp, Homo sapiens
atggtgtgatctcggcccactgcactccagcctgggcgacagagcaagattccatctcaaaaaaaaaaaaaaaaaaggcatcccaatagatgctggagacyaatggcaaccttaggcagggactccatttgctcctcagcatcacccatcacagggcaggcactctggagacttccagagatgtgtgatgggtgggtgagt

SEQ ID NO: 64974 - DNA, 201 bp, Homo sapiens
atatcttgcaggtgcgttagggcagaaaaattagtgttgcctcctttgtctgagtctgagtttccttatcagttaagttaaagggcttatttgaaattctytgttatgtgctgagatggaaatggtgttagaagttataggatgcggccgggcgcggtggcttatgcctgtaatcccagcacattgggaggccaagcagat

SEQ ID NO: 64975 - DNA, 201 bp, Homo sapiens
agcagccaccacgcccggcctaggaaccctttcattagagttactctaaactgtggaagccccagtgactgttattgatttcattaaataacagacttttwaaaaaagtatttaatttttaaaaatatattgtgaaggggtaacgtattccaattgttctgcctgcaaaagcatgcatattaaaaaatctccctccagcgt

SEQ ID NO: 64976 - DNA, 201 bp, Homo sapiens
aaaggcgacgtggggctggtggccgagaacagccgcagcacccagaggctcatgctgccaccacctccgctcactgcctccggggtcttcagcaagttccrcgacatcgccaggctcactggcagtgctgtgagtggggcgggccgctcatcccggaccccagacatcttggggacctgaggccacgcgtgtgtcaggaag

SEQ ID NO: 64977 - DNA, 201 bp, Homo sapiens
cccgggcagcggcgcgcgggaccaacgcaaggcaagtggggccgtccgcaagcagatgggaggcggagggcggcgggtgcgccgaatgcttggggcctatrcttcgccatgtcggggtgtctgcagaggagtgggcgtggggacgctgaggctgccgagagcgcggtggagacggaagagcgcgggctgcgggccgccgga

SEQ ID NO: 64978 - DNA, 201 bp, Homo sapiens
gacgtctgcgcgcgaatgccgtggcgcgaacttgggactgcagaggcgcgcctggcggatctgagtgtgttgcccgggcagcggcgcgcgggaccaacgcraggcaagtggggccgtccgcaagcagatgggaggcggagggcggcgggtgcgccgaatgcttggggcctatgcttcgccatgtcggggtgtctgcagagg

SEQ ID NO: 64979 - DNA, 201 bp, Homo sapiens
cggcgtccacctcccacaatgccccgcgcccaggcctggcccggcccttgctcccgggatgccccgcgcggtctcccgcctctcttcccgccgtgcctcgygggggcgcttccaccgattcctcctctttccctgccagtcactcctcagaccctcagccacacccgctcatccagggcgagggaaagcgcgggcattttc

SEQ ID NO: 64980 - DNA, 201 bp, Homo sapiens
ttcctcacctctcagatgggggcacagtgatgagaggaagcatgttcttccacccactcttccccacgtgccaggcactcagcaacgggctttccctgacscaatgctccaaatcctcacaacactgctgggagtagattctgttgttatcctggtttcctgggtgagaaaagtaaagcggggaggtgggacagtattgag

SEQ ID NO: 64981 - DNA, 201 bp, Homo sapiens
agcgaggtcctgaaacgctttgaggaggcagctttcacctgcgaatacaaatatgacgggcagagggcacaggtatggggagtgggacatgtcccttccayagacaggaaaacgtcaaagagcaggggtgtggggtcactgaggcctgagcttcaagccggcctgcgccacagactgccgagccctcgctcatctctctgg

SEQ ID NO: 64982 - DNA, 201 bp, Homo sapiens
tcgctcttgcgtctcttttccttccctagggttccttacctggctgtggcccggacgtttgagaagatcgaggaggtgtctgctcggtaactaatgaggamtgcctgggtggggggcggggtcgcttctgggtctgtcctctgcatggcggtctgtgctgccttgttccgccaaaccctgtcaacttggcctctgaccccg

SEQ ID NO: 64983 - DNA, 201 bp, Homo sapiens
ctgcaccgtgtgccttgaacagagcctggcacatcacagttggaaggaatgactttgctttgacccagggctctatgcaattcaatctccgttttgcctcygtagacccctggatccatctggttacaatcctgccaagaacaactatcatcccgtggaagatgcctgctggaaaccgggccagaagtgaggtttctccct

SEQ ID NO: 64984 - DNA, 201 bp, Homo sapiens
tcctcctcttgcaggacttggcaaaccttttctataaagagccagagagtaaatattttaggctttatgggacacatttggcccctgttgcaaaaccattmttagatcccagaacctgtagaaacggtccagggtcggagtttgctgaccgtggccccagccaccctctgaccctgcctccagtctttcatcctcagtctg

SEQ ID NO: 64985 - DNA, 201 bp, Homo sapiens
aggtgggttaaaaagtatgacgcagtgagtccaaaatctctttgatgtcacgcctctacaaatgaaacagataacgacaagaaattctttcagctttaacrtttcatgattacagtttaagtctaacaaaaaagtgttcggaggattcttgacatcaattttgtacccccaattgagaccttatcaaggaggttaaatagc

SEQ ID NO: 64986 - DNA, 201 bp, Homo sapiens
tagaaaatgctccgtagcatcagctgtcgtttctctgggctgatcatcaccatcttcatcattgttaccgtcacaccaagttactcccccactgtaaccgyccggtgggttcaccttgcccgctgcctagacagagccgatttatctagacgggggaactgcagtggagaaagagtcattcccacagagctggctgtgcgg

SEQ ID NO: 64987 - DNA, 201 bp, Homo sapiens
gacacagggaggtgcagggactcgccacaagcacacacagctggagaaaattcatccaggccgcgagagaagggagacacgcagccacaactgtcaccctygacacccccacccgcgctctcccctgaaggtcggcagctggagtccgtccgggctgaggcagccgagaaaggcgacgtggggctggtggccgagaacagc

SEQ ID NO: 64988 - DNA, 201 bp, Homo sapiens
cccacctcggcctcccaaagtgctgggattacaggcgtgagccagtacacctggcctgaactcaccagatttagtgtatgtgctggaagcctgcaggcgcrtctactctgccttaaaattcactgaacaccccttctttgccagccctgggcggcccacgaggatgaaccatagagagccggccgccctgccccagccctc

SEQ ID NO: 64989 - DNA, 201 bp, Homo sapiens
cctctcttcctctgctcactgcaggccctggtgctgcccagcccacgcccttacgtgcggatagatggcgctgtgattcccgaccactggctggaccccarcgctgtgtgggaggtgaagtgcgctgacctctccctctctcccatctaccctgctgcgcggggcctggtgagtggcagaggacctggccgtggccctgtg

SEQ ID NO: 64990 - DNA, 201 bp, Homo sapiens
agctgctgggaggagtgggaatattttcttctcatgacgatgagatttctttttaccactattcctaagtctcctatttcaggccaagtgctagaattcckctagttagcactgaggagtagacagcaggcctgagatctcagctcaaagctaacagaaaggaaaagggtaggtgtagttatatcttccatctgcagggtc

SEQ ID NO: 64991 - DNA, 201 bp, Homo sapiens
ccccttcccccgattatgaccctatggctcgccacatgcagctgtagctggggcttccctgagacactctcatctccagatgtactccccacatgcagttrtccacgcttcgcctacaggtgtgtgccccacttgtggctagttctcctcggaagtgtcaccagtattcacctgtggtcccctcctcctcagatgcggccc

SEQ ID NO: 64992 - DNA, 201 bp, Homo sapiens
gtggctcacgcctataatcctagcactttgggaggccaaggcaggcagatcatttgaggtcaggagttcaaaatcagcctagcgaacatggtgaaacctcrtctcttctgaaaatacaaaaaaatcagccaggtgtggtcgtgtacgcctgtaatcccagttacttgggaggctgaggcagaagaatcacttgaagccagg

SEQ ID NO: 64993 - DNA, 201 bp, Homo sapiens
ggcttgccagatctttccatcggacgatgctgggtgacgcagggtactctgggagctcagaagtcaagcagcccaggggaggtgatggctgagccgagtcktagaagatgggttggggttggccatgttgagaaaggacagatgcatgcatttcagacaagaagggcacgtgcagaggcctcgagatgggaacagcatggg

SEQ ID NO: 64994 - DNA, 201 bp, Homo sapiens
agaagaggccacccctgagttagggctgagaccatagggtcagaaaggagggtagacagagaggtttcagtcccctctactctcaacttttggaaaatggrgtccctccttcccccgctcactctagaactgttctttcctcttccagaagcctgccctggactgctcacaggtctccccgccccgtcctgccacatctcc

SEQ ID NO: 64995 - DNA, 201 bp, Homo sapiens
gctgttgccccttcccccgattatgaccctatggctcgccacatgcagctgtagctggggcttccctgagacactctcatctccagatgtactccccacawgcagttatccacgcttcgcctacaggtgtgtgccccacttgtggctagttctcctcggaagtgtcaccagtattcacctgtggtcccctcctcctcagat

SEQ ID NO: 64996 - DNA, 201 bp, Homo sapiens
ctccctaaccagacataagctccttcccacagagccagggctgtgggaggtcccagccttcttagtcttcttgcctagctcccagcactggggctggcccytaggaagcccaggaaatctgccatgaaagaaatttaaatgagcactttcagattttttttttcactagtcaatcatggactcatttatttactcagtaag

SEQ ID NO: 64997 - DNA, 201 bp, Homo sapiens
aaagagcctccctaaccagacataagctccttcccacagagccagggctgtgggaggtcccagccttcttagtcttcttgcctagctcccagcactggggytggcccctaggaagcccaggaaatctgccatgaaagaaatttaaatgagcactttcagattttttttttcactagtcaatcatggactcatttatttact

SEQ ID NO: 64998 - DNA, 201 bp, Homo sapiens
ttcctgtcattatctcttcattttggtaaccgctttattgagatataattcacaattatacagtttgcccatttaaagtgtacaattttgcccatttaaartgtacaagtcagtggttttcagtgtatttaaagtgtatttcagtgtatttaaagtgcccatttaaagtgtacaagtcagtggttttcagtgtatgcgctg

SEQ ID NO: 64999 - DNA, 201 bp, Homo sapiens
ggagtttctttttgaaggggaaattcatgtttctgtttttttttttttctttctttcttaaagaaagggttttatgtgtgtttagatctctgcacaaccartcacctcaacaagtgtttggatttctgttccaggagcagctgacagacgaagaaaagtgctggacaggaagggagaattctgacgccaacatgcagcgaa

SEQ ID NO: 65000 - DNA, 201 bp, Homo sapiens
tgctgggattacaggcgtgagccaccacacccagcctcctccctgcttctgaacatgcttgaccccggcctacaacactgtccctaacccaccctgcccakcaggcttccctcaggccccaactcctattgcacctgcttagggaagccgggtgcctctcccttcatgtgtgagaggaggtgcgtgtccccagcacttgag

SEQ ID NO: 65001 - DNA, 201 bp, Homo sapiens
aaaaaaaagaaaaaaaaagtctcagggtcaaagagtttgcatcaccgtctgagctctctcaccgcagaagcagagaccccgacggaaagcgtttcagagcytgaggtggccacgaagcaggaactgcaggaggaggaagagcagaccaagcctccccgcagagctcccaagacgctcagcagcttcttcagtgagtttccc

SEQ ID NO: 65002 - DNA, 201 bp, Homo sapiens
cctcaaggtcgctgccttgcttggggttgacaaggagcagggtcttacgtggcccactgctttacaggcacattggattggcacaagatagaactgtaagmcctgcactttgggaggccaaggcgggtggctcacctgaggtcagtagttcaagaccagcctggccaacatggtgaaatcccatctctactaaaaatacaa

SEQ ID NO: 65003 - DNA, 201 bp, Homo sapiens
ctgtttttttcccttcctccctctccccagccctccaacacttggccttgactttgagattccagaccctctgttcctctcttcctctgctcactgcaggscctggtgctgcccagcccacgcccttacgtgcggatagatggcgctgtgattcccgaccactggctggaccccagcgctgtgtgggaggtgaagtgcgct

SEQ ID NO: 65004 - DNA, 201 bp, Homo sapiens
tcatttctttccatctcccattcctcccaactcccacctttctcaactttttacttcaagggggtcttgtttcttttcccttctttcactttctgtttctmtttctatttctgtttacttcaagggggtgtcttgtttcttttcccttatttcacttcctatttctgtttacttcaagggggtgcctgtttttttcccttc

SEQ ID NO: 65005 - DNA, 201 bp, Homo sapiens
tcacggcaggcctgctgggagaacattcccacccgggagtctctggatggatgctccgcacccccagctccctacttccctggttttctgtggatactgcrtagaccagagtggggtgggggccatgagtgtacacagctttagatggcaggagcaagtgctgggcctgtggccggctgagcctctgacctcccgcttcct

SEQ ID NO: 65006 - DNA, 201 bp, Homo sapiens
gggagtggttcacggcaggcctgctgggagaacattcccacccgggagtctctggatggatgctccgcacccccagctccctacttccctggttttctgtrgatactgcgtagaccagagtggggtgggggccatgagtgtacacagctttagatggcaggagcaagtgctgggcctgtggccggctgagcctctgacctc

SEQ ID NO: 65007 - DNA, 201 bp, Homo sapiens
agagctacaccctgtctcaaaaaaaaaaaaaaaaaaaaaaaaaaagactggaagtgaggacagccagttactgggcagtgaggatgtgggtgagcataagrgagtgacttcctggggccagggagacagtggaagcagcaagagtttctccataaagcagaagacagggagtggttcacggcaggcctgctgggagaacat

SEQ ID NO: 65008 - DNA, 201 bp, Homo sapiens
atctacattgtcaccattttgcattatttagaatagatttttaaatgagctattgtcaggacaaaaggcaaaaagaatccttaagactctcaatgcaaaargggctttccaggtgacgtttatattggtgattattgcccacttgctgcgtatctgccagcatccagcattactgctaatttttagcctttcctattttgg

SEQ ID NO: 65009 - DNA, 201 bp, Homo sapiens
cctgaaccagctccccgtggctgtgtggggaagttgttgccggctttgttctgatgggtaatgtgattacttagtgtccgttaacctaaacgatcagtgayagaagtgacttttataaatcacaaatgttttggccaccaatctacattgtcaccattttgcattatttagaatagatttttaaatgagctattgtcagga

SEQ ID NO: 65010 - DNA, 201 bp, Homo sapiens; identical to SEQ ID NO: 13551

SEQ ID NO: 65011 - DNA, 201 bp, Homo sapiens
tgtaggtggaacctagccttgaaaacctttgtctatttttattttgtttgagacggagtctcgccctgtcatccaggctggagtgcagcagcacaatctcmgctcactgcaacttccgcctccagggttcaagtgattctcctgcctcagtctcctgagtagctgggactacaggcgcgtgccaccacccccagctaactt

SEQ ID NO: 65012 - DNA, 201 bp, Homo sapiens
aggcaagacgcaaacttatttttctctctcctgagtgcagagtccgggattcatgtgaccgtctcacagggtcagaggcccaggcttcctctgtgctgtcrtttgctctctgtagatgcccttgtccctgtgaacatccatattctgccaacaggaagaggagggcaccccactcaacattaagtggatgttatttgaacc

SEQ ID NO: 65013 - DNA, 201 bp, Homo sapiens
gagacacgcagccacaactgtcaccctcgacacccccacccgcgctctcccctgaaggtcggcagctggagtccgtccgggctgaggcagccgagaaaggygacgtggggctggtggccgagaacagccgcagcacccagaggctcatgctgccaccacctccgctcactgcctccggggtcttcagcaagttccgcgaca

SEQ ID NO: 65014 - DNA, 201 bp, Homo sapiens
cttgagtaccgtggtaaggagaaaggaacgtgggctttggagccagccacaccgggttttgaagccttgcctgaaccccagctatgttcctctgtcctcaktaccttcatctataaagtggggatgatctcacctgtcttggagggctgacttgaggattgagggtatttgagaatgtgatcagcctgtcaggcatagagt

SEQ ID NO: 65015 - DNA, 201 bp, Homo sapiens
ctccaggatctccctgggtgactggatggatgacaaagccgtcggcagcttgggaccctggtgaggggcaggcacctgcagggggcattaatcaccccagygtggggcaggcatgagcaacctctatctgtgggcccccagggccatccaggaagtttggaaacgggtctgaggctcaccaggtctggctcagagcccagg

SEQ ID NO: 65016 - DNA, 201 bp, Homo sapiens
gttgagaagccagccttgagtaccgtggtaaggagaaaggaacgtgggctttggagccagccacaccgggttttgaagccttgcctgaaccccagctatgytcctctgtcctcagtaccttcatctataaagtggggatgatctcacctgtcttggagggctgacttgaggattgagggtatttgagaatgtgatcagcct

SEQ ID NO: 65017 - DNA, 201 bp, Homo sapiens; identical to SEQ ID NO: 13564

SEQ ID NO: 65018 - DNA, 201 bp, Homo sapiens
attggattggcacaagatagaactgtaagacctgcactttgggaggccaaggcgggtggctcacctgaggtcagtagttcaagaccagcctggccaacatrgtgaaatcccatctctactaaaaatacaaaaaaatagctggatgtggtggtgggcgcctgtcatcccagctactcgggaggctgaggcaggagaatcgca

SEQ ID NO: 65019 - DNA, 201 bp, Homo sapiens; identical to SEQ ID NO: 13566

SEQ ID NO: 65020 - DNA, 201 bp, Homo sapiens
cccatctctactaaaaatacaaaaaaatagctggatgtggtggtgggcgcctgtcatcccagctactcgggaggctgaggcaggagaatcgcatgaacccrggaggcagaggttgcagtgagccaagatcacaccattgcactccagcctgggcggtaagaacgaaactctgtctcaaaaaaaagaacagatgacagatga

SEQ ID NO: 65021 - DNA, 201 bp, Homo sapiens; identical to SEQ ID NO: 13568

SEQ ID NO: 65022 - DNA, 201 bp, Homo sapiens
ctactcgggaggctgaggcaggagaatcgcatgaacccaggaggcagaggttgcagtgagccaagatcacaccattgcactccagcctgggcggtaagaaygaaactctgtctcaaaaaaaagaacagatgacagatgagggcagactgtctccagagtcaaaatgcccttgtaggttcaatgggatttttttgccatctg

SEQ ID NO: 65023 - DNA, 201 bp, Homo sapiens
cgggaggctgaggcaggagaatcgcatgaacccaggaggcagaggttgcagtgagccaagatcacaccattgcactccagcctgggcggtaagaacgaaaytctgtctcaaaaaaaagaacagatgacagatgagggcagactgtctccagagtcaaaatgcccttgtaggttcaatgggatttttttgccatctgaccgt

SEQ ID NO: 65024 - DNA, 201 bp, Homo sapiens
gaggcaggagaatcgcatgaacccaggaggcagaggttgcagtgagccaagatcacaccattgcactccagcctgggcggtaagaacgaaactctgtctcraaaaaaagaacagatgacagatgagggcagactgtctccagagtcaaaatgcccttgtaggttcaatgggatttttttgccatctgaccgttctgtctat

SEQ ID NO: 65025 - DNA, 201 bp, Homo sapiens
ccctgcatgttggtgaacccaccgaaaacagccataaagatctgatcgattgatcatctggggcctgcatgagattacaccaattgcagcctttaacgtcrtttggttttttgtttctgcaaacaaataaaaggtccattttccagggcagatttaaatttggttaagatctgatttcttggccaggtgcagtggctcacg

SEQ ID NO: 65026 - DNA, 201 bp, Homo sapiens; identical to SEQ ID NO: 13574

SEQ ID NO: 65027 - DNA, 201 bp, Homo sapiens
ggctgagcctctgacctcccgcttcctccctgcagcttggaactggcttcagtgacgaggagctggaggagcatcaccagagcctcaaggtgagccatggyggctgcgcctcagcctccacccctctcccccctgcccctgacagcacagtccttccatgcagggctcttggcttccaccatcttggggctccaggtgtgg

SEQ ID NO: 65028 - DNA, 201 bp, Homo sapiens
agccccgccgtcccacctagctgtgcctctcccctccccaagatgtgcacccttcccgcccctccccactcacctacccgccccggagcggcgtccacctyccacaatgccccgcgcccaggcctggcccggcccttgctcccgggatgccccgcgcggtctcccgcctctcttcccgccgtgcctcgcgggggcgcttcc

SEQ ID NO: 65029 - DNA, 201 bp, Homo sapiens
ccttctcccagctgaagaaggactaccttgatggcgtgggtgacaccctggacctggtggtgatcggcgcctacctgggccgggggaagcgggccggccgrtacgggggcttcctgctggcctcctacgacgaggacagtgaggagctgcaggccatatgcaaggtcctggggaactggggctgatggcagaagcaggagg

SEQ ID NO: 65030 - DNA, 201 bp, Homo sapiens
atggcccctcgtcctcggatgggctccttcaccccagatgctccccccacgtccagctgcgcgtctcccctcgagcagccccatccagcccgctcccgacsctcctactccccccctccccgcccgctgcggcaccttccagccccgccgtcccacctagctgtgcctctcccctccccaagatgtgcacccttcccgccc

SEQ ID NO: 65031 - DNA, 201 bp, Homo sapiens
caccttgggcgctcccccttctcatctcttgcctccccttctcccagctgaagaaggactaccttgatggcgtgggtgacaccctggacctggtggtgatyggcgcctacctgggccgggggaagcgggccggccggtacgggggcttcctgctggcctcctacgacgaggacagtgaggagctgcaggccatatgcaagg

SEQ ID NO: 65032 - DNA, 201 bp, Homo sapiens
tcttgattcctaattccaactcgtctcctcctccgcagatgtgacccttaggtacagttggaatctctcctcccaaaatacgacccttaagctcagatgtyccttaaggacatctcctcaaatgtgttctcaaattccagctaaaacctcctccccttccagctgtgtctctcacccaagagtaacttctaactctcgtat

SEQ ID NO: 65033 - DNA, 201 bp, Homo sapiens
aaattagctgggtatggtggcatgcgcctgtagtcccagctactcaggaggctgaggcatgagaatcccttgaaactgggaggtggaggttgcagtgagcygagattgtgccactgcactctagcctgggcgacagagggagactgtgtctcaaaaaaaaaagatttgatttcttattgacaatttttagtacaaatttta

SEQ ID NO: 65034 - DNA, 201 bp, Homo sapiens
gaccccggcctcccagcctgtccccagtcctggaccgtttgaccagaatcctgcctgctccggcgcttgtgagccagggcttcccaaggaccacgcttctrtgtctccctcagactcctgcgaggggctgatggtgaagaccctggatgttgatgccacctacgagatcgccaagagatcgcacaactggctcaaggtgat

SEQ ID NO: 65035 - DNA, 201 bp, Homo sapiens
gagatagacactattatgtctcccattttccacatgaggaaactgaggccacagaaaggtgaagtcactcactcaacagcatccaccaagcatcagcagcrcaatggcccagagtccatgctctcgaatcctgtaacagctatcacttaaccagccaccccatgttccaggcaccagggttatgtgtttttctcatgtatg

SEQ ID NO: 65036 - DNA, 201 bp, Homo sapiens
tgtcgctcaggctacagtgcagtggcacagtttgggctcactgcagtctccacctcccaggctcaagcgattctcccacctcagcttcccgagtagctggrattacagacacaccaccacgcccagctaatttttgtatttttagtagagacagggtttcactatgttgaccaagctggtctcgaactcctgagctcacat

SEQ ID NO: 65037 - DNA, 201 bp, Homo sapiens
gaaaggctgagcaattctgttccagggagggaagttctgagagagagggatgggggaggaactggagctggagagctgaagctgcagcagtggtgacttcragagagtcactgtgtaacctctggcaagggggaaggagtggacaggaagaaagttcttgtctggttccttgcaccctcagccccagcctcctccttcata

SEQ ID NO: 65038 - DNA, 201 bp, Homo sapiens
ctcccgggttcaaacgattctcctgccttagcctcctgagtagctgggactacaggagcccgccaccatgcctggctaatttttgtatttttagtagagayggggtttcactatgttggccaggctggtctcaaactcctgacctcgtgatccgcctgcctcagcctcccaaagtgctgggattacaggcgtgagccaccg

SEQ ID NO: 65039 - DNA, 201 bp, Homo sapiens
cccatttattcttgatcgttcaggttttcaagatctttatgttttcaacggccggtgtgtattgagaaaggctgagcaattctgttccagggagggaagtkctgagagagagggatgggggaggaactggagctggagagctgaagctgcagcagtggtgacttcgagagagtcactgtgtaacctctggcaagggggaag

SEQ ID NO: 65040 - DNA, 201 bp, Homo sapiens
tggcatgatctcggctcactgacctccgcctcccgggttcaaacgattctcctgccttagcctcctgagtagctgggactacaggagcccgccaccatgcytggctaatttttgtatttttagtagagacggggtttcactatgttggccaggctggtctcaaactcctgacctcgtgatccgcctgcctcagcctcccaa

SEQ ID NO: 65041 - DNA, 201 bp, Homo sapiens
cagtggcatgatctcggctcactgacctccgcctcccgggttcaaacgattctcctgccttagcctcctgagtagctgggactacaggagcccgccaccakgcctggctaatttttgtatttttagtagagacggggtttcactatgttggccaggctggtctcaaactcctgacctcgtgatccgcctgcctcagcctcc

SEQ ID NO: 65042 - DNA, 201 bp, Homo sapiens
ctggagtgcagtggcatgatctcggctcactgacctccgcctcccgggttcaaacgattctcctgccttagcctcctgagtagctgggactacaggagccygccaccatgcctggctaatttttgtatttttagtagagacggggtttcactatgttggccaggctggtctcaaactcctgacctcgtgatccgcctgcct

SEQ ID NO: 65043 - DNA, 201 bp, Homo sapiens
gtgtgagccaccatgccaggccccaacattttatatttagttgtttgcttaatatttctgcccttcaccagagtgttagcttcttgaaggcaggaacttcrtgtgtctgggtcactgccaaacccctcaggcccagaacaggccctggcacataataagtgcttaggtaggccgggcgcagtggctcacacctgtaatccc

SEQ ID NO: 65044 - DNA, 201 bp, Homo sapiens
tgggggctaccggaaggagaaaagacccactgttttctgtcttcattcctagccccccggaagccagcagtcaaaaaagaagtgaaggaagaggagccagrggctccaggaaaggagggagctgctgaggggtgagtcagtgtccaggtctggaaaggttcttcgggatgtgttcccttctctgcattccgacagccccac

SEQ ID NO: 65045 - DNA, 201 bp, Homo sapiens
tttttccttttctttttgaagattaaataaacctcttattctggaataattttagaggtacaggaaagttgcaaagacagtacagagaggtcctgtatacycttggccagtttccattgtcaatatcatacattactatgatccgtttctcaccactgagatactaatgtcagtacattactcttaactgaactccatact

SEQ ID NO: 65046 - DNA, 201 bp, Homo sapiens
ttctttttctttttctttctttttctttcttttttttttttttgagacagagtgttactctgttgcccaggctagagtgcatgatctcactgcaacctccrcttcctgggttcaagtgattctcctgcctcagcctccccactagctgggattacaggtgtgcaccaccatacctggctaatttttgtatttttagtagag

SEQ ID NO: 65047 - DNA, 201 bp, Homo sapiens
ttacttcctgctccccaactggccctgagaaactctgtttggaaattgctgagtttcttttttgtttgtttttgttttgttttttttttttttaagacggrgtctcgctctgtcgcccaggctggagtccagtggtgcagtctcagctcactgcaacctctgcctcctgggatcaagtgattctcctgcctcagcctcctg

SEQ ID NO: 65048 - DNA, 201 bp, Homo sapiens
gtttggaaacgggtctgaggctcaccaggtctggctcagagcccagggttcgggctggtcagtgtaggagggatgaccacccactggtgggttctcatccrcctggggagaggatgtgctgggagcactggagctggcttagggccatgggcaccaacatttagggaagtcgggggtttcaggctttcatgagaggacaga

SEQ ID NO: 65049 - DNA, 201 bp, Homo sapiens
gaaaagaggtgacacacagtatctggtgacaagggtgtgttggttctgataggttgagagctgcttgtcacagctgtcaccgtgacttgaggctccatctscccagctcttacacccaggcgcccatgggacccagctctggacagtaagtggggccagagcacatcccacgtgtgtaagctggtggctccaaaacaagcc

SEQ ID NO: 65050 - DNA, 201 bp, Homo sapiens
ctcactggcagtgctgtgagtggggcgggccgctcatcccggaccccagacatcttggggacctgaggccacgcgtgtgtcaggaaggcttctgggtagaycatcagctgggtcgcatcagtccttctcatggggtgcacagcttcctctcctccttcctgcacccaagcctaggggagtctcctcttcagagtctagcag

SEQ ID NO: 65051 - DNA, 201 bp, Homo sapiens
tcaagattttctcactcattcactcaagatgtgtttcgggagcactgacgtcataccagacccagcacacacggggtcggttaagaatactctgagctgcrggtaacagaaaacccaactacattggcttggacaaagaaggatctgtttttctcacaaaagaagttgcagatgctggctttcctgcccaacaatccatgg

SEQ ID NO: 65052 - DNA, 201 bp, Homo sapiens
ttatagcgaggaccccctactcattcacagaggttccctgcagagcgtcccaccccagtgatgcccagtgcatagcactgccccaccctggtccttctcarcagcatgttagcatcgctggtccctgccagcccccttctctgtccccatttcctcttctctccttgtcctcctcacccccagcactcgcccctgtgtatt

SEQ ID NO: 65053 - DNA, 201 bp, Homo sapiens
agggggactgtggttggagggaccagaaggacaggagctcagccagagaaaatgcagaggtcaggtggatcggagagatggtggagagaggctgtgaaacrgggttgaggagaaggctgagagggaggagagcctgatggggacagatttgcaggggtgtgggagagaacacaggggcagcagttcaggtgagggaggacc

SEQ ID NO: 65054 - DNA, 201 bp, Homo sapiens
tgtttcgggagcactgacgtcataccagacccagcacacacggggtcggttaagaatactctgagctgcaggtaacagaaaacccaactacattggcttgsacaaagaaggatctgtttttctcacaaaagaagttgcagatgctggctttcctgcccaacaatccatggcagctggggcctcttccactgtctcatgcct

SEQ ID NO: 65055 - DNA, 201 bp, Homo sapiens
cacttccctagtgaccttgtcccgcctgtggctttaaatcccatccgcgccctgatgacaccggcccagatgtctcccctgagtgtggtcatgctcgttcwtccaccgctttcctggctccacgtgcatgtttgctgacttcctacagccagcgtggctgggggcacgttccccaagccatttctaccaagtgggtgagcg

SEQ ID NO: 65056 - DNA, 201 bp, Homo sapiens
agagcctttctctttgcctgcccctaattaaataggaaataagttatttaagaaagcagggggcacggtgcccatcattctgcctgttagagacagtgacrgagagaggcacagttcagtgcacgtgttaggggagctcctgttccgtgccaagcactgttctttaaatcaattttcttaagatgtaatttccctaaaagt

SEQ ID NO: 65057 - DNA, 201 bp, Homo sapiens
tgtcaccctggctgctatggggaagctggattggaggggatcggtgcaggacagggaagcccagtaggcgaggctgagcagggagttggtgggaagtggayggcttaggaaatcatcaggttcactgaggaactgaatgtgggtgacaggaggagggagatgacaagagctcctaggtttccagcttgtgagaccaaatat

SEQ ID NO: 65058 - DNA, 201 bp, Homo sapiens
gaactgtgccatgtcactgccattagctgcagaaaagtctaggagagcaaatatctggtgaaggggaatgaggttgtcggaattagctgagagccgttaasgatccagcacctggagccagcagcatggccgccctcacagatgggcagccagttaggtggcgagagggagaccggtagatgaatgctgtcggcctcaggc

SEQ ID NO: 65059 - DNA, 201 bp, Homo sapiens
aaatggtgtcgggccctcttgccagtgactagccccatgctttaagctctcagaatccttctgacatcagggttcttccctctcaaggctttccacgaacsctgtcactagttgtgacccgcacatgtcctgttcgcctcacatttagggcttattgtctttattctcacaaagatgtctcatctctcttctccctgccgg

SEQ ID NO: 65060 - DNA, 201 bp, Homo sapiens
ctccctggacaccaaggacatcgagcagatcgccgagttcctggagcagtcagtgaaaggtgagggtgctcacttttctctcctgaggtctgcagcttgcrctgaccccggcctcccagcctgtccccagtcctggaccgtttgaccagaatcctgcctgctccggcgcttgtgagccagggcttcccaaggaccacgctt

SEQ ID NO: 65061 - DNA, 201 bp, Homo sapiens
aaagcatctgtgtgcacctgcctctttgttagtgcatcttgagagctgcagaaggaaaagggaatttatctccccgtgtttgtctttccacctcatcttcyacctctctcaggccctgggtctctcccttcacttttcagattaaactcccatcggtcacatccttcatcctggacaccgaagccgtggcttgggaccggg

SEQ ID NO: 65062 - DNA, 201 bp, Homo sapiens
attaaactcccatcggtcacatccttcatcctggacaccgaagccgtggcttgggaccgggaaaagaagcagatccagccattccaagtgctcaccaccckcaaacgcaaggtagcatcacccgctccactgcctgccaaggccccgtacttcctcatcttccacccagtcctggctgtgggtcctgcccagtgcccagaa

SEQ ID NO: 65063 - DNA, 201 bp, Homo sapiens
ggtgggagatgccagggtctctgatcaggtaccacgtggcaagccccgtgaatgttagaaaaaactgtcagtgggatccagcagctgcccccggcaagccrgctgtgcctccagtcatgcagtgccctctgcttccctccattggcactgcctgatgcccaggtggcgccagagcaagaagaagatttgtggagtcccggt

SEQ ID NO: 65064 - DNA, 201 bp, Homo sapiens; identical to SEQ ID NO: 13601

SEQ ID NO: 65065 - DNA, 201 bp, Homo sapiens; identical to SEQ ID NO: 13602

SEQ ID NO: 65066 - DNA, 201 bp, Homo sapiens; identical to SEQ ID NO: 13603

SEQ ID NO: 65067 - DNA, 201 bp, Homo sapiens
gcacatcacagttggaaggaatgactttgctttgacccagggctctatgcaattcaatctccgttttgcctccgtagacccctggatccatctggttacartcctgccaagaacaactatcatcccgtggaagatgcctgctggaaaccgggccagaagtgaggtttctcccttttcagactgtccccctccggtccctgt

SEQ ID NO: 65068 - DNA, 201 bp, Homo sapiens
gagaattgcttgaacctgggagatggaggttgtggtgagccgagatcgtgccattgcactccagcctgaacaacagggcaagactccatctcaaaaaaaaraaaaaattatctgagacctgtatctccatcagggtctcaatgggagacagaaaccataccagtgatttgaacagagggagtttaaaggatggtcactagg

SEQ ID NO: 65069 - DNA, 201 bp, Homo sapiens
tgagagggaggagagcctgatggggacagatttgcaggggtgtgggagagaacacaggggcagcagttcaggtgagggaggaccaggcatgtgctgggacrgggggtgtggggtgcagggaaggggagggctggggaaagatgctggaggcagagacagcaggatttgggggctgagatggaaggttggggcttagagagg

SEQ ID NO: 65070 - DNA, 201 bp, Homo sapiens
ctcttcattttggtaaccgctttattgagatataattcacaattatacagtttgcccatttaaagtgtacaattttgcccatttaaaatgtacaagtcagyggttttcagtgtatttaaagtgtatttcagtgtatttaaagtgcccatttaaagtgtacaagtcagtggttttcagtgtatgcgctgagttgtgcagtta

SEQ ID NO: 65071 - DNA, 201 bp, Homo sapiens
agcaagggaggtggccagggaaggtacaggtgtgcagctgtgtcccagggatgacccggggacccaggttcctgtgtccctctgccctccaaaggttgtcrccccaatgtctgtgatcaaatgtggctcacttccctgttctaattgtgggaggagggacgcagaggagggaggggaggcaaccagattccttgcaaggat

SEQ ID NO: 65072 - DNA, 201 bp, Homo sapiens
aagtctaggagagcaaatatctggtgaaggggaatgaggttgtcggaattagctgagagccgttaaggatccagcacctggagccagcagcatggccgccytcacagatgggcagccagttaggtggcgagagggagaccggtagatgaatgctgtcggcctcaggcacagtgccccgtctcaccttcctgcactcacgaa

SEQ ID NO: 65073 - DNA, 201 bp, Homo sapiens
ccctaaccttcctagcggcatggctacagatgaatgactcagcctctctgtgtgtcagtttcttgatctacagtaaggagctaacagtggcaggtgctttrtctgttagggtgagggctaaacagtgggataggggtgtggaactcagtagttagtacatggaagctctcaaaaaaaattagctgcaatcatcaatatccc

SEQ ID NO: 65074 - DNA, 201 bp, Homo sapiens
agtggcaggtgctttgtctgttagggtgagggctaaacagtgggataggggtgtggaactcagtagttagtacatggaagctctcaaaaaaaattagctgyaatcatcaatatcccagataatcttttttttttttttttttgagatggagtctcactctgttgcccaggctggagtgcagtggcatgatctcagctcact

SEQ ID NO: 65075 - DNA, 201 bp, Homo sapiens
gggaccgatcgaacaaaagagaaaagcaattcaaagccacaagacggattagtcagtgttgacatgtggagacaactgctttgtcctttgtttaaaaacaytcagatcacctccttcctctctgacacacactcttgcaaggtccagctggaactgatttcaaagcaaaacacaaaactgtaaatgtgctggaaaaactca

SEQ ID NO: 65076 - DNA, 201 bp, Homo sapiens
gatgacaccggcccagatgtctcccctgagtgtggtcatgctcgttcatccaccgctttcctggctccacgtgcatgtttgctgacttcctacagccagcrtggctgggggcacgttccccaagccatttctaccaagtgggtgagcgttagacacagggaggtgcagggactcgccacaagcacacacagctggagaaaa

SEQ ID NO: 65077 - DNA, 201 bp, Homo sapiens
gtgaggctacagagggggactgcaggctcggaggtgaaaggagggagggactggcagctggaatcatcacaaatgccctgaccatccttggatgagaaaarcatgagcaggaggcccagcccctaaagagtgggaagggacaccatttcctttcacaggccagcttctgtcccttggtagtgctgtctagagaaggcccct

SEQ ID NO: 65078 - DNA, 201 bp, Homo sapiens
ataaaactggatcttcctcttgaaggtttcaggaagtcagtgggggttccgtgccgggagtcacaggttgtcattgtgcgaagctcctggggtttcccctygagtggaggacgggtgtgttgagggccagcgagcaggagcctgtcatcagtaagagttgatggatgtttgagtggagaggggcagtgaggggtggacaag

SEQ ID NO: 65079 - DNA, 201 bp, Homo sapiens
gccatggtggatgctgggaagggcaagacagcagaggccagaaagacgtggctggaggagcaaggcatgatcctgaagcagacgttctggtgagagctggrcagtgggtggagttgccaggggctgtgggcagagtgccagggtgggggtggagccagaggagcagtgggtggggccagtgaagtgacggacaggcatcac

SEQ ID NO: 65080 - DNA, 201 bp, Homo sapiens
ttgttctcacccgccaccccagcgaggttcccgacctggaccgaattatccccgtgctgctggagcacggcctggaacgtctcccggagcactgcaagctsagcccaggtacaggccccaggggcgctcaccagcctggcagcagccctgctccctcctgagtcggcgtgagggtggccatcgtaggcgcccctctcagaa

SEQ ID NO: 65081 - DNA, 201 bp, Homo sapiens
cttatcagttaagttaaagggcttatttgaaattctctgttatgtgctgagatggaaatggtgttagaagttataggatgcggccgggcgcggtggcttaygcctgtaatcccagcacattgggaggccaagcagatcacaaggtcaggagatcgagaccatcctggctaacacggtgataccccatctctactaaaaata

SEQ ID NO: 65082 - DNA, 201 bp, Homo sapiens
gagaatcgcttgaacctgggaggcagaagttgcagtgagccgagatcacaccattgcactctagcctgggcaacagagcgagagtctgtctaaaaaaaaaagatttaaaaagtgcatagttaatatttgttgaataaaacttgggatgtatcatatcttgcaggtgcgttagggcagaaaaattagtgttgcctcctttgt

SEQ ID NO: 65083 - DNA, 201 bp, Homo sapiens
tcggcctcccaaaatgctgggattacaggcatgagccaccgtgcccggccccatttgttcttatttaaacctagaaacccttcccatgtccagtctcttcycaggggccatccttggggttccttctggaagttcccttcagacttacttctagtccctcctcagtccactgaggagcccctccccagcagtgagggcccc

SEQ ID NO: 65084 - DNA, 201 bp, Homo sapiens
caggggccatccttggggttccttctggaagttcccttcagacttacttctagtccctcctcagtccactgaggagcccctccccagcagtgagggccccrccttgggcgctcccccttctcatctcttgcctccccttctcccagctgaagaaggactaccttgatggcgtgggtgacaccctggacctggtggtgatcg

SEQ ID NO: 65085 - DNA, 201 bp, Homo sapiens; identical to SEQ ID NO: 13618

SEQ ID NO: 65086 - DNA, 201 bp, Homo sapiens; identical to SEQ ID NO: 13620

SEQ ID NO: 65087 - DNA, 201 bp, Homo sapiens; identical to SEQ ID NO: 13621

SEQ ID NO: 65088 - DNA, 201 bp, Homo sapiens; identical to SEQ ID NO: 13622

SEQ ID NO: 65089 - DNA, 201 bp, Homo sapiens; identical to SEQ ID NO: 13623

SEQ ID NO: 65090 - DNA, 201 bp, Homo sapiens; identical to SEQ ID NO: 13624

SEQ ID NO: 65091 - DNA, 201 bp, Homo sapiens; identical to SEQ ID NO: 13625

SEQ ID NO: 65092 - DNA, 201 bp, Homo sapiens; identical to SEQ ID NO: 13626

SEQ ID NO: 65093 - DNA, 201 bp, Homo sapiens; identical to SEQ ID NO: 13627

SEQ ID NO: 65094 - DNA, 201 bp, Homo sapiens; identical to SEQ ID NO: 13632

SEQ ID NO: 65095 - DNA, 201 bp, Homo sapiens
cacccagtaggggtctcgtgcctgttcgaggagtcccctatcaaagagcctttctctttgcctgcccctaattaaataggaaataagttatttaagaaagyagggggcacggtgcccatcattctgcctgttagagacagtgacggagagaggcacagttcagtgcacgtgttaggggagctcctgttccgtgccaagcac

SEQ ID NO: 65096 - DNA, 201 bp, Homo sapiens; identical to SEQ ID NO: 13639

SEQ ID NO: 65097 - DNA, 201 bp, Homo sapiens; identical to SEQ ID NO: 13640

SEQ ID NO: 65098 - DNA, 201 bp, Homo sapiens
tctaggccagtgtggcacagtgcggggtttattgggaggagatcaggttgcgtttggctgcaaatgacagagcactcagtcctgcgtggtgtaagcccatrtgattttttctcacatctagaggtgggcaccccagcaccgacttggctgagcactgatgtccccctgaaccaagcttatcgctacctctatcccctgctg

SEQ ID NO: 65099 - DNA, 201 bp, Homo sapiens
tggacacctcccacccacaacccctcccccgccgtggactgcagctgggagtcactgtccagcactgggttccatggccaccctagtgcaacaaagcctcrgaaagccagagtctaactctgcagcctctccagccaggaacgcggggaggaggagtcaggacgagtttggagggggccagcctgtggataggccccaagc

SEQ ID NO: 65100 - DNA, 201 bp, Homo sapiens
gctttcttccatgctttgctcagatatcacttcctcagcgaaactttcctcaccacctatgttagcttcccatttgctgccataacaattgaccacaaacrcagtggcttaaaacagtgtcagtttattgtcttacagtttgggagtcgtgagtctcaaatgggttgcactgggctaaactcaaggtgtcagcaggtctgc

SEQ ID NO: 65101 - DNA, 201 bp, Homo sapiens
tactctagcctgggtgacagtaagactccatctcaaaaaaataaaaataaaaaatcaaatatttccttgtgtccctggccaagcaaggccccctcctctgyccaacaccatgcatccaccagaggcaaccccaggtctgctttttggtcgccacaggttggttttacctgttctagagcttcctgttggtggtataatatg

SEQ ID NO: 65102 - DNA, 201 bp, Homo sapiens
cagagagtcctgcagctggctctgtaaattatatgtggagatccgggctccacaggaaaggaccagcattctgtgagcctatgtaacaaacaggcctggcyggtgacagtggctcctgtaatcccagcactttgggagggcaaggcgggtgaatcacttgaggttaggagttcgagaccagcctggccaacatggtgaaac

SEQ ID NO: 65103 - DNA, 201 bp, Homo sapiens
aggcgggtgaatcacttgaggttaggagttcgagaccagcctggccaacatggtgaaaccctgactactaaaaatacagaaattagctggatgtggtggcrtgctcttgtagtcccagctacttgggaggctgaggcaggagaatcacttgaacgtgggaggcagaggctgcactgagcggagattgcaccactgcacgcc

SEQ ID NO: 65104 - DNA, 201 bp, Homo sapiens
gagggaaaagaaggcttgccagtggaggagacagacaggggcaggggttctagagggaacggcacatgcaaaggcccagtagtggaagaggcattgcccayttatttgagaaacagagaggctcacgtgctggggtgaagagaggctcagggggccaggtgaggcgagggacgacccaggctgacccgggagagtcccccc

SEQ ID NO: 65105 - DNA, 201 bp, Homo sapiens
acttccctggttttctgtggatactgcgtagaccagagtggggtgggggccatgagtgtacacagctttagatggcaggagcaagtgctgggcctgtggcyggctgagcctctgacctcccgcttcctccctgcagcttggaactggcttcagtgacgaggagctggaggagcatcaccagagcctcaaggtgagccatgg

SEQ ID NO: 65106 - DNA, 201 bp, Homo sapiens
gacaagagctcctaggtttccagcttgtgagaccaaatattacattctcagagacattagtttctgtctcctcttggtggggaataaaagaaaagcatctrtgtgcacctgcctctttgttagtgcatcttgagagctgcagaaggaaaagggaatttatctccccgtgtttgtctttccacctcatcttccacctctctc

SEQ ID NO: 65107 - DNA, 201 bp, Homo sapiens
tgtacacagctttagatggcaggagcaagtgctgggcctgtggccggctgagcctctgacctcccgcttcctccctgcagcttggaactggcttcagtgaygaggagctggaggagcatcaccagagcctcaaggtgagccatggcggctgcgcctcagcctccacccctctcccccctgcccctgacagcacagtccttc

SEQ ID NO: 65108 - DNA, 201 bp, Homo sapiens
gcttccaccatcttggggctccaggtgtgggcaggagggcagcaggcagtggagctggctttggagtccagcatctccaggttcatgtctcagcactgccrgctactagctggtgaccctgctcaagcagcctcacctccccaagccctgtgcctcattcacaccaggggttagccaaaggacacagcaggtgccatagct

SEQ ID NO: 65109 - DNA, 201 bp, Homo sapiens
tgtttttttcccttcctccctctccccagccctccaacacttggccttgactttgagattccagaccctctgttcctctcttcctctgctcactgcaggcsctggtgctgcccagcccacgcccttacgtgcggatagatggcgctgtgattcccgaccactggctggaccccagcgctgtgtgggaggtgaagtgcgctg

SEQ ID NO: 65110 - DNA, 201 bp, Homo sapiens; identical to SEQ ID NO: 13649

SEQ ID NO: 65111 - DNA, 201 bp, Homo sapiens; identical to SEQ ID NO: 13650

SEQ ID NO: 65112 - DNA, 201 bp, Homo sapiens; identical to SEQ ID NO: 13652

SEQ ID NO: 65113 - DNA, 201 bp, Homo sapiens; identical to SEQ ID NO: 13653

SEQ ID NO: 65114 - DNA, 201 bp, Homo sapiens
tgatttaatactgaaaactgaaatacctcgaactagtagttcacacactggccagcaggtgtcgctgggtttcctttgaaaaatctaaaatatcttgcagygcccagtgagttccctgcatgttggtgaacccaccgaaaacagccataaagatctgatcgattgatcatctggggcctgcatgagattacaccaattgca

SEQ ID NO: 65115 - DNA, 201 bp, Homo sapiens
tcccaggcccctcctgctgctcctctcttcccccgcccatcacatctgcagccgcatccacagctcctcctcagctcgctccatcctggcttcccacaccyaccaggtgcacttccacctctgggccactaccttctttcccagcctaaaactctctttcccagatacacgcctggctcagtcccctgctttcttccatgc

SEQ ID NO: 65116 - DNA, 201 bp, Homo sapiens
tttttttttttttttttttttttttgagacagagtctcactctgtcatccaggctggagtgcattggcatgatcttggctcactgtaacctccacctcctrgcttcaagtgattctcctgcctcagcctcccaagtagctgggactacaggcgcccgctaccgtgcccggctaattttttgtatttttagtagagacgagg

SEQ ID NO: 65117 - DNA, 201 bp, Homo sapiens
aatgctccagagtgacccccgagatgcgaggcagctggggtatttatacaccaactcctgccgatcgtggggtgagggcctctcctggggctagtttattycctgccacttccagacttctgaggttccggggaagctgtctggaacacttggaggcagttaagatctgaggggagcagtggggagctcaggggacctgct

SEQ ID NO: 65118 - DNA, 201 bp, Homo sapiens
ttcaaggtccctctctttccaactccacattggcgtgaggtggatcttcctcaggtcctgcaacgagaagagtgtgtcgtagaagcacgcaggagaatccrgcctctgttaagccagatattagaggatttgcaaaagtgtaaaataatgcctctagtctcaccactttctcaaaacttgggttatgtttcatcaaaatat

SEQ ID NO: 65119 - DNA, 201 bp, Homo sapiens
tggctgagggcatgctgggagctccaggtggacgctgaggttggccctgggggtgtgtcaggggatcttgttcagagggagcaacattgagctatgtcccraacctcacatgctgaggcctggaggggtgacacagcttggtgtgtctggaaacaccccagtttagcagtgatataaaagaaggtggagtatgtggtgtgg

SEQ ID NO: 65120 - DNA, 201 bp, Homo sapiens
tcacgcctgtaatcagagcactttgggaggtgggaggatcgcttgagcccagtagttcaagaccagcctgggcaatatagaaaagaccttgtgtctattcmaaaaaaaaaaaaaaattaatattatttgggtgagcatattggatttatttttttaatttctcattttaaatttctaataggtgtaactataatattatgt

SEQ ID NO: 65121 - DNA, 201 bp, Homo sapiens
ggtgtccaacttgagatgtgcagtgagttcattggattttgaagacctagcatgaaaacagaatgttggaatcatactgttttagatgtattgagcaaaayagactcttcaaaccaagttcaacctggttttttccccctttttattaacgtggctgcaagaaagtttaaggttacatacgtggcttgccagatctttcca

SEQ ID NO: 65122 - DNA, 201 bp, Homo sapiens
ctttccaaagcgctgagattacaggcatgagccactgcagtagcctacatttctaattttagagcttctagtagccatattaaaaggtaagaagaaacagrtaaaatcatattttctttaatccaatgtctaagatattatcctttcaatgtgtgatgaatataagaaattattaacatggaattttacactcttttcttg

SEQ ID NO: 65123 - DNA, 201 bp, Homo sapiens
gaactgatttcaaagcaaaacacaaaactgtaaatgtgctggaaaaactcagtgaaaacttttggaattctaaggaaaggaggactttttttttttttttwaaattatcttggggatgaggctggatgcagtggctcacgcctgtaatcccaacactttgggaggctgaggtgggtggatctcttgtgatgtgcacctgta

SEQ ID NO: 65124 - DNA, 201 bp, Homo sapiens
tctcaaggctttccacgaaccctgtcactagttgtgacccgcacatgtcctgttcgcctcacatttagggcttattgtctttattctcacaaagatgtctyatctctcttctccctgccggccctgcagtccctggtacgtgagcccctttcccggcgccggcagctgctccgggagaactttgtggagacagagggcgag

SEQ ID NO: 65125 - DNA, 201 bp, Homo sapiens
tccagcacagacctttcctgtctcaggaaatagcactgttgtgcccccagggctgagcttctgcctggcacatggttagcacttagtgaacgtttctgaaygaatgggaaaatgctctccctttggaggagtggccagagtgagttggccacgtctctgtcctgagggaaagacggcggcaaggctgactcctgaggtccc

SEQ ID NO: 65126 - DNA, 201 bp, Homo sapiens
tctcattggccagaactgtgccatgtcactgccattagctgcagaaaagtctaggagagcaaatatctggtgaaggggaatgaggttgtcggaattagctragagccgttaaggatccagcacctggagccagcagcatggccgccctcacagatgggcagccagttaggtggcgagagggagaccggtagatgaatgctg

SEQ ID NO: 65127 - DNA, 201 bp, Homo sapiens
ctgccatgtgcctctggcctcatcatcacaatgtggctgcaggagttccagccctcatggccatgcctgctccacgcaccagggaagagcaaagggggttsgaccctgagtcagcctcagccagtgaacaccttctgctcaagttctgttgctcatcactttgctccatggctcacccctagctgcaaggaattctgggaa

SEQ ID NO: 65128 - DNA, 201 bp, Homo sapiens
atgtgcctctggcctcatcatcacaatgtggctgcaggagttccagccctcatggccatgcctgctccacgcaccagggaagagcaaagggggttggaccytgagtcagcctcagccagtgaacaccttctgctcaagttctgttgctcatcactttgctccatggctcacccctagctgcaaggaattctgggaaatgta

SEQ ID NO: 65129 - DNA, 201 bp, Homo sapiens
ttttgcattatttagaatagatttttaaatgagctattgtcaggacaaaaggcaaaaagaatccttaagactctcaatgcaaaaggggctttccaggtgaygtttatattggtgattattgcccacttgctgcgtatctgccagcatccagcattactgctaatttttagcctttcctattttggtaggtgaaagaagctc

SEQ ID NO: 65130 - DNA, 201 bp, Homo sapiens
gcgggtgcctgtaatcccggctactcaggaggctgaggtacgagaatcacttgaacccaggaggcagagattgcagtgagctgagatcacgctattacacyccagcctgggtgacagagtgagactctgtctcaaaaacaaacaaacaaaattatcatgggtacggctcattctgcttgccttcactatcaaacccgtttc

SEQ ID NO: 65131 - DNA, 201 bp, Homo sapiens
gtgtgagccaccgcgcccggccctaattttgtatttgtaatagagatggggtttcactatgttggccaggctggtcttgaactcctgacctcaagtgatcsgcccgcctcggcctcccaaaatgctgggattacaggcctgagccaccacacccggccctcttctgtattttgtaaggatgctttttggattcagagccta

SEQ ID NO: 65132 - DNA, 201 bp, Homo sapiens
tgctgggattacaggcatgaaccatcgtgcctggcctctagggtgtggtcttaactacctcaccagcttatccgaagctacaatcctccagagtcctgacygatgatagtgggagctcatgaaacgtgggctccgctgatgctgctggtgggtgtgttcattttaacagccgttctgggaggtgcctacatgaccccttca

SEQ ID NO: 65133 - DNA, 201 bp, Homo sapiens
tggggtttcactgtgttagccaggaagatcttgatctcctgacctcgtgatccgcccacctccgcctcccaaagtgctgggattacaggtgtgagccaccrcgcccggccctaattttgtatttgtaatagagatggggtttcactatgttggccaggctggtcttgaactcctgacctcaagtgatccgcccgcctcggc

SEQ ID NO: 65134 - DNA, 201 bp, Homo sapiens
ttgaggctgcagtgcgcattgctccactgcactctagcctgggcgacagtgagaccctgtctcaaaaaaaaatagaggttgggaactgtctctagagctgygctgcttaccagctgtgtggccatgggtgagttaatcactctgtgccccagtttccttatccggaaaaggaagttagaaaggtcccttctggccaggcac

SEQ ID NO: 65135 - DNA, 201 bp, Homo sapiens
cttgccatacagcaaaccacccactgcaccctggtgtagccaaggatgtgggtgccttccaaagcctctggtgggtcttttcttagaattcccaccagccrtggtggatgctgggaagggcaagacagcagaggccagaaagacgtggctggaggagcaaggcatgatcctgaagcagacgttctggtgagagctgggcag

SEQ ID NO: 65136 - DNA, 201 bp, Homo sapiens
ggattggggatggtgagcaatgaggtgagaaggtcctggaaaaccagcttggggaacagcgtctttgtcctaagggggacttggaatgtttgctgtggggkaagaacagggcgagagacccattcgtaatgcggggcagtgtgagcccttgccgtccggtctagcctattgagcgctttagcgtggtgagtgtgacagggg

SEQ ID NO: 65137 - DNA, 201 bp, Homo sapiens
ggcaacaagcaaaggaggaggggagcatgctaggcaaggggaacatagaaattgagaaggcctgggggctgctgagggcctggtgtgctggcgtgtagagygcaggattggggatggtgagcaatgaggtgagaaggtcctggaaaaccagcttggggaacagcgtctttgtcctaagggggacttggaatgtttgctgtg

SEQ ID NO: 65138 - DNA, 201 bp, Homo sapiens
ctgaaggagtggaatggagtggtgtccgagagtgactctccggtgaagaggccagggaggaaggcggcccgggtcctgggcagcgaaggggaagaggaggrtgaagcccttagccctgctaaaggccaggtaggtccccatcaccctgcccatttttaccagaagaaactaattcccattaacctttggaacagagtgcag

SEQ ID NO: 65139 - DNA, 201 bp, Homo sapiens
ggaagagttttgggcagaagagaggcagagatcatttagtcctgggcagtgtttaaaatattcatctggccaggcacgatggctcacgcctgtaatcccarcactttgggaggccaaggcgggtggatcacgaggtcagaagttcgagagcagccaggccaacatagtgaaacctcatctctgctacaaaagttagccggg

SEQ ID NO: 65140 - DNA, 201 bp, Homo sapiens
caaagccaggccttgtggaaacctcccaggcccctcctgctgctcctctcttcccccgcccatcacatctgcagccgcatccacagctcctcctcagctcrctccatcctggcttcccacacccaccaggtgcacttccacctctgggccactaccttctttcccagcctaaaactctctttcccagatacacgcctggct

SEQ ID NO: 65141 - DNA, 201 bp, Homo sapiens
ctgctgggagaacattcccacccgggagtctctggatggatgctccgcacccccagctccctacttccctggttttctgtggatactgcgtagaccagagyggggtgggggccatgagtgtacacagctttagatggcaggagcaagtgctgggcctgtggccggctgagcctctgacctcccgcttcctccctgcagctt

SEQ ID NO: 65142 - DNA, 201 bp, Homo sapiens
acaaccagaaaatgttcattggatgcttgaaaggaagggaaggaaacagcaaagaaaccaaagtgtttgcgggcagtgcccccactctgcctgctgtagtygcccctttacacccccatttccccaccttccagggcggcactgaaggagtggaatggagtggtgtccgagagtgactctccggtgaagaggccagggagg

SEQ ID NO: 65143 - DNA, 201 bp, Homo sapiens
tcactctcacccaggctggagtgcaatggtgtgatctcggcccactgcactccagcctgggcgacagagcaagattccatctcaaaaaaaaaaaaaaaaaaggcatcccaatagatgctggagaccaatggcaaccttaggcagggactccatttgctcctcagcatcacccatcacagggcaggcactctggagacttcc

SEQ ID NO: 65144 - DNA, 201 bp, Homo sapiens; identical to SEQ ID NO: 13702

SEQ ID NO: 65145 - DNA, 201 bp, Homo sapiens; identical to SEQ ID NO: 13703

SEQ ID NO: 65146 - DNA, 201 bp, Homo sapiens
ctcccagcagtttgggaggccgaagcgggtggatcacttgaggtcgggagttggagaccagcctggccaacatggtgaaaccccatccctaccaaaattayaaaaattagctgggtatggtggcatgcgcctgtagtcccagctactcaggaggctgaggcatgagaatcccttgaaactgggaggtggaggttgcagtga

SEQ ID NO: 65147 - DNA, 201 bp, Homo sapiens; identical to SEQ ID NO: 13704

SEQ ID NO: 65148 - DNA, 201 bp, Homo sapiens
caaagatcagtcgggcatggttgcttgcacctgtagtcctagctactcaagaagctgaggtaggagaatcccttgagcccaggaggttgaggctgcagtgygcattgctccactgcactctagcctgggcgacagtgagaccctgtctcaaaaaaaaatagaggttgggaactgtctctagagctgcgctgcttaccagct

SEQ ID NO: 65149 - DNA, 201 bp, Homo sapiens
acccaccctgcccagcaggcttccctcaggccccaactcctattgcacctgcttagggaagccgggtgcctctcccttcatgtgtgagaggaggtgcgtgyccccagcacttgagtcagactgtcttttatgtcttgtcacatggtaaagagcctccctaaccagacataagctccttcccacagagccagggctgtggga

SEQ ID NO: 65150 - DNA, 201 bp, Homo sapiens; identical to SEQ ID NO: 13706

SEQ ID NO: 65151 - DNA, 201 bp, Homo sapiens
aacccaccctgcccagcaggcttccctcaggccccaactcctattgcacctgcttagggaagccgggtgcctctcccttcatgtgtgagaggaggtgcgtstccccagcacttgagtcagactgtcttttatgtcttgtcacatggtaaagagcctccctaaccagacataagctccttcccacagagccagggctgtggg

SEQ ID NO: 65152 - DNA, 201 bp, Homo sapiens
cctaacccaccctgcccagcaggcttccctcaggccccaactcctattgcacctgcttagggaagccgggtgcctctcccttcatgtgtgagaggaggtgygtgtccccagcacttgagtcagactgtcttttatgtcttgtcacatggtaaagagcctccctaaccagacataagctccttcccacagagccagggctgt

SEQ ID NO: 65153 - DNA, 201 bp, Homo sapiens
actggccacgtcttgatgctgtctcatctaagtagaagacaacagtactcttttttttttgaaatggagtctcactctcacccaggctggagtgcaatggygtgatctcggcccactgcactccagcctgggcgacagagcaagattccatctcaaaaaaaaaaaaaaaaaaggcatcccaatagatgctggagaccaatg

SEQ ID NO: 65154 - DNA, 201 bp, Homo sapiens; identical to SEQ ID NO: 13720

SEQ ID NO: 65155 - DNA, 201 bp, Homo sapiens
accgtgttagccaggatggtcttgatctcctgacctcgtgatccgcccacctcggcctcccaaagtgttgggattacaggtgtgagccaccatgccaggcmccaacattttatatttagttgtttgcttaatatttctgcccttcaccagagtgttagcttcttgaaggcaggaacttcgtgtgtctgggtcactgccaaa

SEQ ID NO: 65156 - DNA, 201 bp, Homo sapiens
actacaggcgcctgccaccacacccagctaattttttttgtatttttagtagaagcagggtttcaccgtgttagccaggatggtcttgatctcctgacctygtgatccgcccacctcggcctcccaaagtgttgggattacaggtgtgagccaccatgccaggccccaacattttatatttagttgtttgcttaatatttc

SEQ ID NO: 65157 - DNA, 201 bp, Homo sapiens
tgcctggctcagtttcctcatctgtcacatggggctgtgtgatatctggggtcccttccaggctctgaagattcttctggtttttgaggagagggtctacrtacatcaaggtcgaggagatcagagaagggaggaggcaagattggggaggtgcagacaagcccccttccctggcctgctctctccccaggtccctgagcg

SEQ ID NO: 65158 - DNA, 201 bp, Homo sapiens
atacaaaaattagccaggtgtggtggtgggcgcctgtaatcccagctccttgggaggctgaggcggaaggctctcttgaacccgggaggtggaggttgcaktgagcagagattgcaccactgctctccagcctgggcgagactccgcctcaaaaaaaaatcagaatgagatctagagcataatgacatttaaacaaatcag

SEQ ID NO: 65159 - DNA, 201 bp, Homo sapiens
agagaggtcctgtatacccttggccagtttccattgtcaatatcatacattactatgatccgtttctcaccactgagatactaatgtcagtacattactcktaactgaactccatactttattattcagatttcaccagattttttttttaatgttcacgccttccaacatttttttttttttttttttgagacagagtct

SEQ ID NO: 65160 - DNA, 201 bp, Homo sapiens
tctggggtcccttccaggctctgaagattcttctggtttttgaggagagggtctacatacatcaaggtcgaggagatcagagaagggaggaggcaagattsgggaggtgcagacaagcccccttccctggcctgctctctccccaggtccctgagcggacggctgcgccttgggctggcagagcagtcggtgctggctgcc

SEQ ID NO: 65161 - DNA, 201 bp, Homo sapiens
gatgctatatatgccgccctgctcaagggctgtgaccggactgtcttaaaataaatagacatagaggctgggcgcagtggctcacgcctgtaatcccagcrctttgggaggctaaggtgggcggatcacctgaggtcgaaagttcaagaccagcctggctctactaaaaatacaaaaattagccaggtgtggtggtgggcg

SEQ ID NO: 65162 - DNA, 201 bp, Homo sapiens
acacagaagtgtccagagcaagggaggtggccagggaaggtacaggtgtgcagctgtgtcccagggatgacccggggacccaggttcctgtgtccctctgmcctccaaaggttgtcaccccaatgtctgtgatcaaatgtggctcacttccctgttctaattgtgggaggagggacgcagaggagggaggggaggcaacca

SEQ ID NO: 65163 - DNA, 201 bp, Homo sapiens
tataaagccgtcagatctcgtgagacttcctcactatcacgagaacagcacgggaaaaacctgcccccatcgttcagttacctcccaccaggtccctccaygacacatggggattttgggagctatgattcaagacaagatgtgggtggggacacacggaccctgacaccatctctgtcccactctttggttctctctctc

SEQ ID NO: 65164 - DNA, 201 bp, Homo sapiens
aacccaggaggcagagggtgcagtgagccaagatcgtgccactacactacagcctccacgataagagtgagactccatcttttaaaaaaaaaaaaaaaaaagggtggatccaacagacacaggatcagagatggatctccaaaatagtgttgagaaaaaagacacaagatgatttacgatagtgacaatgatttcttgaca

SEQ ID NO: 65165 - DNA, 201 bp, Homo sapiens
ttagagcccagtttcactggcccagcctgggccacatacctatccctgaaccagccacagggatgcagcctggatcacgtgtccacccctggtcacaggcraaagggccagcccactcaaatcgtgtgtactgagagaatgtggggtaagaagcatcccaagaggaaaacggaggggctgttaccaggaggaaaaaatgga

SEQ ID NO: 65166 - DNA, 201 bp, Homo sapiens
tactcttttttttttgaaatggagtctcactctcacccaggctggagtgcaatggtgtgatctcggcccactgcactccagcctgggcgacagagcaagaytccatctcaaaaaaaaaaaaaaaaaaggcatcccaatagatgctggagaccaatggcaaccttaggcagggactccatttgctcctcagcatcacccatc

SEQ ID NO: 65167 - DNA, 201 bp, Homo sapiens; identical to SEQ ID NO: 13724

SEQ ID NO: 65168 - DNA, 201 bp, Homo sapiens
gaggagggaggggaggcaaccagattccttgcaaggatgtgagccagacattgcacatgctgcgtgggttccaatcacatggcctttcccacctggaaggmaggccgggggctgtagtccccagtgggaggctaggtccccttctaaaacgtgggaggcttcgtgactgaatagcaagaaagcagaatggtcctggggccc

SEQ ID NO: 65169 - DNA, 201 bp, Homo sapiens
ccctgggaatctgtctctctccattgttcagctctactgtccttgaggttgtcctcaccctcaggcgggctctcccctcttagcggtccccttggaaagakggtgttagagcccagtttcactggcccagcctgggccacatacctatccctgaaccagccacagggatgcagcctggatcacgtgtccacccctggtcac

SEQ ID NO: 65170 - DNA, 201 bp, Homo sapiens
ggaggatcacttgagcccaggagttcgggaccagcctgggcaacatagtgagaccccacctctacaaaaacttttttaaaaaattagccaggcgtggtggygcatgcctgtggtcccagctacttgggaggctgaggcaggaggattgcttgagcccaggaggtggaggttgcagtgagccaagattgcaccactgcactc

SEQ ID NO: 65171 - DNA, 201 bp, Homo sapiens
gtcaggccagatagaatttctttctgtcacacagaagtgtccagagcaagggaggtggccagggaaggtacaggtgtgcagctgtgtcccagggatgaccyggggacccaggttcctgtgtccctctgccctccaaaggttgtcaccccaatgtctgtgatcaaatgtggctcacttccctgttctaattgtgggaggagg

SEQ ID NO: 65172 - DNA, 201 bp, Homo sapiens
cagtgtctggagatatttttggttgttacaacctagggacagagggtttgccattggcatctagtggctaaaagccaggcatgctgctaaacatccttcarttcataggacagcccccccaacaacacagaaccatcaggcccaacatgtcaatagtgtctaggttgagaaacctcgtgttaatgcagtccggcttcagga

SEQ ID NO: 65173 - DNA, 201 bp, Homo sapiens
atgggccagaaggcagtgggtcaggccagatagaatttctttctgtcacacagaagtgtccagagcaagggaggtggccagggaaggtacaggtgtgcagytgtgtcccagggatgacccggggacccaggttcctgtgtccctctgccctccaaaggttgtcaccccaatgtctgtgatcaaatgtggctcacttccctg

SEQ ID NO: 65174 - DNA, 201 bp, Homo sapiens
ggatttctgttccaggagcagctgacagacgaagaaaagtgctggacaggaagggagaattctgacgccaacatgcagcgaagtatcatgtgagcaccctyccttgcccctgagtctttccttctccaagtcctctgtttctttctctaaatctgtacttaaaaaaacaaacaaacaaacaaaaacccttacgttagattt

SEQ ID NO: 65175 - DNA, 201 bp, Homo sapiens
acctccgcctcccgggttcaagcgattcccctgcctcagcctcccgagtagctgggattacaggcacacgccaccacgcccggctaattttgtatttttartagagacggggtttctccatgttggtcagactggtctcgaactcccgacctcaggtgatccacccgcctcggcctcccaaaatgctgggattacaggcat

SEQ ID NO: 65176 - DNA, 201 bp, Homo sapiens
gccactgcgttccagcctgggcaacagagtgagactgtcttaaaaaaaagaaagacgctgacagcaagggagggcagccggcaacatgaggtttctgagtkccagacagggctgtgcatgcagaaaggccttaagggacccagagaggagcaggtgactgacacatggtgaagggtcttgacagtcatggagaggacatcc

SEQ ID NO: 65177 - DNA, 201 bp, Homo sapiens
tggctgccctctcccaggcagtgagcctcacgcccccgggccaaggtgagctcctgtggcccgtctctgcatccctcgctggagttacctcaggcttcccycctcctcttcagaggcccatgcccgccccttccccagcgggcccctgccataccaggctcctctctcctgggtgggggggagggggcgtcttgggccgcg

SEQ ID NO: 65178 - DNA, 201 bp, Homo sapiens
gtttcactctcattgcccaggctggagtgcaatggcacgatcttggctcactgcaacctccgcctcccgggttcaagcgattcccctgcctcagcctcccragtagctgggattacaggcacacgccaccacgcccggctaattttgtatttttagtagagacggggtttctccatgttggtcagactggtctcgaactcc

SEQ ID NO: 65179 - DNA, 201 bp, Homo sapiens
atggggaggcaaactaagccacttgtctcctgccactggctcaaagcaaggaccatgctggggtcctgaccatcacagtcaccagggcgggcgccaggctyagttctctccctgactcatcctcctcaagcctcgccaacccctcagggcagctgagatgggaggtgctggtgcacctacttgtgcccctccccagtctat

SEQ ID NO: 65180 - DNA, 201 bp, Homo sapiens
tggatctcttgtgatgtgcacctgtagtcccagctactcgggaggccgacgcaagacagtcgcttgaattcaggaggcggaggctgcagtcagccaagatygcaccaccgcactccagcctgggcgacagagcgagattccgtctcaaaaaaacaaaaacaaaaaacaaaactgatgagatgcccgtaaagtgttaattca

SEQ ID NO: 65181 - DNA, 201 bp, Homo sapiens
aactgatttcaaagcaaaacacaaaactgtaaatgtgctggaaaaactcagtgaaaacttttggaattctaaggaaaggaggacttttttttttttttttwaattatcttggggatgaggctggatgcagtggctcacgcctgtaatcccaacactttgggaggctgaggtgggtggatctcttgtgatgtgcacctgtag

SEQ ID NO: 65182 - DNA, 201 bp, Homo sapiens
attggcatgatcttggctcactgtaacctccacctcctggcttcaagtgattctcctgcctcagcctcccaagtagctgggactacaggcgcccgctaccrtgcccggctaattttttgtatttttagtagagacgaggtttcaccatgttggccaagatggtctcgatctcttgacctcatgatccacccacctcagcct

SEQ ID NO: 65183 - DNA, 201 bp, Homo sapiens
gaggaggaggaaggtgagcccccagaaggagaggtgtgtgtgtgtgtgtgtgtgtgtgtgtgtgtgtgtgtgtgtgtgtgtgtgttttggatctgcaaggkcaggggcctgagagctcaggatgtttggaccctgccgatttgatgcctgtgtccaggcatccaggaattccacctaccaatatgggaacttttgttctga

SEQ ID NO: 65184 - DNA, 201 bp, Homo sapiens
taagagcacgggtccaccatccactggctgtatgacctgggacaaatgactgaccttctctgagcttaggttgctttatctgtagagatgatgataatgayagcacctaccgcacagaaatatctgagttagaagataacacgtgtacgctgctcagaactgggcccagccctcagtcggggctcagtcattgtgggtcat

SEQ ID NO: 65185 - DNA, 201 bp, Homo sapiens
cacggtagcagtggcttaggcaagacgcaaacttatttttctctctcctgagtgcagagtccgggattcatgtgaccgtctcacagggtcagaggcccagrcttcctctgtgctgtcgtttgctctctgtagatgcccttgtccctgtgaacatccatattctgccaacaggaagaggagggcaccccactcaacattaag

SEQ ID NO: 65186 - DNA, 201 bp, Homo sapiens
tgcttgaacctgggagatggaggttgtggtgagccgagatcgtgccattgcactccagcctgaacaacagggcaagactccatctcaaaaaaaaaaaaaaattatctgagacctgtatctccatcagggtctcaatgggagacagaaaccataccagtgatttgaacagagggagtttaaaggatggtcactaggtatgca

SEQ ID NO: 65187 - DNA, 201 bp, Homo sapiens
aagagctatgggggtccttgatgggaccatgatcctgcactggagggcgggatgatggcccaggtgagaagaggccacccctgagttagggctgagaccayagggtcagaaaggagggtagacagagaggtttcagtcccctctactctcaacttttggaaaatggggtccctccttcccccgctcactctagaactgttc

SEQ ID NO: 65188 - DNA, 201 bp, Homo sapiens
gatctctgcacaaccaatcacctcaacaagtgtttggatttctgttccaggagcagctgacagacgaagaaaagtgctggacaggaagggagaattctgaygccaacatgcagcgaagtatcatgtgagcaccctcccttgcccctgagtctttccttctccaagtcctctgtttctttctctaaatctgtacttaaaaaa

SEQ ID NO: 65189 - DNA, 201 bp, Homo sapiens
tttaaaaatatattgtgaaggggtaacgtattccaattgttctgcctgcaaaagcatgcatattaaaaaatctccctccagcgtctgtccctcctgaggcracagcattaccagttttttgtcttccaactgagatgttctgtacatatacaagatatgtggatacatttatagtctttcttttgtttttgttttttgaga

SEQ ID NO: 65190 - DNA, 201 bp, Homo sapiens
ccagtttatagaaggggaaatggagacatggggaggcaaactaagccacttgtctcctgccactggctcaaagcaaggaccatgctggggtcctgaccatyacagtcaccagggcgggcgccaggctcagttctctccctgactcatcctcctcaagcctcgccaacccctcagggcagctgagatgggaggtgctggtgc

SEQ ID NO: 65191 - DNA, 201 bp, Homo sapiens
tttttaaaaatatattgtgaaggggtaacgtattccaattgttctgcctgcaaaagcatgcatattaaaaaatctccctccagcgtctgtccctcctgagrcaacagcattaccagttttttgtcttccaactgagatgttctgtacatatacaagatatgtggatacatttatagtctttcttttgtttttgttttttga

SEQ ID NO: 65192 - DNA, 201 bp, Homo sapiens
gtgaggtctgcctcggcttgggcgcgggccctgcagcaggaagccagggtttgtttgccatgacagtgagagcaaatccattgagggctcacatcatggarcatttcttgggagccctgccctgtgccccgtgccttacctcatcagttcctaccagcaactctgtgagactggtcttgttaccctcacctccagtttata

SEQ ID NO: 65193 - DNA, 201 bp, Homo sapiens
cagcgccggcctactgagttttttgattccaaaattgagtttgagttgtggtgccaacatgtggcggccaaggctgtagagagtagtggagacttagaggygtgtggtgcgggacagagagtactgattccagaaaacgaaaggggaccccatgggttgaagaagatttctgtgcaaaggaagggaaagtcaaagaaaacc

SEQ ID NO: 65194 - DNA, 201 bp, Homo sapiens
ccaagaagatagacatcatcaaaggcctctttgtggcctgccgccactcagaagcccggttcatcgctaggtaagcgtgtgggcctgtgaggctacagagsgggactgcaggctcggaggtgaaaggagggagggactggcagctggaatcatcacaaatgccctgaccatccttggatgagaaaagcatgagcaggaggc

SEQ ID NO: 65195 - DNA, 201 bp, Homo sapiens
tgattctcctgcctcagcctcctgagtagttgggattacaggctggcaccaccatgcctggctaattttttgcatttttagtagagatggggtttcaccatgcgggccaggctggtcttgaactcctgacctcgtgatccgcctgtctcagccttccaaagtgctgggagtacaggcgtgagccacagcgccggcctactg

SEQ ID NO: 65196 - DNA, 201 bp, Homo sapiens
tgttcgttcattacggattgctttccctttcattcttttctgtgttagggttagggcgttatctcgataggtgtaggcaggttatgttatctccacatttyatttcagaccagaaaagaggtgacacacagtatctggtgacaagggtgtgttggttctgataggttgagagctgcttgtcacagctgtcaccgtgacttg

SEQ ID NO: 65197 - DNA, 201 bp, Homo sapiens
tgtcaggcatagagtaggcttcccagtaaacgcttatgtatttctccttcccttgcaactcagtctggtggttaagaggtgagctgtggagcaggccgacytggggtggaacgtactatagatgcaggttaagttcctttgaaaacccctctgtgccttagtttctgtaacagagttgttgtggagagtcagtataattga

SEQ ID NO: 65198 - DNA, 201 bp, Homo sapiens
gtggcccacgcctgtaatcccagcactttgggaggctgaggcgggtggatcacctgaggtcaggagttcaagaccagcctggctgacatggtgaaatcccrtctctactaaaaatacaaaaattagctgggtgtggtggcacgcacctgtagtcccagctacttgggaggctgaggcacgagaatcgtttgtacccaggag

SEQ ID NO: 65199 - DNA, 201 bp, Homo sapiens
taccagacccagcacacacggggtcggttaagaatactctgagctgcaggtaacagaaaacccaactacattggcttggacaaagaaggatctgtttttcycacaaaagaagttgcagatgctggctttcctgcccaacaatccatggcagctggggcctcttccactgtctcatgcctccacccttgatgggtcgtgttc

SEQ ID NO: 65200 - DNA, 201 bp, Homo sapiens
ggaggggctgaagggagctaaggggcggggccggggaaaagattgcgtgtgggcggggccacctggaagggggaggtgccaagggtggggctggctgggarccggaagtgctgagggggcgggggccacctggaagtgctgagggggcggggctagaagaaggtaaatcgcgggcagcagcatcacctggaaggagtgggc

SEQ ID NO: 65201 - DNA, 201 bp, Homo sapiens
atcttcagcaggaatcaggaagacaacactgggaagtacccggacatcatcagccgcatccccaaggtgggcgtctgcctcacacttgcactctgccaggrtctgtggtcaggggtgcaaaggcctgaggcccatctaggccagtgtggcacagtgcggggtttattgggaggagatcaggttgcgtttggctgcaaatga

SEQ ID NO: 65202 - DNA, 201 bp, Homo sapiens
gatggtggagagaggctgtgaaacagggttgaggagaaggctgagagggaggagagcctgatggggacagatttgcaggggtgtgggagagaacacaggggcagcagttcaggtgagggaggaccaggcatgtgctgggacagggggtgtggggtgcagggaaggggagggctggggaaagatgctggaggcagagacagc

SEQ ID NO: 65203 - DNA, 201 bp, Homo sapiens
gcagacagtggatgtcagggtgaggaggcaggaggaatgcctccaggatctccctgggtgactggatggatgacaaagccgtcggcagcttgggaccctgrtgaggggcaggcacctgcagggggcattaatcaccccagcgtggggcaggcatgagcaacctctatctgtgggcccccagggccatccaggaagtttgga

SEQ ID NO: 65204 - DNA, 201 bp, Homo sapiens
tctcccagtctttgtcacgtgtacaaaacctggctcttctgtttccctggctgtctctggtgtctctgcctccatgtctccatgtttctggaattttccgtgactattttctcctcttggggtgtgtgtgttttacgctctgcctctcgaagtctctattacattctgtaagtcaggccgggcacagtggctcgcggctgt

SEQ ID NO: 65205 - DNA, 201 bp, Homo sapiens
gagagatggtggagagaggctgtgaaacagggttgaggagaaggctgagagggaggagagcctgatggggacagatttgcaggggtgtgggagagaacacaggggcagcagttcaggtgagggaggaccaggcatgtgctgggacagggggtgtggggtgcagggaaggggagggctggggaaagatgctggaggcagaga

SEQ ID NO: 65206 - DNA, 201 bp, Homo sapiens
agaggtctgaaaggactttgactggagggattggaaggagtgggaggaaagaacatggtgtgtggggggccagcagcctgaaggggcccagccgccagtgstgggtggaaaggctggtgatgcggatggcccgcctgccaagggcctggagtgctcggtgcttatcatgaggacactggggagccatggaaggattgtgag

SEQ ID NO: 65207 - DNA, 201 bp, Homo sapiens
actagaatatccccagcccacagcatgggacctggccccttattcactgaatagatggatccttttctttatcctgcggcttctctgcagttcagtctccyagtctctgtctcccagtctttgtcacgtgtacaaaacctggctcttctgtttccctggctgtctctggtgtctctgcctccatgtctccatgtttctgga

SEQ ID NO: 65208 - DNA, 201 bp, Homo sapiens
gggaggccgaggcgggcggatcatttgaggtcaggagttcgagaccagcctgaccaacacgttgaaaccccgtctctactaaaaattaaaaaaaattagcygggcatggtggtgcgcaccggtagtcccggctactccggaggagaatcacctgaacccacaaggtggaggttgcagcgagccgagatcgtgccactgcac

SEQ ID NO: 65209 - DNA, 201 bp, Homo sapiens
aacacaaaattagcccagcatggtggcgggtgcctgtaatcccggctactcaggaggctgaggtacgagaatcacttgaacccaggaggcagagattgcastgagctgagatcacgctattacaccccagcctgggtgacagagtgagactctgtctcaaaaacaaacaaacaaaattatcatgggtacggctcattctgc

SEQ ID NO: 65210 - DNA, 201 bp, Homo sapiens
actttgaaggcccctgtgactatatcaggcccacctggatagtccagggtaatcccactatcggaaggtcagctgattagcaacctcaattaccctttgcyatgtaacctaacatattcccaggttccaggtattagaatagagatctcttttggagcttagactttaccctgaggcttctggggagctaggaagagtttt

SEQ ID NO: 65211 - DNA, 201 bp, Homo sapiens
ctcccccactgtaaccgtccggtgggttcaccttgcccgctgcctagacagagccgatttatctagacgggggaactgcagtggagaaagagtcattcccrcagagctggctgtgcgggagaccggagtttcatttttactcaaatcagtctccctgagcatgtggggagcagagtttttaaagataatttggcgtgtagg

SEQ ID NO: 65212 - DNA, 201 bp, Homo sapiens
gcctggccaacatggtgaaaccccatctctactaaaaacacaaaattagcccagcatggtggcgggtgcctgtaatcccggctactcaggaggctgaggtrcgagaatcacttgaacccaggaggcagagattgcagtgagctgagatcacgctattacaccccagcctgggtgacagagtgagactctgtctcaaaaaca

SEQ ID NO: 65213 - DNA, 201 bp, Homo sapiens
agaccagcctggccaacatggtgaaaccccatctctactaaaaacacaaaattagcccagcatggtggcgggtgcctgtaatcccggctactcaggaggckgaggtacgagaatcacttgaacccaggaggcagagattgcagtgagctgagatcacgctattacaccccagcctgggtgacagagtgagactctgtctca

SEQ ID NO: 65214 - DNA, 201 bp, Homo sapiens
gaccatcctggctaacatggtgaaaccatgtctctatcaaaaatacaaaaaattagctgggcgtggtggcgggcgcctgtagtcccagctactcgggaggmtgaggcaggagaatggcgtgaacccgggaggcggagcttgcagtgagccaagatcgtgccactgcactccagcctgggtgacagagcaagactctgtctc

SEQ ID NO: 65215 - DNA, 201 bp, Homo sapiens
gacgtttgagaagatcgaggaggtgtctgctcggtaactaatgaggactgcctgggtggggggcggggtcgcttctgggtctgtcctctgcatggcggtcygtgctgccttgttccgccaaaccctgtcaacttggcctctgaccccgctcgggcgtatgatcatggatgtcagacatggtcacaaaagcggctgcaggtc

SEQ ID NO: 65216 - DNA, 201 bp, Homo sapiens
ctcttgcctccccttctcccagctgaagaaggactaccttgatggcgtgggtgacaccctggacctggtggtgatcggcgcctacctgggccgggggaagygggccggccggtacgggggcttcctgctggcctcctacgacgaggacagtgaggagctgcaggccatatgcaaggtcctggggaactggggctgatggca

SEQ ID NO: 65217 - DNA, 201 bp, Homo sapiens
ttgttttcatccagctctgcaccgtgtgccttgaacagagcctggcacatcacagttggaaggaatgactttgctttgacccagggctctatgcaattcartctccgttttgcctccgtagacccctggatccatctggttacaatcctgccaagaacaactatcatcccgtggaagatgcctgctggaaaccgggccaga

SEQ ID NO: 65218 - DNA, 201 bp, Homo sapiens
ctatagcctttctcttttacacagttcagtagcacacactctgtgatattctgccctttgtttgaaataacagcataccttagaaactgcccaagagctartttatgtagaccagcgggtacaattttataagcttccacagttgtttcacggaattatgtcatcaccttaaaacaatttttcactaacctttaaacttaa

SEQ ID NO: 65219 - DNA, 201 bp, Homo sapiens
aggagatcgagaccatcctggctaacacggtgataccccatctctactaaaaatacaaaaaattagctgggcatggtggcgggtgcctgtagttccagctrcttgggaggctgaggcaggagaatggcatgcacccaggaggcggagcttgcagtgagctgagattgcgccattgcactccagcctgggctacagagcgag

SEQ ID NO: 65220 - DNA, 201 bp, Homo sapiens
gatggatgaaatgatgagatttgctgaggagacaaccagaaaatgttcattggatgcttgaaaggaagggaaggaaacagcaaagaaaccaaagtgtttgygggcagtgcccccactctgcctgctgtagtcgcccctttacacccccatttccccaccttccagggcggcactgaaggagtggaatggagtggtgtccga

SEQ ID NO: 65221 - DNA, 201 bp, Homo sapiens
taggcagggactccatttgctcctcagcatcacccatcacagggcaggcactctggagacttccagagatgtgtgatgggtgggtgagtggatgagtgggygggtggattaatgcactgatggatgaaatgatgagatttgctgaggagacaaccagaaaatgttcattggatgcttgaaaggaagggaaggaaacagcaa

SEQ ID NO: 65222 - DNA, 201 bp, Homo sapiens
ttgttacattggaactgggttctgttaataggtttcagattaggcctgagcttctttgagcttcttgcaagctctaacgttctaggtttctgggtgatgtrtgtgtttgatgctgttccactttcagatctccgagtctctgtttctagaataagtagtgagaaagaagttgcaagaatgtatttcacaatacatgtttaa

SEQ ID NO: 65223 - DNA, 201 bp, Homo sapiens
cactctcactactatgggccactatctataatttttttttgttttttggtctttgtctaccccattaagttctgaactgttcaagagccgagatcagtctyggattctaaacgtccagtgaagggcatgcacatagtaggtgctcaataagcatttgttacattggaactgggttctgttaataggtttcagattaggcct

SEQ ID NO: 65224 - DNA, 201 bp, Homo sapiens
tcccaactcctgtactcagccctgccagatccagcccttgacaccactgcagcctcatgtcctgcctttccttacacactaacttctccagcctgacctcsgcccatgggctgtccctgggctgtggcactggagaggctctgctttgagcagctcgagagagtgagggagctagacatgacggctccaagatatcgttcc

SEQ ID NO: 65225 - DNA, 201 bp, Homo sapiens
actttgggaggccgaggcgggcggatcatttgaggtcaggagttcgagaccagcctgaccaacacgttgaaaccccgtctctactaaaaattaaaaaaaawtagccgggcatggtggtgcgcaccggtagtcccggctactccggaggagaatcacctgaacccacaaggtggaggttgcagcgagccgagatcgtgccac

SEQ ID NO: 65226 - DNA, 201 bp, Homo sapiens
gcctcggcctcccaaaatgctgggattacaggcctgagccaccacacccggccctcttctgtattttgtaaggatgctttttggattcagagcctaccttmattcactatgctctcatcttaatctacaggtacatccgcaaagaccttctttccaaatgaggtcatgttgtgaggctctgagtggacctgaattttgggg

SEQ ID NO: 65227 - DNA, 201 bp, Homo sapiens
cacgatttcagctcaccgcgacctccacctcctgggttcaagtgattctcctgcctcagcctcccaggtagctgggattacaggcatgcgccaccatgccyggctacttttgtatttttaatagagacagacacttttttgttagacttaaactttaatcatgaaatgttaaagctgaaagaatttcttgtcgttatctgt

SEQ ID NO: 65228 - DNA, 201 bp, Homo sapiens
tactacgactgcttttctttcttttgagacggagttttgctcttgctgcccaggctggagtgcagtggcacgatttcagctcaccgcgacctccacctccygggttcaagtgattctcctgcctcagcctcccaggtagctgggattacaggcatgcgccaccatgcccggctacttttgtatttttaatagagacagaca

SEQ ID NO: 65229 - DNA, 201 bp, Homo sapiens
cttcccaggttcaagcgattcttctgcctccacatcccaagtagccagaattacaggtgcctcgccaccaagcctggctaatttttgtatttttagtagaraccgggtttcaccatgttggccaggctggtctcgaactcctaatctcaggtgttctggccgcctcagcctctcaaagtgctgggattacaggcgtgagcc

SEQ ID NO: 65230 - DNA, 201 bp, Homo sapiens
cttacattgcagcctcctggcatctgcagccttttcctgctccctctgcacaccatgtccccacgtgctgtcattcctccctgctttttttttttttttttgagatggaatctcactctgttgcccaggctggagtgcagtggcacgatctcagctcattgcaccttcaacttcccaggttcaagcgattcttctgcctcc

SEQ ID NO: 65231 - DNA, 201 bp, Homo sapiens
ccttacattgcagcctcctggcatctgcagccttttcctgctccctctgcacaccatgtccccacgtgctgtcattcctccctgctttttttttttttttttgagatggaatctcactctgttgcccaggctggagtgcagtggcacgatctcagctcattgcaccttcaacttcccaggttcaagcgattcttctgcctc

SEQ ID NO: 65232 - DNA, 201 bp, Homo sapiens
ggcagatcacaaggtccggagattgagaccatcctggctaacatggtgaaaccatgtctctatcaaaaatacaaaaaattagctgggcgtggtggcgggcrcctgtagtcccagctactcgggaggatgaggcaggagaatggcgtgaacccgggaggcggagcttgcagtgagccaagatcgtgccactgcactccagcc

SEQ ID NO: 65233 - DNA, 201 bp, Homo sapiens
tcaaggtcgctgccttgcttggggttgacaaggagcagggtcttacgtggcccactgctttacaggcacattggattggcacaagatagaactgtaagacctgcactttgggaggccaaggcgggtggctcacctgaggtcagtagttcaagaccagcctggccaacatggtgaaatcccatctctactaaaaatacaaaa

SEQ ID NO: 65234 - DNA, 201 bp, Homo sapiens
ccctcaaggtcgctgccttgcttggggttgacaaggagcagggtcttacgtggcccactgctttacaggcacattggattggcacaagatagaactgtaaracctgcactttgggaggccaaggcgggtggctcacctgaggtcagtagttcaagaccagcctggccaacatggtgaaatcccatctctactaaaaataca

SEQ ID NO: 65235 - DNA, 201 bp, Homo sapiens
tcctctaaatgatttccttttccttgtaaattttaccataaagttgcagttcccaaacattcttagttcacagcacccttgatgtcttagtaatttttttmtgatgctcctaggccaataccttatcagttctattaagtagttatgtccaaacaactattagatactatacatacattggaaaaaaagtaatatttgtgc

SEQ ID NO: 65236 - DNA, 201 bp, Homo sapiens
cgtctcaaataaaataaaataaaataaagtaaaataaaattggggtcaatttggctgggtgtggtggctcatgcctgtaatcccagcattctgggaggccraggtgggcagatcacctcagcctccttgaggtcaggagttcgagaccagcctggccaacatggtgacaccccatctctactacaaatacaaaaattaggt

SEQ ID NO: 65237 - DNA, 201 bp, Homo sapiens
cagagtgaggacgaggacagagaagccaagaggaagaaggaggaggaaggtgagcccccagaaggagagaagtgtgtgtgtgtgtgtgtgtgtgtgtgtgragccaagaggaaggaggaggaggaaggtgagcccccagaaggagaggggtgtgtgtgtgtgtgtgtgtgtgtgtgtgtgtgtgtgaagccaagaggaagg

SEQ ID NO: 65238 - DNA, 201 bp, Homo sapiens
gaagtgagctcatgcatttgggtattggcaagggtgtcccgaggaggcgtgaggaagcaagggtgcagacgggcagcatggtatagcctgcaccactgtcrctcttgcgtctcttttccttccctagggttccttacctggctgtggcccggacgtttgagaagatcgaggaggtgtctgctcggtaactaatgaggactg

SEQ ID NO: 65239 - DNA, 201 bp, Homo sapiens
gggaatttatctccccgtgtttgtctttccacctcatcttccacctctctcaggccctgggtctctcccttcacttttcagattaaactcccatcggtcayatccttcatcctggacaccgaagccgtggcttgggaccgggaaaagaagcagatccagccattccaagtgctcaccacccgcaaacgcaaggtagcatca

SEQ ID NO: 65240 - DNA, 201 bp, Homo sapiens
  misc_feature (1)...(201): n = A,T,C or G, or insertion/deletion polymorphism (see Tables 1-2)
tgccggccaccgcttgttaaaccccaagttcataccaaaggccatgcacagccctgcagtggcactatctgtcttggccatccatgccctgtgtgagcatnagaatcagctgaagagctgaaaaatatcctgaggtctctttctcccccccaacccttgtccccattttggtacagatgtaggcctggggctggggagtcc

SEQ ID NO: 65241 - DNA, 201 bp, Homo sapiens
gactgctcacaggtctccccgccccgtcctgccacatctcctgagaacaatgcttccctctctgacacctctcccatggacagttccccatcagggattcygaagcgtcgcacaggtgagaacacacgggcccctgccccttcagtcgcctgcctttctttttctcttttttttttttttttttttttttgagacatagtc

SEQ ID NO: 65242 - DNA, 201 bp, Homo sapiens
cccctgcccaccacactctgctgcctcattgtaatgccggccaccgcttgttaaaccccaagttcataccaaaggccatgcacagccctgcagtggcactrtctgtcttggccatccatgccctgtgtgagcatcagaatcagctgaagagctgaaaaatatcctgaggtctctttctcccccccaacccttgtccccatt

SEQ ID NO: 65243 - DNA, 201 bp, Homo sapiens
taccctgaggcttctggggagctaggaagagttttgggcagaagagaggcagagatcatttagtcctgggcagtgtttaaaatattcatctggccaggcaygatggctcacgcctgtaatcccaacactttgggaggccaaggcgggtggatcacgaggtcagaagttcgagagcagccaggccaacatagtgaaacctca

SEQ ID NO: 65244 - DNA, 201 bp, Homo sapiens; identical to SEQ ID NO: 13841

SEQ ID NO: 65245 - DNA, 201 bp, Homo sapiens
cacattttggactagattttcttacgtatttcctatattcccctctccaacaaatttgggtcttttgccacagaaacagaacaaaatatcacctagaatcktaccacccagagacacgcagtagtgacatttgagggaatgttttatttacatttttgcaaagttgtgatccttctctatgagtaattttcttttctgcct

SEQ ID NO: 65246 - DNA, 201 bp, Homo sapiens
tgctccaaatcctcacaacactgctgggagtagattctgttgttatcctggtttcctgggtgagaaaagtaaagcggggaggtgggacagtattgaggacyggctaggaatcccagctccacctctctcagctgtgtgaccttgaggaagtgacttagcctttctgtgtctctcttctgaggatgtgaaacacttagccca

SEQ ID NO: 65247 - DNA, 201 bp, Homo sapiens
ttgccttccacttacccatttattcatttttttgagatagagtctcgctctgttgcccaggctggaatgcagtggcacaatcttagctcactgcaaccttygcctcctgggttcaagtgattctcctgcctcagcttcccgagtagctgggattacaggcacctgccaccaggcccggctaatttttgtatttttagtaca

SEQ ID NO: 65248 - DNA, 201 bp, Homo sapiens
gcacattttggactagattttcttacgtatttcctatattcccctctccaacaaatttgggtcttttgccacagaaacagaacaaaatatcacctagaatygtaccacccagagacacgcagtagtgacatttgagggaatgttttatttacatttttgcaaagttgtgatccttctctatgagtaattttcttttctgcc

SEQ ID NO: 65249 - DNA, 201 bp, Homo sapiens
ttgttatgaaatgagaagtgtggagggggcagtctgatgccattagggattcaggttcctcctctccccacatttttttttgtccccacattttttttttmtgccatgtgcctctggcctcatcatcacaatgtggctgcaggagttccagccctcatggccatgcctgctccacgcaccagggaagagcaaagggggttg

SEQ ID NO: 65250 - DNA, 201 bp, Homo sapiens
ccatgttggtcagactggtctcgaactcccgacctcaggtgatccacccgcctcggcctcccaaaatgctgggattacaggcatgagccaccgtgcccggmcccatttgttcttatttaaacctagaaacccttcccatgtccagtctcttctcaggggccatccttggggttccttctggaagttcccttcagacttact

SEQ ID NO: 65251 - DNA, 201 bp, Homo sapiens
ggtttctccatgttggtcagactggtctcgaactcccgacctcaggtgatccacccgcctcggcctcccaaaatgctgggattacaggcatgagccaccgygcccggccccatttgttcttatttaaacctagaaacccttcccatgtccagtctcttctcaggggccatccttggggttccttctggaagttcccttcag

SEQ ID NO: 65252 - DNA, 201 bp, Homo sapiens
ggctggagtgcagtggcacgatctcagctcattgcaccttcaacttcccaggttcaagcgattcttctgcctccacatcccaagtagccagaattacaggygcctcgccaccaagcctggctaatttttgtatttttagtagagaccgggtttcaccatgttggccaggctggtctcgaactcctaatctcaggtgttctg

SEQ ID NO: 65253 - DNA, 201 bp, Homo sapiens
ctccctttggaggagtggccagagtgagttggccacgtctctgtcctgagggaaagacggcggcaaggctgactcctgaggtcccatcgatcccgcctgcrtttcccatttgttcttatttatttatttatttattttaagacggagtttcactctcattgcccaggctggagtgcaatggcacgatcttggctcactgca

SEQ ID NO: 65254 - DNA, 201 bp, Homo sapiens
aaatgctctccctttggaggagtggccagagtgagttggccacgtctctgtcctgagggaaagacggcggcaaggctgactcctgaggtcccatcgatccygcctgcgtttcccatttgttcttatttatttatttatttattttaagacggagtttcactctcattgcccaggctggagtgcaatggcacgatcttggct

SEQ ID NO: 65255 - DNA, 201 bp, Homo sapiens
ccatgaagaaaagcaagtcagctccgggccagcaaggcggggctgggagtgccccggatgatcaggaagagtctttcccaaagtgagggacagagcactasggaggaaaacccccggtgcagagaccctgagggaggagcagcctctgcgtgtgcagggagcaagggcaggcgaggcgggaggtgagctcagagtggggag

SEQ ID NO: 65256 - DNA, 201 bp, Homo sapiens
gaattaagccaggacatgaataagagaaagtcaggcaggagtgggcgccatgaagaaaagcaagtcagctccgggccagcaaggcggggctgggagtgccycggatgatcaggaagagtctttcccaaagtgagggacagagcactagggaggaaaacccccggtgcagagaccctgagggaggagcagcctctgcgtgtg

SEQ ID NO: 65257 - DNA, 201 bp, Homo sapiens
ccacctacgagatcgccaagagatcgcacaactggctcaaggtgattctcgacccccaactgggccttctccaccccgggtctggaggtctgtcccagctrggcagtggatttcgagcctccactgtgtaccctgtctgagctcagggccccttttcacaatcccaccccagccccctgctgcaactgagttcagaccttc

SEQ ID NO: 65258 - DNA, 201 bp, Homo sapiens; identical to SEQ ID NO: 13847

SEQ ID NO: 65259 - DNA, 201 bp, Homo sapiens; identical to SEQ ID NO: 13848

SEQ ID NO: 65260 - DNA, 201 bp, Homo sapiens; identical to SEQ ID NO: 13849

SEQ ID NO: 65261 - DNA, 201 bp, Homo sapiens; identical to SEQ ID NO: 13850

SEQ ID NO: 65262 - DNA, 201 bp, Homo sapiens; identical to SEQ ID NO: 13853

SEQ ID NO: 65263 - DNA, 201 bp, Homo sapiens
gcaggagaatggcgtgaacccgggaggcggagcttgcagtgagccaagatcgtgccactgcactccagcctgggtgacagagcaagactctgtctcaaaarataaataaataaataaataaataagcaagtggcattgcctccttctgtgcctttcttctgtggccacatctcaccctgactttcctctcctgccaccctc

SEQ ID NO: 65264 - DNA, 201 bp, Homo sapiens; identical to SEQ ID NO: 13855

SEQ ID NO: 65265 - DNA, 201 bp, Homo sapiens; identical to SEQ ID NO: 13857

SEQ ID NO: 65266 - DNA, 201 bp, Homo sapiens; identical to SEQ ID NO: 13859

SEQ ID NO: 65267 - DNA, 201 bp, Homo sapiens; identical to SEQ ID NO: 13862

SEQ ID NO: 65268 - DNA, 201 bp, Homo sapiens; identical to SEQ ID NO: 13864

SEQ ID NO: 65269 - DNA, 201 bp, Homo sapiens
gaggcccatctaggccagtgtggcacagtgcggggtttattgggaggagatcaggttgcgtttggctgcaaatgacagagcactcagtcctgcgtggtgtragcccatatgattttttctcacatctagaggtgggcaccccagcaccgacttggctgagcactgatgtccccctgaaccaagcttatcgctacctctatc

SEQ ID NO: 65270 - DNA, 201 bp, Homo sapiens
aactgtttggttgaagcattgcttacttcctgctccccaactggccctgagaaactctgtttggaaattgctgagtttcttttttgtttgtttttgttttkttttttttttttttaagacggagtctcgctctgtcgcccaggctggagtccagtggtgcagtctcagctcactgcaacctctgcctcctgggatcaagtg

SEQ ID NO: 65271 - DNA, 201 bp, Homo sapiens
gtgtgaactgtttggttgaagcattgcttacttcctgctccccaactggccctgagaaactctgtttggaaattgctgagtttcttttttgtttgtttttkttttgttttttttttttttaagacggagtctcgctctgtcgcccaggctggagtccagtggtgcagtctcagctcactgcaacctctgcctcctgggatc

SEQ ID NO: 65272 - DNA, 201 bp, Homo sapiens
gaggcgcgcctggcggatctgagtgtgttgcccgggcagcggcgcgcgggaccaacgcaaggcaagtggggccgtccgcaagcagatgggaggcggagggyggcgggtgcgccgaatgcttggggcctatgcttcgccatgtcggggtgtctgcagaggagtgggcgtggggacgctgaggctgccgagagcgcggtggag

SEQ ID NO: 65273 - DNA, 201 bp, Homo sapiens
ttattcttgatcgttcaggttttcaagatctttatgttttcaacggccggtgtgtattgagaaaggctgagcaattctgttccagggagggaagttctgaragagagggatgggggaggaactggagctggagagctgaagctgcagcagtggtgacttcgagagagtcactgtgtaacctctggcaagggggaaggagtg

SEQ ID NO: 65274 - DNA, 201 bp, Homo sapiens
ataggttgttaagcaattaattgcttcactgtaattttgttaattatttgaagagatgtctgggctgattcccacgacatctaacatgcacacaggaggcygcactgaagactggctgaatggatgattggatgcgtgggtggataaatatcctataaagtaatgaggtcacccccccatctctgccatgctcaaaaccca

SEQ ID NO: 65275 - DNA, 201 bp, Homo sapiens
tagagagccggccgccctgccccagccctcgtgatgtgcttagtgtgctggggctgtgggacactgaataggttgttaagcaattaattgcttcactgtarttttgttaattatttgaagagatgtctgggctgattcccacgacatctaacatgcacacaggaggccgcactgaagactggctgaatggatgattggatg

SEQ ID NO: 65276 - DNA, 201 bp, Homo sapiens
ggcgcgtctactctgccttaaaattcactgaacaccccttctttgccagccctgggcggcccacgaggatgaaccatagagagccggccgccctgccccakccctcgtgatgtgcttagtgtgctggggctgtgggacactgaataggttgttaagcaattaattgcttcactgtaattttgttaattatttgaagagatg

SEQ ID NO: 65277 - DNA, 201 bp, Homo sapiens
ctgatggtgaagaccctggatgttgatgccacctacgagatcgccaagagatcgcacaactggctcaaggtgattctcgacccccaactgggccttctccrccccgggtctggaggtctgtcccagctaggcagtggatttcgagcctccactgtgtaccctgtctgagctcagggccccttttcacaatcccaccccagc

SEQ ID NO: 65278 - DNA, 201 bp, Homo sapiens
agagcctgggggatctttctaacacccagagttgactctgcccctctagggttccccagagccgtcaggagaaaatctaagcccatttggccactggctgycacctccctctctggcctcacttcctacctctctgttcctctggctctgaactcaccagattttttatttttgagacagagtcttgctctgtcgcctagc

SEQ ID NO: 65279 - DNA, 201 bp, Homo sapiens
tccctcagactcctgcgaggggctgatggtgaagaccctggatgttgatgccacctacgagatcgccaagagatcgcacaactggctcaaggtgattctcracccccaactgggccttctccaccccgggtctggaggtctgtcccagctaggcagtggatttcgagcctccactgtgtaccctgtctgagctcagggccc

SEQ ID NO: 65280 - DNA, 201 bp, Homo sapiens
aaagagccagagagtaaatattttaggctttatgggacacatttggcccctgttgcaaaaccattcttagatcccagaacctgtagaaacggtccagggtyggagtttgctgaccgtggccccagccaccctctgaccctgcctccagtctttcatcctcagtctgatccccgtagagcctgggggatctttctaacaccc

SEQ ID NO: 65281 - DNA, 201 bp, Homo sapiens
acttttctctcctgaggtctgcagcttgcgctgaccccggcctcccagcctgtccccagtcctggaccgtttgaccagaatcctgcctgctccggcgcttrtgagccagggcttcccaaggaccacgcttctgtgtctccctcagactcctgcgaggggctgatggtgaagaccctggatgttgatgccacctacgagatc

SEQ ID NO: 65282 - DNA, 201 bp, Homo sapiens
tgcccttgtaggttcaatgggatttttttgccatctgaccgttctgtctatcgtcagaagaggagaccccgaaagaaagcctcacagaggctgaagtggcmacagagaaggaaggagaagacggggaccagcccaccacgcctcccaagcccctaaagacctccagtgagtttctggtcctctcctccgccctgccccacc

SEQ ID NO: 65283 - DNA, 201 bp, Homo sapiens
cgcctcacatttagggcttattgtctttattctcacaaagatgtctcatctctcttctccctgccggccctgcagtccctggtacgtgagcccctttccckgcgccggcagctgctccgggagaactttgtggagacagagggcgagtttgtcttcgccacctccctggacaccaaggacatcgagcagatcgccgagttc

SEQ ID NO: 65284 - DNA, 201 bp, Homo sapiens
gtgggcgcctgtcatcccagctactcgggaggctgaggcaggagaatcgcatgaacccaggaggcagaggttgcagtgagccaagatcacaccattgcacyccagcctgggcggtaagaacgaaactctgtctcaaaaaaaagaacagatgacagatgagggcagactgtctccagagtcaaaatgcccttgtaggttcaa

SEQ ID NO: 65285 - DNA, 201 bp, Homo sapiens
ttataaagagaggtttcctggactcacagttccacacggctggggaggcctcacagtcatggcagaaggcgaaagaggagcaaaggcacatcttacatggygccaggcaagagagcgtgtgcaggggaactgccctttataaagccgtcagatctcgtgagacttcctcactatcacgagaacagcacgggaaaaacctgc

SEQ ID NO: 65286 - DNA, 201 bp, Homo sapiens
aacctgcaccccacaggtttccccttttccatctcattggccagaactgtgccatgtcactgccattagctgcagaaaagtctaggagagcaaatatctgstgaaggggaatgaggttgtcggaattagctgagagccgttaaggatccagcacctggagccagcagcatggccgccctcacagatgggcagccagttagg

SEQ ID NO: 65287 - DNA, 201 bp, Homo sapiens
tggcttgggaccgggaaaagaagcagatccagccattccaagtgctcaccacccgcaaacgcaaggtagcatcacccgctccactgcctgccaaggccccstacttcctcatcttccacccagtcctggctgtgggtcctgcccagtgcccagaagggcagagtgtcagtctggatgcacttctctcagccttctgcagaa

SEQ ID NO: 65288 - DNA, 201 bp, Homo sapiens
acctgtagtcccagctacttgggaggctgaggcacgagaatcgtttgtacccaggaggcggaggttgcagtgagctgagatcgggccactgtactctagcstgggtgacagtaagactccatctcaaaaaaataaaaataaaaaatcaaatatttccttgtgtccctggccaagcaaggccccctcctctgcccaacacca

SEQ ID NO: 65289 - DNA, 201 bp, Homo sapiens
ctcgctggagttacctcaggcttcccccctcctcttcagaggcccatgcccgccccttccccagcgggcccctgccataccaggctcctctctcctgggtrggggggagggggcgtcttgggccgcggcatctgcattccttgccatacagcaaaccacccactgcaccctggtgtagccaaggatgtgggtgccttccaa

SEQ ID NO: 65290 - DNA, 201 bp, Homo sapiens
gctgcgctccgtggtggccctgtcgcctccagacctcctccctgtcctctacctcagcctcaaccaccttgggccaccccagcagggcctggagcttggcrtgggtgatggtgtccttctcaaggcagtggcccaggccacaggtaagggggactgtggttggagggaccagaaggacaggagctcagccagagaaaatgc

SEQ ID NO: 65291 - DNA, 201 bp, Homo sapiens; identical to SEQ ID NO: 13885

SEQ ID NO: 65292 - DNA, 201 bp, Homo sapiens; identical to SEQ ID NO: 13888

SEQ ID NO: 65293 - DNA, 201 bp, Homo sapiens; identical to SEQ ID NO: 13889

SEQ ID NO: 65294 - DNA, 201 bp, Homo sapiens
ctctaccaaaaatacaaaaattagccatgtgtgatggcgggtgcctgtagtcccagctacccaggaggctgaggcaggagaatcgcttgaacctgggaggyggaggttgcagtgagccgagatcacaccactgtactccatcctgggtgacaaagcaagactctgtctcaaaaaaagaaaagaaaattcttttcttaaata

SEQ ID NO: 65295 - DNA, 201 bp, Homo sapiens
ggaaggcggcccgggtcctgggcagcgaaggggaagaggaggatgaagcccttagccctgctaaaggccaggtaggtccccatcaccctgcccatttttaycagaagaaactaattcccattaacctttggaacagagtgcagcagctgttcaggagaattctggagaaattgcccgggagaggtagatgtgtttcctggt

SEQ ID NO: 65296 - DNA, 201 bp, Homo sapiens
aggatggtgacaaagatcaggaaggtggcaaacagtgaagggtcagtgaccccaggagaggtatagaaagacgctggcagcggccaggcacagtggctcaygcctgtaatcccagcacttgggagcctgaagcaggcagatcacttgaggtcaggagtttgagaccagcctggccaacatggtgaaaccctgtctctacta

SEQ ID NO: 65297 - DNA, 201 bp, Homo sapiens
gtgttctttttttttttttttttttttttttttgagacagagtctcactctgtcatccaggctggagtgcattggcatgatcttggctcactgtaacctcyacctcctggcttcaagtgattctcctgcctcagcctcccaagtagctgggactacaggcgcccgctaccgtgcccggctaattttttgtatttttagtag

SEQ ID NO: 65298 - DNA, 201 bp, Homo sapiens
gaggggtgagtcagtgtccaggtctggaaaggttcttcgggatgtgttcccttctctgcattccgacagccccacccccagctcaggcttcctcctcttgsaggacttggcaaaccttttctataaagagccagagagtaaatattttaggctttatgggacacatttggcccctgttgcaaaaccattcttagatcccag

SEQ ID NO: 65299 - DNA, 201 bp, Homo sapiens
tgctggcaggtctctgagcttagagaaggtgccccgagagcctgcaactctgatctttcaggaagggagcactgggtgggagatgccagggtctctgatcmggtaccacgtggcaagccccgtgaatgttagaaaaaactgtcagtgggatccagcagctgcccccggcaagccggctgtgcctccagtcatgcagtgccc

SEQ ID NO: 65300 - DNA, 201 bp, Homo sapiens
ctgcagcttggaactggcttcagtgacgaggagctggaggagcatcaccagagcctcaaggtgagccatggcggctgcgcctcagcctccacccctctccyccctgcccctgacagcacagtccttccatgcagggctcttggcttccaccatcttggggctccaggtgtgggcaggagggcagcaggcagtggagctggc

SEQ ID NO: 65301 - DNA, 201 bp, Homo sapiens
agtatttacaaaggactgattacgtgttagctactggattttaggtgcctgagatctggtaggaaacaaatcagacaaaaattcctctttatagaacttargttttttgggttttttgttttttgtttcttgttttttttttaaagacagggtcttgctctgttacccaggctggagtgcagtggtgctcctgggctcggg

SEQ ID NO: 65302 - DNA, 201 bp, Homo sapiens
atgtgttgtgtctcttctgtcctggcaagtgtggggccttctcacctggggataggtaagcaggcaaagtgggtgggagccacagggctcggggcagttasaggaagtggacccctgaggagaccagcctggccaacatggtgaaaccccatctctactaaaaccacaaaaatgagccagtgtggtggcgtgtgcctgtag

SEQ ID NO: 65303 - DNA, 201 bp, Homo sapiens
ggatgtcagacatggtcacaaaagcggctgcaggtcctcttgactttctgcctcattctcatggtcagagcaagacacaaggggcgagcccagatgtgcarggtaaggagacaggctccatctcgggatgactggcaccattgcacacagtccgtgattacttctagtccaccctgagtcatcaaaagtgacttcagtctt

SEQ ID NO: 65304 - DNA, 201 bp, Homo sapiens
gcccggacgtttgagaagatcgaggaggtgtctgctcggtaactaatgaggactgcctgggtggggggcggggtcgcttctgggtctgtcctctgcatggyggtctgtgctgccttgttccgccaaaccctgtcaacttggcctctgaccccgctcgggcgtatgatcatggatgtcagacatggtcacaaaagcggctgc

SEQ ID NO: 65305 - DNA, 201 bp, Homo sapiens
gtctcttttccttccctagggttccttacctggctgtggcccggacgtttgagaagatcgaggaggtgtctgctcggtaactaatgaggactgcctgggtsgggggcggggtcgcttctgggtctgtcctctgcatggcggtctgtgctgccttgttccgccaaaccctgtcaacttggcctctgaccccgctcgggcgta

SEQ ID NO: 65306 - DNA, 201 bp, Homo sapiens
gcacctcagcgcctttgcacacgctattctctctgcctggaatgctcgtcccctgctgcccactgtgctaacccctccctcattctgcccagatgtctccrgccttccctgaccaccctgtgaagcagcaccctcatctcatcctcttcctctactcggctttcttttgttttctgaaagatttttttaacacctaaaatt

SEQ ID NO: 65307 - DNA, 201 bp, Homo sapiens
ccctctgtcccagctcagctacgcaatcccttttctgtttctcaagtttgtctgcacctcagcgcctttgcacacgctattctctctgcctggaatgctcrtcccctgctgcccactgtgctaacccctccctcattctgcccagatgtctccggccttccctgaccaccctgtgaagcagcaccctcatctcatcctctt

SEQ ID NO: 65308 - DNA, 201 bp, Homo sapiens
tataaaggttgaggccgggcgcagtggctcatgcctataatcccaggactttgggaggtcgaggtgggaggatcgcttaagtccaggagtgagacaccagygtgtgcaacacggcaaaaccccatctctacaaagatcagtcgggcatggttgcttgcacctgtagtcctagctactcaagaagctgaggtaggagaatcc

SEQ ID NO: 65309 - DNA, 201 bp, Homo sapiens
acagtttcaccgtattggtcaggctggtcttgaactcctagcctcaggtgacccacccacctcggcctcccaaagtgctgggattacaggcgtgagccagkacacctggcctgaactcaccagatttagtgtatgtgctggaagcctgcaggcgcgtctactctgccttaaaattcactgaacaccccttctttgccagcc

SEQ ID NO: 65310 - DNA, 201 bp, Homo sapiens
tccctctctggcctcacttcctacctctctgttcctctggctctgaactcaccagattttttatttttgagacagagtcttgctctgtcgcctagcctgcrgtgcagtggtgctgtctcagctcaccacagcctccacctcccaggttcaagcgattctcccaggtagctgggattacaggtgcatgccaccacacccaga

SEQ ID NO: 65311 - DNA, 201 bp, Homo sapiens
ctttctaacacccagagttgactctgcccctctagggttccccagagccgtcaggagaaaatctaagcccatttggccactggctgccacctccctctctrgcctcacttcctacctctctgttcctctggctctgaactcaccagattttttatttttgagacagagtcttgctctgtcgcctagcctgcagtgcagtgg

SEQ ID NO: 65312 - DNA, 201 bp, Homo sapiens
tctctccagaggcctgagatgctgcgaagacccttcttcctttcctgctggttggaaagtcggccttgtctctaccagcctgtctcccatctccctgagcrctggggtggtgctgggtgcagaatggatgggaggtgggggctaccggaaggagaaaagacccactgttttctgtcttcattcctagccccccggaagcca

SEQ ID NO: 65313 - DNA, 201 bp, Homo sapiens
aggactttgggaggtcgaggtgggaggatcgcttaagtccaggagtgagacaccagcgtgtgcaacacggcaaaaccccatctctacaaagatcagtcggrcatggttgcttgcacctgtagtcctagctactcaagaagctgaggtaggagaatcccttgagcccaggaggttgaggctgcagtgcgcattgctccactg

SEQ ID NO: 65314 - DNA, 201 bp, Homo sapiens
agaggagccaggggctccaggaaaggagggagctgctgaggggtgagtcagtgtccaggtctggaaaggttcttcgggatgtgttcccttctctgcattcygacagccccacccccagctcaggcttcctcctcttgcaggacttggcaaaccttttctataaagagccagagagtaaatattttaggctttatgggacac

SEQ ID NO: 65315 - DNA, 201 bp, Homo sapiens
cagtaagtggggccagagcacatcccacgtgtgtaagctggtggctccaaaacaagccgaagggtctttggtcactgccagagatgttcatgacccgccaraggaaagggtcccttggccttctctgctctgtccacactcacttccctagtgaccttgtcccgcctgtggctttaaatcccatccgcgccctgatgacac

SEQ ID NO: 65316 - DNA, 201 bp, Homo sapiens
tgtacaggcaggaggctggtgagcctctctccagaggcctgagatgctgcgaagacccttcttcctttcctgctggttggaaagtcggccttgtctctacyagcctgtctcccatctccctgagcactggggtggtgctgggtgcagaatggatgggaggtgggggctaccggaaggagaaaagacccactgttttctgtc

SEQ ID NO: 65317 - DNA, 201 bp, Homo sapiens
cctagtgaccttgtcccgcctgtggctttaaatcccatccgcgccctgatgacaccggcccagatgtctcccctgagtgtggtcatgctcgttcatccacygctttcctggctccacgtgcatgtttgctgacttcctacagccagcgtggctgggggcacgttccccaagccatttctaccaagtgggtgagcgttagac

SEQ ID NO: 65318 - DNA, 201 bp, Homo sapiens
ttaagttagacaaccaaactgagttacaggattttagaggctgaagttaccctctcagggtggtccaagtgtccatgaggcccctgtgttagaaacaacayttgccgggagaattttagggatacagagttgtatctgattttctgcagctgctgggaggagtgggaatattttcttctcatgacgatgagatttcttttt

SEQ ID NO: 65319 - DNA, 201 bp, Homo sapiens
aaattcatccaggccgcgagagaagggagacacgcagccacaactgtcaccctcgacacccccacccgcgctctcccctgaaggtcggcagctggagtccrtccgggctgaggcagccgagaaaggcgacgtggggctggtggccgagaacagccgcagcacccagaggctcatgctgccaccacctccgctcactgcctc

SEQ ID NO: 65320 - DNA, 201 bp, Homo sapiens
ggggatggggtgagggaaggagggcaggtattccaaaatgcagggcagcagcacggctggtggggtggaggtgtggtccctgccttcaccaggcactgacrgctcttcccctgactctccagtccacagccaagaagatagacatcatcaaaggcctctttgtggcctgccgccactcagaagcccggttcatcgctaggt

SEQ ID NO: 65321 - DNA, 201 bp, Homo sapiens
ctgcactccagccttggccacagagcaagaactcccccgcctcagacaaagtaaaagataaaaagtattcatagctttcagaagtcataggtgtaaattaratgttattaattaagttagacaaccaaactgagttacaggattttagaggctgaagttaccctctcagggtggtccaagtgtccatgaggcccctgtgtt

SEQ ID NO: 65322 - DNA, 201 bp, Homo sapiens
tccccagtctatgctagtgggcaggatcattactgcctggctcagtttcctcatctgtcacatggggctgtgtgatatctggggtcccttccaggctctgmagattcttctggtttttgaggagagggtctacatacatcaaggtcgaggagatcagagaagggaggaggcaagattggggaggtgcagacaagccccctt

SEQ ID NO: 65323 - DNA, 201 bp, Homo sapiens
ttgagcccaggaggtggaggttgcagtgacctatggtcgcaccactgcactccagccttggccacagagcaagaactcccccgcctcagacaaagtaaaakataaaaagtattcatagctttcagaagtcataggtgtaaattaaatgttattaattaagttagacaaccaaactgagttacaggattttagaggctgaag

SEQ ID NO: 65324 - DNA, 201 bp, Homo sapiens
gatctagacaaggctggtgcttgacacaaggatggtgacaaagatcaggaaggtggcaaacagtgaagggtcagtgaccccaggagaggtatagaaagacrctggcagcggccaggcacagtggctcacgcctgtaatcccagcacttgggagcctgaagcaggcagatcacttgaggtcaggagtttgagaccagcctgg

SEQ ID NO: 65325 - DNA, 201 bp, Homo sapiens
tactcgggaggctgaggcaggagaatcgcatgaacccaggaggcagaggttgcagtgagccaagatcacaccattgcactccagcctgggcggtaagaacraaactctgtctcaaaaaaaagaacagatgacagatgagggcagactgtctccagagtcaaaatgcccttgtaggttcaatgggatttttttgccatctga

SEQ ID NO: 65326 - DNA, 201 bp, Homo sapiens
cagaaatagcagctcagagtcatacagggctgggcctcacaggccccagagttggggacttctctgcacccagtaggggtctcgtgcctgttcgaggagtmccctatcaaagagcctttctctttgcctgcccctaattaaataggaaataagttatttaagaaagcagggggcacggtgcccatcattctgcctgttaga

SEQ ID NO: 65327 - DNA, 201 bp, Homo sapiens
ggtttcactatgttgaccaagctggtctcgaactcctgagctcacatgatctgcccacctcggcctcacaaagccctgggattacaggcgtgagccactgygcccagcctgtattttgttcttaaataaccataattacttgtgggaaatgccttggatactctgtaacatcttaaacagtggaattcaattgaaaactgc

SEQ ID NO: 65328 - DNA, 201 bp, Homo sapiens
tgtatttttagtagagacagggtttcactatgttgaccaagctggtctcgaactcctgagctcacatgatctgcccacctcggcctcacaaagccctgggrttacaggcgtgagccactgcgcccagcctgtattttgttcttaaataaccataattacttgtgggaaatgccttggatactctgtaacatcttaaacagt

SEQ ID NO: 65329 - DNA, 201 bp, Homo sapiens
caagtacattacatcattgtttactcgtggggattatttctattctgcagtcgtgagagagcaaagcacagagaaattaagtaacctgcccaaggtcacayagccaggaagcaggagggattgaagggtgcggcctgcactggggcagtgactgtgtgcaggcagagaaggggagagggcccagagccttccagaggctac

SEQ ID NO: 65330 - DNA, 201 bp, Homo sapiens
ggaacagagggtgattcaggacaggggagcagccaacacaggatgtgctgttgggtctgctatgtgttgggcagctggagcttagttttgtgggattctcyggggaacggtgtaaatgctccagagtgacccccgagatgcgaggcagctggggtatttatacaccaactcctgccgatcgtggggtgagggcctctcctg

SEQ ID NO: 65331 - DNA, 201 bp, Homo sapiens
actttatcctggataaagcagagaatgtggagtcatggaagggttttgagcagggagagacagtgccagccatgctgatagaaggtccctctggggccacstgaaggagccactgggggccgggagaccggggaccaggtggcgcaatggccaacatgagatataacagtgaagatgggtacaactgcctttgtgtgagct

SEQ ID NO: 65332 - DNA, 201 bp, Homo sapiens; identical to SEQ ID NO: 13962

SEQ ID NO: 65333 - DNA, 201 bp, Homo sapiens
gccatgttagccaggctggtcttgaactcctgacctcaagtgatccacccacctcggcctcccaaagtgctgggatgacaggcgtgagctactgtgcctgrcctatagcctttctcttttacacagttcagtagcacacactctgtgatattctgccctttgtttgaaataacagcataccttagaaactgcccaagagct

SEQ ID NO: 65334 - DNA, 201 bp, Homo sapiens
gaggtcaggagttcaagaccagcctggccaacatggtgaaaccccatctctactaaaaacacaaaattagcccagcatggtggcgggtgcctgtaatcccrgctactcaggaggctgaggtacgagaatcacttgaacccaggaggcagagattgcagtgagctgagatcacgctattacaccccagcctgggtgacagag

SEQ ID NO: 65335 - DNA, 201 bp, Homo sapiens
aaattagcccagcatggtggcgggtgcctgtaatcccggctactcaggaggctgaggtacgagaatcacttgaacccaggaggcagagattgcagtgagcygagatcacgctattacaccccagcctgggtgacagagtgagactctgtctcaaaaacaaacaaacaaaattatcatgggtacggctcattctgcttgcct

SEQ ID NO: 65336 - DNA, 201 bp, Homo sapiens
catgtgagcaccctcccttgcccctgagtctttccttctccaagtcctctgtttctttctctaaatctgtacttaaaaaaacaaacaaacaaacaaaaacycttacgttagattttgagttggaatttccaggagtcaagtagtatggaaaatgagccgtgggatatggaagacagtgtattgaacaacagtttttagttg

SEQ ID NO: 65337 - DNA, 201 bp, Homo sapiens
cccttgctcccgggatgccccgcgcggtctcccgcctctcttcccgccgtgcctcgcgggggcgcttccaccgattcctcctctttccctgccagtcactyctcagaccctcagccacacccgctcatccagggcgagggaaagcgcgggcattttcccagtgtgctctgcgggagggctcgccccacttcaccccttttc

SEQ ID NO: 65338 - DNA, 201 bp, Homo sapiens
agtgtgagctacttacgatataaaggttgaggccgggcgcagtggctcatgcctataatcccaggactttgggaggtcgaggtgggaggatcgcttaagtycaggagtgagacaccagcgtgtgcaacacggcaaaaccccatctctacaaagatcagtcgggcatggttgcttgcacctgtagtcctagctactcaagaa

SEQ ID NO: 65339 - DNA, 201 bp, Homo sapiens
gaagctgcttcctcagcaggtacagctggccggggcagagcagattggaacccagatgagtctgaatgcagagtttggctggggtcagtgtgagctacttrcgatataaaggttgaggccgggcgcagtggctcatgcctataatcccaggactttgggaggtcgaggtgggaggatcgcttaagtccaggagtgagacac

SEQ ID NO: 65340 - DNA, 201 bp, Homo sapiens
ctggaaggcggggaggtgaagatcttcagcaggaatcaggaagacaacactgggaagtacccggacatcatcagccgcatccccaaggtgggcgtctgccwcacacttgcactctgccagggtctgtggtcaggggtgcaaaggcctgaggcccatctaggccagtgtggcacagtgcggggtttattgggaggagatcag

SEQ ID NO: 65341 - DNA, 201 bp, Homo sapiens
agaaggtcagatggagagagattaggtaggatcggggtagacatcaaaagactttatcctggataaagcagagaatgtggagtcatggaagggttttgagyagggagagacagtgccagccatgctgatagaaggtccctctggggccacgtgaaggagccactgggggccgggagaccggggaccaggtggcgcaatggc

SEQ ID NO: 65342 - DNA, 201 bp, Homo sapiens
tctccagcctgggcgagactccgcctcaaaaaaaaatcagaatgagatctagagcataatgacatttaaacaaatcagcacccacatgcagcaaggtgcaygtgcctacatggggagaggtgtagggattggaaatgaagaagaaaatgatggtagggccttccagagcagggctgggaggtgctgttggaactgaggaga

SEQ ID NO: 65343 - DNA, 201 bp, Homo sapiens
gtgtctggaaacaccccagtttagcagtgatataaaagaaggtggagtatgtggtgtgggaagggttagaaggtcagatggagagagattaggtaggatcrgggtagacatcaaaagactttatcctggataaagcagagaatgtggagtcatggaagggttttgagcagggagagacagtgccagccatgctgatagaag

SEQ ID NO: 65344 - DNA, 201 bp, Homo sapiens
acctcggcctcccaaagtgctgggattacatgcctgtaggcatgagccaccatgcccggccaaaaacctttttttaaaaactgtattcttgagtggtctcmtgtgtagccgagtagagaatcgctggtctcgtggtgacagatagggaacaggggcaaggccagactaagggagacaaagcaacagatagtgacacgaagg

SEQ ID NO: 65345 - DNA, 201 bp, Homo sapiens
cttggtgtgtctggaaacaccccagtttagcagtgatataaaagaaggtggagtatgtggtgtgggaagggttagaaggtcagatggagagagattaggtmggatcggggtagacatcaaaagactttatcctggataaagcagagaatgtggagtcatggaagggttttgagcagggagagacagtgccagccatgctga

SEQ ID NO: 65346 - DNA, 201 bp, Homo sapiens
acacaaggatggtgacaaagatcaggaaggtggcaaacagtgaagggtcagtgaccccaggagaggtatagaaagacgctggcagcggccaggcacagtgkctcacgcctgtaatcccagcacttgggagcctgaagcaggcagatcacttgaggtcaggagtttgagaccagcctggccaacatggtgaaaccctgtctc

SEQ ID NO: 65347 - DNA, 201 bp, Homo sapiens
gctgggagctccaggtggacgctgaggttggccctgggggtgtgtcaggggatcttgttcagagggagcaacattgagctatgtcccaaacctcacatgcygaggcctggaggggtgacacagcttggtgtgtctggaaacaccccagtttagcagtgatataaaagaaggtggagtatgtggtgtgggaagggttagaag

SEQ ID NO: 65348 - DNA, 201 bp, Homo sapiens
gtggctgagggcatgctgggagctccaggtggacgctgaggttggccctgggggtgtgtcaggggatcttgttcagagggagcaacattgagctatgtccyaaacctcacatgctgaggcctggaggggtgacacagcttggtgtgtctggaaacaccccagtttagcagtgatataaaagaaggtggagtatgtggtgtg

SEQ ID NO: 65349 - DNA, 201 bp, Homo sapiens
gcatgcatttcagacaagaagggcacgtgcagaggcctcgagatgggaacagcatgggatgtttggggcctctcatctacttccttgtttctggagaatcrgatgcgacctgggaagcagggagagtttgaggatagcacgtggtgagaggtgagctagagaggagagtgggggctggatctcaaaaggtcttgcactccc

SEQ ID NO: 65350 - DNA, 201 bp, Homo sapiens
cagcccaggggaggtgatggctgagccgagtcttagaagatgggttggggttggccatgttgagaaaggacagatgcatgcatttcagacaagaagggcaygtgcagaggcctcgagatgggaacagcatgggatgtttggggcctctcatctacttccttgtttctggagaatcggatgcgacctgggaagcagggagag

SEQ ID NO: 65351 - DNA, 201 bp, Homo sapiens
tatgtgattcagtgcgtaaagactttgcactttttccacatcattttggaacagctttggtatgtgaatagctgtacattttatgaaacctacacagatcwtgttgccgatgaaaatctggtgtccaacttgagatgtgcagtgagttcattggattttgaagacctagcatgaaaacagaatgttggaatcatactgttt

SEQ ID NO: 65352 - DNA, 201 bp, Homo sapiens
cagcgtctttgtcctaagggggacttggaatgtttgctgtggggtaagaacagggcgagagacccattcgtaatgcggggcagtgtgagcccttgccgtcyggtctagcctattgagcgctttagcgtggtgagtgtgacaggggagctgaatctttcatgttagatcctttcagttgaatttacatttgaaagctaatat

SEQ ID NO: 65353 - DNA, 201 bp, Homo sapiens
agaaggtcctggaaaaccagcttggggaacagcgtctttgtcctaagggggacttggaatgtttgctgtggggtaagaacagggcgagagacccattcgtratgcggggcagtgtgagcccttgccgtccggtctagcctattgagcgctttagcgtggtgagtgtgacaggggagctgaatctttcatgttagatccttt

SEQ ID NO: 65354 - DNA, 201 bp, Homo sapiens
cctctgacctcccgcttcctccctgcagcttggaactggcttcagtgacgaggagctggaggagcatcaccagagcctcaaggtgagccatggcggctgcrcctcagcctccacccctctcccccctgcccctgacagcacagtccttccatgcagggctcttggcttccaccatcttggggctccaggtgtgggcaggag

SEQ ID NO: 65355 - DNA, 201 bp, Homo sapiens
gactgaccttctctgagcttaggttgctttatctgtagagatgatgataatgacagcacctaccgcacagaaatatctgagttagaagataacacgtgtaygctgctcagaactgggcccagccctcagtcggggctcagtcattgtgggtcattgtgactgtagttatgcgctgagatggaggcctcacagctcatgtgg

SEQ ID NO: 65356 - DNA, 201 bp, Homo sapiens
ggggtttcaccatgcgggccaggctggtcttgaactcctgacctcgtgatccgcctgtctcagccttccaaagtgctgggagtacaggcgtgagccacagygccggcctactgagttttttgattccaaaattgagtttgagttgtggtgccaacatgtggcggccaaggctgtagagagtagtggagacttagaggcgtg

SEQ ID NO: 65357 - DNA, 201 bp, Homo sapiens
cacggggtgactgagagcagaggtggtgatctagacaaggctggtgcttgacacaaggatggtgacaaagatcaggaaggtggcaaacagtgaagggtcartgaccccaggagaggtatagaaagacgctggcagcggccaggcacagtggctcacgcctgtaatcccagcacttgggagcctgaagcaggcagatcactt

SEQ ID NO: 65358 - DNA, 201 bp, Homo sapiens
ccacgcgtgtgtcaggaaggcttctgggtagaccatcagctgggtcgcatcagtccttctcatggggtgcacagcttcctctcctccttcctgcacccaakcctaggggagtctcctcttcagagtctagcagacctaatgccatggctgccacatgacaggactcagtaaatacttcctggataaagggagagggaggca

SEQ ID NO: 65359 - DNA, 201 bp, Homo sapiens
gatgaccacccactggtgggttctcatccgcctggggagaggatgtgctgggagcactggagctggcttagggccatgggcaccaacatttagggaagtcrggggtttcaggctttcatgagaggacagagggactgagaaaggttgacttggatcaggaaagagttacgggcttatgggagccagaggagatgagactca

SEQ ID NO: 65360 - DNA, 201 bp, Homo sapiens
gggatgaccacccactggtgggttctcatccgcctggggagaggatgtgctgggagcactggagctggcttagggccatgggcaccaacatttagggaagkcgggggtttcaggctttcatgagaggacagagggactgagaaaggttgacttggatcaggaaagagttacgggcttatgggagccagaggagatgagact

SEQ ID NO: 65361 - DNA, 201 bp, Homo sapiens
gatttccctgatgttggtttttgtatttcttctctgcaccttaaaaacctcggtaatgagacttctgtaggaaaaacccagcttctgtttctaatgaggcyccctaagtttttcagtaacaaagccattctttccagctttgaagttttagacagaaacacggttttcgttttagaggtggtgcagcttggtggctgggag

SEQ ID NO: 65362 - DNA, 201 bp, Homo sapiens
caccggaggctctctaagcagagtcttggttgggagaaatggtcaagtctctccctcctgtgttttggcgacaatcagcagcattgaaagggacagagagrcagccctgggaagtgagctcatgcatttgggtattggcaagggtgtcccgaggaggcgtgaggaagcaagggtgcagacgggcagcatggtatagcctgc

SEQ ID NO: 65363 - DNA, 201 bp, Homo sapiens
tccctgaccaccctgtgaagcagcaccctcatctcatcctcttcctctactcggctttcttttgttttctgaaagatttttttaacacctaaaattaatgwtgtgtttatgtgggggctttttgcccactttcctctgactctcctgctggaatgtgagctccaggttagcaaactttgttttcatccagctctgcaccgt

SEQ ID NO: 65364 - DNA, 201 bp, Homo sapiens
caatgcttccctctctgacacctctcccatggacagttccccatcagggattccgaagcgtcgcacaggtgagaacacacgggcccctgccccttcagtcrcctgcctttctttttctcttttttttttttttttttttttttgagacatagtctcgctctgttgcctaggctggagtgcagtggcatgatctcggctcac

SEQ ID NO: 65365 - DNA, 201 bp, Homo sapiens
ggcagaggttgcagcgagccgagatcatgccactgcactccagcctgggcaacagagtgagactctgtctcaagaaaaaaggaaaggtcccttcctcccakgtctgattgttaatcgatgtggtgttagcatggcacctggcactttgcgacacccgggactatacgcacctccctctgtcccagctcagctacgcaatcc

SEQ ID NO: 65366 - DNA, 201 bp, Homo sapiens
ccccgtcctgccacatctcctgagaacaatgcttccctctctgacacctctcccatggacagttccccatcagggattccgaagcgtcgcacaggtgagarcacacgggcccctgccccttcagtcgcctgcctttctttttctcttttttttttttttttttttttttgagacatagtctcgctctgttgcctaggctgg

SEQ ID NO: 65367 - DNA, 201 bp, Homo sapiens; identical to SEQ ID NO: 13746

SEQ ID NO: 65368 - DNA, 201 bp, Homo sapiens; identical to SEQ ID NO: 13750

SEQ ID NO: 65369 - DNA, 201 bp, Homo sapiens
cggtgcaggctctacaacctcagcggaacagacgggagctctggatgtagctctttttgagttatctcacttggactggaatagccaggcctttaaacccmgcattggtcattcgttagttgtggcctaccctgggaagggcatggtttgggcgagggaggccattttgaagctgagaccatctctgatttgggctgaaca

SEQ ID NO: 65370 - DNA, 201 bp, Homo sapiens
cacggtgcaggctctacaacctcagcggaacagacgggagctctggatgtagctctttttgagttatctcacttggactggaatagccaggcctttaaacmcagcattggtcattcgttagttgtggcctaccctgggaagggcatggtttgggcgagggaggccattttgaagctgagaccatctctgatttgggctgaa

SEQ ID NO: 65371 - DNA, 201 bp, Homo sapiens
ctcagcctgggtgacagagtgagtccctgtctctaaaaaagaaaaagtggaagcagaataatgttatttcctaatctcaagctctttcctcagctccatcmcattccatccacacatgcacccatccgccccttcatttcttcagtcacccattcaaaaaagattttctaagtacctggtctatgcctgacattgtttcag

SEQ ID NO: 65372 - DNA, 201 bp, Homo sapiens
tgatgtctcgctgaggaggtcctggaagctccagaccctctccacctggtcaacatggagcaagcgcttgtggagaaccaaagcccaaaagccccagatcsccttaaagcagagagggagggcaggcgggagggagggcattggcatgcggcgctgtgcatggggtgagacccagagcggtatctttgccaggatgggggc

SEQ ID NO: 65373 - DNA, 201 bp, Homo sapiens
ttgccatttgtctgtcttctttagagagatagctgttcacgtcttttgcccatttgtcttctttagagagatggctgttcacgtcttttgcccatttgtcytctttagagagatggctgttcacgtcttttgcccatagttattagattgatgcaaaagtaattgtgattttgccattaaaagcaatatttgtcattatgc

SEQ ID NO: 65374 - DNA, 201 bp, Homo sapiens
agtcatgtatcccaattaaacagatgagaaaagtgaggctcatgaagattataaatcttatccaagatcctgccatctctagaataaatgttaggactttwtttttttgagacggggtttcactgttgtccccaggctggagtgcaatggtgcaatctcggctcactacaacctctgcctcccgggttcaagccagtctcc

SEQ ID NO: 65375 - DNA, 201 bp, Homo sapiens
aagcgatctgcccacctcggcctcccaaagttctgggattacaggcgtgagccaccgagcccagcctgtaagccaattttatctcaacctcatgaggtagmtctattaaacatgccaacttgacagatgagaaactgaggcacagggttaagtaacttgccacagagatctgattcccatttcatagatggagaaatggaa

SEQ ID NO: 65376 - DNA, 201 bp, Homo sapiens
aatggacagttgcttgtcaaagggtacaaagttttggttagacaggaggaataacttttgagatctattgcacagcaggataactatagtaaataataatrtatgtttcaaaaatcacctaaaaagtaagttttaaatgtatcgctgggcactttggctcaggactgtaagcctagcactttggaaggacaaggtggaagg

SEQ ID NO: 65377 - DNA, 201 bp, Homo sapiens
tctattcagtttgacacgaatggagatggggagatcaccctggtggagctacagcaggccatgcagagactcctgggggagcggctcaccccccgggagakctctgaggttgtccgggaggctgatgttaatggagacggcacagttgactttgaaggtgacattgacggggcgtggtggggagcgggggcagccaccgca

SEQ ID NO: 65378 - DNA, 201 bp, Homo sapiens
aataaatagggaagaaaaataacgtattccaaacacctgcaatggatcaatgcctctgtatactttatctgatttaatcctcaaaaaaacaaacaaacaaaaacaaaaacacgcacacaaacacattaggagtaagcaagcagtcatgtatcccaattaaacagatgagaaaagtgaggctcatgaagattataaatctta

SEQ ID NO: 65379 - DNA, 201 bp, Homo sapiens
ggcatgagccaccgtgcctggccagggcctctattcttagtgcctgtaacaggaagaatccaagaatttgagatcccagaagggaatgcaaagtggtcatmtggtacgaaccacttgctgcagacatactaaaaaatatcagacccagtgagaataacagacttgcttatatcccctgataaaataccttctcgttctgag

SEQ ID NO: 65380 - DNA, 201 bp, Homo sapiens
aaagggtacaaagttttggttagacaggaggaataacttttgagatctattgcacagcaggataactatagtaaataataatgtatgtttcaaaaatcacytaaaaagtaagttttaaatgtatcgctgggcactttggctcaggactgtaagcctagcactttggaaggacaaggtggaagggttgcttaaggccaagat

SEQ ID NO: 65381 - DNA, 201 bp, Homo sapiens
caataaatagggaagaaaaataacgtattccaaacacctgcaatggatcaatgcctctgtatactttatctgatttaatcctcaaaaaaacaaacaaacaaaaacaaaaacacgcacacaaacacattaggagtaagcaagcagtcatgtatcccaattaaacagatgagaaaagtgaggctcatgaagattataaatctt

SEQ ID NO: 65382 - DNA, 201 bp, Homo sapiens
cagtcacccattcaaaaaagattttctaagtacctggtctatgcctgacattgtttcaggtaatggaaatagagcaaggacaaggtatttggcctcaacartctcatattttagaaccatgcaattcaatagaatcttctgcgaggatagaaatattccagacccgcgctgtttattatggtagccacatgtgactactga

SEQ ID NO: 65383 - DNA, 201 bp, Homo sapiens
gcttaaggccaagattttaagaccaacctggccaaaatagtgagaccccgtctcattaaaaaaaagtttcggccgggcacagtggctcaagcctgtaatcycagcactttaggaggctgaggcaggtggatcaactgaggtcaggagttcaagatcagcctggccaacatggtgaaaccctgtctctactaaaaatacaaa

SEQ ID NO: 65384 - DNA, 201 bp, Homo sapiens
tcaataaatagggaagaaaaataacgtattccaaacacctgcaatggatcaatgcctctgtatactttatctgatttaatcctcaaaaaaacaaacaaacaaaaacaaaaacacgcacacaaacacattaggagtaagcaagcagtcatgtatcccaattaaacagatgagaaaagtgaggctcatgaagattataaatct

SEQ ID NO: 65385 - DNA, 201 bp, Homo sapiens
aagtttcggccgggcacagtggctcaagcctgtaatctcagcactttaggaggctgaggcaggtggatcaactgaggtcaggagttcaagatcagcctggycaacatggtgaaaccctgtctctactaaaaatacaaatattaaacaggtttggtggtgcgcgcctgtaatcccagctactcgggaggctgagggacgaga

SEQ ID NO: 65386 - DNA, 201 bp, Homo sapiens
atcaataaatagggaagaaaaataacgtattccaaacacctgcaatggatcaatgcctctgtatactttatctgatttaatcctcaaaaaaacaaacaaacaaaaacaaaaacacgcacacaaacacattaggagtaagcaagcagtcatgtatcccaattaaacagatgagaaaagtgaggctcatgaagattataaatc

SEQ ID NO: 65387 - DNA, 201 bp, Homo sapiens
aaaccctgtctctactaaaaatacaaatattaaacaggtttggtggtgcgcgcctgtaatcccagctactcgggaggctgagggacgagaatcgcttgaayccaggaggtgaaggctgcagtgagctgagattgcaccactgcacttcagcctgggtgacagggtgagactgtctcaaataaaaaaaaaaaaaaaaagaaa

SEQ ID NO: 65388 - DNA, 201 bp, Homo sapiens
tcatggtgctggtgatggtagaggcagaccctctgaggtctgcctgtaattagccaatgccatggacagcacccaccaaccaggcccccacctttttttttccagccatggtgggatcaataaatagggaagaaaaataacgtattccaaacacctgcaatggatcaatgcctctgtatactttatctgatttaatcctca

SEQ ID NO: 65389 - DNA, 201 bp, Homo sapiens
aactccatcatctcgtggctatcatcattgtcattgctgatataatctatttctgcttctattcagtttgacacgaatggagatggggagatcaccctggyggagctacagcaggccatgcagagactcctgggggagcggctcaccccccgggagatctctgaggttgtccgggaggctgatgttaatggagacggcaca

SEQ ID NO: 65390 - DNA, 201 bp, Homo sapiens
tcctcagtgggtggccgtgtagactttgatgactttgtggagctgatgacccccaaattgcttgcagaaacagctgggatgatcggtgtccaggagatgcrggatgccttcaaggaggtgagttaacagtgtcatggtgctggtgatggtagaggcagaccctctgaggtctgcctgtaattagccaatgccatggacagc

SEQ ID NO: 65391 - DNA, 201 bp, Homo sapiens
ttatagggcagggagaagggagctgatctaactgactcgaagcacaaagtgaggtaatggaaggccagggcttgtggggtctcgctaatcctgtgccatcytcctcagtgggtggccgtgtagactttgatgactttgtggagctgatgacccccaaattgcttgcagaaacagctgggatgatcggtgtccaggagatgc

SEQ ID NO: 65392 - DNA, 201 bp, Homo sapiens; identical to SEQ ID NO: 13525

SEQ ID NO: 65393 - DNA, 201 bp, Homo sapiens
gagctgcgggaagcatttcttgagttcgataaggaccgagatgggttcatctcttgtaaggatctggggaatctcatgaggacgatgggttacatgcccasggagatggaactgattgagctcggccagcaaatccgcatgaactgtgagtccagggaatgggagggatggccggggttagggaagggatcagggcagaat

SEQ ID NO: 65394 - DNA, 201 bp, Homo sapiens; identical to SEQ ID NO: 13526

SEQ ID NO: 65395 - DNA, 201 bp, Homo sapiens; identical to SEQ ID NO: 13530

SEQ ID NO: 65396 - DNA, 201 bp, Homo sapiens; identical to SEQ ID NO: 13533

SEQ ID NO: 65397 - DNA, 201 bp, Homo sapiens; identical to SEQ ID NO: 13535

SEQ ID NO: 65398 - DNA, 201 bp, Homo sapiens; identical to SEQ ID NO: 13538

SEQ ID NO: 65399 - DNA, 201 bp, Homo sapiens; identical to SEQ ID NO: 13539

SEQ ID NO: 65400 - DNA, 201 bp, Homo sapiens
ttactgggctccgtgtccctctgctggctccccagtaatacctcccgcttgcttctgcagtaatacggattcgtggcatctctagagtttattgcctattkccttctgagaccatggaccaattccttcatcatcactatatccccaaatcctagcactgagcccagcatgagtatattggatcactgaataagtgaaaag

SEQ ID NO: 65401 - DNA, 201 bp, Homo sapiens; identical to SEQ ID NO: 13542

SEQ ID NO: 65402 - DNA, 201 bp, Homo sapiens; identical to SEQ ID NO: 13544

SEQ ID NO: 65403 - DNA, 201 bp, Homo sapiens
ttttgtctacacatctgatgataagggcttctctttttttatttagattccagaagtcacagagcagtgaggtcagttgatccatgcgggagatttagagmccatttctacaggctggagaacatctttcaagcttaaataaccacctttagaaataccctctgcaccacctgcttcaatcagctggtcctttgtgaagaa

SEQ ID NO: 65404 - DNA, 201 bp, Homo sapiens
gggtttcactgttgtccccaggctggagtgcaatggtgcaatctcggctcactacaacctctgcctcccgggttcaagccagtctcctgtctcagcctccyaagtaactgggattacaggtgcgcgataccacacccagctaatttttgtatttttcgtagagacggggtttcaccatgttgaccaggctggtctcgaact

SEQ ID NO: 65405 - DNA, 201 bp, Homo sapiens
gtgagctgagattgcaccactgcacttcagcctgggtgacagggtgagactgtctcaaataaaaaaaaaaaaaaaaagaaagaaaaaaagaaaaaaaaaaacagaacaaaactgtcttttggagctgacgttctagtggctcacattcccaaagcttttatctcagtgcttgacccacagtaagcgataggtaaactccat

SEQ ID NO: 65406 - DNA, 201 bp, Homo sapiens
caaaaacaaaaacacgcacacaaacacattaggagtaagcaagcagtcatgtatcccaattaaacagatgagaaaagtgaggctcatgaagattataaatyttatccaagatcctgccatctctagaataaatgttaggactttttttttttgagacggggtttcactgttgtccccaggctggagtgcaatggtgcaatc

SEQ ID NO: 65407 - DNA, 201 bp, Homo sapiens
tcttcctcccagctgtgaagtcttacagaagtttttctgttcctctccatggaagttatcacagcagaccttgctgtgttgagttgtattagcttccaagrcctccatcctagatagagaggaggaagggccattctctaaaccatatatgctgtatgtcccagtatggaaacacagtagaggctggttggacacctgcta

SEQ ID NO: 65408 - DNA, 201 bp, Homo sapiens; identical to SEQ ID NO: 13550

SEQ ID NO: 65409 - DNA, 201 bp, Homo sapiens
aaacagctgggatgatcggtgtccaggagatgcgggatgccttcaaggaggtgagttaacagtgtcatggtgctggtgatggtagaggcagaccctctgakgtctgcctgtaattagccaatgccatggacagcacccaccaaccaggcccccacctttttttttccagccatggtgggatcaataaatagggaagaaaaa

SEQ ID NO: 65410 - DNA, 201 bp, Homo sapiens
tgtgttgagttgtattagcttccaaggcctccatcctagatagagaggaggaagggccattctctaaaccatatatgctgtatgtcccagtatggaaacayagtagaggctggttggacacctgctagatctagccaggattaggtgtgcagtggacatcaagtgacatctggagaaggtggggtgggggtgggagatgat

SEQ ID NO: 65411 - DNA, 201 bp, Homo sapiens; identical to SEQ ID NO: 13553

SEQ ID NO: 65412 - DNA, 201 bp, Homo sapiens
gcagtggacatcaagtgacatctggagaaggtggggtgggggtgggagatgatcctcaggccaaccaaaggcaagggaaggtcaggatgacctcaagaccygggtgggcagcaagatcgtcttgagccacagcaaagtcaggtgcaacctgcattccttccagggttcaccattcactatccacgtggcctcaggtatgtt

SEQ ID NO: 65413 - DNA, 201 bp, Homo sapiens; identical to SEQ ID NO: 13555

SEQ ID NO: 65414 - DNA, 201 bp, Homo sapiens
tcctcaggccaaccaaaggcaagggaaggtcaggatgacctcaagacccgggtgggcagcaagatcgtcttgagccacagcaaagtcaggtgcaacctgcrttccttccagggttcaccattcactatccacgtggcctcaggtatgttggtgaccctcgctggcgtaagtttccttatctgtaaagtgacacttatccct

SEQ ID NO: 65415 - DNA, 201 bp, Homo sapiens
agacccgggtgggcagcaagatcgtcttgagccacagcaaagtcaggtgcaacctgcattccttccagggttcaccattcactatccacgtggcctcaggyatgttggtgaccctcgctggcgtaagtttccttatctgtaaagtgacacttatccctccaggatggttgagatgatgaaatctcatagtgacaatcacag

SEQ ID NO: 65416 - DNA, 201 bp, Homo sapiens; identical to SEQ ID NO: 13558

SEQ ID NO: 65417 - DNA, 201 bp, Homo sapiens
tccacgtggcctcaggtatgttggtgaccctcgctggcgtaagtttccttatctgtaaagtgacacttatccctccaggatggttgagatgatgaaatctsatagtgacaatcacaggttttttgggttttgttttttagatggagtctcactccgtcacccaggctgcactacagtggtgcaaccttggctcactgcaac

SEQ ID NO: 65418 - DNA, 201 bp, Homo sapiens; identical to SEQ ID NO: 13560

SEQ ID NO: 65419 - DNA, 201 bp, Homo sapiens
agagtttgtgaagatgatgtctcgctgaggaggtcctggaagctccagaccctctccacctggtcaacatggagcaagcgcttgtggagaaccaaagcccmaaagccccagatccccttaaagcagagagggagggcaggcgggagggagggcattggcatgcggcgctgtgcatggggtgagacccagagcggtatcttt

SEQ ID NO: 65420 - DNA, 201 bp, Homo sapiens
gggagggcaggcgggagggagggcattggcatgcggcgctgtgcatggggtgagacccagagcggtatctttgccaggatgggggcgtctgcagaactagrttaagaaggaagagtctgtggatggaaataggaagcgtgggagggtccagttgccacccccaaaaattccaatgattcttgacatcttttcacttcacgt

SEQ ID NO: 65421 - DNA, 201 bp, Homo sapiens
ttaagtaatttcccagggatcaccagcagtgcctgccacataggaagggctcaaaaaataatgttgggggcttttacaacgagatgccttactggggattyttttttttctttgcagagtttgtgaagatgatgtctcgctgaggaggtcctggaagctccagaccctctccacctggtcaacatggagcaagcgcttgtg

SEQ ID NO: 65422 - DNA, 201 bp, Homo sapiens
gttcatctcttgtaaggatctggggaatctcatgaggacgatgggttacatgcccacggagatggaactgattgagctcggccagcaaatccgcatgaacygtgagtccagggaatgggagggatggccggggttagggaagggatcagggcagaattgggaaggatgtagaggttaagagtagagttcggggtggagagg

SEQ ID NO: 65423 - DNA, 201 bp, Homo sapiens
atccgcatgaactgtgagtccagggaatgggagggatggccggggttagggaagggatcagggcagaattgggaaggatgtagaggttaagagtagagttsggggtggagaggaggatgagagggactagaagtctggaagaaaacaggtcagattcgactcaggaaggcagcatttgaagtggttaaaagcttttagaga

SEQ ID NO: 65424 - DNA, 201 bp, Homo sapiens; identical to SEQ ID NO: 13570

SEQ ID NO: 65425 - DNA, 201 bp, Homo sapiens
cttgggagaacaaggagaccctttggagaatgggtgaccctctctccaaattccctctcatctgcattcctttccaggaaagaccactgggacaagatgarattgaaggtaacaccgtcttccccagttgcttccacgttgccatccacccacctgacctgccctcagtccctttgtgcatttctgtataaattccattac

SEQ ID NO: 65426 - DNA, 201 bp, Homo sapiens; identical to SEQ ID NO: 13571

SEQ ID NO: 65427 - DNA, 201 bp, Homo sapiens
cactgggacaagatgagattgaaggtaacaccgtcttccccagttgcttccacgttgccatccacccacctgacctgccctcagtccctttgtgcatttcygtataaattccattacatggaatttttacaatccctctctcttcccactcaactgtaattttgtagaactctttctcgtggcagttgaaggacttcccaa

SEQ ID NO: 65428 - DNA, 201 bp, Homo sapiens
gagctgggcagcaagtcctttcttgaagggggatctaggaagcccacgtctatctccatcacaggggcaattccacggacaatgagtgaagggaggaggakactgcaggaagacaaggggtaagagaattccagcacaaggaagacacggaggcggggggaggaggaggagagggagaaggagagggaggaggagaaggag

SEQ ID NO: 65429 - DNA, 201 bp, Homo sapiens
aaccaagatggcaccctgcactcagcctgggtgacagagtgagtccctgtctctaaaaaagaaaaagtggaagcagaataatgttatttcctaatctcaasctctttcctcagctccatcccattccatccacacatgcacccatccgccccttcatttcttcagtcacccattcaaaaaagattttctaagtacctggtc

SEQ ID NO: 65430 - DNA, 201 bp, Homo sapiens; identical to SEQ ID NO: 1042

SEQ ID NO: 65431 - DNA, 201 bp, Homo sapiens; identical to SEQ ID NO: 1048

SEQ ID NO: 65432 - DNA, 201 bp, Homo sapiens; identical to SEQ ID NO: 1051

SEQ ID NO: 65433 - DNA, 201 bp, Homo sapiens; identical to SEQ ID NO: 13588

SEQ ID NO: 65434 - DNA, 201 bp, Homo sapiens
ctgacattgtttcaggtaatggaaatagagcaaggacaaggtatttggcctcaacagtctcatattttagaaccatgcaattcaatagaatcttctgcgasgatagaaatattccagacccgcgctgtttattatggtagccacatgtgactactgagtattaaatgtgtgagcaaggctgagaaactaaattttatttta

SEQ ID NO: 65435 - DNA, 201 bp, Homo sapiens
tagaggcagaccctctgaggtctgcctgtaattagccaatgccatggacagcacccaccaaccaggcccccacctttttttttccagccatggtgggatcrataaatagggaagaaaaataacgtattccaaacacctgcaatggatcaatgcctctgtatactttatctgatttaatcctcaaaaaaacaaacaaacaaa

SEQ ID NO: 65436 - DNA, 201 bp, Homo sapiens; identical to SEQ ID NO: 13589

SEQ ID NO: 65437 - DNA, 201 bp, Homo sapiens
tattgaattgcatgtttcaaaatataagcttgttgaggccaaataccttgtccttgctctatttccattacctggaacaatgccaggcatagaccaggtayttagaaaatcttttttgaatgggtgactgaagaaatgaaggggaagatgggtgaatgtgtagatggaatgagaattgtgggagctatcattcaagatgag

SEQ ID NO: 65438 - DNA, 201 bp, Homo sapiens
gcctgtaattagccaatgccatggacagcacccaccaaccaggcccccacctttttttttccagccatggtgggatcaataaatagggaagaaaaataacrtattccaaacacctgcaatggatcaatgcctctgtatactttatctgatttaatcctcaaaaaaacaaacaaacaaaaacaaaaacacgcacacaaacac

SEQ ID NO: 65439 - DNA, 201 bp, Homo sapiens
agaaaaataacgtattccaaacacctgcaatggatcaatgcctctgtatactttatctgatttaatcctcaaaaaaacaaacaaacaaaaacaaaaacacrcacacaaacacattaggagtaagcaagcagtcatgtatcccaattaaacagatgagaaaagtgaggctcatgaagattataaatcttatccaagatcctg

SEQ ID NO: 65440 - DNA, 201 bp, Homo sapiens
ccgtctggaataccctttcccctctcccctggctaactcctagttatgttcctggaaggtacctcccacctctcttactgggctccgtgtccctctgctgkctccccagtaatacctcccgcttgcttctgcagtaatacggattcgtggcatctctagagtttattgcctatttccttctgagaccatggaccaattcct

SEQ ID NO: 65441 - DNA, 201 bp, Homo sapiens; identical to SEQ ID NO: 13846

SEQ ID NO: 65442 - DNA, 201 bp, Homo sapiens
ccttccgtctggaataccctttcccctctcccctggctaactcctagttatgttcctggaaggtacctcccacctctcttactgggctccgtgtccctctkctggctccccagtaatacctcccgcttgcttctgcagtaatacggattcgtggcatctctagagtttattgcctatttccttctgagaccatggaccaat

SEQ ID NO: 65443 - DNA, 201 bp, Homo sapiens
atcatgcacaaagcaccactgtatttttaaattttccttccctgtctttgctcaagttgtccttccgtctggaataccctttcccctctcccctggctaaytcctagttatgttcctggaaggtacctcccacctctcttactgggctccgtgtccctctgctggctccccagtaatacctcccgcttgcttctgcagtaa

SEQ ID NO: 65444 - DNA, 201 bp, Homo sapiens
tgtaaaatgaggtggatgatgacaccttttggagaaaactaaaagaaatcatgcacaaagcaccactgtatttttaaattttccttccctgtctttgctcragttgtccttccgtctggaataccctttcccctctcccctggctaactcctagttatgttcctggaaggtacctcccacctctcttactgggctccgtgt

SEQ ID NO: 65445 - DNA, 201 bp, Homo sapiens
cacatgtgactactgagtattaaatgtgtgagcaaggctgagaaactaaattttattttatttttatcaagtgagaacagttttattaatgaatacataaktgcattagtctgttttcatgatgctgataaagacatacccgagactggataatttataaagaaaaagaggccaggcatggtggctcatgcttgtaatcct

SEQ ID NO: 65446 - DNA, 201 bp, Homo sapiens
taagggtcagttttcccatctgtaaaatgaggtggatgatgacaccttttggagaaaactaaaagaaatcatgcacaaagcaccactgtatttttaaattwtccttccctgtctttgctcaagttgtccttccgtctggaataccctttcccctctcccctggctaactcctagttatgttcctggaaggtacctcccacc

SEQ ID NO: 65447 - DNA, 201 bp, Homo sapiens; identical to SEQ ID NO: 13604

SEQ ID NO: 65448 - DNA, 201 bp, Homo sapiens
aagtggttaaaagcttttagagataggtctgggttcaaatctcagttctattatttactaattacagtcattttgaaaagtgaagttatccgctactcttsagtttccatttcctcatctatagaggaagatgcctctctccttacctcatgggactgtggaaaggaagagaaggaagagataaagatgctgatgcagtta

SEQ ID NO: 65449 - DNA, 201 bp, Homo sapiens; identical to SEQ ID NO: 1049

SEQ ID NO: 65450 - DNA, 201 bp, Homo sapiens; identical to SEQ ID NO: 13874

SEQ ID NO: 65451 - DNA, 201 bp, Homo sapiens; identical to SEQ ID NO: 13876

SEQ ID NO: 65452 - DNA, 201 bp, Homo sapiens; identical to SEQ ID NO: 13880

SEQ ID NO: 65453 - DNA, 201 bp, Homo sapiens; identical to SEQ ID NO: 13878

SEQ ID NO: 65454 - DNA, 201 bp, Homo sapiens
gcaagatagaataagagccaagagaaaggggtttccccctataaaaccatcagctcttgtgagacttattcactaccatgagaacagtatgaaggaaactkcccccataattccattatcttccaccaggtttctcccacaacatgtgggaattacgggagctatgattcaagatgagatttgggtggggacacagccaaa

SEQ ID NO: 65455 - DNA, 201 bp, Homo sapiens; identical to SEQ ID NO: 13881

SEQ ID NO: 65456 - DNA, 201 bp, Homo sapiens; identical to SEQ ID NO: 13614

SEQ ID NO: 65457 - DNA, 201 bp, Homo sapiens; identical to SEQ ID NO: 13616

SEQ ID NO: 65458 - DNA, 201 bp, Homo sapiens
ctggtggctccgaggaacacctcagccaaggccctttccttcccatgctcaggacgcccttccgccttgcccattccttgttagtttgcagggcacctttkatcctaggaagaacttgtcccatcagaaagagactggactggctagcagctggagctctggggtcaggttcaggggcttcaaattcaggatcatcgctga

SEQ ID NO: 65459 - DNA, 201 bp, Homo sapiens
gacccgcgctgtttattatggtagccacatgtgactactgagtattaaatgtgtgagcaaggctgagaaactaaattttattttatttttatcaagtgagmacagttttattaatgaatacataagtgcattagtctgttttcatgatgctgataaagacatacccgagactggataatttataaagaaaaagaggccagg

SEQ ID NO: 65460 - DNA, 201 bp, Homo sapiens
gtgcaagtggcattcaaagtcaactccttccttttcctgatttcctggaagcactgtctggtttctctctctctctctctctctctctctctctctctctstctgtctgtctctgtctcccctcccacatcccttcctttgtgtaagatactcaggggactgaattaaaccacaaatctggattatcaaggtttagagcta

SEQ ID NO: 65461 - DNA, 201 bp, Homo sapiens
gacacagccaaaccacatcaataggtaacatgggaattatgggagctacaattcaagatgagatttgggtggggacatggccaaaccatatttccatcctygcagaagattctattgaattgcatgtttcaaaatataagcttgttgaggccaaataccttgtccttgctctatttccattacctggaacaatgccaggca

SEQ ID NO: 65462 - DNA, 201 bp, Homo sapiens
ggatgagacgtggggttcttttttatgtgaggcataggaaggcatgtcggccggacatggtggctcacgcctgtaatcccagcactttgggaggccgaggygagtggatcacctgaggttagtagtttgagaccagcctggccaacatggcgaaatcctgtctctactacgaatacaaaaaaattagccggaagtggtggc

SEQ ID NO: 65463 - DNA, 201 bp, Homo sapiens; identical to SEQ ID NO: 13630

SEQ ID NO: 65464 - DNA, 201 bp, Homo sapiens
ccttgttagtttgcagggcaccttttatcctaggaagaacttgtcccatcagaaagagactggactggctagcagctggagctctggggtcaggttcaggrgcttcaaattcaggatcatcgctgactcagcatgtggcttatgctactccctttttctctttaagggtcagttttcccatctgtaaaatgaggtggatga

SEQ ID NO: 65465 - DNA, 201 bp, Homo sapiens
caggctattcatttcaaagagctgggtgtcgctcacttctggtggctccgaggaacacctcagccaaggccctttccttcccatgctcaggacgcccttcygccttgcccattccttgttagtttgcagggcaccttttatcctaggaagaacttgtcccatcagaaagagactggactggctagcagctggagctctggg

SEQ ID NO: 65466 - DNA, 201 bp, Homo sapiens; identical to SEQ ID NO: 1041

SEQ ID NO: 65467 - DNA, 201 bp, Homo sapiens; identical to SEQ ID NO: 13643

SEQ ID NO: 65468 - DNA, 201 bp, Homo sapiens
gagtgatctcacctcactgcaacgtctacctcccgggctcaagccatccacccacctcagcctcaccctcctcagctgggaccataggtgcatgccaccaygcctggttaatttttgtatttttttttttgtaaagacagggttttgccatgttgcccaggctggttgcaaactcctgggctcaagctatccacccttttc

SEQ ID NO: 65469 - DNA, 201 bp, Homo sapiens; identical to SEQ ID NO: 13906

SEQ ID NO: 65470 - DNA, 201 bp, Homo sapiens
tctcactgctacctccgcctcccaggttcaagcgattcttctgccttggctgaggcagcctccctagtagctgggatcaaaggcatgagccaccatgcccrgctaattttttgtatttagtagagatggggttctgccatgttggtcagtctggcctcaaactcctcacctcaggtgatccacccacctcgacctcccaaa

SEQ ID NO: 65471 - DNA, 201 bp, Homo sapiens
ttctctcttaactttcagagctgcgggaagcatttcttgagttcgataaggaccgagatgggttcatctcttgtaaggatctggggaatctcatgaggackatgggttacatgcccacggagatggaactgattgagctcggccagcaaatccgcatgaactgtgagtccagggaatgggagggatggccggggttaggga

SEQ ID NO: 65472 - DNA, 201 bp, Homo sapiens; identical to SEQ ID NO: 13917

SEQ ID NO: 65473 - DNA, 201 bp, Homo sapiens
acacagcagcaggcaagatagaataagagccaagagaaaggggtttccccctataaaaccatcagctcttgtgagacttattcactaccatgagaacagtwtgaaggaaacttcccccataattccattatcttccaccaggtttctcccacaacatgtgggaattacgggagctatgattcaagatgagatttgggtggg

SEQ ID NO: 65474 - DNA, 201 bp, Homo sapiens
tgaaggctgcagtgagctgagattgcaccactgcacttcagcctgggtgacagggtgagactgtctcaaataaaaaaaaaaaaaaaaagaaagaaaaaaaraaaaaaaaaaacagaacaaaactgtcttttggagctgacgttctagtggctcacattcccaaagcttttatctcagtgcttgacccacagtaagcgatag

SEQ ID NO: 65475 - DNA, 201 bp, Homo sapiens
tgcaacgtctacctcccgggctcaagccatccacccacctcagcctcaccctcctcagctgggaccataggtgcatgccaccatgcctggttaatttttgkatttttttttttgtaaagacagggttttgccatgttgcccaggctggttgcaaactcctgggctcaagctatccacccttttcagctcccccaaagtgct

SEQ ID NO: 65476 - DNA, 201 bp, Homo sapiens; identical to SEQ ID NO: 13936

SEQ ID NO: 65477 - DNA, 201 bp, Homo sapiens
gtgaaggctgcagtgagctgagattgcaccactgcacttcagcctgggtgacagggtgagactgtctcaaataaaaaaaaaaaaaaaaagaaagaaaaaargaaaaaaaaaaacagaacaaaactgtcttttggagctgacgttctagtggctcacattcccaaagcttttatctcagtgcttgacccacagtaagcgata

SEQ ID NO: 65478 - DNA, 201 bp, Homo sapiens; identical to SEQ ID NO: 13673

SEQ ID NO: 65479 - DNA, 201 bp, Homo sapiens; identical to SEQ ID NO: 13938

SEQ ID NO: 65480 - DNA, 201 bp, Homo sapiens; identical to SEQ ID NO: 13677

SEQ ID NO: 65481 - DNA, 201 bp, Homo sapiens
acgaatggagatggggagatcaccctggtggagctacagcaggccatgcagagactcctgggggagcggctcaccccccgggagatctctgaggttgtccrggaggctgatgttaatggagacggcacagttgactttgaaggtgacattgacggggcgtggtggggagcgggggcagccaccgcaggaatccacttccaa

SEQ ID NO: 65482 - DNA, 201 bp, Homo sapiens; identical to SEQ ID NO: 13679

SEQ ID NO: 65483 - DNA, 201 bp, Homo sapiens
tactcaggaggctgaggcagaagaatcgcttgaacccgggaggcagaggttgcagtgagccaagatcgcaccactgcactccagcctgggtaaaaagagcraaactccacctcaaaaaaaaaaaaaaaaaaaaaaaaaaagctgaatagtattccattgtgtacttatgccatgttttctttatccactcttctgttttga

SEQ ID NO: 65484 - DNA, 201 bp, Homo sapiens; identical to SEQ ID NO: 13954

SEQ ID NO: 65485 - DNA, 201 bp, Homo sapiens
acatggagaaaccccgtctctactaaaaatacaaaattagctaggcgtggtggtacatgcgtgtaatcccaagtactcaggaggctgaggcagaagaatcrcttgaacccgggaggcagaggttgcagtgagccaagatcgcaccactgcactccagcctgggtaaaaagagcgaaactccacctcaaaaaaaaaaaaaaa

SEQ ID NO: 65486 - DNA, 201 bp, Homo sapiens
cagtgtttaagaccccctttgacacaatgtgatgggtgtttgtctcagaaagggagaaaaagggagattgggattcgtgggtgggagagagacatcgagargggggtggggagccaagaactgtggaacaggagtcaggagatgggaaaaggaatgggagggatggaggaggagagagagaatggaaagagaaccacgaga

SEQ ID NO: 65487 - DNA, 201 bp, Homo sapiens; identical to SEQ ID NO: 13692

SEQ ID NO: 65488 - DNA, 201 bp, Homo sapiens
ggcaagatagaataagagccaagagaaaggggtttccccctataaaaccatcagctcttgtgagacttattcactaccatgagaacagtatgaaggaaacytcccccataattccattatcttccaccaggtttctcccacaacatgtgggaattacgggagctatgattcaagatgagatttgggtggggacacagccaa

SEQ ID NO: 65489 - DNA, 201 bp, Homo sapiens
aaaaaaaaaaaagcatgtcaagttctaattgtgacattctttggttcaaagatctcagcacctatctgctgcttatggacaaaaatccaaaattctggccrggctcagtggctcatgcctgtaatttcagcactttgggaagccaaggttggcggatcacctgaggtcaggagttcgagaccaggggggccaacgtggtga

SEQ ID NO: 65490 - DNA, 201 bp, Homo sapiens; identical to SEQ ID NO: 13976

SEQ ID NO: 65491 - DNA, 201 bp, Homo sapiens; identical to SEQ ID NO: 13980

SEQ ID NO: 65492 - DNA, 201 bp, Homo sapiens
aatccacttccaactcactgtcagattttccaagttggccactccttctcactcctctccaagtttgagaatggaagcgggtggcaggttttggaagcatytgttctgtccctttcttcccaggctattcatttcaaagagctgggtgtcgctcacttctggtggctccgaggaacacctcagccaaggccctttccttcc

SEQ ID NO: 65493 - DNA, 201 bp, Homo sapiens; identical to SEQ ID NO: 13981

SEQ ID NO: 65494 - DNA, 201 bp, Homo sapiens; identical to SEQ ID NO: 13705

SEQ ID NO: 65495 - DNA, 201 bp, Homo sapiens; identical to SEQ ID NO: 13984

SEQ ID NO: 65496 - DNA, 201 bp, Homo sapiens
tgagagctttcagcaacacaaggtgaaaataaagagtagtagagtgtttgggagcaaaggatttggaaccaggcaaacatgggttcaaatcctaggaggcytccacctattggctgtgcaagtgcctcccccagcttcttataaagatctacagctggccgggctcagtggctcacacccataatcccagcactttgggag

SEQ ID NO: 65497 - DNA, 201 bp, Homo sapiens; identical to SEQ ID NO: 1060

SEQ ID NO: 65498 - DNA, 201 bp, Homo sapiens
tgcaagtggcattcaaagtcaactccttccttttcctgatttcctggaagcactgtctggtttctctctctctctctctctctctctctctctctctctcsctgtctgtctctgtctcccctcccacatcccttcctttgtgtaagatactcaggggactgaattaaaccacaaatctggattatcaaggtttagagctag

SEQ ID NO: 65499 - DNA, 201 bp, Homo sapiens; identical to SEQ ID NO: 13993

SEQ ID NO: 65500 - DNA, 201 bp, Homo sapiens
taaattcttattaaaggtagttattactatcaccactaagattcatcagtggagcacgagattggagctgtattggatgttggaaacaaacttggagctgsagctaatgttggtgaatacagctgcaaaaaggatggatggatttttggatggagatcataactgatttttagattttagctagaataaaattcctattga

SEQ ID NO: 65501 - DNA, 201 bp, Homo sapiens
caccccaaagggaggagggatggggttttgtctacacatctgatgataagggcttctctttttttatttagattccagaagtcacagagcagtgaggtcakttgatccatgcgggagatttagagaccatttctacaggctggagaacatctttcaagcttaaataaccacctttagaaataccctctgcaccacctgctt

SEQ ID NO: 65502 - DNA, 201 bp, Homo sapiens
gggttttgtctacacatctgatgataagggcttctctttttttatttagattccagaagtcacagagcagtgaggtcagttgatccatgcgggagatttaragaccatttctacaggctggagaacatctttcaagcttaaataaccacctttagaaataccctctgcaccacctgcttcaatcagctggtcctttgtgaa

SEQ ID NO: 65503 - DNA, 201 bp, Homo sapiens
tggaggagaaggaggagaagatggaggaggaggagagggagaagaagagtgaaaggaagaagaagaaagaacaagaacaacaatgtgaatttccatctggrctgagagggaatcagattctgtaatcagttcttgatatctgccatgggcacagggagggaatggttgaggcagtcttgtggtgaattttctaccctctgt

SEQ ID NO: 65504 - DNA, 201 bp, Homo sapiens
ctctatgctaaggggaaggggacctgcaaagtgccagttctgctgtgatggacagaagtcagaggctggacgctgttcctagtcctagccacagactgaavgccactgtgggtgttttttaatatctaccctgttaagatggtgcccagagttccaaaccccctcctttccctctcctctattccaggaagatgattttca

SEQ ID NO: 65505 - DNA, 201 bp, Homo sapiens
acttgaacttgagggggtggaggttgcagtgagccgagatcatgccacttcactccagcctgagtgaaagagcaaaactccatctcaaaaaaaaaaaaaaagaaaaagaaaaagaaaaaaaggtataatggcctcacagttccacgtggctggggaggcctcacaatcatggcggaaggtgaaaggcacgtcttacacagc

SEQ ID NO: 65506 - DNA, 201 bp, Homo sapiens
ctaaaaataaaaaaattagccgggtgtggtggtgcatgcctgtaatcccagctactcaggaggctgaggcaggagaatcacttgaacttgagggggtggakgttgcagtgagccgagatcatgccacttcactccagcctgagtgaaagagcaaaactccatctcaaaaaaaaaaaaaaagaaaaagaaaaagaaaaaaag

SEQ ID NO: 65507 - DNA, 201 bp, Homo sapiens
gctgatataatctatttctgcttctattcagtttgacacgaatggagatggggagatcaccctggtggagctacagcaggccatgcagagactcctggggragcggctcaccccccgggagatctctgaggttgtccgggaggctgatgttaatggagacggcacagttgactttgaaggtgacattgacggggcgtggtg

SEQ ID NO: 65508 - DNA, 201 bp, Homo sapiens
tcctctccaagtttgagaatggaagcgggtggcaggttttggaagcatttgttctgtccctttcttcccaggctattcatttcaaagagctgggtgtcgcycacttctggtggctccgaggaacacctcagccaaggccctttccttcccatgctcaggacgcccttccgccttgcccattccttgttagtttgcagggca

SEQ ID NO: 65509 - DNA, 201 bp, Homo sapiens
actcctctccaagtttgagaatggaagcgggtggcaggttttggaagcatttgttctgtccctttcttcccaggctattcatttcaaagagctgggtgtcsctcacttctggtggctccgaggaacacctcagccaaggccctttccttcccatgctcaggacgcccttccgccttgcccattccttgttagtttgcaggg

SEQ ID NO: 65510 - DNA, 201 bp, Homo sapiens
ggaaatagagcaaggacaaggtatttggcctcaacagtctcatattttagaaccatgcaattcaatagaatcttctgcgaggatagaaatattccagaccygcgctgtttattatggtagccacatgtgactactgagtattaaatgtgtgagcaaggctgagaaactaaattttattttatttttatcaagtgagaacag

SEQ ID NO: 65511 - DNA, 201 bp, Homo sapiens; identical to SEQ ID NO: 14018

SEQ ID NO: 65512 - DNA, 201 bp, Homo sapiens
aaaaaaaaaaaaaaaaaagctattgggtttgcttctgggcatgtaacgaactaaacaaggttgaattcaaggtaatgatagtattcatatctgaaaaaaawttgtatgctcatttaattcatgctcctctttgtacaggtctacagaggaggagaaacatcttaaccaactgtctgaaagtcacacaggcagttacttcca

SEQ ID NO: 65513 - DNA, 201 bp, Homo sapiens; identical to SEQ ID NO: 13742

SEQ ID NO: 65514 - DNA, 201 bp, Homo sapiens
cagctcccggccccgcttacataaagcttcctgtgtgtgctggtcacacctcacacctcacgcctcacgcctcatgcctcactcacacctcacacctcacwcctcacacctccaactcagactttttagcttgaacttttttctcaataaaaccacagaagcccaggccgggtgcagtgactcatgcctgtgatcccagca

SEQ ID NO: 65515 - DNA, 201 bp, Homo sapiens; identical to SEQ ID NO: 29235

SEQ ID NO: 65516 - DNA, 201 bp, Homo sapiens; identical to SEQ ID NO: 29236

SEQ ID NO: 65517 - DNA, 201 bp, Homo sapiens
ccaaaggcagctcccggccccgcttacataaagcttcctgtgtgtgctggtcacacctcacacctcacgcctcacgcctcatgcctcactcacacctcacwcctcactcctcacacctccaactcagactttttagcttgaacttttttctcaataaaaccacagaagcccaggccgggtgcagtgactcatgcctgtgat

SEQ ID NO: 65518 - DNA, 201 bp, Homo sapiens; identical to SEQ ID NO: 29237

SEQ ID NO: 65519 - DNA, 201 bp, Homo sapiens; identical to SEQ ID NO: 29278

SEQ ID NO: 65520 - DNA, 201 bp, Homo sapiens
cagccagcctcaccgatcaaggaggccaaaggcagctcccggccccgcttacataaagcttcctgtgtgtgctggtcacacctcacacctcacgcctcacrcctcatgcctcactcacacctcacacctcactcctcacacctccaactcagactttttagcttgaacttttttctcaataaaaccacagaagcccaggcc

SEQ ID NO: 65521 - DNA, 201 bp, Homo sapiens; identical to SEQ ID NO: 29279

SEQ ID NO: 65522 - DNA, 201 bp, Homo sapiens; identical to SEQ ID NO: 29280

SEQ ID NO: 65523 - DNA, 201 bp, Homo sapiens; identical to SEQ ID NO: 29281

SEQ ID NO: 65524 - DNA, 201 bp, Homo sapiens; identical to SEQ ID NO: 29282

SEQ ID NO: 65525 - DNA, 201 bp, Homo sapiens; identical to SEQ ID NO: 29283

SEQ ID NO: 65526 - DNA, 201 bp, Homo sapiens
cgatcaaggaggccaaaggcagctcccggccccgcttacataaagcttcctgtgtgtgctggtcacacctcacacctcacgcctcacgcctcatgcctcaytcacacctcacacctcactcctcacacctccaactcagactttttagcttgaacttttttctcaataaaaccacagaagcccaggccgggtgcagtgact

SEQ ID NO: 65527 - DNA, 201 bp, Homo sapiens; identical to SEQ ID NO: 29284

SEQ ID NO: 65528 - DNA, 201 bp, Homo sapiens
atgcaagcagagggtgggtgggcaggggcactgtcgggaggagcagccctggggactccagcaatctgtctttgattcctcccagactgttaaccctgggrcacagcctccttcacccccagaggcccacagcagacaagctgagagccacacagcggccaagaggaggtgctggagggcccaggggtcccagtgctgcct

SEQ ID NO: 65529 - DNA, 201 bp, Homo sapiens
gcctcaccgatcaaggaggccaaaggcagctcccggccccgcttacataaagcttcctgtgtgtgctggtcacacctcacacctcacgcctcacgcctcaygcctcactcacacctcacacctcactcctcacacctccaactcagactttttagcttgaacttttttctcaataaaaccacagaagcccaggccgggtgc

SEQ ID NO: 65530 - DNA, 201 bp, Homo sapiens
gcctgcagcctgtcatttgtgagctgcaccatgagggctggaggccaggaaatggcgctctgtgcccccagtgtggggcacctcaagctagcatctgcagygactgtctctttacggccaggagcggacaggtgagcccaccacagctcaacggccaggagcagacaggtgaacccaccacagctcacctgtggactggga

SEQ ID NO: 65531 - DNA, 201 bp, Homo sapiens; identical to SEQ ID NO: 29239

SEQ ID NO: 65532 - DNA, 201 bp, Homo sapiens; identical to SEQ ID NO: 29286

SEQ ID NO: 65533 - DNA, 201 bp, Homo sapiens; identical to SEQ ID NO: 29287

SEQ ID NO: 65534 - DNA, 201 bp, Homo sapiens; identical to SEQ ID NO: 29288

SEQ ID NO: 65535 - DNA, 201 bp, Homo sapiens; identical to SEQ ID NO: 29289

SEQ ID NO: 65536 - DNA, 201 bp, Homo sapiens; identical to SEQ ID NO: 29290

SEQ ID NO: 65537 - DNA, 201 bp, Homo sapiens; identical to SEQ ID NO: 29240

SEQ ID NO: 65538 - DNA, 201 bp, Homo sapiens; identical to SEQ ID NO: 29241

SEQ ID NO: 65539 - DNA, 201 bp, Homo sapiens; identical to SEQ ID NO: 29291

SEQ ID NO: 65540 - DNA, 201 bp, Homo sapiens
ccagccagcctcaccgatcaaggaggccaaaggcagctcccggccccgcttacataaagcttcctgtgtgtgctggtcacacctcacacctcacgcctcaygcctcatgcctcactcacacctcacacctcactcctcacacctccaactcagactttttagcttgaacttttttctcaataaaaccacagaagcccaggc

SEQ ID NO: 65541 - DNA, 201 bp, Homo sapiens; identical to SEQ ID NO: 29292

SEQ ID NO: 65542 - DNA, 201 bp, Homo sapiens
gagctgctatcatcccactgtacccatggggagagccgctctcctccctcctttttccattctgtgttatttacagagcaccctcctgtatgccctgcacyactctcaaccctgggtacacagatggggctgccacagacgtggccctcaaggcgctcaggccgccttttggggagggccgtgaggggctggaatttttct

SEQ ID NO: 65543 - DNA, 201 bp, Homo sapiens; identical to SEQ ID NO: 29243

SEQ ID NO: 65544 - DNA, 201 bp, Homo sapiens
tgagggctggaagagcctccaggaggacccagccctgaacacgcccagctccacggcctcgtggaataaacttctcccatttcacaccccccagtttgtgktgcatggttagcacagccctaggaaaccagcacggatagtgagctccccgtcacaggaggtatgcaagcagagggtgggtgggcaggggcactgtcggga

SEQ ID NO: 65545 - DNA, 201 bp, Homo sapiens
cgccgcttttccagtcttgcccaacccggtatttctgcgcttgcctcagccacccgcaggagcgcaggccgcccttcgtcctcccgtcctctgcgcccacrggaccccgggccccgcccagtccgcaggtcccgcaggtccccccgggcgtgtcttcctggccctgcgacccccgggacagcgctgagaacacgcggaagg

SEQ ID NO: 65546 - DNA, 201 bp, Homo sapiens; identical to SEQ ID NO: 29293

SEQ ID NO: 65547 - DNA, 201 bp, Homo sapiens; identical to SEQ ID NO: 29244

SEQ ID NO: 65548 - DNA, 201 bp, Homo sapiens; identical to SEQ ID NO: 29246

SEQ ID NO: 65549 - DNA, 201 bp, Homo sapiens; identical to SEQ ID NO: 29247

SEQ ID NO: 65550 - DNA, 201 bp, Homo sapiens; identical to SEQ ID NO: 29249

SEQ ID NO: 65551 - DNA, 201 bp, Homo sapiens; identical to SEQ ID NO: 29250

SEQ ID NO: 65552 - DNA, 201 bp, Homo sapiens; identical to SEQ ID NO: 29253

SEQ ID NO: 65553 - DNA, 201 bp, Homo sapiens; identical to SEQ ID NO: 29254

SEQ ID NO: 65554 - DNA, 201 bp, Homo sapiens
tctcagcaattttttcttttctttttttttttttttttttcctgagactgagtctcactctgtcgcccaggctggagggcagtggcacgatctcggctcastgcaagctccgccacccgggttcacaccattctcctgcctcagcctcccgagtagctgggactacaggcggccgccactacgcccagctaattttttgta

SEQ ID NO: 65555 - DNA, 201 bp, Homo sapiens; identical to SEQ ID NO: 29258

SEQ ID NO: 65556 - DNA, 201 bp, Homo sapiens; identical to SEQ ID NO: 29260

SEQ ID NO: 65557 - DNA, 201 bp, Homo sapiens; identical to SEQ ID NO: 29261

SEQ ID NO: 65558 - DNA, 201 bp, Homo sapiens; identical to SEQ ID NO: 29297

SEQ ID NO: 65559 - DNA, 201 bp, Homo sapiens; identical to SEQ ID NO: 29298

SEQ ID NO: 65560 - DNA, 201 bp, Homo sapiens; identical to SEQ ID NO: 29262

SEQ ID NO: 65561 - DNA, 201 bp, Homo sapiens
cttttcctggcgttttcctccattccctctggctcctattccctcccccttcctctctttcttgggtatggttgagcaggtcgtgcactgcacaaggactmccagcagaggacgaggactgacatcaatttgtctttccctcccaacactgtgcgttccctaaccctgcacgaaggcaccctcctcccctcctcaagattc

SEQ ID NO: 65562 - DNA, 201 bp, Homo sapiens
ccgcaggtccccccgggcgtgtcttcctggccctgcgacccccgggacagcgctgagaacacgcggaaggtggggagacgcgcggcgctggccgggtcccwggcgccgttctcgcggtgcagcctgtgcctgggagtccggccgtcccacctcagaaccagagcaaagcgggagatggggcggcggccgctggggagaagg

SEQ ID NO: 65563 - DNA, 201 bp, Homo sapiens; identical to SEQ ID NO: 29299

SEQ ID NO: 65564 - DNA, 201 bp, Homo sapiens
tggcctgcagccctagccccaagccgcagctgggcaggttgggcagagcactggggaggccaggcccggccatgctgagcccggtgactcgtcagggtttscacaaaacatcttgagcacccagctgcaggcccctcgggacgtttccaatgaggctcccctgggcccctctctgtggcagaagggaccccggggctgctt

SEQ ID NO: 65565 - DNA, 201 bp, Homo sapiens
ctgcgacccccgggacagcgctgagaacacgcggaaggtggggagacgcgcggcgctggccgggtccctggcgccgttctcgcggtgcagcctgtgcctgsgagtccggccgtcccacctcagaaccagagcaaagcgggagatggggcggcggccgctggggagaaggcagccccgggtcggaggaggaaggaggcgggg

SEQ ID NO: 65566 - DNA, 201 bp, Homo sapiens; identical to SEQ ID NO: 5436

SEQ ID NO: 65567 - DNA, 201 bp, Homo sapiens; identical to SEQ ID NO: 29266

SEQ ID NO: 65568 - DNA, 201 bp, Homo sapiens; identical to SEQ ID NO: 29267

SEQ ID NO: 65569 - DNA, 201 bp, Homo sapiens; identical to SEQ ID NO: 29300

SEQ ID NO: 65570 - DNA, 201 bp, Homo sapiens; identical to SEQ ID NO: 29268

SEQ ID NO: 65571 - DNA, 201 bp, Homo sapiens; identical to SEQ ID NO: 29270

SEQ ID NO: 65572 - DNA, 201 bp, Homo sapiens; identical to SEQ ID NO: 29269

SEQ ID NO: 65573 - DNA, 201 bp, Homo sapiens; identical to SEQ ID NO: 29301

SEQ ID NO: 65574 - DNA, 201 bp, Homo sapiens
acaggcggccgccactacgcccagctaattttttgtatttttagtagagacggggtttcaccatgttagccaggatggtctcgatctcctgacctcgtgakccacccgtctcggcctctcaaagtgctgggatgacaggcgtgagccaccgcgtccggccacagttttttgaggcttatccgatttgccatcaggtcaaag

SEQ ID NO: 65575 - DNA, 201 bp, Homo sapiens; identical to SEQ ID NO: 29271

SEQ ID NO: 65576 - DNA, 201 bp, Homo sapiens; identical to SEQ ID NO: 29272

SEQ ID NO: 65577 - DNA, 201 bp, Homo sapiens; identical to SEQ ID NO: 29273

SEQ ID NO: 65578 - DNA, 201 bp, Homo sapiens; identical to SEQ ID NO: 29274

SEQ ID NO: 65579 - DNA, 201 bp, Homo sapiens; identical to SEQ ID NO: 29306

SEQ ID NO: 65580 - DNA, 201 bp, Homo sapiens; identical to SEQ ID NO: 29307

SEQ ID NO: 65581 - DNA, 201 bp, Homo sapiens; identical to SEQ ID NO: 29275

SEQ ID NO: 65582 - DNA, 201 bp, Homo sapiens; identical to SEQ ID NO: 29276

SEQ ID NO: 65583 - DNA, 201 bp, Homo sapiens
tcccagcactttgggaggcctaggcgggtggatcacgaggtcaggagatcgagaccatgaccatcctggctaacatggtgaaaccccgtctctactaaaamtacaaaaaaattagctgggtgtggtggtacacacctggagtcccaactacttgggaggctgaggcaggagaatcacttgagcctgggaggcggaggttgc

SEQ ID NO: 65584 - DNA, 201 bp, Homo sapiens; identical to SEQ ID NO: 20879

SEQ ID NO: 65585 - DNA, 201 bp, Homo sapiens; identical to SEQ ID NO: 20881

SEQ ID NO: 65586 - DNA, 201 bp, Homo sapiens; identical to SEQ ID NO: 20882

SEQ ID NO: 65587 - DNA, 201 bp, Homo sapiens; identical to SEQ ID NO: 20883

SEQ ID NO: 65588 - DNA, 201 bp, Homo sapiens; identical to SEQ ID NO: 20884

SEQ ID NO: 65589 - DNA, 201 bp, Homo sapiens; identical to SEQ ID NO: 20886

SEQ ID NO: 65590 - DNA, 201 bp, Homo sapiens
cccaaagtgctgggattacaggcgtgagccaccgcgcccggccaggagtctgtttctgtgttgctaggctgcccttcctggtcctgctagggagggctggstttggttggcagttccagcttctgcagggctaggtctagggcaagcagaaaagaaagccccgggctccccctgcactgtcccacagccgccctctgtcac

SEQ ID NO: 65591 - DNA, 201 bp, Homo sapiens
aactgaggtgggaagatcccttgagccaggaggtcgaggctgcatggagctttgatcgtaccactgccctccagcctgagcaacagagtgagaaaaaaaamagactttttttctatttctggaaaaaaataaagaatttataagtatgatggttctggtaatagaagtaggtggctaggcagagtggacacttcacactgc

SEQ ID NO: 65592 - DNA, 201 bp, Homo sapiens; identical to SEQ ID NO: 20891

SEQ ID NO: 65593 - DNA, 201 bp, Homo sapiens
cgcagacaacaccacgccccaggcctggcgagcgcaccctgcgggtggggcggacctacgtcagcaacccatcgtccgatcccgtccattggctgagaggkaatgcgtgcgcccgactcgccgctgattggtcggcgcgcgagcagccgggctcgcacgggccaatcctgtggtagcgcgtgaggaggcagaggcctctgg

SEQ ID NO: 65594 - DNA, 201 bp, Homo sapiens
cagccgaggctgcaggcctgcctgcgggagagtgagctggggtccccataagcccatccctccctgttgtcagcagggtccgagcatccagaaagtgcttytgcctctgtgcccctcctgaggcagcaggcggggtggctgggaaccagacatgcccgctgggccgccagctccagggcagtggcccacctcaatgaccag

SEQ ID NO: 65595 - DNA, 201 bp, Homo sapiens; identical to SEQ ID NO: 20895

SEQ ID NO: 65596 - DNA, 201 bp, Homo sapiens; identical to SEQ ID NO: 2238

SEQ ID NO: 65597 - DNA, 201 bp, Homo sapiens
tggccgggaggaggatgtggggcagccgaggctgcaggcctgcctgcgggagagtgagctggggtccccataagcccatccctccctgttgtcagcagggwccgagcatccagaaagtgcttctgcctctgtgcccctcctgaggcagcaggcggggtggctgggaaccagacatgcccgctgggccgccagctccagggc

SEQ ID NO: 65598 - DNA, 201 bp, Homo sapiens
tcctgtggggaagccaggtttctctactgactcttgtgtagaggagaagactaggcgtggtggctcatgcctgtaatcccagcactttgggaggccgaggygggaggatcacttgagcccaggagtttaagacaagcctgggcaacatagcaagaccctgtttctacaaaaaaacaaaaaaattaaaaaattggttgggtg

SEQ ID NO: 65599 - DNA, 201 bp, Homo sapiens
ggcctttccccccctgccctcagcagggctgaccttgctcgagtgggcagccatgaggctctctcagtagaaaggggtacctggctggcatcggtcctcartgctggcctctgaggtggccctgggtttccttttcagttaaaaaccaccacaacagccgtcatcagcaaggacttcaccgaggaccggatttggctgaat

SEQ ID NO: 65600 - DNA, 201 bp, Homo sapiens
agggcaggaggagggagaggagcagaaaagatggggggagggcaggaggagggagaggagcagaaaagatggggggagggcaggaggagggagaggagcakaaaagataactattgggtactgggcttagtacctgagtgatgaaataatctttacaacaaactcccgtgacatgtgtttatttatgtaacaaaccttcac

SEQ ID NO: 65601 - DNA, 201 bp, Homo sapiens
cgggtaagaaactctccacgaggagtctggcaggcagaggcctggtgttcagctgtgaccccgggcaggtgggcaggagcagggcgggcagggtgctgacrgctgggccacacgctgtctcattgtctctgcagtccgctgcctggcccggaagcggaggaactcacgggatggggacccgctgccctccagcctcagctg

SEQ ID NO: 65602 - DNA, 201 bp, Homo sapiens; identical to SEQ ID NO: 2245

SEQ ID NO: 65603 - DNA, 201 bp, Homo sapiens
caacaaactcccgtgacatgtgtttatttatgtaacaaaccttcacatgtacccccaaacctaaaataaaagttaaaaaaaagtatcaaattgttaactcytctggaataaacatttccttgtctttttttaatttaaattattatttttaaaatgcccatattccctgagtcctcgcttctttttacctctccaatcgcc

SEQ ID NO: 65604 - DNA, 201 bp, Homo sapiens
ccgggtaagaaactctccacgaggagtctggcaggcagaggcctggtgttcagctgtgaccccgggcaggtgggcaggagcagggcgggcagggtgctgayggctgggccacacgctgtctcattgtctctgcagtccgctgcctggcccggaagcggaggaactcacgggatggggacccgctgccctccagcctcagct

SEQ ID NO: 65605 - DNA, 201 bp, Homo sapiens
tgagtcctcgcttctttttacctctccaatcgcctggcttcatggtgtttcacatttgctgactgcttccagaaaaacattcccactgaaggcctcccaaygcaaggcagatatagagcaagctagacacatgccttcctttccagttgctttctgactttttaaagtcccagatgcctgggcttggggaaaggacaggaa

SEQ ID NO: 65606 - DNA, 201 bp, Homo sapiens; identical to SEQ ID NO: 20905

SEQ ID NO: 65607 - DNA, 201 bp, Homo sapiens
aatcaatagaggttatctaaaacttaaaaaaatagggccaggcacagtggctcacgcctgcaatcgcagcactttgggaggctgaggcgggcggatcacamggtcaggagatcgagaccatcctggctaacacagtgaaaccccgtctctactaaaaataacaaaaaaaagtagccggtcgtggtggtgggcgcctgtagt

SEQ ID NO: 65608 - DNA, 201 bp, Homo sapiens; identical to SEQ ID NO: 20906

SEQ ID NO: 65609 - DNA, 201 bp, Homo sapiens
gagtctgagaccagcctggccaaacatggcgaaaccccgtctctactaaaaatacaaaaatttgccgggcctgctggtgcacgcttgtaatcccagctacttgggaggctgaggcatgagaatcacttgaaaccaggaggcagaagttgcagtgagctatgattgcccccctgcactccagcctgggtgacacagcgagac

SEQ ID NO: 65610 - DNA, 201 bp, Homo sapiens; identical to SEQ ID NO: 20907

SEQ ID NO: 65611 - DNA, 201 bp, Homo sapiens
tgtctgctttcctccaagttgtacaggattgccttttatatttaagtctgtgatccaaggttgtccagttagcccagaaaggctatccttcctctattgarttgcttttgcacttttgtaaaaaaaaaaatcagctgggcatgtttgtgtgggtctatttctggattttctcttctgctattttttttttttttttttttt

SEQ ID NO: 65612 - DNA, 201 bp, Homo sapiens
acgtaggaaagcactgtttatagtaacaacccaactaggacagaccaggtatatttagacaacaaacaaggaagctttttactaaattgggatgatctctaagaagaaggtacgtagaaaaagcaaggtgggagaacacgctatgtgcttgtactatgcacgtcaatgaaaaaatacacaaagaattgacaggccaggtgg

SEQ ID NO: 65613 - DNA, 201 bp, Homo sapiens
cgtaggaaagcactgtttatagtaacaacccaactaggacagaccaggtatatttagacaacaaacaaggaagctttttactaaattgggatgatctctaagaagaaggtacgtagaaaaagcaaggtgggagaacacgctatgtgcttgtactatgcacgtcaatgaaaaaatacacaaagaattgacaggccaggtgga

SEQ ID NO: 65614 - DNA, 201 bp, Homo sapiens
atggtgaaacccccgtctctactgaaaaaaaataaaatatgtattctagatattagtctcctgttggacatgtggtttgcaggtattgtctcccaaactarctaatctttttgtcctcttaacaaagagccagtttttcattttaaagaagttcagtgtatcaatgttgatgtcaagtctaagacctctttgcttagccct

SEQ ID NO: 65615 - DNA, 201 bp, Homo sapiens; identical to SEQ ID NO: 2225

SEQ ID NO: 65616 - DNA, 201 bp, Homo sapiens
gtaggaaagcactgtttatagtaacaacccaactaggacagaccaggtatatttagacaacaaacaaggaagctttttactaaattgggatgatctctaagaagaaggtacgtagaaaaagcaaggtgggagaacacgctatgtgcttgtactatgcacgtcaatgaaaaaatacacaaagaattgacaggccaggtggag

SEQ ID NO: 65617 - DNA, 201 bp, Homo sapiens
catctaacgttttctttctttctttcttttctttccagaagccgccaccacgactggctaatttttttgtgtttcccttaccaataaagctgccataaaaygttgtatacaggtttttgtgtgaacatacatttccattcttctgggataaatgcccaggagtgcggttgctgggtcagatggtagatatatatatatgcc

SEQ ID NO: 65618 - DNA, 201 bp, Homo sapiens; identical to SEQ ID NO: 2227

SEQ ID NO: 65619 - DNA, 201 bp, Homo sapiens
cgtccgatcccgtccattggctgagaggtaatgcgtgcgcccgactcgccgctgattggtcggcgcgcgagcagccgggctcgcacgggccaatcctgtgrtagcgcgtgaggaggcagaggcctctggggtgggatcgcgggccgtaagtggctgtggagctggggtcactgcgcggtgggaccatggcctcggagaagc

SEQ ID NO: 65620 - DNA, 201 bp, Homo sapiens; identical to SEQ ID NO: 20918

SEQ ID NO: 65621 - DNA, 201 bp, Homo sapiens; identical to SEQ ID NO: 20919

SEQ ID NO: 65622 - DNA, 201 bp, Homo sapiens; identical to SEQ ID NO: 2233

SEQ ID NO: 65623 - DNA, 201 bp, Homo sapiens; identical to SEQ ID NO: 2234

SEQ ID NO: 65624 - DNA, 201 bp, Homo sapiens; identical to SEQ ID NO: 2235

SEQ ID NO: 65625 - DNA, 201 bp, Homo sapiens; identical to SEQ ID NO: 20928

SEQ ID NO: 65626 - DNA, 201 bp, Homo sapiens; identical to SEQ ID NO: 20930

SEQ ID NO: 65627 - DNA, 201 bp, Homo sapiens; identical to SEQ ID NO: 20934

SEQ ID NO: 65628 - DNA, 201 bp, Homo sapiens
tttctatttctggaaaaaaataaagaatttataagtatgatggttctggtaatagaagtaggtggctaggcagagtggacacttcacactgcatactcccmtattttccgaaatctgagctttttttttttttttttttttttttttttttttgagatggagtcttgctctgtcaccctggctggagtacagcagcaccat

SEQ ID NO: 65629 - DNA, 201 bp, Homo sapiens
caggcgcctgggcacacggcgcctgcgcagacaacaccacgccccaggcctggcgagcgcaccctgcgggtggggcggacctacgtcagcaacccatcgtmcgatcccgtccattggctgagaggtaatgcgtgcgcccgactcgccgctgattggtcggcgcgcgagcagccgggctcgcacgggccaatcctgtggtag

SEQ ID NO: 65630 - DNA, 201 bp, Homo sapiens
cctggggaggtgaaagtccccactccttcagggagggaaagggggcggggcactgttccagcctggagtgtgggagggatctgtttctttttttcttttctttttttttttttttgagaaagggtctccctctgttgccaggctggagtaaggctggagtgcagtggtgccatctcggctcagtgcaacctccgcctccca

SEQ ID NO: 65631 - DNA, 201 bp, Homo sapiens
aagggtctccctctgttgccaggctggagtaaggctggagtgcagtggtgccatctcggctcagtgcaacctccgcctcccaggttcaagcgattttccckcctcagcctcctgagtagctgggataacaggcgtgcgtcactacagcctggctaatttttgtatttttagtagagatggggtttcaccatattggtcagg

SEQ ID NO: 65632 - DNA, 201 bp, Homo sapiens; identical to SEQ ID NO: 2226

SEQ ID NO: 65633 - DNA, 201 bp, Homo sapiens
gcctgcgcagacaacaccacgccccaggcctggcgagcgcaccctgcgggtggggcggacctacgtcagcaacccatcgtccgatcccgtccattggctgrgaggtaatgcgtgcgcccgactcgccgctgattggtcggcgcgcgagcagccgggctcgcacgggccaatcctgtggtagcgcgtgaggaggcagaggcc

SEQ ID NO: 65634 - DNA, 201 bp, Homo sapiens
ccgtggtggtgcgcgtttgtggctccagctactcgggaggctgaggcgggaggatggccagagcccgggaggtcgaggctgcagtgagcggaaatcgcgcyactgctcccccagcccgagaccctgtgtccctccctcgccccgtttctcccagcggtaacctccaaggagcggtaatggggggcccgcaggcccacatcc

SEQ ID NO: 65635 - DNA, 201 bp, Homo sapiens; identical to SEQ ID NO: 20949

SEQ ID NO: 65636 - DNA, 201 bp, Homo sapiens
ctggctggagtacagcagcaccatctcggctcactgcaacttccgcctcctgagttcaagcaattgtcctgcctcagcctccccagtagctgggattacasgcgtgcaccacacgcccacctaattattgtatttttagtagagacagggtttcaccatgttggccaggctggtctcaaactcctgacctcgtgatccgcc

SEQ ID NO: 65637 - DNA, 201 bp, Homo sapiens
cccatcgtccgatcccgtccattggctgagaggtaatgcgtgcgcccgactcgccgctgattggtcggcgcgcgagcagccgggctcgcacgggccaatcstgtggtagcgcgtgaggaggcagaggcctctggggtgggatcgcgggccgtaagtggctgtggagctggggtcactgcgcggtgggaccatggcctcgga

SEQ ID NO: 65638 - DNA, 201 bp, Homo sapiens
catagcaagaccctgtttctacaaaaaaacaaaaaaattaaaaaattggttgggtgtggtggctaagtctgtaatcgcagtacttcaggaggccaaggcargaggagtgcttgagcataggaggccaagtctgcagtgagccgtgaccttgccagtgcattcagtctgggcaacagagtgagaccctgtctcaaaacaaac

SEQ ID NO: 65639 - DNA, 201 bp, Homo sapiens
aagaccctgtttctacaaaaaaacaaaaaaattaaaaaattggttgggtgtggtggctaagtctgtaatcgcagtacttcaggaggccaaggcaggaggaktgcttgagcataggaggccaagtctgcagtgagccgtgaccttgccagtgcattcagtctgggcaacagagtgagaccctgtctcaaaacaaacaaatga

SEQ ID NO: 65640 - DNA, 201 bp, Homo sapiens
cgcacagcgcctcaaggtctccgcacagcccccagcacagcgcctcacacagcccttcgcacagccccccgcacagctcctcacgggccccacacagctgycgcacagccccgcacaagcccgcacagcaccagcagacaggtagcccccacaggcaacagcgcccacctcgccgcgcccagaccccggatcgccgacgcg

SEQ ID NO: 65641 - DNA, 201 bp, Homo sapiens; identical to SEQ ID NO: 2237

SEQ ID NO: 65642 - DNA, 201 bp, Homo sapiens
cccacacagctgtcgcacagccccgcacaagcccgcacagcaccagcagacaggtagcccccacaggcaacagcgcccacctcgccgcgcccagaccccgratcgccgacgcggacgccaggcgcctgggcacacggcgcctgcgcagacaacaccacgccccaggcctggcgagcgcaccctgcgggtggggcggaccta

SEQ ID NO: 65643 - DNA, 201 bp, Homo sapiens; identical to SEQ ID NO: 20967

SEQ ID NO: 65644 - DNA, 201 bp, Homo sapiens
ccgcacagcgccccacggccccttcatggtccccgcacagcgcctcacaacccgcacacagcgcctcacggaccctttacggcccccgcagagtctcccayacggcgccccacacagagcctcacggaccccgcacagcgcctcaaggtctccgcacagcccccagcacagcgcctcacacagcccttcgcacagcccccc

SEQ ID NO: 65645 - DNA, 201 bp, Homo sapiens; identical to SEQ ID NO: 2240

SEQ ID NO: 65646 - DNA, 201 bp, Homo sapiens; identical to SEQ ID NO: 20971

SEQ ID NO: 65647 - DNA, 201 bp, Homo sapiens; identical to SEQ ID NO: 20972

SEQ ID NO: 65648 - DNA, 201 bp, Homo sapiens; identical to SEQ ID NO: 20973

SEQ ID NO: 65649 - DNA, 201 bp, Homo sapiens
gtaatcgcagtacttcaggaggccaaggcaggaggagtgcttgagcataggaggccaagtctgcagtgagccgtgaccttgccagtgcattcagtctgggyaacagagtgagaccctgtctcaaaacaaacaaatgaaaaataaaaagtaagtatctaacgcaggaataggaaatcaaatactgcatcttctcacttataa

SEQ ID NO: 65650 - DNA, 201 bp, Homo sapiens
ccgtgaccttgccagtgcattcagtctgggcaacagagtgagaccctgtctcaaaacaaacaaatgaaaaataaaaagtaagtatctaacgcaggaatagraaatcaaatactgcatcttctcacttataagtgggagctaaatgataagaatttatgaacacaaggaaataacagacacgggggtccacttgagggggga

SEQ ID NO: 65651 - DNA, 201 bp, Homo sapiens
ataaaaagtaagtatctaacgcaggaataggaaatcaaatactgcatcttctcacttataagtgggagctaaatgataagaatttatgaacacaaggaaayaacagacacgggggtccacttgaggggggagggcaggaggagggagaggagcagaaaagatggggggagggcaggaggagggagaggagcagaaaagatg

SEQ ID NO: 65652 - DNA, 201 bp, Homo sapiens
agcagaaaagatggggggagggcaggaggagggagaggagcagaaaagatggggggagggcaggaggagggagaggagcagaaaagatggggggagggcargaggagggagaggagcagaaaagatggggggagggcaggaggagggagaggagcataaaagataactattgggtactgggcttagtacctgagtgatgaa

SEQ ID NO: 65653 - DNA, 201 bp, Homo sapiens
cagaaaagatggggggagggcaggaggagggagaggagcagaaaagatggggggagggcaggaggagggagaggagcagaaaagatggggggagggcaggwggagggagaggagcagaaaagatggggggagggcaggaggagggagaggagcataaaagataactattgggtactgggcttagtacctgagtgatgaaat

SEQ ID NO: 65654 - DNA, 201 bp, Homo sapiens
tctgctggcctgtccaggccaaacccccagggctgcaggcctggaaccaggcaggacatgctcagccctggctgggcttcccctccttgccccaacaccaktcagggcccacccacgggctccagctgtctggcttcccattcatctcccagaccctctcccctcatgaatcagtgccacacacagcctacccataccata

SEQ ID NO: 65655 - DNA, 201 bp, Homo sapiens
tctctagtagctgggagtacaggtgtgcaccactacggccagctaattttgaaaaaatttttttgtaggctggatgcggtggctcatgtctgtaatcccakcactttgggaggcctaggcgggtggatcacgaggtcaggagatcgagaccatgaccatcctggctaacatggtgaaaccccgtctctactaaaaatacaa

SEQ ID NO: 65656 - DNA, 201 bp, Homo sapiens
tgtggtggtacacacctggagtcccaactacttgggaggctgaggcaggagaatcacttgagcctgggaggcggaggttgcagtgagcctgggaggcggasgttgcagtgagcctgggaggcggaggttgcagtgagccgagattgcaccactgcactccagcctgggcaatggaacaagactgtgtcttaaaaaaaaaaa

SEQ ID NO: 65657 - DNA, 201 bp, Homo sapiens
gggaggctgaggcaggagaatggcgtgaacgtgggaggcggaggttgcagtgagccgagatcacgccactgcactccagcctgggtgacagaccgagactytgtctcaaaaaaaaaaaaataataataataataaaaacgccaggcatggtggctcacgcctgtaatcccagtgctttgggaggccgaggcaggcgtatca

SEQ ID NO: 65658 - DNA, 201 bp, Homo sapiens
cactccagcctgggtgacagaccgagactctgtctcaaaaaaaaaaaaataataataataataaaaacgccaggcatggtggctcacgcctgtaatcccartgctttgggaggccgaggcaggcgtatcacttgaggcaaggagtctgagaccagcctggccaaacatggcgaaaccccgtctctactaaaaatacaaaaa

SEQ ID NO: 65659 - DNA, 201 bp, Homo sapiens
ggggtatttgagacgcccaccttaatgcaggttggacccagctccgggctgccgggcttccccgccccggggtctttcgtgtgagccccgtggcgggggaycctggcccaggacatggcgcggagaaggctgtgggcggcgggacagggtgccttcggctgccgggttaagagtggatcccgggatacatcctccagcgcc

SEQ ID NO: 65660 - DNA, 201 bp, Homo sapiens
caagcgccgcaacccagtccaaggctttgctcctacagggccttacagggggtatttgagacgcccaccttaatgcaggttggacccagctccgggctgcsgggcttccccgccccggggtctttcgtgtgagccccgtggcgggggaccctggcccaggacatggcgcggagaaggctgtgggcggcgggacagggtgcc

SEQ ID NO: 65661 - DNA, 201 bp, Homo sapiens; identical to SEQ ID NO: 20986

SEQ ID NO: 65662 - DNA, 201 bp, Homo sapiens; identical to SEQ ID NO: 20987

SEQ ID NO: 65663 - DNA, 201 bp, Homo sapiens; identical to SEQ ID NO: 20876

SEQ ID NO: 65664 - DNA, 201 bp, Homo sapiens
ctcccccagcccgagaccctgtgtccctccctcgccccgtttctcccagcggtaacctccaaggagcggtaatggggggcccgcaggcccacatccgtgcsggggaggccggtccgcacctgtgcgttcacagccccgcccctcccctcgcgccggggttacctggccgccactgaccactcatttctgtaacgtcatttc

SEQ ID NO: 65665 - DNA, 201 bp, Homo sapiens
cacagctgtcgcacagccccgcacaagcccgcacagcaccagcagacaggtagcccccacaggcaacagcgcccacctcgccgcgcccagaccccggatcrccgacgcggacgccaggcgcctgggcacacggcgcctgcgcagacaacaccacgccccaggcctggcgagcgcaccctgcgggtggggcggacctacgtc

SEQ ID NO: 65666 - DNA, 201 bp, Homo sapiens; identical to SEQ ID NO: 20887

SEQ ID NO: 65667 - DNA, 201 bp, Homo sapiens
tcccagcacttggggaggctgaggtgggcggatcacctgaggtcaggagtttgagaccagcttggccaacatggtgaaacccccgtctctactgaaaaaawataaaatatgtattctagatattagtctcctgttggacatgtggtttgcaggtattgtctcccaaactaactaatctttttgtcctcttaacaaagagcc

SEQ ID NO: 65668 - DNA, 201 bp, Homo sapiens; identical to SEQ ID NO: 20889

SEQ ID NO: 65669 - DNA, 201 bp, Homo sapiens
atggggtttcaccgtgttagccaggctggtctgaagctcctgacctcgtgatctgcccacctcagcctcccaaagtgctgggattacaggtgtgagccacsgcgtctggccttttatttttattttttatatttatttattttatatttatatttttatatttatttgtattacttttatatttatttttttgagacagac

SEQ ID NO: 65670 - DNA, 201 bp, Homo sapiens
ggtcttctttaaaccttacgtttgagctggtttttgatagcgcgctggtggaggagggggtgctggctcaagataaggaggcagaagtccaggttcccctycccaccaacgctgtcccatccccaccaggccctcaggaattcctgagtgtctgcttggcctctgacaagagccggcaggtcaggggagtccagtctcccg

SEQ ID NO: 65671 - DNA, 201 bp, Homo sapiens
ccccaggcctccctggcctctctggagttgttcagtctcttcccagagcacatctgaacattttcatcttccagttgcagctggcgtggggctctcgcctrtaatcccagtacttaagaggctgatgggggagaagcactgtaggccaggagttcaagaccagcctgggcaacatagtgagacccccccccatctctacaa

SEQ ID NO: 65672 - DNA, 201 bp, Homo sapiens; identical to SEQ ID NO: 20892

SEQ ID NO: 65673 - DNA, 201 bp, Homo sapiens; identical to SEQ ID NO: 2243

SEQ ID NO: 65674 - DNA, 201 bp, Homo sapiens; identical to SEQ ID NO: 20903

SEQ ID NO: 65675 - DNA, 201 bp, Homo sapiens
tccttttcagttaaaaaccaccacaacagccgtcatcagcaaggacttcaccgaggaccggatttggctgaatggccgggaggaggatgtggggcagccgmggctgcaggcctgcctgcgggagagtgagctggggtccccataagcccatccctccctgttgtcagcagggtccgagcatccagaaagtgcttctgcctc

SEQ ID NO: 65676 - DNA, 201 bp, Homo sapiens
cctcaaggtctccgcacagcccccagcacagcgcctcacacagcccttcgcacagccccccgcacagctcctcacgggccccacacagctgtcgcacagcsccgcacaagcccgcacagcaccagcagacaggtagcccccacaggcaacagcgcccacctcgccgcgcccagaccccggatcgccgacgcggacgccagg

SEQ ID NO: 65677 - DNA, 201 bp, Homo sapiens
cctcgccgcgcccagaccccggatcgccgacgcggacgccaggcgcctgggcacacggcgcctgcgcagacaacaccacgccccaggcctggcgagcgcaycctgcgggtggggcggacctacgtcagcaacccatcgtccgatcccgtccattggctgagaggtaatgcgtgcgcccgactcgccgctgattggtcggcg

SEQ ID NO: 65678 - DNA, 201 bp, Homo sapiens; identical to SEQ ID NO: 20909

SEQ ID NO: 65679 - DNA, 201 bp, Homo sapiens; identical to SEQ ID NO: 2228

SEQ ID NO: 65680 - DNA, 201 bp, Homo sapiens; identical to SEQ ID NO: 2229

SEQ ID NO: 65681 - DNA, 201 bp, Homo sapiens
tgttcctggggcatatgagcagtgagatgtgaggagttctcagagctgggctccttttgtttgggaaggtggaggggaggcaggccgcggtgggagcgatscgcacctgggcactcacggatgctggagtagaagcgatgaaggaatggggagcggggacggaggttggctggcctccagctctgctctgggagcctgagc

SEQ ID NO: 65682 - DNA, 201 bp, Homo sapiens
ttacctaaaggctaggatgagatggcctagcgacgactcccagccagcacgcagtgtctgttccatctcccagtattaggagagctgagcacagcacacaygtgcccccaggtctcgtcacacatgcgcacaccgtgccccaggggctcccctgggagtccccgtctctttattcaggataaggcctggttgctccacaag

SEQ ID NO: 65683 - DNA, 201 bp, Homo sapiens
gcttcaaggagggcacagcgcgacccgccctcccctcagccccgcacaccgtcccacggccccgcacagcctccctcccacacagcgccccacggcacccrcacagcgccccacggcacccgcacagcgccccacggccccttcatggtccccgcacagcgcctcacaacccgcacacagcgcctcacggaccctttacgg

SEQ ID NO: 65684 - DNA, 201 bp, Homo sapiens; identical to SEQ ID NO: 20931

SEQ ID NO: 65685 - DNA, 201 bp, Homo sapiens; identical to SEQ ID NO: 20936

SEQ ID NO: 65686 - DNA, 201 bp, Homo sapiens; identical to SEQ ID NO: 20937

SEQ ID NO: 65687 - DNA, 201 bp, Homo sapiens; identical to SEQ ID NO: 2222

SEQ ID NO: 65688 - DNA, 201 bp, Homo sapiens; identical to SEQ ID NO: 2223

SEQ ID NO: 65689 - DNA, 201 bp, Homo sapiens; identical to SEQ ID NO: 20941

SEQ ID NO: 65690 - DNA, 201 bp, Homo sapiens; identical to SEQ ID NO: 20944

SEQ ID NO: 65691 - DNA, 201 bp, Homo sapiens; identical to SEQ ID NO: 20945
